United States Patent 8,952,217 (PROCESS FOR DECREASING VERBASCOSE IN A PLANT BY EXPRESSION OF A CHLOROPLAST-TARGETED FIMD PROTEIN) - sequence listing, part 9

SEQ ID NO: 36539 - protein, 701 aa, Acinetobacter sp. ADP1
MDKIQRKSTLSSKLGWSIVAIIGAVSFGILAVSRGEHVNAVWLVLAAICVYSIAYRFYSLFIATKVFELNSRRLTPAHRLADGLDYVPTNKYVLFGHHFAAIAGAGPLVGPILAAQMGYLPGTIWLLVGVVLAGAVQDFLVLFISTRRDGRSLGEMAKQELGSFAGIVVMLGALGVMVIILAVLALVVVKALAHSPWGVFSIAATIPIALFMGVYMRYLRPGKIAEVSIIGFVLMMLAIVYGGHIAADPYWGPFFTLTGTQLTWCLIIYGFIASVLPVWLLLAPRDYLSTFLKIGVIAGLAIGIMVALPELKMPAVTHFIDGTGPVFSGSLFPFLFITIACGAISGFHALVSSGTTPKLVDNEVNIRMIGYGGMLMESFVAIMAMICATVLDPGVYFAINAPAAVLGTSVETAAEAVRNLGFVVTPEALTLLAQEVGESTILSRTGGAPTFAIGMAHIISEIFNNRSMMAFWYHFAILFEALFILTAVDAGTRACRFMVQDTVGIVVPAIKKSGSFVGNIIGTAVAVGGWGFFVYQGVVDPLGGINSLWPLFGVGNQMLAAMALILGTVILFKMKKEKYVWVTIIPTIFLLVTCMTAGWQKIFHENPKIGFLAQANRFSDAIARGEILKPAKTLAEMQTVVLSNQINAVLCGFFMIVAIVMVIASFGVVRRALASKVPTVNEAPAIYEDPEIVVSPSSQGK

SEQ ID NO: 36540 - DNA, 2154 bp, Erwinia carotovora subsp. atroseptica SCRI1043
  CDS (1)..(2154): transl_table=11
atgaagagcaattccattcttaaacacatcccctggatgattcttggaatcattggggctgcctgcctcggcgtagtcgcactacgtcgcggtgagcatgtcagtgccttatggattattgttgcttctgtcgccgtttacctcgtggcctatcgatactacagcctgtatatcgcacaaaaagtcatgcagttggatccgaccagagcaacccccgccgttgtcaataacgacggtcttaactatgtaccgacgaaccgtaacgttctgttcgggcaccactttgctgctatcgcaggtgcggggccgctggttgggccggtactggccgcgcaggtcggctacctgccgggcaccttatggttgctgggcggcgtggtgctggcgggtgccgtgcaggacttcatggtgctgtttatttcgacccgccgtaacggtgcgtcgttaggcgaaatcgttaagaaagaactcggcccagtaccgggtacgattgcgctgttcggctgcttccttatcatgatcatcattcttgccgtactggcgctgattgtggtgaaagcgctggcagaaagtccgtggggcgtctttaccgtttgttctacggtaccgatcgcgctctttatgggcgtctacatgcgctttatccgtccgggtaaagtcggtgaaatttcggtgatggggatcgtgctgctggtgctggcgatctggtttggtggcgtagtggcacatgacccgtactggggtccggcgctgaccttcaaagatacgaccattacttatacgctgattggctatgccttcgtgtctgcactgctgccagtatggttgattctggctccgcgtgactatctggcgaccttcctgaaaatcggtgtgatcgtcggtctggcgattggtattgtgatacttaatcccgatctgaaaatgccagcgataacgcagtttgtggatggcaccggtccggtctggaaaggtacgctgttcccattcctgtttattactatcgcctgtggtgcggtgtctggcttccacgcattgattgcttccggtactacgccgaaattgatggctaacgaaaaagatgcacggttcatcggttacggtgcaatgttgatggaatctttcgtggcgatcatggctttggttgcggcgtctatcatcgaaccgggtctctactttgcgatgaataccccgccagcggcgttgggtattacgatgccggatctgcatcgactgggcactgcggatgcgccgatgattttggcacagttacaagatgtatctgcacacgcggcagcaaccgtcagctcctggggcttcgtaatttctcctgagcagattatgcaaacggcgaaagacatcggtgaaccttccgttcttaaccgcgcaggtggtgcaccaacgctggctgtcggcattgcacacgtgttccaccagatcattcctggcgccaatatgggcttctggtatcacttcggtattctgtttgaagcgctgtttattctgacagctctggatgcgggtacgcgtgctggtcgcttcatgttgcaggatctgttgggtaacttcgttcctttcctgaagaaaacggattcgctgattgctggtatgatcggtacggcgggttgtgtcggtctgtggggctacctgctgtatcaaggtgtggttgatccgctgggcggcgtgaagagcctgtggccgctgttcggtatctctaaccagatgctggctgcggtggcgctggtactgggtaccgtcatcctgattaagatgaaacgtacacagtacatttgggtcacattggttccggcggtttggctgctgatctgtaccacttgggcgctgggtctgaaactgttcagcgacaacccacagttggaaggcttcttctacatggcgaacatgttcaagggcaaaattgcagaaggcggtgccgatctgagcgcgcagcagatttcgaacatgaaccatatcgtgaccaacaactataccaacgccggtctgagcattctgttcctgatcgtggtgtacagcatcatagcgtacggtattaaagcggcattggctgcacgtaaagtggctgaacgtaccgatcaggaaacgccgtatgttccggttcctgaaggtggcgtgaaactctcttccggtcactaa

SEQ ID NO: 36541 - protein, 717 aa, Erwinia carotovora subsp. atroseptica SCRI1043
MKSNSILKHIPWMILGIIGAACLGVVALRRGEHVSALWIIVASVAVYLVAYRYYSLYIAQKVMQLDPTRATPAVVNNDGLNYVPTNRNVLFGHHFAAIAGAGPLVGPVLAAQVGYLPGTLWLLGGVVLAGAVQDFMVLFISTRRNGASLGEIVKKELGPVPGTIALFGCFLIMIIILAVLALIVVKALAESPWGVFTVCSTVPIALFMGVYMRFIRPGKVGEISVMGIVLLVLAIWFGGVVAHDPYWGPALTFKDTTITYTLIGYAFVSALLPVWLILAPRDYLATFLKIGVIVGLAIGIVILNPDLKMPAITQFVDGTGPVWKGTLFPFLFITIACGAVSGFHALIASGTTPKLMANEKDARFIGYGAMLMESFVAIMALVAASIIEPGLYFAMNTPPAALGITMPDLHRLGTADAPMILAQLQDVSAHAAATVSSWGFVISPEQIMQTAKDIGEPSVLNRAGGAPTLAVGIAHVFHQIIPGANMGFWYHFGILFEALFILTALDAGTRAGRFMLQDLLGNFVPFLKKTDSLIAGMIGTAGCVGLWGYLLYQGVVDPLGGVKSLWPLFGISNQMLAAVALVLGTVILIKMKRTQYIWVTLVPAVWLLICTTWALGLKLFSDNPQLEGFFYMANMFKGKIAEGGADLSAQQISNMNHIVTNNYTNAGLSILFLIVVYSIIAYGIKAALAARKVAERTDQETPYVPVPEGGVKLSSGH

SEQ ID NO: 36542 - DNA, 2064 bp, Erwinia carotovora subsp. atroseptica SCRI1043
  CDS (1)..(2064): transl_table=11
atgagtaacataaagagcattgtgatctggctgctagtcggactggcgggcgctttttcgttcgctatgctggcgctaagccgaggtgagcacgtcaatgcggtatggttggttatcgccgcagtatcgtgttacagcatcgcttatcggttttacagcctgtttatcgccaaaaaagtgtttgagctcgacgatcgccgactaacaccggctgaacgtcataacgacggcctagattacgttcccaccaataaatgggtactgttcggacaccacttcgccgctatcgctggggcaggtccgctggttgggccgattctcgccgcacagatgggttttcttcccggcacaatctggattttggtcggcgtgatgctggcgggtgccgtgcaggattttctggtgctgtttatctccacacgtcgtgacggtcgttcgctgggggaaatggcaaaacaggaactgggcacgttcgcgggtattatcaccatgctcggcgcgctgggcgtcatgatcatcattctttcggcgctggcactggttgtcgttaaagcgctggcggaaagcccgtgggggttgtttacgatcgccgccaccatccccatcgcgctcttcatgggcatttacatgcgctttttacgtccaggtaaaatcgctgaagtgtccatcatcggctttgtgctaatgatgctggcgattgtctacggcggcaacatcgccgcacacccatactggggcccattcttcacgctgaaaggcacatcgctcacctgggtgctggttatctacggcttcgtggcgtcagtcctgcccgtctggctgctgctggcaccgcgtgattacctctctacgttcctgaaaattggggttattatcgggctggccttcggtatcgtgttcgccatgccggaaatgaaaatgcccgctgtttctcgctttattgatggcagcggccccgtattctcaggttctctgttccccttcttatttattaccatcgcctgcggcgcgatttccggcttccacgccctcgtttccagcggcactacgccgaagttaatcgagcgtgagagccatatccgttttatcggatatggtgccatgttgatggagtccttcgtggcaatcatggcgctgatttgtgcatcggtcatcgagccgggcatttactttgccatgaactcacccgccgcactgatcggcaccacggttgagagcgcctcgctggccattaacaactgggggtttgtgattaccccgcaggaattgagtgccattgccaatgatgtcggcgaaatctctattctttcccgtgctggcggcgcgccaaccttcgcggtgggcatggcctatatcatcacggaaatctttaatagccgggcgatgatggcattctggtatcacttcgcgattctgtttgaagccctgttcattctgaccgccgttgatgccgggacgcgcgcctgtcgcttcatggtgcaagatctggtcggtattgcgattccaagattagctaacagccgttcctggatggggaatttggccggtacgaccgttgccgtttctggctggggattcttcgtatatcaaggtgtaatcgacccgttgggaggtattaacacgctctggccactgttcggtatcggtaaccagatgctcgcatcgatggcgctgattctcggcaccgtggtgttgtttaagatgaagaaacagcgctatgcgtgggtgactatcgtaccgaccgtctggctgtttattacgtcgatgacggcgggttggcaaaaaatcttccatgaaaaaccgagcatcggctttctggctcaagcgaaacgcttcgctgcgggtattgaacagaacacgctgatcgcaccggctaaatcgattaaagacatggaaaccatcgtcttcagtaaccagatcaacgccgcactgtgcgggttcttcatgctggtggcagtgacgatgctggtttccgcgttcttcgtcattcgtcgtgcactcaacagcaatgtgccaacgacaaaagagacgccgattgtcttacgggacggcgctcagccttaa

SEQ ID NO: 36543 - protein, 687 aa, Erwinia carotovora subsp. atroseptica SCRI1043
MSNIKSIVIWLLVGLAGAFSFAMLALSRGEHVNAVWLVIAAVSCYSIAYRFYSLFIAKKVFELDDRRLTPAERHNDGLDYVPTNKWVLFGHHFAAIAGAGPLVGPILAAQMGFLPGTIWILVGVMLAGAVQDFLVLFISTRRDGRSLGEMAKQELGTFAGIITMLGALGVMIIILSALALVVVKALAESPWGLFTIAATIPIALFMGIYMRFLRPGKIAEVSIIGFVLMMLAIVYGGNIAAHPYWGPFFTLKGTSLTWVLVIYGFVASVLPVWLLLAPRDYLSTFLKIGVIIGLAFGIVFAMPEMKMPAVSRFIDGSGPVFSGSLFPFLFITIACGAISGFHALVSSGTTPKLIERESHIRFIGYGAMLMESFVAIMALICASVIEPGIYFAMNSPAALIGTTVESASLAINNWGFVITPQELSAIANDVGEISILSRAGGAPTFAVGMAYIITEIFNSRAMMAFWYHFAILFEALFILTAVDAGTRACRFMVQDLVGIAIPRLANSRSWMGNLAGTTVAVSGWGFFVYQGVIDPLGGINTLWPLFGIGNQMLASMALILGTVVLFKMKKQRYAWVTIVPTVWLFITSMTAGWQKIFHEKPSIGFLAQAKRFAAGIEQNTLIAPAKSIKDMETIVFSNQINAALCGFFMLVAVTMLVSAFFVIRRALNSNVPTTKETPIVLRDGAQP

SEQ ID NO: 36544 - DNA, 2286 bp, Propionibacterium acnes KPA171202
  CDS (1)..(2286): transl_table=11
gtggacactgtcccaccccgtacgtacaacaactcaaacttccccgaaggtctgcccgccgtcagcctgtcggacgaggagcgagcccgtcagcaacgatggacaccgctgcgcgtgacgatctggatcctcatctccgctatcgccgggctgggctggtggatgctcgccgtacgacgcggcgaaacggtcaacggcatctggttcgtcttcgcggccatcggttcgtatttcatcggctaccggttctacgccaagtacattcaggacaagctcgtccatcccgacgacagccgggctacccccgccgagtatgactacaatggacgagatttcgtccccacggatcgccgcatcctctacggccaccacttcgccgccatcgctggtgccggccccctcgtcggcccggtactctcagctcagatgggctatctcccaagcacgatctggatcatcgtcggcgtcatcttggcaggagccgtccaggattaccttgttctcgtcatctcgatgagacgcggtggacggtccctcggacagatggccagagaggaattggggcgcttcggaggcatcgcggcgctcatcgccactctcacgatcatgctcatcatcgtggccatcctggctatggtcgtcgtcaactccctggccgcctcctcatggggtgtgtggagcgtcggactgactatccccatcgccctgctcatgggcttctacctgcgttatctgcgccctggcaaagtatttgaggtctcgatcatcggcatcgtcctgctcgtgctggccattgcctcgggggcctggatcgagaacactgccgttgccagtgctctccacttgagcaagccgtttttggcctgggccatcatcatttacggattcatcgccgcagtactccccgtatggatgctgctggctccccgtgactacttgtctaccttcatgaaggtcggcgtgatcgcgatgttggcgatctcgatcgtcatcgtccgcccggtcatcaacgtgccagcaatgacggtctatgccaccaacggtgcgggccccgtgttctccggaaaactcttccccttcctcttcgtaactatcgcgtgtggagcgctatcgggattccacgccacgatctcctctggaaccaccccaaagctcatcgaaaaggaatcccaggcacgtctcatcggctacggcggcatgctcatggagtccttcgtagcaatcatggctctggtggccgccctgtcggtggaccggggcatttacttcgctatgaattccccagccggtgcgacgggcaataccgtcaagtccgccatcgcttacgtcaattctttgggcttgtcgggtgtgcacgccaacgctaacactctcacgacgacagccaagctcgtcggcgaaacatcgatcgtcagtcgaaccggtggcgcccccaccctggctgttggtctagcgacgatcatgcacaagatctttggtggcgaggccatgatgagcttctggtaccacttcgcgatcatgttcgaggccctgttcatcctcacctcggtcgacgctggcacccgcgtcgcccggttcatgctctccgatgcgctgggtaacttctggccgcgcctcaaggaccactcgtggaaggttggctcctggctgactaccgcgatcatggtggctggctggggctcgattctgctcatgggcgtcaccgacccgttggggggcatcaacactctcttcccgctcttcggcattgccaaccagctgctggcagctgtcgccctgtcgatctgcttggtgatcttcgcccgggctggtcacacgtggcggctgctcatcatcttcgtaccgatgctcttcaccgccattatcacggtttacgggtcctggttgaagatcttctcccccgacccgaagctcggttactgggccaatcacatgacctacaagcgggccatcgctgacggcaagacctcgctggggcaagccaagaacattgacgaaatgcacaccgtcgtcggcaacaccgccattcaaggaacgatgtcgatcatcttcgtcgtctgcgccctcatcgtcatgatcgtggcctgtatccgcactgttcaggcgctgcgtggtcgcaacatcatcgacaccgaagacccagccaagccgtccaaaatcttcgctcccagtggtctcatgcccaccaaggctgagagggatctgcaggttgagtgggacgccttctacgaggagcaccctgagcttgacctggaaagtgtccacaaggacaaggagcacgcgtga

SEQ ID NO: 36545 - protein, 761 aa, Propionibacterium acnes KPA171202
MDTVPPRTYNNSNFPEGLPAVSLSDEERARQQRWTPLRVTIWILISAIAGLGWWMLAVRRGETVNGIWFVFAAIGSYFIGYRFYAKYIQDKLVHPDDSRATPAEYDYNGRDFVPTDRRILYGHHFAAIAGAGPLVGPVLSAQMGYLPSTIWIIVGVILAGAVQDYLVLVISMRRGGRSLGQMAREELGRFGGIAALIATLTIMLIIVAILAMVVVNSLAASSWGVWSVGLTIPIALLMGFYLRYLRPGKVFEVSIIGIVLLVLAIASGAWIENTAVASALHLSKPFLAWAIIIYGFIAAVLPVWMLLAPRDYLSTFMKVGVIAMLAISIVIVRPVINVPAMTVYATNGAGPVFSGKLFPFLFVTIACGALSGFHATISSGTTPKLIEKESQARLIGYGGMLMESFVAIMALVAALSVDRGIYFAMNSPAGATGNTVKSAIAYVNSLGLSGVHANANTLTTTAKLVGETSIVSRTGGAPTLAVGLATIMHKIFGGEAMMSFWYHFAIMFEALFILTSVDAGTRVARFMLSDALGNFWPRLKDHSWKVGSWLTTAIMVAGWGSILLMGVTDPLGGINTLFPLFGIANQLLAAVALSICLVIFARAGHTWRLLIIFVPMLFTAIITVYGSWLKIFSPDPKLGYWANHMTYKRAIADGKTSLGQAKNIDEMHTVVGNTAIQGTMSIIFVVCALIVMIVACIRTVQALRGRNIIDTEDPAKPSKIFAPSGLMPTKAERDLQVEWDAFYEEHPELDLESVHKDKEHA

SEQ ID NO: 36546 - DNA, 1431 bp, Desulfotalea psychrophila LSv54
  CDS (1)..(1431): transl_table=11
atgcttttcttttttacctgtgttggcctgttgatcttgggctacttcacctacggggtctttgttgaaaagatctttggcattgaccgcaaccgggcaaccccctgtagcaccaaggaagagggcgttgactatatcgccatgccgacctggaaggtgttcttcatccagctccttgatattgcgggacttggccccatattcggaccaatcctcggtgctctatacggcccatctgccctcatctgggtagttattggctgtatctttggcggcgctgtccacgactattttagtggtatgctttctctgcgtagcggcggaaagtctatccctgaggtagttggtgacattatgggaatgccggcacgacagaccctgcgcatattttccatcgtcctcctcctccttgttggtgttgttttcatcctgggaccggcaaagcttctccaccagctgacgggagtcaatgttcagatactgatcggctgtatcttcttttactatttcatcgccaccatcctccccatcgacaagatcattggtcgtctctatccatttttcggcgccctcctcatattcatgacctttggcgttattggcggtttgatcttccacggctatgagattctgccaaaccttgattttttcaccaatactcacccggcagacaagcctatctggcctcttctcttcatcaccctgtcctgcggtgcgatcagtggttttcactccacccaatcaccgctgatggcacgttgcgtacaaaatgagtcccacggccgatccgtcttctatggttcaatgatcatggagggtattatcgcccttgtctgggttaccattggtctctccttctaccagacccccgaggcactcagtgctgtaattgctaccggctcccctgccgcagtggtcaatgaagcatgtaacaccctgctgggccccgtcggtggttttctggcaatcatgggcgttatcatcctgcctatctccagtggtgatacggcctttcgatccacccgtttgattattgcagagatcgttaatatcaagcagaaccgacctggcctgcgactgataattgccatccccctctttgccgtggcctttgccatcagtaatgtcgagttcaccaccgtatggcgctactttggttggtccaaccagatgctctccatgatgatgctctggacggcagccatctatctggtcaaaaagagaaaacttcactggatatgcaccatccctgccacctttatgaccgcggttgatgcagcattcatcctccaggccaagatcggttttgagctggactctaccctgtcaaatatcgctggcgtagttattgccatagcggtcctcgtcgccttcctcatctacaccaagcccctggaagagggcgcgcatctttggaagatagaagagtaa

SEQ ID NO: 36547 - protein, 476 aa, Desulfotalea psychrophila LSv54
MLFFFTCVGLLILGYFTYGVFVEKIFGIDRNRATPCSTKEEGVDYIAMPTWKVFFIQLLDIAGLGPIFGPILGALYGPSALIWVVIGCIFGGAVHDYFSGMLSLRSGGKSIPEVVGDIMGMPARQTLRIFSIVLLLLVGVVFILGPAKLLHQLTGVNVQILIGCIFFYYFIATILPIDKIIGRLYPFFGALLIFMTFGVIGGLIFHGYEILPNLDFFTNTHPADKPIWPLLFITLSCGAISGFHSTQSPLMARCVQNESHGRSVFYGSMIMEGIIALVWVTIGLSFYQTPEALSAVIATGSPAAVVNEACNTLLGPVGGFLAIMGVIILPISSGDTAFRSTRLIIAEIVNIKQNRPGLRLIIAIPLFAVAFAISNVEFTTVWRYFGWSNQMLSMMMLWTAAIYLVKKRKLHWICTIPATFMTAVDAAFILQAKIGFELDSTLSNIAGVVIAIAVLVAFLIYTKPLEEGAHLWKIEE

SEQ ID NO: 36548 - DNA, 1818 bp, Yersinia pseudotuberculosis IP 32953
  CDS (1)..(1818): transl_table=11
atgctcatgcaacatgcgattacctttgttatcgcttccgcgtgtatccttacgatctgctaccgtttatacggtatcttttttgttcgtaaggtgctgcgcgtcgatgacagtgaagttaccccttcccatacctttgaagatggcaaagattacgttccgactaaaaagtgggtgaactttggtagccacttcgccgcaatcgcggcggcaggccccttggttggcccggtgttggctgctcaatacgggtatttacccggcttcttatggcttttgatcggttgtgttatcggcggtgccgtacacgatacggtcgtcttgtttgcctcaatgaaacatcaggggaaatccctgtcagaagtcgctaaatccgaacttggcccagttgctggctggtgtaccggcctggcgatgttgttcattatcactattaccatggccgggttatcgatggtggtcgtacatgctctggaacgtaacccttgggggactttcgcagtgttcatgaccatccctatcgccatctgtgttggcttgtgggaacgcatgactggcagcatgaaaggggcttcgtatgtgggtattgccgctatcatggtgtgcgtatttgtcggcccgtatattgaaggcacttggcttggtgaatggttaatgctgaaagctgatacggtcagtattattctgccaatgtatgctttctttgcaaccgcactgcctgtctggatgttgttaaccccacgtggttacctttccagctttatgaagatcggtgtgttcggtgcactgattgttggtgttgtcttcattaatcctgaaattcaattccctgcggttacgcagtttattcacggcggtggcccagttcttgcgggaccggtttggccgtttatctctattactattgcctgtggtgctatctctgggttccatgcctttatcggttcgggtacgacaccgaaacagattgataaatggagcgatatcttgcccgtcggttttggtgcgatgctggcagaatgtatggttggggttatggcccttatcgccgcaacctctttgcatcctgctgactactttgccattaactcctctgctgaagcctggagtgcgcttggtatggaggttgtgaacctgccaaaattgagtgaagaaattggtttggacctgtatggccgtaccggtggtgctgtcactctggctgtagggatgaccgatatcttcattcgtgtgccatggtttaatagtttggctgcttacttcttccaatttgttgttatgtttgaagcggtgtttatcctgactgcggttgattcaggtacccgtgttgcccgttatttactgcaagattttctgggcgatatctgggctccactgaaacggaccgattggttaccaggaacattggtttgtagtgttattgcctgtgcattgtggggttacctccttaactcaggtgatattaactctgtctgggcattgttcggagtatcgaaccaattaatggcttctgttggcttaatcattggtgccacgattatcctgcgcttggcgaccaagcgtgtgtatatgctgacctgtgttattcctctggcttacctgtttgtcacagtaaattacgccggctattggatgatcactcacgtgtactttaattcagcggctaaaggctacaacctgttcaatggtatcatctcaattatcatgatgaccttgggtgtaatcatcttgatctccgcgctgaggaaatggcgtgagctatggatccgcaggtctgctgagatggctggcaacaaagtggttactgccaacgcctga

SEQ ID NO: 36549 - protein, 605 aa, Yersinia pseudotuberculosis IP 32953
MLMQHAITFVIASACILTICYRLYGIFFVRKVLRVDDSEVTPSHTFEDGKDYVPTKKWVNFGSHFAAIAAAGPLVGPVLAAQYGYLPGFLWLLIGCVIGGAVHDTVVLFASMKHQGKSLSEVAKSELGPVAGWCTGLAMLFIITITMAGLSMVVVHALERNPWGTFAVFMTIPIAICVGLWERMTGSMKGASYVGIAAIMVCVFVGPYIEGTWLGEWLMLKADTVSIILPMYAFFATALPVWMLLTPRGYLSSFMKIGVFGALIVGVVFINPEIQFPAVTQFIHGGGPVLAGPVWPFISITIACGAISGFHAFIGSGTTPKQIDKWSDILPVGFGAMLAECMVGVMALIAATSLHPADYFAINSSAEAWSALGMEVVNLPKLSEEIGLDLYGRTGGAVTLAVGMTDIFIRVPWFNSLAAYFFQFVVMFEAVFILTAVDSGTRVARYLLQDFLGDIWAPLKRTDWLPGTLVCSVIACALWGYLLNSGDINSVWALFGVSNQLMASVGLIIGATIILRLATKRVYMLTCVIPLAYLFVTVNYAGYWMITHVYFNSAAKGYNLFNGIISIIMMTLGVIILISALRKWRELWIRRSAEMAGNKVVTANA

SEQ ID NO: 36550 - DNA, 2067 bp, Yersinia pseudotuberculosis IP 32953
  CDS (1)..(2067): transl_table=11
atgaataacatcaggaccgttgtcatatggctgacagtggcgctaatcggtgcatttgcctttgccatgttggcccttagccggggtgaacatgtcaatgccatctggttagtgattgcatccgtggcttgttacagcatcgcttatcgcttctacagtcggtttattgccaagaatgtctttgaactggatgaccgtcgtctgacgccagcagaacgacgcaatgacggtctggattatgttcctaccaacaaatgggtgttgtttggtcaccactttgctgccatcgcgggtgctgggccactggtcgggccaatcttggccgcacagatgggttttctgccggggactatctggatcctggtcggtgtaatgatggccggtgccgtacaggacttcttaatcctgtttatctccactcgccgcgatggccgctcactgggtgaaatggcaaagcaagagttgggggcatttgctggtgtgataactatgctgggtgcattgggcgtaatgattatcattttgtccgcactcgcactggtggtggtaaaagcattagctgatagcccgtggggcctgtttaccattgccgcaacgatccccatagccctctttatgggcgtctatatgcggtttatccgccctggtaaaattgctgaagtatcattaatcggtttcgtactgatgatgtctgcaatcatttacggtgggaacatcgcggtacacccttactgggggcctttctttacgttacatggcaccacgctaacctggatattggttatctatggtttcatcgcctctgtactgccagtgtggttgctgctagcaccacgagattacttatcaaccttcctgaaaattggggtcatcattggtttagcggttggtattgtattcgccatgccagaaatgaagatgcccgcggtctcacactttattgatggcagcggcccggtcttctccggcagcctgttcccgttcctgtttattactatcgcttgtggtgctatctctggcttccatgctctggtatccagtggcaccacaccgaaactgattgaacgcgaaagccatacccgctttatcggctacggcgcaatgttgatggagtcattcgttgccatcatggcgctaatctgtgcctcggttatcgaccctggtgtttatttcgccatgaactcacccgcggctctgattggtaccaccgtagaaagtgcctcgctggccattagtagctgggggtttgtcgttacgccagaaacactggcgatggtcgccaaagatgttggtgaaaactcgattctgtcacgggctggtggtgcaccgaccttcgctgtgggcatggcgcatatcatcagtgaaatatttaatagccgtaatatgatggctttctggtatcactttgccatcttgtttgaagccatgtttattctgactgcggtcgatgctggtacccgtgcctgccgctttatggttcaggatctggttggggtggtcgtacctcgtctggccaataaccgttcatggtttggtaacctttccggaacgacagtcgcggtagccggttggggattcttcgtttaccaaggtgttatcgatccactggggggaataaacaccttgtggccgctgttcggtattggtaaccaaatgctggcatcaatggcactgattctaggtaccgtcgtactgtttaaaatgaagaaacaacgctacgcctgggtcaccatcctgccaacaatttggttatttatcacctcaatgaccgcaggttggcagaagatattccatgaaaaaccaagtattggcttccttgctcaagcaaaaaaattctctaacggcattgaacaaggggtgttaatcgcacccgcgaagagctttaaagacatggaaactatcgtgtttagcaaccagatcaacgccgcgctatgtgcattctttatgctggtggcggtgacgatgctagtttctgccttctttgtgattcgtcgcgcactgaaatccagcaaaccaacaacccatgaaactgaaattgtataccgtgaggaggtcgcccgtggttaa

SEQ ID NO: 36551 - protein, 688 aa, Yersinia pseudotuberculosis IP 32953
MNNIRTVVIWLTVALIGAFAFAMLALSRGEHVNAIWLVIASVACYSIAYRFYSRFIAKNVFELDDRRLTPAERRNDGLDYVPTNKWVLFGHHFAAIAGAGPLVGPILAAQMGFLPGTIWILVGVMMAGAVQDFLILFISTRRDGRSLGEMAKQELGAFAGVITMLGALGVMIIILSALALVVVKALADSPWGLFTIAATIPIALFMGVYMRFIRPGKIAEVSLIGFVLMMSAIIYGGNIAVHPYWGPFFTLHGTTLTWILVIYGFIASVLPVWLLLAPRDYLSTFLKIGVIIGLAVGIVFAMPEMKMPAVSHFIDGSGPVFSGSLFPFLFITIACGAISGFHALVSSGTTPKLIERESHTRFIGYGAMLMESFVAIMALICASVIDPGVYFAMNSPAALIGTTVESASLAISSWGFVVTPETLAMVAKDVGENSILSRAGGAPTFAVGMAHIISEIFNSRNMMAFWYHFAILFEAMFILTAVDAGTRACRFMVQDLVGVVVPRLANNRSWFGNLSGTTVAVAGWGFFVYQGVIDPLGGINTLWPLFGIGNQMLASMALILGTVVLFKMKKQRYAWVTILPTIWLFITSMTAGWQKIFHEKPSIGFLAQAKKFSNGIEQGVLIAPAKSFKDMETIVFSNQINAALCAFFMLVAVTMLVSAFFVIRRALKSSKPTTHETEIVYREEVARG

SEQ ID NO: 36552 - DNA, 1776 bp, Symbiobacterium thermophilum IAM 14863
  CDS (1)..(1776): transl_table=11
atgagctcaccggccctgttcgttctgcttgcgctggttgcctatggcatcgcgtacttcgggtacggcaagtggttcgaccggaacgtgtggaaaccggatcccaagcggacgacgccggcccacatgtatacggacggggtggagtacttcccggtcagcaagtacgtcctgtggggttaccagttcaagagcgtcgccgcgctcggtcccatcctgggtccgtacatcgccatccaatacggctgggccccggcgctggcgtggatcatcctgggcaacttcttcatcggctggctccaggactacggcgccatcatgctctccatccgcaaccagggacgctctttcggacccatcacctacgagttcaccggcaacaccggccgaaacaccctcctgggcttcatcctgttctatctcctgatcatctccgcgaccttcatctacttcatcgccctgttctggcacacgttcccgtccacctttgcggccaccgtcggcatcctgctggtcggcgtgctggccggacagatgctctacaagatgcgggccaacgtggtgacggccacggcgctgtccatcgtcctcatggccctggtcatctgggccgccgcctccttcccgttcctgcagacgccccagggcgcctggccgccgaaccccgcccagggcgtggaggcgggcggcatcgccggcccgtggtccctgctgatctggtgcatcgtcgcctgcgtcgtcctgtacctcgcgtcggtcctgccgctgcccacgttcatccagccggtcaactacgtctccttcttccccaccttcctggcggtgatcctgatcctcatcggcgccctcgtctccaacttcaccggcgtccggctggagcagccggcctggatcggcttcaaccccaccggcaataacccgatgtggccactgatgttcgtggccatcgcctgcggctccatctcgggctggcacagcctggtttccagctcttccaccgccaagcagctggacatcgagaccgacgcccacccggtcggcgccggcgccatgctctccgaggggctgctggccctggcctccctggccgcctacatgatcatcccgcgggagcagctcaccggcaacgtgggctcctgggtggccggcgccatcaagttcaccgccccgttcctgggaggcgaggccgcggtgggcttcttgcgggcgtacttcggcgtgtgcctcatcctctacgccctgacggtacaggccctggtcacccgcttctggcggctggtctccaccgaggtcttccagggccgactggccatcctgggccagaagcacgtcgccaccttcatcggcctgctgatcccgctggcctttgcggccaccggctcctggaacaacctgtggctctacttcggcggctccaaccagctcctcgcgggcctggcgctgatgctcatcaccatccatctcgcccgcgtgcaggcgcccacggtctacaccctgatcccggcgaccttcatgatggtcaccaccatcaccgccatcggctggcaggtggtgaaggtctacctcccggccttcctgggcacaacccccacgctggtgcagtacccgttcaaccagtacccggggttcagccgggccatggacggcatcttcgtcctggtgggggtcgcgctcttcgtcctgggcctggtgatggcctacaagacctactcggcctacgccgaggcccggcgggggctgggctccagcccgcgggtcgccaccagcggggattag

SEQ ID NO: 36553 - protein, 591 aa, Symbiobacterium thermophilum IAM 14863
MSSPALFVLLALVAYGIAYFGYGKWFDRNVWKPDPKRTTPAHMYTDGVEYFPVSKYVLWGYQFKSVAALGPILGPYIAIQYGWAPALAWIILGNFFIGWLQDYGAIMLSIRNQGRSFGPITYEFTGNTGRNTLLGFILFYLLIISATFIYFIALFWHTFPSTFAATVGILLVGVLAGQMLYKMRANVVTATALSIVLMALVIWAAASFPFLQTPQGAWPPNPAQGVEAGGIAGPWSLLIWCIVACVVLYLASVLPLPTFIQPVNYVSFFPTFLAVILILIGALVSNFTGVRLEQPAWIGFNPTGNNPMWPLMFVAIACGSISGWHSLVSSSSTAKQLDIETDAHPVGAGAMLSEGLLALASLAAYMIIPREQLTGNVGSWVAGAIKFTAPFLGGEAAVGFLRAYFGVCLILYALTVQALVTRFWRLVSTEVFQGRLAILGQKHVATFIGLLIPLAFAATGSWNNLWLYFGGSNQLLAGLALMLITIHLARVQAPTVYTLIPATFMMVTTITAIGWQVVKVYLPAFLGTTPTLVQYPFNQYPGFSRAMDGIFVLVGVALFVLGLVMAYKTYSAYAEARRGLGSSPRVATSGD

SEQ ID NO: 36554 - DNA, 1797 bp, Bacillus licheniformis ATCC 14580
  CDS (1)..(1797): transl_table=11
atgaatgcaataacaattgtgatcgcttccatctgtattttggcgatcgcctatcgtttgtacggaacatttatgatggtgaaagtgttgaaggttgatgacgacaagccgactcctgcccatcttcagaaagacggcaaagattatgtgccgacgaacaaatgggtgtctttcggccaccactttgcggccatcgcagccgcggggccgcttgtcgggccgatcttggcggcgcagttcggctacttgccggggctgttgtggctcctgatcggagcggtcatcgggggcgccgtgcatgatattgttgttttatttgcgtcgatgcggaggaagggaaagtcgctttcagaagtggcgaaagaagagctcgggcctgttgcgggattttgcacggggcttgcgatgctgtttattattacaatcacgatggcggggctgtcgatggttgtgcttcatgcgcttgaacgcaatccgtgggggacgttcgccgttgcgattacaattccgatcgcgatgggggtcggcttattttataaaaagacaggcaacttaaaattagcgtctaccggcggatttattttgctgatggccggtgtcttcatcgggccctccattgcagagacgccgcttggagacgccttgacgctcgatacgaaaacgcttgctgtcgcacttcctgtctatgcattttttgcagcggcgctgcctgtatggctgctgctcgcaccgcgcgattatttgagcagctttatgaaaatcggggtgtttatcgctttgattgccggggttttcgttgtcaatccggcgattccgtttccggcgtttaccgagttcacgggcggagggggacctgtttcgcctggtccggtctggccgttcatttcaattacgatcgcctgcggtgcgatttccggtttccatgcgtttgtcggttcaggcacgacgccgaagatgcttgacaagtggagcgacatgaaattcgtcggcttcggagcgatgctcgttgagtgtcttgtcggcatcatggctttaatcgcggcaacggcgttgcagccgggcgattattttgccatcaacagttcgccagaagtctttcggacgcttggcatgaatgtcgtccatctgcctgaactcagccgcgaaatcggtctcgatcttgaaggaagaacaggcggagctgttacccttgccgtcggcatggcttatattttcacggatattccgtttttcagccatttggcctcttactttttccaatttgtcatcatgtttgaagctgtctttattttaacggcgatcgatgccggtacaagggtggcgcgttatttgattcaagactttttcggggaagtgtacaaaccgctgaaaaaaacggactggcttccgggttcggtcgcagcgagcgcccttgcctgtttcatgtggggatatttgctgtactcaggcgatatcagctcgatttgggcgctgtttggcgtatccaaccagctgatggcatccgtcggtttaattatcggagcgacggtcattttaaaaattgcggacaaacggcgttatatgctgacatgtctcattccgctcgcttatttgtatgtgacggtcaactatgcgggatactggatgatcaaaaacgtttattttaatgcggaagctgccggtttcagcgttttaaacggcattttatcgatcattatgcttgtgttgggacttgtgatcatggctgcagccattaaaaaatggacggagatttggcgcgatccggcattgcggatggagccttctatacctggatga

SEQ ID NO: 36555 - protein, 598 aa, Bacillus licheniformis ATCC 14580
MNAITIVIASICILAIAYRLYGTFMMVKVLKVDDDKPTPAHLQKDGKDYVPTNKWVSFGHHFAAIAAAGPLVGPILAAQFGYLPGLLWLLIGAVIGGAVHDIVVLFASMRRKGKSLSEVAKEELGPVAGFCTGLAMLFIITITMAGLSMVVLHALERNPWGTFAVAITIPIAMGVGLFYKKTGNLKLASTGGFILLMAGVFIGPSIAETPLGDALTLDTKTLAVALPVYAFFAAALPVWLLLAPRDYLSSFMKIGVFIALIAGVFVVNPAIPFPAFTEFTGGGGPVSPGPVWPFISITIACGAISGFHAFVGSGTTPKMLDKWSDMKFVGFGAMLVECLVGIMALIAATALQPGDYFAINSSPEVFRTLGMNVVHLPELSREIGLDLEGRTGGAVTLAVGMAYIFTDIPFFSHLASYFFQFVIMFEAVFILTAIDAGTRVARYLIQDFFGEVYKPLKKTDWLPGSVAASALACFMWGYLLYSGDISSIWALFGVSNQLMASVGLIIGATVILKIADKRRYMLTCLIPLAYLYVTVNYAGYWMIKNVYFNAEAAGFSVLNGILSIIMLVLGLVIMAAAIKKWTEIWRDPALRMEPSIPG

SEQ ID NO: 36556 - DNA, 1503 bp, Mannheimia succiniciproducens MBEL55E
  CDS (1)..(1503): transl_table=11
atgttgtggttcttgttatgtgtggcaattttgctattaggttattttatctacggtaaaattgtcgaaaaaatctttgttatcaatcctgatcgtaaaacgccggcttattccttaagagacggagtggattacgtgccgatgaccaagaaaaaaatctggttaatccaattattgaatattgccggtacgggtccgattttcggtccgattttaggtgcgctatacgggccggtggcgatgctctggatcgtattcggttgcgtatttgccggtgcggtgcacgattatttcagcggtatgttgagtattcgtaacggcggggcgaacgtgccgtatttagcgggtaaatatttaggtcgcccggctaaacattttatgaatattattgctattttattattgttattagtgggtgtggtattcgtagcaagcccagcgtcactgttaaccaatattaccagcgatttaatgaattcgggttctgtcggcgcggcggccgtaaatgatgaagcgggtgcggcaaaaggcaatattctgattatgtggactgctgtaattttcatttattacattatcgccacattagtaccaattgataaaattataggtcgtatttatccgttcttcggtgccttattgttgtttatgacctgcggtatgttattcggtcttttctttgaaggcattccgttcttcagaacactcggcggcgatatcagcttagcggattttttcactaatatgcatccgaaaaatgcgccgatttggccgttgctgttcattaccattgcctgtggtgcgatttccggtttccatgcaacccaatctccgttaatggcgcgttgtactgagaacgaaagagaaggacgtttcattttctacggcgcaatgatcggtgagggtatcattgcattaatctggtgtatggtgggattaagtttctacaacgatcaggctggacttgccgaagcaatccaaatcggtacaccgtctaaagtggtttatgatgccgcaatcggtatgttaggcgtgtttggcggtattttagcagtattgggcgtggtggtattacctattacttccggtgatacggcattccgtgctgcgcgtttattaattgcggatttctttaaatatgatcaacgtaatcttactaaacgtttgactattgcacttccgttattcgctatcggcttctgggtttcaaccattgacttctccgttttatggcgttatttcggttgggcgaaccaaaccactgcaatggtaatgttatggactgcggcggcatatttattccgtcatcaaaaattccactgggtatgtacgattcctgcggtgtttatgactctggtttgttcaacattcttactcaacgcaccaatcggtttcggcttggattaccaactttccgtatggttaggcggtgcggtaacggcggtagcggttattgctttcttcatgttgctaaaaccgatttctgcagatgaacaagattaa

SEQ ID NO: 36557 - protein, 500 aa, Mannheimia succiniciproducens MBEL55E
MLWFLLCVAILLLGYFIYGKIVEKIFVINPDRKTPAYSLRDGVDYVPMTKKKIWLIQLLNIAGTGPIFGPILGALYGPVAMLWIVFGCVFAGAVHDYFSGMLSIRNGGANVPYLAGKYLGRPAKHFMNIIAILLLLLVGVVFVASPASLLTNITSDLMNSGSVGAAAVNDEAGAAKGNILIMWTAVIFIYYIIATLVPIDKIIGRIYPFFGALLLFMTCGMLFGLFFEGIPFFRTLGGDISLADFFTNMHPKNAPIWPLLFITIACGAISGFHATQSPLMARCTENEREGRFIFYGAMIGEGIIALIWCMVGLSFYNDQAGLAEAIQIGTPSKVVYDAAIGMLGVFGGILAVLGVVVLPITSGDTAFRAARLLIADFFKYDQRNLTKRLTIALPLFAIGFWVSTIDFSVLWRYFGWANQTTAMVMLWTAAAYLFRHQKFHWVCTIPAVFMTLVCSTFLLNAPIGFGLDYQLSVWLGGAVTAVAVIAFFMLLKPISADEQD

SEQ ID NO: 36558 - DNA, 1428 bp, Bacteroides fragilis YCH46
  CDS (1)..(1428): transl_table=11
atgattacattcacgatttgcctgctggctctgattgcaggttactttatttacggacggttggtggagcgtgtctttggccccgacgaccgaaagaccccggcactgacacatgccgacggagtggattatattccccttcctacctggaaaatcttcatgattcaatttttaaacatagccggtctcggccccatcttcggagctattatgggagcgaagttcggtactgcttcctatctgtggattgtgttgggaagtatctttgccggtgccacacacgattatttcgccggaatgctctctctgcgtaacggtggtgagagcttgcctgaaattgtcggccgttttctggggatgactaccaagcaggtgatgcggggttttaccgttgtcctgatgattctggtaggtgcggtctttgtggcaggaccggcaggactgctggcgaagttgactcccgacagtctcgacactactttctggatcattgtggtgttcatctattatattcttgccactctgcttccggtcgataaaatcatcggaaagatatatcccttgttcgctgcagctttgttgtttatggcagtgggtatcctggtgatgctttatgttcatcatccggtcatcccggagttgtgggacggattacagaatactaatccggaagcagccgtgttacctattttcccgattatgtttgtcagtatcgcctgtggagccatctccggatttcatgctacgcaaagtcccctgatggcacgttgcatgacttctgagcgtcatggacgtcctgtcttttacggtgccatgattaccgagggcattgtggcgctgatctgggctgccgccgcgacttatttttatcgtgaacacggtatggaagagaacaatgcctctgtcattgtagacgctataacgaaagattggctcggtgcggtaggtggggtgcttgccattctgggagtgattgcggcgcctattacatcgggcgacaccgcgtttcgttcggcacgtctgatcgtagccgattttctgaaactggaacaaaaaagcatgcgtcgccgtttgtatatttgtgtgccgatgttcattgtcgccatcgggctgttgctttacagtttgcgtgataaagacgggttcgacatgatctggcgctattttgcctgggccaaccagaccttatcggtctttactctctgggccatcacagtctacttggcgcgtgcccgcaagtggtatggtttgacattggttcccgctctgtttatgacagctgtctgttccacttatatctgcatcgcccccgaaggattaggattgtcacattgggtttcgtatgtgacaggagggggttgtacactgattggagccgtttggtttattgtttggaaaaaagggattggatactcgtataaaaaataa

SEQ ID NO: 36559 - protein, 475 aa, Bacteroides fragilis YCH46
MITFTICLLALIAGYFIYGRLVERVFGPDDRKTPALTHADGVDYIPLPTWKIFMIQFLNIAGLGPIFGAIMGAKFGTASYLWIVLGSIFAGATHDYFAGMLSLRNGGESLPEIVGRFLGMTTKQVMRGFTVVLMILVGAVFVAGPAGLLAKLTPDSLDTTFWIIVVFIYYILATLLPVDKIIGKIYPLFAAALLFMAVGILVMLYVHHPVIPELWDGLQNTNPEAAVLPIFPIMFVSIACGAISGFHATQSPLMARCMTSERHGRPVFYGAMITEGIVALIWAAAATYFYREHGMEENNASVIVDAITKDWLGAVGGVLAILGVIAAPITSGDTAFRSARLIVADFLKLEQKSMRRRLYICVPMFIVAIGLLLYSLRDKDGFDMIWRYFAWANQTLSVFTLWAITVYLARARKWYGLTLVPALFMTAVCSTYICIAPEGLGLSHWVSYVTGGGCTLIGAVWFIVWKKGIGYSYKK

SEQ ID NO: 36560 - DNA, 2079 bp, Burkholderia pseudomallei K96243
  CDS (1)..(2079): transl_table=11
atgaatcgggcttccggttatttggtctggatcgcggtcgcgctgctcggcgcgttcgcgttcggcacgatcgcgctcgcgcacggcgagcggatcagcgcgctatggatcgtgatcgccgccgtttgcgtgtatttgatcgcgtaccgcttctacagccgcttcatcgcgagcaaggtcgtccagctcgacggcctgcgcatgacgcccgccgtcaagtacaacgacggcctcgattacgtgccgaccaacaaatacgtgctgttcggccatcatttcgccgcgatcgccggcgcgggcccgctcgtcggcccggtgctcgccgcgcagatgggctacacgcccggcatgctgtggattctcgcgggcgtcgtgttcgcgggcgcggtgcaggacttcatcgtgctgttcatctcgacgcgccgcgacggccgctcgctcggcgacctcgtcaagatggagctcggcacggtgcccggcgtgatcgcgctgttcggcgcgttcctgatcatggtgatcattctcgcggtgctcgcgctgatcgtcgtgaaggcgctcgccaattcgccgtggggcacgttcaccgtcgccgcgacgattccgatcgcgctgttcatgggcgtctacacgcgctacatccggccgggccggatcggcgaagtgtcgatcatcggcttcgtgctgctgatggcgtcgatcgcgtacggccagcacgtgcacgattcggccgcgctcgccgcgtggttcacgttcagcggcacgcagctcacgtggatcctgatcggttacggcttcgtcgcgtcggtgctgccggtgtggctgctgctcgcgccgcgcgactacctgtcgacgttcctgaagatcggcacgatcgtcggcctcgcgatcggcatcctgatcgtcgcgccggagctgaagatgccggcgctcacgaagttcgtcgacggcacgggcccggtctggtcgggcaacctgttcccgttcctgttcatcacgatcgcgtgcggcgcggtgtcgggcttccattcgctgatctcgtcgggcacgacgccgaagctgctcgacaacgaaaccaacgcgcgcttcatcggctatggcgcgatgctgatggaatcgttcgtcgcgatcatggcgctcgtcgccgcgtgcgtgatcgagccgggcgtctacttcgcgatgaacgcgccggccgccgtgctcggcacgacgccggaagcggtcgcgcacaccgtcacgcagtggggcttcatgctgacgcccgacatgctcacgcagacggcgaaggccgtcggcgagacgacgatcatcgcgcgcgccggcggcgcgccgacgctcgcggtcggcatggcgcagatcctgcaccaggtgatcggcggcgaggcgatgatggcgttctggtatcacttcgcgatcctgttcgaggcgctgttcatcctgaccgcggtcgacgcgggcacgcgcgcgggccgcttcatgctgcaggatttgctcggcacgttccacccggcgctcaagcgcaccgaatcgctgccggcgaacctgaccgcgaccgcgctgtgcgtggccgcgtggggttacttcctgtatcagggcgtggtcgatccgctcggcggcatcaatacgctgtggccgctgttcggcatctcgaaccagatgctcgccgcgatcgcgctggtgctcggcaccgtcgtgctgttcaagatgaagcgcgagcgctacgcgtgggtgacgatcgtgccgacggcgtggctgctgatctgcacgctgacggccggctggcagaaggtgttcgattcgaatccgaaggtgagcttcctcgcgcacgcggcgaagctgcaggcggccgcggccgacggcaaggtgctcgcgccggcgaagtcgctcgcgcagatgcagcggatcatcttcaacgactacgtggacgcggcgctctcggcgctgttcatcctggtcgtcgtgagcatcgcggtgtacggcgtggttgcggtcgtgcgcgcgcggcgcgcggtgcagcccacgtcgcgcgaaacgccgtacgaaccgatgccggtcgcgcaggcgctcggcagcggacgctga

SEQ ID NO: 36561 - protein, 692 aa, Burkholderia pseudomallei K96243
MNRASGYLVWIAVALLGAFAFGTIALAHGERISALWIVIAAVCVYLIAYRFYSRFIASKVVQLDGLRMTPAVKYNDGLDYVPTNKYVLFGHHFAAIAGAGPLVGPVLAAQMGYTPGMLWILAGVVFAGAVQDFIVLFISTRRDGRSLGDLVKMELGTVPGVIALFGAFLIMVIILAVLALIVVKALANSPWGTFTVAATIPIALFMGVYTRYIRPGRIGEVSIIGFVLLMASIAYGQHVHDSAALAAWFTFSGTQLTWILIGYGFVASVLPVWLLLAPRDYLSTFLKIGTIVGLAIGILIVAPELKMPALTKFVDGTGPVWSGNLFPFLFITIACGAVSGFHSLISSGTTPKLLDNETNARFIGYGAMLMESFVAIMALVAACVIEPGVYFAMNAPAAVLGTTPEAVAHTVTQWGFMLTPDMLTQTAKAVGETTIIARAGGAPTLAVGMAQILHQVIGGEAMMAFWYHFAILFEALFILTAVDAGTRAGRFMLQDLLGTFHPALKRTESLPANLTATALCVAAWGYFLYQGVVDPLGGINTLWPLFGISNQMLAAIALVLGTVVLFKMKRERYAWVTIVPTAWLLICTLTAGWQKVFDSNPKVSFLAHAAKLQAAAADGKVLAPAKSLAQMQRIIFNDYVDAALSALFILVVVSIAVYGVVAVVRARRAVQPTSRETPYEPMPVAQALGSGR

SEQ ID NO: 36562 - DNA, 2076 bp, Methylococcus capsulatus str. Bath
  CDS (1)..(2076): transl_table=11
atgccctctcgcaagctcaccgtcgtcctgacttggtccgccgtcgcgctgctcggtgcctccgcactgggaggaatcgcgctaaaccgcggtgagtcggtcaacagcctctggttcgtgaccgcggcggtctgcgtctacgccctgggttatagattctacagtgcctttgttgcaacccgcgtgctgctgctggatgccggccgcgccacacccgccgaacgcttcaacgacggccgcgacttcgtacccacccaccggtgggtcgtgttcggccaccacttcgccgcgatcgccggccccgggccgctgatcggcccgaccctggcggcccagttcggctatctgcccggcacgctttggatactgatcggcgctgtgttcggcggctgcgtgcaggacttcgtggtgctggtgtgctctatccgccgcgacggccgttcgctcggccagatggcccgcgacgagttgggccccatcggcggctcggcggcgctcgtcggtgtgatggcgatcatgatcatcctgatcgcggtgctcggcctggtcgtggtcaacgccatgaagcacagcccctgggcgacttcgacggtggcggcgacgattcccatcgcggtgctgatcggcctctacatgcgcgagatccgccccgggcgggtgatcgaggcgacgctgatcggcgtcaccctgctgatcctctcggtcgccggcggcggctggatcgaccaccatccggcgatccggacctggttcgactacgacgcccccaccctggcgctgatgatcatcgcctacggtttcgccgctgccgtattgccggtgtggctgctgctggcgccgcgcgactacctctctaccttcatgaaactgggtaccatcgccgccctcgccgtcgccatcctgatcctgcatcccgacatcaggatgccggcgctcacggccttcatcgacggcaccgggccgatcttcggcggcaagctgtttccgttcgtgttcatcaccatcgcctgcggcgcgatctccggtttccacgccctgatctcctccggcaccacgcccaagctgctggccaacgaggccgacgcccgcttcatcggctatggggcgatgatgatggaatccttcgtggccatcatggccatgatcgcggcgaccgtgctcgaccccggcatctatttcgccatcaacagcccggccggcgtggtcggcaaggaagcggccgacgcggtggcgacgatctcgtcctggggcttcccggtcgacgtcgggcaaatggcgaccctggcccgggagatgggcgaggcgagcctgttcgcccgcaccggcggcgccccttcgctggccgtgggcatggcatccttgttcgccagcgcgttcggcgacggcctgctggctctgtggtaccacttcgccatcatgttcgaggcactgttcatcctgacgacgctggacgccggcacccgcgtcgcccgcttcatgctgcaggatatgctgggcaactggcatcccgtgctgggacggaccggctggtatcccggcgtactgttctcctcggcgctggtcgtcgccggctggggctatttcctgtacatgggcaccatcgacccgctgggcggcatcaacagcctgtggccgctgttcggcatcgccaaccagatgctggccgccatcgccctgtgcgtcgccaccaccatcctggtcaagaccggcaaggcttcctacgcctggatcaccgccctgccgctgtcctggctgatcgtggtcaccagcagcgcggcctgggaaaaactgttcagccccgaactgcgcgtgggcttcctggcgcatgcccgcgacctgggcgacaagctggcggccggcctgctttcggcggaccaggccgccaaggcgccgcagctgatcttcaacgactatctggatgccaccctgaccgcggttttcatggggctgagctggatcctggcggcggacacgacgagggtctgctactgcgtgctcgccgggcgcccgcatccgcccagcagcgagtcgccccgcatcccgagccggcttacggaaaactgggtcagagactga

SEQ ID NO: 36563 - protein, 691 aa, Methylococcus capsulatus str. Bath
MPSRKLTVVLTWSAVALLGASALGGIALNRGESVNSLWFVTAAVCVYALGYRFYSAFVATRVLLLDAGRATPAERFNDGRDFVPTHRWVVFGHHFAAIAGPGPLIGPTLAAQFGYLPGTLWILIGAVFGGCVQDFVVLVCSIRRDGRSLGQMARDELGPIGGSAALVGVMAIMIILIAVLGLVVVNAMKHSPWATSTVAATIPIAVLIGLYMREIRPGRVIEATLIGVTLLILSVAGGGWIDHHPAIRTWFDYDAPTLALMIIAYGFAAAVLPVWLLLAPRDYLSTFMKLGTIAALAVAILILHPDIRMPALTAFIDGTGPIFGGKLFPFVFITIACGAISGFHALISSGTTPKLLANEADARFIGYGAMMMESFVAIMAMIAATVLDPGIYFAINSPAGVVGKEAADAVATISSWGFPVDVGQMATLAREMGEASLFARTGGAPSLAVGMASLFASAFGDGLLALWYHFAIMFEALFILTTLDAGTRVARFMLQDMLGNWHPVLGRTGWYPGVLFSSALVVAGWGYFLYMGTIDPLGGINSLWPLFGIANQMLAAIALCVATTILVKTGKASYAWITALPLSWLIVVTSSAAWEKLFSPELRVGFLAHARDLGDKLAAGLLSADQAAKAPQLIFNDYLDATLTAVFMGLSWILAADTTRVCYCVLAGRPHPPSSESPRIPSRLTENWVRD

SEQ ID NO: 36564 - DNA, 2277 bp, Nocardia farcinica IFM 10152
  CDS (1)..(2277): transl_table=11
atggcgacaatcgaatatctgcggaccgaccccgacctgcccccggtgggcgtggtcgaccgatcccccatgaccccggccaagaaggccgtcctcgccgggatcgcgatactcggcgccgtcgcctggtcgatcctcgccctcgcgcgcggcgagaacgtcaacgcggtgtggatcgtcatcgcggcggtgtgtacgtatgtgatcgcctaccgcctctacgcgcggttcatcgaatggaagatcaccaagccgcgcgacgacctcgccaccccggccgaaatcctggagaacggcaaggatttcatgccgatggaccgccgggtcctctacggccaccacttcgcggccatcgcgggcgcgggtccgctggtcggcccggtgctggcggcgcagatggggtatctgccgggcaccatctggatcgtggtcggcgtctgcctggccggtgcggtgcaggactacctggtgctgtgggcttcgacgaaacggcgcgggcgcagcctcgggcagatggcgcgcgacgagctcggcgtggtcggcggtgtcgcggccatcgccgcgatcatcgtgatcatgatgatcctgctggcggtgctggcgctggtcgtcgtgaacgcgctcggcgagagcccgtggggtgtgttctccatcgccatgaccatccccatcgccctgttcatgggcatctacctgcggttcctgcggccgggcaaggtgggcgaggtgtcggtgatcggcatcgcgctgctgttgctggccatcgtcgccggtggctgggtgtcggaaaccgactggggcaccgactggttcacgctctcgcgcaccaccatcgcctggctgctgatcggctacggcttcctcgcctcggtgctgccggtgtggctgctgttggcgccgcgcgactacctgtcgacgttcatgaagatcggcaccatcggcctgctggccatcggcatcctggtcaccatgccggtgctgaaggcgcccgcgatctccgaattcgccaccagcggcaccggtcccgccttcgcgggcagcctgttcccgttcctgttcatcaccatcgcctgcggcgcgctctcgggcttccacgcgctgatctcctccggcaccactcccaaactgctggagaaggaatcgcacgcgaagatgatcggctacggcggcatgctgatggagtcgttcgtcgcggtgatggccatcatcaccgccaccatcatcgaccagcacctctacttcggcatgaacgcgccgctcgggctcaccggcggcacacccgagaaggcggcccaatacaccaactcgctcggcctgtccggtccgcccgccaccgcggagaccttcgcgggtgcggccgccgacgtcggtgagaacaccatcatctcccgcaccggcggcgcgccgaccctggccgtcggcatctccgaggtgttccaccgcttcctcggcggggagagcatgaagtcgttctggtaccacttcgcgatcatgttcgaggcgctgttcatcctcaccaccatcgacgcgggcacccgcgtcgcgcggttcatggtctcggacgcgttgggcaacttcggtggtccgctgcgcaagttcaaggacccgtcgtggcgggtgggcgcctgggtctgctcggtggtcgtggtcgccgcgtggggctcgatcctgctgatgggcgtgaacgatccgctgggcggcatcaacgccctctacccgctgttcggcatcgccaaccagctgctggccgcggtggcgctgaccgtcgtgctgaccatcatcgtgaagaagggcctggtgaaatgggcctggattcccggcatcccgctggtgtgggatctgctggtgacgatgacggcctcctggcaaaagatcttctccgccgacccgaaggtcggctactggaagcagcacagcctgtgccagcaggcgcaggaggccggcacactctgcctgacggccaagacgccgcaggaggtggacgtggtggtgcgcaacaccttcatccagggcacgctctcgatcgtgttcgcggtgctggtgctggtggtggccgtcgtcggcaccatcgtgtgcctgcgggcctggcgggccggggagagtccgaccaccgagtcgccggaggagccgtcgaagatcttcgcgcccagcggcttcatcgccacacccgccgagcgggaggtgcagaaggagtgggacgcgctgatcgcggcgggcaaggtgcgcgcgcccggcgcggcgcaccaggcgcccgacaaggcggaatcgagggcgtga

SEQ ID NO: 36565 - protein, 758 aa, Nocardia farcinica IFM 10152
MATIEYLRTDPDLPPVGVVDRSPMTPAKKAVLAGIAILGAVAWSILALARGENVNAVWIVIAAVCTYVIAYRLYARFIEWKITKPRDDLATPAEILENGKDFMPMDRRVLYGHHFAAIAGAGPLVGPVLAAQMGYLPGTIWIVVGVCLAGAVQDYLVLWASTKRRGRSLGQMARDELGVVGGVAAIAAIIVIMMILLAVLALVVVNALGESPWGVFSIAMTIPIALFMGIYLRFLRPGKVGEVSVIGIALLLLAIVAGGWVSETDWGTDWFTLSRTTIAWLLIGYGFLASVLPVWLLLAPRDYLSTFMKIGTIGLLAIGILVTMPVLKAPAISEFATSGTGPAFAGSLFPFLFITIACGALSGFHALISSGTTPKLLEKESHAKMIGYGGMLMESFVAVMAIITATIIDQHLYFGMNAPLGLTGGTPEKAAQYTNSLGLSGPPATAETFAGAAADVGENTIISRTGGAPTLAVGISEVFHRFLGGESMKSFWYHFAIMFEALFILTTIDAGTRVARFMVSDALGNFGGPLRKFKDPSWRVGAWVCSVVVVAAWGSILLMGVNDPLGGINALYPLFGIANQLLAAVALTVVLTIIVKKGLVKWAWIPGIPLVWDLLVTMTASWQKIFSADPKVGYWKQHSLCQQAQEAGTLCLTAKTPQEVDVVVRNTFIQGTLSIVFAVLVLVVAVVGTIVCLRAWRAGESPTTESPEEPSKIFAPSGFIATPAEREVQKEWDALIAAGKVRAPGAAHQAPDKAESRA

SEQ ID NO: 36566 - DNA, 1527 bp, Photobacterium profundum SS9
  CDS (1)..(1527): transl_table=11
ttgggtataagcgttatcaaattcccaacatcacagcgagaaaacaaaatgacttggttcttactctgcgttgctgcactagtcggtggttacttcatctacggtgcctttattgaaaaaatatttggcataaatgaaaatcgccaaacaccagcatatagtaaacaagatggcgtagattatgtgccaatgtcgaacaagaaggtttaccttgttcagttattaaacatcgcgggtgtgggtccgatttttggtccgattatgggtgcgctatatggcccagcagccatgttatggattgtattagggtgtatcttcgccggcgcagtacatgattacttctcgggtatgctgtcgattcgtaataatggtgcatcagtacctacgattacgggacgctacctaggcaacggtgcaaaacattttatgaatatctttgctatcgtactgttgctattagtgggtgtggtattcgtatcggcacctgctggcatgatcactaaccttgtgaacgaacaaactggcattgatatgtcaatgacaacaatggttgtgattatttttgcttattacatcatcgcgaccattgttcctgttgataaaatcatcggtcgtttctacccattatttggcgcattacttatctttatgtctgtggggctgattaccgctatcgcattctctagtgagcacacgctactgggtgattacgagatgagccagatgttcaccaacatgaacccgaatgacttacctctttggcctgcactgtttatcactatcgcttgtggtgctatctctggtttccacgcaacccagtcgccactgatggctcgctgtcttcaaaatgaaaagaacggtcgcttcgtattttacggtgcaatgattggtgaaggtattatcgcattaatttggtgtgctcttgcattgtctttcttcggctctgttgaagcgctatcagaagcaatatctactggtggccctggtagtgtggtatacaactcatctatcggtctactgggtgtgtttggcggtattattgctttcttaggtgtggttatcttaccgattacctcaggtgacactgcattccgttcaagccgtctaattcttgctgaatatttcaatatggatcagaaagccctgcgtaaccgcctactaatggcattaccattgtttgttcttggtggcattctaacgcaagtcgacttcggtattatctggcgctacttcggctttgcaaaccaaacaacagccgtaatgatgctgtggacagcctctgcttacttactgcgtcacaataaactgcactgggtagcgactgtaccagcaatgttcatgacaacggtttgtattaccttcatcttaaacaacagccaactaggctttggtttatcgatgatgacatcaacgattacgggtcttgtagcaatgctagccattacaggctacgtcattaagaaatcgaaaggtaaaggcgaaactgaccttgccaatgaagaagacggtaggttagaaactgtataa

SEQ ID NO: 36567 - protein, 508 aa, Photobacterium profundum SS9
MGISVIKFPTSQRENKMTWFLLCVAALVGGYFIYGAFIEKIFGINENRQTPAYSKQDGVDYVPMSNKKVYLVQLLNIAGVGPIFGPIMGALYGPAAMLWIVLGCIFAGAVHDYFSGMLSIRNNGASVPTITGRYLGNGAKHFMNIFAIVLLLLVGVVFVSAPAGMITNLVNEQTGIDMSMTTMVVIIFAYYIIATIVPVDKIIGRFYPLFGALLIFMSVGLITAIAFSSEHTLLGDYEMSQMFTNMNPNDLPLWPALFITIACGAISGFHATQSPLMARCLQNEKNGRFVFYGAMIGEGIIALIWCALALSFFGSVEALSEAISTGGPGSVVYNSSIGLLGVFGGIIAFLGVVILPITSGDTAFRSSRLILAEYFNMDQKALRNRLLMALPLFVLGGILTQVDFGIIWRYFGFANQTTAVMMLWTASAYLLRHNKLHWVATVPAMFMTTVCITFILNNSQLGFGLSMMTSTITGLVAMLAITGYVIKKSKGKGETDLANEEDGRLETV

SEQ ID NO: 36568 - DNA, 1896 bp, Haloarcula marismortui ATCC 43049
  CDS (1)..(1896): transl_table=11
atgacacaggtaatctggatcgtcctggcagtactggtgacgttcagcgtggggtatctggggtattcgaagtacctcgcgcggttcctcgaactcgacgacgacaacgagacaccggcgcacaagtacgaagacgggcaagaatacgtcccgtcgaagaaaccggtgttgctgggtcaccactactccagtatcgcgggtggggcaccgattgtcggaccgattacggcgggcgctgtgtgggggtgggttcccgcactcctgtggattgccatcggtaacccgctgatggggagcgtccacgacttcgtctcgctgtcggggtcgctcagacacgaggggaagtcaatcggctacattattggtgagtacatcggggaagggggcaagaacatgctgctgtggttcgcgttcctgaccatcatcctcgtcgtcgcggtgttcgcgctggtggtcgccatcgtgttcgacgcgttcccacaggtgacgaccgcgagcttcgtttacatcgtactggcgctggtgtttggcgtgtatctctaccagttgaacggaccgttcctcccgggaacagttctgttcgtcgctggtgtgttcgccggcgtgtacgtgggaattctgaaccccgttgcgctgttcccggccgtcggcgagacgagctaccccgcaggcacgctcgtgctcgcggacgtgctgaacctcggcactggacagtggattcccgggtcgtctgcgacggcgatgaaccccaaccgtgcggcgtgggtgccgataatcatggtgtacgcgggcattgcgagcgcgctcccggtgtgggtgctgctccagccgcgtgactacctctcgtcgttcctgctgtacgccggcgtcggcggttcgctggtggctgtcatcgtcggcacgattttcggcacggctgccaccgagaccggctcgctggtcatcgcggactcgatgggtgcattcaacggcttctggggtgtcgagggcgcgggcctcgcaccgctgttcccgctgctgttcattaccatcgcctgcgggacgatcagtggcttccactcgctggtgtcctctgggacgacagccaagcagctgaacaaggagaccgacgcccgcctcatcgggtacggtgggatgctcggcgagggactgctggccgccgtcgcactgtcgacgctcgccgtggccggcttcgctgatcccgccggcggtatcggtgctgcgttgccgaacttcgcgacgggtggcggcatcatcttcaccagtctcggcatcccccagaccttcggcgcaccgttcatggcgctcgtattggtgagtttcctgctgacctccacggacacggccgtccgactcggccggtacatgatggaggagatcgtcgggctccgggcgggcgaaacggcttccggattcaacgtcggcggcggcatccgttcgaccctcggcgaaatcgggcgcggccgctacacgaacccgctcgtgcaggccatcccggcctatctgatggttatctccggcgagtggctcacgctctgggccctgttcggcggtgcgaaccagctgctcgcggcgctggcgctgctgaccgcgactgtctggctcgcgaactgggacgacaacaagcagctgtactccacgggcgtgccgatggccatcatgacgactatcactattctggggctgtcttggctggcgttctacagcaacctctaccagaacctcattcagggcggtgccgaggggactgcggccatcgcgtcctcgaccgtccagatggtactggcgctggtcctcatcggcctcgcgctggccctcgtgaagaaagggtacgacaacatcagcacggtccgtgaccgtgggcccgccagcgcggtcgaaccaggcgacgactga

SEQ ID NO: 36569 - protein, 631 aa, Haloarcula marismortui ATCC 43049
MTQVIWIVLAVLVTFSVGYLGYSKYLARFLELDDDNETPAHKYEDGQEYVPSKKPVLLGHHYSSIAGGAPIVGPITAGAVWGWVPALLWIAIGNPLMGSVHDFVSLSGSLRHEGKSIGYIIGEYIGEGGKNMLLWFAFLTIILVVAVFALVVAIVFDAFPQVTTASFVYIVLALVFGVYLYQLNGPFLPGTVLFVAGVFAGVYVGILNPVALFPAVGETSYPAGTLVLADVLNLGTGQWIPGSSATAMNPNRAAWVPIIMVYAGIASALPVWVLLQPRDYLSSFLLYAGVGGSLVAVIVGTIFGTAATETGSLVIADSMGAFNGFWGVEGAGLAPLFPLLFITIACGTISGFHSLVSSGTTAKQLNKETDARLIGYGGMLGEGLLAAVALSTLAVAGFADPAGGIGAALPNFATGGGIIFTSLGIPQTFGAPFMALVLVSFLLTSTDTAVRLGRYMMEEIVGLRAGETASGFNVGGGIRSTLGEIGRGRYTNPLVQAIPAYLMVISGEWLTLWALFGGANQLLAALALLTATVWLANWDDNKQLYSTGVPMAIMTTITILGLSWLAFYSNLYQNLIQGGAEGTAAIASSTVQMVLALVLIGLALALVKKGYDNISTVRDRGPASAVEPGDD

SEQ ID NO: 36570 - DNA, 2076 bp, Geobacillus kaustophilus HTA426
  CDS (1)..(2076): transl_table=11
gtgaaggggctaaaatcgattttgttatggggcctgatttccgtccttggggccgcagcgtttgccattttggctttaagccgcggcgaatcggtcaacgccatgtggcttatcgtcgccgccgtctgcacgtatgcggtcgcttatcggttttacagccggtttatcgcccgcaaagtgtttggtcttgatgataaccggaaaacgccagcggaagtgttcaatgacgggaaggactatgttccgacgaacaaatgggtgctatttggccatcactttgccgctattgcgggtgcgggaccgcttgtcggaccgattttggccgcgcagatgggctatctgcctgggacgctttggattgtgatcggcgttgtgctcggcggagcggtgcaagactttgtcattttgttcgcttcgatgcgccgcaacgggaagtcgctcggcgaaatgattaaggaagaaatgggtccggtgacgggctttatcgcagcgcttggcattttgggcattatgattattttattggccgtattggcgctcgttgtcgtgaaagcgcttgtcggaagcccgtgggggatgtttacgatcgccgcgacgattccgattgcgattttgatgggcatttacatgcgcttcatccgtccagggcgcgttgctgaagcgtcgcttgggggatttgtgctgttgattttgtcgatcgtggtcgggcaatatgtcgcggagcacccgacgctctcggcgatgtttacgctaaaaggggaaacgatcgccatcttaatgatcatttatggctttgtcgcttcggcgttgccggtatggctgttgttggcgccgcgcgactatttgagcacgttcttgaaaatcggcacgattgtcggattggcgctcggcattttcgtcgtcatgccggacttgcaaatgccggcagtgacgaaatttatcgatggcaccgggccggtgtttgcaggcaacttgttcccgttcttgttcattacgatcgcttgcggcgcggtgtctggattccacgcgctcgtttcatccggcacaacgccgaagatgattgagcttgaaagccatgcgcggccgatcggctacggtgcgatgctgatggagtcgttcgtcgctgtcatggcgatggtggcggcttgcgtcttgacgccaggggcgtattttgccatcaacagcccggctgctgtcatcggaaccgatgtggcgcaggcggcaaaagtggtatcgtcatggggcttcaccgtcacgccggatatgcttgcgcagttggcgaaagacgtcggcgaacaaacggtgttgtcacgcacgggcggggcgccgacgttggcgatcgggatggcgcacattttatcgagcgtcatcggcggcaaggcgcttatggcgttctggtatcactttgccatcctgtttgaagcgctgttcatcttgacgacgattgacgccggcacgcgcgtcggccgtttcatgatccaagacattatgggcacgttttacaaaccgctcggcaaaacggattcgcttgcctcgaacttgatcgctacgaccctttgcgtactggcgtggggttacttcctgtaccaaggcgtcgtcgacccgctcggcggcatcaacacgctatggccgctgtttggcatcgccaatcaaatgttggctggcatcgccttgttgtttgcgacgacggttctatttaaaatgggcaaaaaggcatatgtttgggtcacgctcgtgccgacaacatggcttttggtcgtcacgctgacagccgggtatcaaaaactgttccacgaaaatgtcaaaattggtttcttgtcgcatgcgaaaatgttccaagacagcttgagccaaggcaaaattttggcgccggcaacgaatgaggcgcaaatgcggcaaattattatgaacgattacattgatgcgacattgtgcgcgattttcatgctcgttgtgatcgcgatgctgatctcggcgttgaacatttggatcaaagtattgcaaaacaaacatgtgccgctcaaggaagcgccgtacgtgccgcgcgatggagaaggagcgaagcactatgcctaa

SEQ ID NO: 36571 - protein, 691 aa, Geobacillus kaustophilus HTA426
MKGLKSILLWGLISVLGAAAFAILALSRGESVNAMWLIVAAVCTYAVAYRFYSRFIARKVFGLDDNRKTPAEVFNDGKDYVPTNKWVLFGHHFAAIAGAGPLVGPILAAQMGYLPGTLWIVIGVVLGGAVQDFVILFASMRRNGKSLGEMIKEEMGPVTGFIAALGILGIMIILLAVLALVVVKALVGSPWGMFTIAATIPIAILMGIYMRFIRPGRVAEASLGGFVLLILSIVVGQYVAEHPTLSAMFTLKGETIAILMIIYGFVASALPVWLLLAPRDYLSTFLKIGTIVGLALGIFVVMPDLQMPAVTKFIDGTGPVFAGNLFPFLFITIACGAVSGFHALVSSGTTPKMIELESHARPIGYGAMLMESFVAVMAMVAACVLTPGAYFAINSPAAVIGTDVAQAAKVVSSWGFTVTPDMLAQLAKDVGEQTVLSRTGGAPTLAIGMAHILSSVIGGKALMAFWYHFAILFEALFILTTIDAGTRVGRFMIQDIMGTFYKPLGKTDSLASNLIATTLCVLAWGYFLYQGVVDPLGGINTLWPLFGIANQMLAGIALLFATTVLFKMGKKAYVWVTLVPTTWLLVVTLTAGYQKLFHENVKIGFLSHAKMFQDSLSQGKILAPATNEAQMRQIIMNDYIDATLCAIFMLVVIAMLISALNIWIKVLQNKHVPLKEAPYVPRDGEGAKHYA

SEQ ID NO: 36572 - DNA, 2151 bp, Salmonella enterica subsp. enterica serovar Paratyphi A str. ATCC
  CDS (1)..(2151): transl_table=11
atggatacgaaaaagatattcaagcacataccctgggtgattctcggaatcatcggtgctttctgcctctcggtcgttgccctacgtcggggtgaacacgtgagcgccctgtggatcgtggtcgcttccgtttccgtctatctggtggcttaccgctactacagcctgtacatcgcccagaaggtcatgaaactcgacccgacgcgcgcgacgccggcggttatcaataacgacggcctgaactacgtgccgactaaccgctacgtgctgtttggtcaccacttcgccgccatcgccggcgcaggtccgctggtcgggccggtattggccgcgcagatgggctatctgccggggacactgtggctgctagcgggcgtggtgctcgcgggcgcagtgcaggactttatggtgctgttcatctcttcccgccgtaacggcgcctctcttggcgagatgatcaaagaagagatgggtaccgttccaggcaccatcgcgctgttcggctgcttcttaattatgatcatcatcctcgcggtgctggcattaatcgtggttaaagcgctggccgaaagcccgtggggcgtcttcaccgtctgctcaacggtgccgattgcgctgtttatgggcatctacatgcgcttcctgcgtccgggacgcgtaggcgaagtctccgttattggtatcgtgctgctggtggcgtctatttacttcggcggcgtgattgcccacgacccgtactggggcccggcgctgacctttaaagacaccaccattaccttcgcgctgatcggctacgcatttgtttccgcgctgctgccggtatggctgatcctcgccccgcgcgactatctcgctaccttcctgaaaatcggcgtgatcgtcggtctggcgctggggattgtgatcctcaacccggaactgaaaatgccggcgttgacgcagtacgtcgacggtaccggcccgctgtggaaaggtgctctgttcccgttcctgttcatcaccatcgcctgtggcgccgtctctggcttccacgcgctcatctcttccggtaccacgccgaaactgctggcctgtgagaccgatgcgcgttttatcggctacggtgcgatgctgatggagtcctttgttgcggtgatggcgctggtggcggcctcgatcattgaaccgggtctctacttcgcgatgaacaccccgccggcaggtctgggcattaccatgccaaacctgcacgagatgggcggcgagaacgcgccgctgattatggcgcagttgaaagacgttaccgcacatgcagcggcgaccgtcagctcctggggctttgtgatttccccggaacaaatcctgcaaactgcgaaagatatcggtgaaccgtcagtattgaaccgcgcaggcggcgcgccaacgctggcagtaggtatcgcgcatgtgttccacaaagtcctgccgatggcggatatgggcttctggtatcacttcggtattctgttcgaagcgctgtttatcctgaccgcactggatgcgggtacccgttccggccgctttatgttgcaggatttactgggtaacttcgtcccgttcctgaaaaaaaccgattctctggtcgcgggtatcatcggtaccgcaggctgcgtcggtttgtggggctatctgctgtatcagggcgtggtcgacccgctgggcggcgtgaagagcctgtggccgctgttcggtatctctaaccagatgctggccgccgtggcgctggtgttgagcaccgtggtactgatcaaaatgcagcgcaccaagtacatctgggtgacggtaatcccggcggtatggctgctgatctgcaccacctgggcgctgggcctgaaactgttcagcgccaacccacagatggaaggtttcttctacatggcaaacctgtataaagagaagattgccaacggcaccaacctgaccgcgcagcagattgccaatatgaaccatatcgtggtgaacaactacactaacgctggtttgagtattctgttcctggtggtggtgtacagtattatcttctacggtttcaccacctggatgaaggtacgcaacagcgataaacgtaccgacaaagaaaccccgtatgtgcccgtgccggaaggcggcgtgaagatctcttcacaccactaa

SEQ ID NO: 36573 - protein, 716 aa, Salmonella enterica subsp. enterica serovar Paratyphi A str. ATCC
MDTKKIFKHIPWVILGIIGAFCLSVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGTVPGTIALFGCFLIMIIILAVLALIVVKALAESPWGVFTVCSTVPIALFMGIYMRFLRPGRVGEVSVIGIVLLVASIYFGGVIAHDPYWGPALTFKDTTITFALIGYAFVSALLPVWLILAPRDYLATFLKIGVIVGLALGIVILNPELKMPALTQYVDGTGPLWKGALFPFLFITIACGAVSGFHALISSGTTPKLLACETDARFIGYGAMLMESFVAVMALVAASIIEPGLYFAMNTPPAGLGITMPNLHEMGGENAPLIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFVPFLKKTDSLVAGIIGTAGCVGLWGYLLYQGVVDPLGGVKSLWPLFGISNQMLAAVALVLSTVVLIKMQRTKYIWVTVIPAVWLLICTTWALGLKLFSANPQMEGFFYMANLYKEKIANGTNLTAQQIANMNHIVVNNYTNAGLSILFLVVVYSIIFYGFTTWMKVRNSDKRTDKETPYVPVPEGGVKISSHH

SEQ ID NO: 36574 - DNA, 1680 bp, Idiomarina loihiensis L2TR
  CDS (1)..(1680): transl_table=11
atgaacgcaatcgtaatgatggttctgggtttaggcgcaatgtttctcggttatgttttttactctaaatttattgctgagaaaatttttaagcttgatccgaacttcagaacacccgctcacgaattagaagacggagtcgacttcgtccctaccaataaatacgttctgtggggccaccactttacttctgtagccggtgcggcacctattattggtcctgccattgcggttatctggggttgggtacctgctttcttatgggttattttcggtaccatattttttgctggcgtacacgacgctggcgcgatctgggcaagtaaccgtaataaagccaaatctattggtaacttgactggcgatgttgttggcaaacgctctcaaacgctgttcatgatcgttatcttccttgtcttactaatggtcaacgcggttttcgctactgctatttcaggtctgttgattaaattctccagctcagtagtgccagtttggggtgctatttttgtcgcacttattatcggacaaattattttccgtaaatggatgggcttaggtgcaatatccattatcggtgtactggcactgtacgcacttatctgggcaggtccctcatttccaatagaattgccagaaacggtaatgggtatcagtgacaacgcgcaatgggttcttatcctgtttggctacgccgctatcgcttcattactgcctgtttggatgttgcttcagccacgtgactacatcaacggtctgcagctcttcattggtcttattttgctttacggtgccacgttattactggctccggaaatttcagctccggccttcaatagcaataccccagaaggcaccccgtcaatgttgccgctgttattcgtcaccatagcctgtggggcaatttcgggcttccacggtctggttgcatcgggtacaacctcgaagcaacttgataaagaaaccgacgcccgttttgtcggatactttggtgcggttggtgaaggctcattgtcgctggcgactatcatcgccgccacagccggttttgcaacattagccgactgggaagcggtctactcatctttcggacaaggcggcgtatcagcctttgttgaaggtggcgccaacattattagtcaggggctaggcctggacattggcgtatcagaaaccctgctgacggtaatggctgtgctttttgccggtaccacaatggatactggattacgtctgcaacgctatattttccaggaatggggaaacttgtataacattaactggatgcaaaaagcctttccggcaacgatgctagctgtaggaagctgcttattgttagccttcggtgctggcggcgcagacggttccggcggcttagttatctggcctctgttcggtaccacaaaccagttattagcagggttgaccttgttggttattacggtcatgttggtgcgcttaggccgaccaatgtattacaccttaataccgttaattttcctgttgataatgacagtcttcgctcttattgttcagcttaaagatttctataacagcggtgactggttcttaatgggtctggatttagtggtgctggttgccgctatctggattgctcttgaagctagcgcaggcttaactaaaatccgtaaggaacaaaaagcccagaagcagcaataa

SEQ ID NO: 36575 - protein, 559 aa, Idiomarina loihiensis L2TR
MNAIVMMVLGLGAMFLGYVFYSKFIAEKIFKLDPNFRTPAHELEDGVDFVPTNKYVLWGHHFTSVAGAAPIIGPAIAVIWGWVPAFLWVIFGTIFFAGVHDAGAIWASNRNKAKSIGNLTGDVVGKRSQTLFMIVIFLVLLMVNAVFATAISGLLIKFSSSVVPVWGAIFVALIIGQIIFRKWMGLGAISIIGVLALYALIWAGPSFPIELPETVMGISDNAQWVLILFGYAAIASLLPVWMLLQPRDYINGLQLFIGLILLYGATLLLAPEISAPAFNSNTPEGTPSMLPLLFVTIACGAISGFHGLVASGTTSKQLDKETDARFVGYFGAVGEGSLSLATIIAATAGFATLADWEAVYSSFGQGGVSAFVEGGANIISQGLGLDIGVSETLLTVMAVLFAGTTMDTGLRLQRYIFQEWGNLYNINWMQKAFPATMLAVGSCLLLAFGAGGADGSGGLVIWPLFGTTNQLLAGLTLLVITVMLVRLGRPMYYTLIPLIFLLIMTVFALIVQLKDFYNSGDWFLMGLDLVVLVAAIWIALEASAGLTKIRKEQKAQKQQ

SEQ ID NO: 36576 - DNA, 1626 bp, Bacillus clausii KSM-K16
  CDS (1)..(1626): transl_table=11
gtgaattttgtgacgcttatgcttatttgcgttgccttgttaattgtcgcctatttcacttatggaaaatacttggagcgtcgcttaaaaattgacggacaacggacaacgcctgcacatacgttctatgacggacaggagtatattccgacgaaaacgcctgtactgcttggccatcatttcacgacaattgcaggcggcggtccgattactgggccaattgccgcgattgtgttcggctggctgcctgccgttctatggattataatcggcagcatttttgtaggcggcacccatgattatgcatctttgcaagcttccattcgccataaagctaagtcgattggcgaagtcattaaagaacatatggggaaacgtgggcagttaatgttcttagccttttcgatagcgacgttaattttgatcattggcgtctttatcattctagttgcaaatacgtttgtgtcctttccaggcgcagccactgcttcccttttgtttattgctgtcgcgatgggtttcggcgttcttgtcaaccaagtgcgcatccatttagcgcttgcaacgttgcttggcgtcgtcgccatggcactatcggtttggattggcctaagctttccaatcacccttagtgctactgcttggtcgctcattttaatcgtttacgcctatttcgcgtccgtgttgcctgtctggtttttactacaaccccgtgattacttaaattcatttttgctctattttctaattggtggcgcatttttaggtttgttaatcgctaggcctactattcaaatgcctgcctttaccggtttttataatgatacgctcggctttttgtttcccattttgtttattacaattgcatgtggggcgatttccggcttccattcactcgtttcgtcgggaacaacgtccaaacagctgaataacgaaaagaatggccgctttgtcgcttacggttccatgttaatcgaagcatttgttgccatcatcgcgattggttccgttgcttatttaacacttgaccaatttaatgcgcttatggccgaactgaatgatccgattagtgtgttttccgtgggcattggacactttatgaacacgtggggattgcctgtggcagctggtgttacgtttacggcactcgctgcatcggcattcttaatgacaacacttgactcggccacgcggctcatgcgttatgctgttacggaactaggcgaaagcatcaacgtgcagttgcttcgtaataagcatacggcaaccgtactcggcttaataggagcaacgacgcttgccctttccggcacatggcaaagcgtatggccgctgtttggcgccgccaaccaaatgcttggggcgttggctctccttgccattaccttatggcttgtgaaaacaaaatcgaaagcattgtttgtgatcatccctatggtgtttatgtttattgtcaccacatcagcgcttctcgttatgatgcattccaattttcttgccggtgattacttgctcgttgttgcttctttcatcctatttgtgatgtgcgtattcctcggcatcgagggggcccgcagtgttacaaaacctaaaaacaagcaaaaaccaactgatttaaacgcataa

SEQ ID NO: 36577 - protein, 541 aa, Bacillus clausii KSM-K16
MNFVTLMLICVALLIVAYFTYGKYLERRLKIDGQRTTPAHTFYDGQEYIPTKTPVLLGHHFTTIAGGGPITGPIAAIVFGWLPAVLWIIIGSIFVGGTHDYASLQASIRHKAKSIGEVIKEHMGKRGQLMFLAFSIATLILIIGVFIILVANTFVSFPGAATASLLFIAVAMGFGVLVNQVRIHLALATLLGVVAMALSVWIGLSFPITLSATAWSLILIVYAYFASVLPVWFLLQPRDYLNSFLLYFLIGGAFLGLLIARPTIQMPAFTGFYNDTLGFLFPILFITIACGAISGFHSLVSSGTTSKQLNNEKNGRFVAYGSMLIEAFVAIIAIGSVAYLTLDQFNALMAELNDPISVFSVGIGHFMNTWGLPVAAGVTFTALAASAFLMTTLDSATRLMRYAVTELGESINVQLLRNKHTATVLGLIGATTLALSGTWQSVWPLFGAANQMLGALALLAITLWLVKTKSKALFVIIPMVFMFIVTTSALLVMMHSNFLAGDYLLVVASFILFVMCVFLGIEGARSVTKPKNKQKPTDLNA

SEQ ID NO: 36578 - DNA, 1458 bp, Bacillus clausii KSM-K16
  CDS (1)..(1458): transl_table=11
atgtatacatttttgggagcgcttgcactattaataattgggtatttcacttacggaagatttgtcgaaaaagtgttccagccaaaggcggaaaggacgacgcctgcctatacgaaacacgatggcgtcgactatttgccgatgggcaaaaagaaaaacgcattgattcagttgattagcattgctggggtagggccgatttttgggccgattatgggtgcgctttacgggcctgtcgccttcatctggatcgtactcggctgtatttttgcaggtgcagtccatgactatttgacagggatgatttcgattcgaaatggcggcgcccacttgcctgagctagcgggaaagtttctagggaaagcgatgaaacacgtggtcaacgcattctcgatcttgcttttgctgctcgtcggtaccgtctttgtcgcctcgccagctgacttgctttatgatctggtcaatggttctgtgccagttgttgtctttgttgtcctcatctttttctattttctattggcaacgatcctgccgatcaataaaatcattggcagcatttatccttatatcggtgccttgctgctgtttagcacggtaggaattggcttggcccttgtttggaaccaagcgccgattccagaattgtcccttgccaatacccatcccgagggagcggcaatttttccgctgttgttcttgacgatttcttgtggggcgctatctggtttccacgccacgcaatcgccaatcatttcgcggacgacacaaaatgaaagccaagggcgcaacattttttatgggatgatgattgcagagggcatgatagcgatgatttgggcagcggcagcaatgagtttatttgatggccctgtcacgcttaacgaattaatctccacgataggcacaggcggcattgtgtctgaaatttctacaatgatgctaggcccaattgttggcacactagcgattctcggcgtcattattttgccgattacatctggcgataccgcttttcggagtgcgcgaatgattattgccgattatatcaacgtgccgcaaaagaaagtgatgaaccgcatttggattgccgcgccattgttcattacgtctatcattttaacgacagtagacttcacaatgctgtggcagtactttaactgggcgaaccaatcgaccgccgtcatcgccctttggatcggcgccatgttcttatacattgcccgccgaaattactggattgcgatttttccagcctggtttatgagtgtgacggcagcgacctatatcgtcaatgcgccaatcggctttaacttgccaatgcaagcatccgttatcatcggcgtaggctttaccgtccttttgactgttttattttttaaagcagcccataaacgccggagcgaaaacctcccgattgaagaagatatttccgaatgggaaaacaaacaaagcgcgtaa

SEQ ID NO: 36579 - protein, 485 aa, Bacillus clausii KSM-K16
MYTFLGALALLIIGYFTYGRFVEKVFQPKAERTTPAYTKHDGVDYLPMGKKKNALIQLISIAGVGPIFGPIMGALYGPVAFIWIVLGCIFAGAVHDYLTGMISIRNGGAHLPELAGKFLGKAMKHVVNAFSILLLLLVGTVFVASPADLLYDLVNGSVPVVVFVVLIFFYFLLATILPINKIIGSIYPYIGALLLFSTVGIGLALVWNQAPIPELSLANTHPEGAAIFPLLFLTISCGALSGFHATQSPIISRTTQNESQGRNIFYGMMIAEGMIAMIWAAAAMSLFDGPVTLNELISTIGTGGIVSEISTMMLGPIVGTLAILGVIILPITSGDTAFRSARMIIADYINVPQKKVMNRIWIAAPLFITSIILTTVDFTMLWQYFNWANQSTAVIALWIGAMFLYIARRNYWIAIFPAWFMSVTAATYIVNAPIGFNLPMQASVIIGVGFTVLLTVLFFKAAHKRRSENLPIEEDISEWENKQSA

SEQ ID NO: 36580 - DNA, 2112 bp, Campylobacter jejuni RM1221
  CDS (1)..(2112): transl_table=11
atgactcagttaagtactaaaattttatggttgtttgttgcaactttaggcgctatttgttttggttatttagctttacaaaatggcgaaagtgtatcagcgatttatttggtggttgctgctgtatgtatttatatgataggatatagattttatgggcgttttgtagcttataaggttttagaacttgataaaaatcgtgcaacaccagcacttgtagaaaatgatgggcgtgattttgtgcctacaaataaagctgtattatttggacatcattttgctgctattgcaggagcaggtccattagtaggacctatcttggctgctcaaatgggatatttgccttccatgctttggattttagtaggaggagttttagcgggtgctgtgcatgattttgttgttctttttatatctactcgtagaaaaggtagaagtcttggcgagatgattaaggatgagatgggtaaatttacaggtggagttgctatggtggcgatttttggcattatgcttattattattgccattttagctatggtggttgtaaaagctttagcagaatctccatggggtttatttactatcgcaatgactattcctatagcaatatttatgggcatttatatgcgttttatccgtccaggtagagtaggggaggcttctataataggttttgtgcttttaattttggctattcattatggtagcgttatagctgctgatccttattgggctaaaatatttactttagaagctccaattttggcaattgttatgatggcttatggttttattgcttctgttttacctgtgtggtttttacttgctccaagagattatctttcaacttttttgaaaatcggtgttattgtggtaatggctgtagctattgttttggttgctcctgatttacaaatgccaaaagcaaatactcagtattttgatggaacaggtccagtatttgcaggtggagtgtttccatttttatttattaccattgcttgtggtgcgatcagtggttttcatgctttgatttctagtggaactactcctaaaatgcttgaaaacgaaactcatgctttggctgttggatatggctctatgcttgctgagagtgctgtggcgattatggctttaatttgtgcttgtattttacatccaggtctttattttgctataaattcaagctctgctttgataggaacagatgttgtaaatgtagcacaaactatttcaagttggggatttagtattactcctgaagaaattactactttaaccacaaatataggagagcatactatactttcaagaacagggggagccccgacttttgctataggtgtagctttgatcttacatgaactttttggcggcgtggatttgatggctttttggtatcattttgctatattgtttgaagctttatttattttaacagcggtggatgctgggacaagggcttgtcgttttatggtgcaagatatattgggtaatgtttataaacctttaggagatattcataattatccagctggacttttggctacggctttaagtgttgcaggttggggatattttctttatcaaggtgccattgatcctaagggaggaatttatacgctttggcctctttttggcgtgagtaatcaaatgcttgcgggtatggctttgcttcttgctacaactatacttgtaaaaatgggcaaggcaagatatacttgggttactttagtacctgcggtatttgtcttagtggcaactctgtatggaggaattcaaaaaattatgccttatgaagaaggcaataaagtagcaaatgcggtaagtcatgtagccgccgttagcatacaaagtcaaaaaattaaagatttagaatttaaattaaataatactaaagatgaaaaagaaatttctgtaattaaaaaagaaatttcaatagccactcaaagtaaagttggaaatttgcttaatgcaattctttgtgtgttctttatgatagctaccttgcttgttataatttcttgtataggaatttgtttaggtaaaattaaaattcctcttaaagaaactaagtatattaagattgatgaatttcaaaaaatttaa

SEQ ID NO: 36581 - protein, 703 aa, Campylobacter jejuni RM1221
MTQLSTKILWLFVATLGAICFGYLALQNGESVSAIYLVVAAVCIYMIGYRFYGRFVAYKVLELDKNRATPALVENDGRDFVPTNKAVLFGHHFAAIAGAGPLVGPILAAQMGYLPSMLWILVGGVLAGAVHDFVVLFISTRRKGRSLGEMIKDEMGKFTGGVAMVAIFGIMLIIIAILAMVVVKALAESPWGLFTIAMTIPIAIFMGIYMRFIRPGRVGEASIIGFVLLILAIHYGSVIAADPYWAKIFTLEAPILAIVMMAYGFIASVLPVWFLLAPRDYLSTFLKIGVIVVMAVAIVLVAPDLQMPKANTQYFDGTGPVFAGGVFPFLFITIACGAISGFHALISSGTTPKMLENETHALAVGYGSMLAESAVAIMALICACILHPGLYFAINSSSALIGTDVVNVAQTISSWGFSITPEEITTLTTNIGEHTILSRTGGAPTFAIGVALILHELFGGVDLMAFWYHFAILFEALFILTAVDAGTRACRFMVQDILGNVYKPLGDIHNYPAGLLATALSVAGWGYFLYQGAIDPKGGIYTLWPLFGVSNQMLAGMALLLATTILVKMGKARYTWVTLVPAVFVLVATLYGGIQKIMPYEEGNKVANAVSHVAAVSIQSQKIKDLEFKLNNTKDEKEISVIKKEISIATQSKVGNLLNAILCVFFMIATLLVIISCIGICLGKIKIPLKETKYIKIDEFQKI

SEQ ID NO: 36582 - DNA, 1740 bp, Thermococcus kodakarensis KOD1
  CDS (1)..(1740): transl_table=11
atgaactctgctgtaattgttctggtggccgctgcaatatacgtggccatgtatttcacctacggtaagagccttcagaacaaggttgttaaggccgaccccaacagaccaacgccggcccacaagctatacgacggcgttgactacgtcccagcacacccgctcgtcctatatggacaccacttcgcttcgatagcaggtgcgggaccaatcgtcggtcctgcggtggcaatggcctggggttggctgccgggactgatctgggtctggtttggaaacgtcttcattggtgccgtccatgactacctcgcactgatgtcatctgtccgctatgatggtaagtccgtccagtggattgcaggaaagctcatgagcaagaggactggagtggcgttcgaactttacatatggtttaccctcctgctcgttgtagctgcgttcgtcgcggtaactgccaaactcctgacaataacccccgaggcggcaactgcaaccctgctcttccttctggtggcagtcatcctcggatggttgctctacaagatgaagatgaacttcacagtggcaacgataataggacttgtgctgctggccatatctgtctggataggccttaaccacccgcttgtcttcgttaacggtcagaccgacacaacctccgccgcctacaccaccgcataccactactggaacataatcctgctggtttatattatcgtagccgcttccctccctgtgtggattctcctccagcccagagactacctcaacgcatacatcctttggttcggcctgctcttcggaggcatagcctttgtactgctcgccaaggactttaccgcacccgcatacacatcttggagcgcctacgtaatcaagggtactgaggcagttccctcaccgttctggccaacggtgccgcttgtaatagcgtgtggtgcactcagcggcttccactccctcgtcggctccggaacttcaagcaagcaacttgacaacgagattcacggtctcctcgttggctatggtggcatgtttacagagggcttcctctcaaccattgtcataacggccatagcggtctacggcgtccagcttacaggtcttgaacctgccaagtgggcaacggaatacattaccaagggcggtcttggaaccttcatcggaggctacgctaagggcgtcagcgagttctacggcgtaagcgagacctttggaaagaccttcgctaccctctgggtctcggccttcacactgacttccctcgacaccgccacaagacttggaaggttcgcctggcaagagctcttcggaatgatcgccgacacgagccagggtatatggaagactatcaccaataagtgggttgcctcaataatcatagccggtctcggcacctggcttgcctggggtgcaagttacaaggttctctggccggctttcgcaggaatgaaccagctcttagcaagcatagcaatgatgactgcagccctttgggccgccaaggtccagagggccggaaagtggtcctgggccgtcctcctgccagcactgttcctctggataaccgtgactgcagcactgatatggtacatagcagtagtgccgctgagcggaagcaccctcatagcagtcaagggatcgctcctcatcggcctgctcctgaacttcctcctggcatgggacttctacattgcctggaagaggccagaagaggagtacgctgcagctgcggcctga

SEQ ID NO: 36583 - protein, 579 aa, Thermococcus kodakarensis KOD1
MNSAVIVLVAAAIYVAMYFTYGKSLQNKVVKADPNRPTPAHKLYDGVDYVPAHPLVLYGHHFASIAGAGPIVGPAVAMAWGWLPGLIWVWFGNVFIGAVHDYLALMSSVRYDGKSVQWIAGKLMSKRTGVAFELYIWFTLLLVVAAFVAVTAKLLTITPEAATATLLFLLVAVILGWLLYKMKMNFTVATIIGLVLLAISVWIGLNHPLVFVNGQTDTTSAAYTTAYHYWNIILLVYIIVAASLPVWILLQPRDYLNAYILWFGLLFGGIAFVLLAKDFTAPAYTSWSAYVIKGTEAVPSPFWPTVPLVIACGALSGFHSLVGSGTSSKQLDNEIHGLLVGYGGMFTEGFLSTIVITAIAVYGVQLTGLEPAKWATEYITKGGLGTFIGGYAKGVSEFYGVSETFGKTFATLWVSAFTLTSLDTATRLGRFAWQELFGMIADTSQGIWKTITNKWVASIIIAGLGTWLAWGASYKVLWPAFAGMNQLLASIAMMTAALWAAKVQRAGKWSWAVLLPALFLWITVTAALIWYIAVVPLSGSTLIAVKGSLLIGLLLNFLLAWDFYIAWKRPEEEYAAAAA

SEQ ID NO: 36584 - DNA, 1467 bp, Vibrio fischeri ES114
  CDS (1)..(1467): transl_table=11
atgctttggtttttaacttgtgttgcagcacttatcggtggttactttctgtatggtgcttttatagaaaaagtattcggtattaaagtagaccgtcaaactcccgctcatacaaaaacagacggtgttgattatgttccaatgtcgacaccaaaagtatacttagttcaacttcttaatattgcaggtgtcggcccaatttttggcccaatcatgggtgccctttacggccctgcagctatgttatggattgtgctaggttgtgtttttgcaggtgcagttcacgattacttctcaggtatgttatctgttcgtaatggtggtgcttctgtaccaagtattactggtaaatacttaggtaatggcgcaaaacactttatgaatgtatttgcaattgtactgctgcttcttgttggtgttgttttcgtatcagcccctgcaagcatgttaactaacctaatgaatgaccaatttaatttaggcattaccatgacagcaatggtagttatcattttcgcctactacattattgcgacaattgttcctgtagataaaatcattggtcgtttctacccactctttggtggcctactcatcttcatgtctgttggtcttatttcagcgattgcgatttctagtgaccattcagtattaggtggttacgaaccaagtcaaatgttcaccaacatgaaccctaatgatttgccattatggcctgcgctattcattaccattgcttgtggtgctatctctggcttccacgcgacacaatcgccattaatggctcgttgtatggaaaatgaaaagaacggtcgtttcgtattctacggtgcgatgattggtgaaggtattatcgctcttatctggtgtgctatcgctctatcattctttgatggtatggaagcacttcaagcagcggttgctaacggtggcccaggtaatgtggtatacagctctgcatttggtctattaggtacattcggtggcatcattgctttcttaggtgtggtaattctaccaatcacttctggtgacacagcattccgttcaagccgtctaatccttgctgaatacttcaacatggaacaaaaaacattacgtaaccgtctattaatggcactaccactgtttgttatcggtggcattctaactcaagtagatttcggtattatctggcgctacttcggttttgctaaccaaacgactgcggtaatgatgctttggacagcaacggcttacctagttcgtcataacaaactacactggatcacaaccgttcctgcagtatttatgacaagtgtttgtattactttcattctaaacaacagtcagttaggttttggtttaccaatgacgctatcaacgattacaggtgtagtatcagcggtagccattgcagctcttgtaattattaaatcaagaaacagtggcgaagttgattctgaagaagaaagccttcaatcttaa

SEQ ID NO: 36585 - protein, 488 aa, Vibrio fischeri ES114
MLWFLTCVAALIGGYFLYGAFIEKVFGIKVDRQTPAHTKTDGVDYVPMSTPKVYLVQLLNIAGVGPIFGPIMGALYGPAAMLWIVLGCVFAGAVHDYFSGMLSVRNGGASVPSITGKYLGNGAKHFMNVFAIVLLLLVGVVFVSAPASMLTNLMNDQFNLGITMTAMVVIIFAYYIIATIVPVDKIIGRFYPLFGGLLIFMSVGLISAIAISSDHSVLGGYEPSQMFTNMNPNDLPLWPALFITIACGAISGFHATQSPLMARCMENEKNGRFVFYGAMIGEGIIALIWCAIALSFFDGMEALQAAVANGGPGNVVYSSAFGLLGTFGGIIAFLGVVILPITSGDTAFRSSRLILAEYFNMEQKTLRNRLLMALPLFVIGGILTQVDFGIIWRYFGFANQTTAVMMLWTATAYLVRHNKLHWITTVPAVFMTSVCITFILNNSQLGFGLPMTLSTITGVVSAVAIAALVIIKSRNSGEVDSEEESLQS

SEQ ID NO: 36586 - DNA, 2082 bp, Neisseria gonorrhoeae FA 1090
  CDS (1)..(2082): transl_table=11
atgaaatcactcaaaaccttcctcatttggggcatagtggtactggtcggcttagcatcctttaccactctggccctcagccgaggcgaacaggtcagcgcggtatggatggttaccgccgccatatccgtttactgtatcgcctaccgtttttacagcctctacatcgccaaccgcgtgatgcggctcgatccgaaccgtctcacgcccgccgagcggcacaacgacggcttggactacgttccgacgcacaaaggcgtattgttcggacaccactttgccgcgattgccggcgcgggccctttggtcggtccggttttggcggcgcaaatgggttatctacccggtactttgtggattatcttcggcgtggtatttgccggcgcggtacaggatatgacggtcttgttcgtctctatgcgccgcgacggtaagtctttgggcgatattgtgaaacaggaactcggcactgtccccggcgtgattgcctccatcggtattttgatgattatggtcatcattatggcggttttggcgttgattgtcgtaaaagcattggttcacagcccttggggtacgttcaccattgccgcaacgatgccgattgcgctgtttatgggtatttacacgcgccatatccgtccgggcaaaatcggcgagatttccatcgtcggctttattttgctgatgttggcggtaatttacggcgaagatgtggcgaaaagctccatcgggcattggtttgaccttgacggcatccagctcacttgggcgattatgatttacggtttcgtggcttcggttttgccggtctggctcttgctgaccccgcgcgactatctctccaccttcctgaaaatcggtacgattgcggccttggctttgggtatcgtcatcgtcaatcccgctttgcaaatgcctgcggttacccactttatcgacggttcgggcccggtattctcaggcacattgttcccgttcttgttcattaccatcgcctgcggtgcggtttcgggcttccacgcactgatttcttccggcaccacgccgaaaatgctggaaaacgaaacccacgtccgtatgatcggttacggcggtatgttgatggaaagtttcgtggcgattatggcgcttgccgccgccgcatcgctcgatcccggcgtgtatttcgcgatgaacagccccgccgcactgatcggtacggatgccaacaccgccgccgaagtaattaccaccaagctgaacttccctgtcgatgccgcaaccctgttgcacaccgctaaggaagtgggcgaaaacaccatcttgtcccgcacaggcggtgcgcctaccctcgcagtcggtatggcgcacattatgagccgtctgattccgggcgaggcgatgatggcattctggtatcacttcgccctgttgtttgaagccttgttcatcctgaccgccgtcgatgccggtacgcgcgtcgcacgttttatgattcaagacttgggcagcatcttctacaaacctttcggcaacaccgactccatccccgccaacctgattgcgaccttcttcgccgtggcattgtggggctacttcctctacaccggcgtaaccgacccgctgggcggcatcaactcgctctggcctttattcggcatcgccaaccaaatgctggcaggcgtagccttgattatgtgtgccgttgtgctgattaagatgaaacgcgaccgttatgtctgggtggcactcgttcctgccgtcggcgtactgcttgtaacctgctacgccggtctgcaaaaactgttccacaacgacccgcgcgccagcttccttgcccacgcaggcaaatacagcgacacattggctaaaaacgaagtccttgcgcccgctaaagacatcggcgaaatggcgcaaatcatcttcaacgacaagattaatgccggtctgaccatcctcttcttgtcggttgtcgtgactgttgccgcgtacggtttgcgtaccgccctcaaagcacgcaaagtcggctggccgaccgccaaagaaatcccggcggtgtaccgcgacggcaaacaaccggaggaacaaagtgaagcataa

SEQ ID NO: 36587 - protein, 693 aa, Neisseria gonorrhoeae FA 1090
MKSLKTFLIWGIVVLVGLASFTTLALSRGEQVSAVWMVTAAISVYCIAYRFYSLYIANRVMRLDPNRLTPAERHNDGLDYVPTHKGVLFGHHFAAIAGAGPLVGPVLAAQMGYLPGTLWIIFGVVFAGAVQDMTVLFVSMRRDGKSLGDIVKQELGTVPGVIASIGILMIMVIIMAVLALIVVKALVHSPWGTFTIAATMPIALFMGIYTRHIRPGKIGEISIVGFILLMLAVIYGEDVAKSSIGHWFDLDGIQLTWAIMIYGFVASVLPVWLLLTPRDYLSTFLKIGTIAALALGIVIVNPALQMPAVTHFIDGSGPVFSGTLFPFLFITIACGAVSGFHALISSGTTPKMLENETHVRMIGYGGMLMESFVAIMALAAAASLDPGVYFAMNSPAALIGTDANTAAEVITTKLNFPVDAATLLHTAKEVGENTILSRTGGAPTLAVGMAHIMSRLIPGEAMMAFWYHFALLFEALFILTAVDAGTRVARFMIQDLGSIFYKPFGNTDSIPANLIATFFAVALWGYFLYTGVTDPLGGINSLWPLFGIANQMLAGVALIMCAVVLIKMKRDRYVWVALVPAVGVLLVTCYAGLQKLFHNDPRASFLAHAGKYSDTLAKNEVLAPAKDIGEMAQIIFNDKINAGLTILFLSVVVTVAAYGLRTALKARKVGWPTAKEIPAVYRDGKQPEEQSEA

SEQ ID NO: 36588 - DNA, 2151 bp, Salmonella enterica subsp. enterica serovar Choleraesuis str
  CDS (1)..(2151): transl_table=11
atggatacgaaaaagatattcaagcacataccctgggtgattctcggaatcatcggtgctttctgcctctcggtcgttgccctacgtcggggtgaacacgtgagcgccctgtggatcgtggtcgcttccgtttccgtctatctggtggcttaccgctactacagcctgtatatcgcccagaaggtcatgaaactcgacccgacgcgcgcgacgccggcggtcatcaataacgacggcctgaactacgtgccgactaaccgctacgtgctgtttggtcaccacttcgccgccatcgccggcgcaggtccgctggtcgggccggtattggccgcgcagatgggctatctgccggggacactgtggttactggcgggcgtggtgctcgcgggcgcagtgcaggactttatggtgctgttcatctcttcccgccgtaacggcgcctctcttggcgagatgatcaaagaagagatgggtaccgttccaggcaccatcgcgctgttcggctgcttcttaatcatgatcatcatcctcgcggtgctggcattaatcgtggttaaagcgctggccgaaagcccgtggggcgtcttcaccgtctgctccacggtgccgattgcgctgtttatgggcatctacatgcgcttcctgcgtccgggacgcgtaggcgaagtctccgttattggtatcgtgctgctggtggcgtctatttacttcggcggcgtgattgcccacgacccttactggggcccggcgctgacctttaaagacaccaccattaccttcgcgctgatcggctacgcctttgtttccgcgctgctgccggtatggctgatcctcgccccgcgcgactatctcgccaccttcctgaaaatcggcgtgatcgtcggtctggcgctggggattgtgatcctcaacccggaactgaaaatgccggcattgacgcagtatgtcgacggtactggcccgctgtggaaaggcgctctgttcccattcctgttcatcaccatcgcctgtggcgccgtctctggcttccacgcgctcatctcttccggtaccacgccgaaactgctggcctgtgagaccgatgcgcgttttatcggctacggcgcgatgctgatggagtcctttgttgcggtgatggcgctggtggcggcctcgatcattgaaccgggtctctacttcgcgatgaacaccccgccggcaggtctgggcattaccatgccaaacctgcacgagatgggcggcgagaacgcgccgctgattatggcgcagttgaaagacgttaccacacatgcagcggcaaccgtcagctcctggggctttgtgatttccccggaacaaatcctgcaaactgcgaaagatatcggtgaaccgtcagtattgaaccgcgcaggcggcgcgccaacgctggcagtaggtatcgcgcacgtgttccacaaagtcctgccgatggcggatatgggcttctggtatcacttcggtattctgttcgaagcgctgtttatcctgaccgcactggatgcgggtacccgttccggccgctttatgttgcaggatttgctgggtaacttcgtcccgttcctgaaaaaaaccgattctctggtcgcgggtatcatcggtaccgcaggctgcgtcggtttgtggggctatctgctgtatcagggcgtggtcgacccgctgggcggcgtgaagagcctgtggccgctgttcggtatctctaaccagatgctggccgccgtggcactggtgttgagcaccgtggtactgatcaaaatgcagcgcaccaagtacatctgggtgacggtgatcccggcggtatggctgctgatctgcaccacctgggcactgggcctgaaactgttcagcgccaacccacagatggagggtttcttctacatggcaaacctgtataaagagaagattgccaacggcaccaacctgaccgcgcagcagattgccaacatgaaccatatcgtggtgaacaactacactaacgctggtttgagtattctgttcctggtggtggtgtacagtattatcttctacggtttcaccacctggatgaaggtacgcaacagcgataaacgtaccgataaagaaaccccgtatgtgcccgtgccggaaggcggcgtgaagatctcttcacaccactaa

SEQ ID NO: 36589 - protein, 716 aa, Salmonella enterica subsp. enterica serovar Choleraesuis str
MDTKKIFKHIPWVILGIIGAFCLSVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGTVPGTIALFGCFLIMIIILAVLALIVVKALAESPWGVFTVCSTVPIALFMGIYMRFLRPGRVGEVSVIGIVLLVASIYFGGVIAHDPYWGPALTFKDTTITFALIGYAFVSALLPVWLILAPRDYLATFLKIGVIVGLALGIVILNPELKMPALTQYVDGTGPLWKGALFPFLFITIACGAVSGFHALISSGTTPKLLACETDARFIGYGAMLMESFVAVMALVAASIIEPGLYFAMNTPPAGLGITMPNLHEMGGENAPLIMAQLKDVTTHAAATVSSWGFVISPEQILQTAKDIGEPSVLNRAGGAPTLAVGIAHVFHKVLPMADMGFWYHFGILFEALFILTALDAGTRSGRFMLQDLLGNFVPFLKKTDSLVAGIIGTAGCVGLWGYLLYQGVVDPLGGVKSLWPLFGISNQMLAAVALVLSTVVLIKMQRTKYIWVTVIPAVWLLICTTWALGLKLFSANPQMEGFFYMANLYKEKIANGTNLTAQQIANMNHIVVNNYTNAGLSILFLVVVYSIIFYGFTTWMKVRNSDKRTDKETPYVPVPEGGVKISSHH

SEQ ID NO: 36590 - DNA, 2076 bp, Pseudomonas syringae pv. syringae B728a
  CDS (1)..(2076): transl_table=11
atgaaaaataataatagtctgatgcgccatgttccctggctcatcgttgcaattgtcggggcatgtgcccttggggtcgtggccttgcgccgcggagaggcgatcaacgccttgtggatagtggtcgctgcggtagctatctacctggttgcctatcgttactacagtcttttcatcgccactcacgtcatgcagctcgatccgctgcgcgcgacaccggcggtggtcaacaacgacggtctggactatgtgccgaccaacaaacacattctcttcggacaccactttgccgccatcgctggcgcaggcccgctggtcggcccggtactggcagcgcaaatgggctatctgcccggcacgctctggctgatcgcaggcgtggtgctggccggtgcggtgcaggacttcatgatcctgttcctctccacgcgccgtgacggacgctcgctgggtgacatggttcgcgaggaaatgggccgtattcccggcaccatcgcgctgttcggctgcttcctgatcatgatcatcatcctggcggtgctggcgctgatcgtggtcaaggccctggccgagagcccgtggggcatgttcacggtcatggcgacgatcccgatcgcgatgttcatgggcatttatatgcgctacatccgtccggggcgcattggtgaaatctccatcgtcggtgtcattctgttgctcggttcgatctgggtcggcgggatggtagcggcggatccgacctgggggccgatgttcacgttcaccggtgtgcagatcacctggatgctggtcggttacggctttgtagcggccatgctgccggtctggctgctgcttgcgccccgtgactacctgtcgaccttcctgaaaatcggcaccattctggcactcgcgatcggcatcctgatcctggcgcccgagctgaaaatgccggccctgacccagttcaccaacggcacaggcccggtctggaagggcgcattgttcccgttcctgttcatcaccattgcctgcggtgcagtgtcgggtttccacgcactgatctcctcgggcaccacgcccaagctgctggataacgagaagaacgcccgttacatcggttacggcggcatgttgatggagtccttcgtggccatcatggcgatggttgccgcttcggtgatcgagccgggcgtgtacttcgccatgaacagcccggctgccgtggtcggcagtgacgtggtgaccgtcgcgcagacggtgtccagctggggctttgccatcacgccggagcaactgacggctgtggcgaaagacattggtgaaaacaccgtgctggcgcgggctggtggtgctccgacgctggccgtcggtatcgcacagatcctccatcaggtgctgccgggtgaaaacaccatggcgttctggtaccactttgcgattctgttcgaggcgctgttcatcctgaccgccgtcgacgccgggacacgtgccggacgcttcatgctgcaggacctgctgggcagcttcgttccggccttgaaacgcaccgagtcgtggacggccaacgccatcggcaccggcggttgcgtggcgctgtggggctatctgctctatcagggcgtcatcgacccgctgggcggcatcaataccttatggccgctgttcggtatctccaaccagatgctcgccggtatcgccctgatgctggccagcgtggtgctgatcaagatgaagcgtcagcgctacgtctgggtgaccatgctgcctgccgtctggctgctgatctgcaccgtgaccgctggcttgatcaagctgttcgacgccaaccctgcggtaggtttcctggccctggccaagaaatacagcgcggcggccgatgccggtcagattctggccccggccaagaccatggaccagatgcagcacgtgatcttcaacgcttacaccaacgccgggctgaccgtgctgttcctgttcgtggtgttcagcatcctgttctacgccattaaagtcggccgtgcggcctggagcaccaaggagcgcaccgacaaggaagcgccattccaggccatgccgccagcgtcgcaggtgtga

SEQ ID NO: 36591 - protein, 691 aa, Pseudomonas syringae pv. syringae B728a
MKNNNSLMRHVPWLIVAIVGACALGVVALRRGEAINALWIVVAAVAIYLVAYRYYSLFIATHVMQLDPLRATPAVVNNDGLDYVPTNKHILFGHHFAAIAGAGPLVGPVLAAQMGYLPGTLWLIAGVVLAGAVQDFMILFLSTRRDGRSLGDMVREEMGRIPGTIALFGCFLIMIIILAVLALIVVKALAESPWGMFTVMATIPIAMFMGIYMRYIRPGRIGEISIVGVILLLGSIWVGGMVAADPTWGPMFTFTGVQITWMLVGYGFVAAMLPVWLLLAPRDYLSTFLKIGTILALAIGILILAPELKMPALTQFTNGTGPVWKGALFPFLFITIACGAVSGFHALISSGTTPKLLDNEKNARYIGYGGMLMESFVAIMAMVAASVIEPGVYFAMNSPAAVVGSDVVTVAQTVSSWGFAITPEQLTAVAKDIGENTVLARAGGAPTLAVGIAQILHQVLPGENTMAFWYHFAILFEALFILTAVDAGTRAGRFMLQDLLGSFVPALKRTESWTANAIGTGGCVALWGYLLYQGVIDPLGGINTLWPLFGISNQMLAGIALMLASVVLIKMKRQRYVWVTMLPAVWLLICTVTAGLIKLFDANPAVGFLALAKKYSAAADAGQILAPAKTMDQMQHVIFNAYTNAGLTVLFLFVVFSILFYAIKVGRAAWSTKERTDKEAPFQAMPPASQV

SEQ ID NO: 36592 - DNA, 2073 bp, Xanthomonas campestris pv. campestris str. 8004
  CDS (1)..(2073): transl_table=11
atgaaaggtatctcgaagctggcctggggcgcgctggcgctgctggccgcgttctgcttgggcaccgtggcgctgcggcgcggcgaacacatcaacgcgttgtggatcgtggtggcggcggtgtcgatctatctgatcgcctaccgcttctatggcctgttcatcgccgacaaggtgatgcagctcgaccccacccgcgccaccccggcggtgaccaataacgacggtctggactacgtgcccaccaacaagcacgtgctgttcgggcaccacttcgccgcgatcgccggcgccgggccgttggtcggcccggtgctcgccgcgcagatgggctacctgcccggcctgctgtggctggtggttggcgtggtgctggccggcgcggtgcaggacttcatggtgctgttcctgtccacgcgccgcaacggccgctcgctcggcgacctggtgcgcgaagagatgggccaggtgcccggcaccatcgcgctgttcggcgccttcctgatcatgatcatcatcctggcggtgctggcgatggtggtggtcaaggccttggccgagagcccgtggggcatgttcacggtgatcgcgacgatgcccatcgcgatcatgatgggcgtgtacatgcgctacatccgccccggcaagatcggcgagatttcggtggtgggattgatcctgctactgggtgcgatctggctaggtggccaggtggccgccgacccgacctggggccctgccttcaccttcaccgccaagcagatcacctggatgttgatcggctacggcttcatcgcctcggtgctgccggtatggctgctgctggcaccgcgcgactatctgtccaccttcctcaagatcggcaccatcctgggcctggcgatcggcatcctgatcgtgatgcccgacctcaagatgccggcgctcacccagttcgctgccagcggcgatggcccggtgtggaagggcggcatcttcccgttcctgttcatcaccatcgcctgcggtgcggtgtccggcttccatgcgttgatcgcctccggcaccacgcccaagctgctcgccaacgaagcgcacatgcgctacatcggctacggcggcatgttgatggaatcgttcgtggcgatcatggcgctggtggccgcgtcgatcatcgaacccggcatctatttcgccatgaatagcccggcctcgttggtcggcagcgataccgtcgcagtggctgccaaggtcagcgaatggggctttgcaatcaccccggaagtgctggaagccaccgcgcgcgacatcggcgagcacagcatcctggcgcgcgccggtggtgcacccacgctggcggtaggcatcgcgcagatcctgcaccacgtgctgccgggcgagaacacgatggcgttctggtaccacttcgcgatcctgttcgaagcgttgttcatcctcaccgcagtggacgcgggcacgcgtgccggccgcttcatgctgcaggacctgctgggcaacttcatcccggcactgaagaagaccgaatcgtggaccgccaacatcatcgccaccgccggttgcgtggcgctgtggggctacctgctctacaccggcgtgatcgatccgttcggcggtatccagacgctgtggccgttgttcggcatctccaaccagatgctggccggcatcgcgttgatgctgggcacagtggtgctgttcaagatgaagcgtgaccgctacgcctgggtcaccatcgtgccggcgctgtggctgctgttgtgcaccacctacgccgggctgatcaagatcttcgacagcaacccggcgcagggtttcctggcgcaggcgcacaagttccaggccgccatcgccagcaacaccatcaccgcaccggccaagaccgtgccgcagatgcagcagatcgtcaccaacgcctacgtcaacaccgggctgacggtgctgttcctgttcgtggtgggctcgatcctgatctacgcagtcaaaacgatcgtggtcgcccgccgcagcccgcagcgcagcgatcgcgaaaccccgtacgtggcactgcagccacaccagatggcggatctgtaa

SEQ ID NO: 36593 - protein, 690 aa, Xanthomonas campestris pv. campestris str. 8004
MKGISKLAWGALALLAAFCLGTVALRRGEHINALWIVVAAVSIYLIAYRFYGLFIADKVMQLDPTRATPAVTNNDGLDYVPTNKHVLFGHHFAAIAGAGPLVGPVLAAQMGYLPGLLWLVVGVVLAGAVQDFMVLFLSTRRNGRSLGDLVREEMGQVPGTIALFGAFLIMIIILAVLAMVVVKALAESPWGMFTVIATMPIAIMMGVYMRYIRPGKIGEISVVGLILLLGAIWLGGQVAADPTWGPAFTFTAKQITWMLIGYGFIASVLPVWLLLAPRDYLSTFLKIGTILGLAIGILIVMPDLKMPALTQFAASGDGPVWKGGIFPFLFITIACGAVSGFHALIASGTTPKLLANEAHMRYIGYGGMLMESFVAIMALVAASIIEPGIYFAMNSPASLVGSDTVAVAAKVSEWGFAITPEVLEATARDIGEHSILARAGGAPTLAVGIAQILHHVLPGENTMAFWYHFAILFEALFILTAVDAGTRAGRFMLQDLLGNFIPALKKTESWTANIIATAGCVALWGYLLYTGVIDPFGGIQTLWPLFGISNQMLAGIALMLGTVVLFKMKRDRYAWVTIVPALWLLLCTTYAGLIKIFDSNPAQGFLAQAHKFQAAIASNTITAPAKTVPQMQQIVTNAYVNTGLTVLFLFVVGSILIYAVKTIVVARRSPQRSDRETPYVALQPHQMADL

SEQ ID NO: 36594 - DNA, 1602 bp, Haemophilus influenzae 86-028NP
  CDS (1)..(1602): transl_table=11
ttgaggagccttcctatgttatggtttttcttttgtgtagccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcgcgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttctccatctaaagttgtgtatgatagttcgttacatttcttaggttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactacagcgggatatttatatcgttatcataaattccactgggttgcgtctcttcctgcgtggtttatcacaacagtatgtgcaacttatttgttctacaacaaaattggtttcggcttagattatcagctttctgtgtatcttggtttagcaacaaccatcgtttgtatcgtattgttcttcacaatgcttaaaccattaggtacgcgagatgaagaagcttatataaataattag

SEQ ID NO: 36595 - protein, 533 aa, Haemophilus influenzae 86-028NP
MRSLPMLWFFFCVAVLIIGYFIYGKIIEKIFVINPKRQTPAYQVNDGVDYMPMSKTKIWLIQLLNIAGTGPIFGPILGALYGPVAMLWIVIGCIFAGAVHDYFCGMLSIRHGGATMPYLAGKFLGRPVKVFINTLALVLLLLVGVVFVASPAQLMGTITMDVFGASQSALVLGDAEAVHHSVEAGGIKVWGMDKATVVALWTAIIFAYYILATLLPVDKIIGRIYPLFGALLLFMSVGMVYGLVVSHFSATDPIEFFRTINADGEGLTWAKFTQNFQVKGDVPIWPLLFLTISCGALSGFHATQTPLMARCTENESEGRFIFYGAMITEGVIALVWCMVGLAFYENPQALQDAISAGSPSKVVYDSSLHFLGFIGGIFAILGVIVLPITSGDTAFRAARLQIAEIFNVDQRSLPKRLLIAVPLFVLGYFISTIDFSVLWRYFTWANQMTAMVMLWTTAGYLYRYHKFHWVASLPAWFITTVCATYLFYNKIGFGLDYQLSVYLGLATTIVCIVLFFTMLKPLGTRDEEAYINN

SEQ ID NO: 36596 - DNA, 2067 bp, Pseudomonas fluorescens Pf-5
  CDS (1)..(2067): transl_table=11
atgaaaaataataatagcctgttgcgccatgttccttggctgctgctggcaatcgtaggagcttgcgcccttggcgtagttgcattgcgtcgcggcgaggcgatcaacgccttgtggattgtggtcgccgccgtggccatctatctggtggcgtaccggtattacagtctgttcattgccaacaacgtgatgcagctggacccgggccgggccacgcccgccgtggtcaacaatgatggtctggactacgtcccgaccaacaagcacatcctcttcggtcaccacttcgcggccattgccggcgcaggtcccctggtgggcccggtgctggcggcgcagatgggctacctgcccggcaccctgtggctgattgccggggtggtcctggccggtgcggtgcaggacttcatggtgctgttcctgtccacccggcgtaacggccgttccctgggcgacatggtccgtgaggaaatgggccgtatcccggggaccatcgcgctgttcggctgcttcctgatcatgatcatcatcctcgcggtgctggcgctgatcgtggtcaaggccctggccgagagcccgtggggcatcttcacggtgatggcgaccatcccgatcgcggtgttcatgggcgtgtacatgcgctacatccgcccgggccgcattggtgagatctcgttgatcggcgtgctgctgttgctcggctccatctggctgggtggccaggtggcggcggatccggtgtggggcaagatgttcaccttcaccggcgtgcagatcacctggatgctgatcggctacggtttcgtcgcggcagtactgccggtgtggctgatcctggcaccgcgggactacctgtcgaccttcctcaagatcggcaccatcatcgctctggcgatcggcatcctgatcaccatgcccgagctgaagatgccggccctgacccagttcaccgacggcaccggcccggtgtggaaaggcggcctgttccccttcctgttcatcaccattgcctgcggtgcggtctccggcttccatgcgctgatctcctcgggcaccacgcccaagctgctggataacgaagccaacgcccgctacatcggctacggcggcatgctcatggagtccttcgtggcgatcatggccatggtcgcggcctcggtgatcgagccgggcgtgtacttcgccatgaacagtccggcggccatcgtcggcggcgacgtggtggcggtagcccagactgtcagcagctggggctttgcgatcagcccggaccaactgcaggcggtggccaaggacatcggtgaaaacaccatcctggcccgtgccggcggcgcgccgaccctggcagtggggatcgcgcagatcctccaccatgtattgccgggtgagaacaccatggccttctggtaccacttcgcgatcctgttcgaagccctgttcatcctcactgcggtggacgccggtacccgtgccgggcgcttcatgctccaggacctgctgggttccttcgttccggcgctgaaacgcaccgagtcgtggaccgccaacctgattgccaccgcaggctgcgtggcgctctggggctacctgctgtaccagggcgtgatcgatcctctgggcggcatcaacaccctgtggccgctgttcggcatctccaaccagatgctggccggtatcgccctgatgctgggtaccgtggtgctgatcaagatgaagcgccagcgctacatctgggtcaccctgctgccggctgtgtggctgctgatctgcaccaccaccgcaggcttcatcaagctgttcgacgccaacccggcgatcggcttcctgtcgctggcgaagaaatacagcgatgcaatggccaacggccagatcatcgctccggccaaggacatcacgcagatgcagcacgtgatcttcaacgcctacaccaacgcgaccctgacagccctgttcctgctggtggtgttcagcatcctgttctacgcgctcaaggtcggcatcgccgcctggggcagcaaggagcgtacggataaagaatcgccctatcaggccgtgccggacgcgtaa

SEQ ID NO: 36597 - protein, 688 aa, Pseudomonas fluorescens Pf-5
MKNNNSLLRHVPWLLLAIVGACALGVVALRRGEAINALWIVVAAVAIYLVAYRYYSLFIANNVMQLDPGRATPAVVNNDGLDYVPTNKHILFGHHFAAIAGAGPLVGPVLAAQMGYLPGTLWLIAGVVLAGAVQDFMVLFLSTRRNGRSLGDMVREEMGRIPGTIALFGCFLIMIIILAVLALIVVKALAESPWGIFTVMATIPIAVFMGVYMRYIRPGRIGEISLIGVLLLLGSIWLGGQVAADPVWGKMFTFTGVQITWMLIGYGFVAAVLPVWLILAPRDYLSTFLKIGTIIALAIGILITMPELKMPALTQFTDGTGPVWKGGLFPFLFITIACGAVSGFHALISSGTTPKLLDNEANARYIGYGGMLMESFVAIMAMVAASVIEPGVYFAMNSPAAIVGGDVVAVAQTVSSWGFAISPDQLQAVAKDIGENTILARAGGAPTLAVGIAQILHHVLPGENTMAFWYHFAILFEALFILTAVDAGTRAGRFMLQDLLGSFVPALKRTESWTANLIATAGCVALWGYLLYQGVIDPLGGINTLWPLFGISNQMLAGIALMLGTVVLIKMKRQRYIWVTLLPAVWLLICTTTAGFIKLFDANPAIGFLSLAKKYSDAMANGQIIAPAKDITQMQHVIFNAYTNATLTALFLLVVFSILFYALKVGIAAWGSKERTDKESPYQAVPDA

SEQ ID NO: 36598 - DNA, 1680 bp, Psychrobacter arcticum 273-4
  CDS (1)..(1680): transl_table=11
atgaatagtgcaattgtgctattgtttgctgttgccgctatgcttggcggttatgtgttttactcaaaatttatcgccactaaaattttagcattagataatagcatccccacgccagcacataccatgaaagatggggtagattatatcccaaccaataaatatgtgttatggggacaccattttacttcagtcgcaggggcagctccgattattggtcctgccattgcagttatttggggctgggtacctgccatcatctgggtggtattgggcaccatttttatggcgggtgtccacgacatgtcagccatttgggcaagtatgcgcaatcgaggtcagtcgattggctcgattgccggtaccgtcatgggtacacgtgtacgtagcttaatgatgatcgtcatctttttattattactgatggtgaatgcagtattcggcgtcgctattgcgaatatgatgataaaaaccccctccgctgtgttgcccgtttggggtgctttgatagtggcctttatcattggtcagtgtatttatcgctataagatgagtctggtttgggtatcaatcattggggtcaccgctttatatgggcttatctatcttggtcctatgttccctatcgtgttacctgagacattcttaggcttacctgataatgccgtttggattattattttatttgcctatgcggcaatcgcttctttgttacctgtttggatgctcttgcaaccgcgagattacatcaatggcttgcagttatttgtcggtctgattttattgtacgccgccatctttattgctacgccgaatattgtcgcgccagcaataaacacggcattgccaatcggcacaccatctatgttacctttattgtttgtgaccattgcttgtggtgcaatctcaggctttcatggtttggtagcgacaggtacgacgtctaagcagattgataaagaagaagatgtgcgattcgttggttatttcggtgccatgggtgagggtatgctggcacttggtgcgatacttgcggcaaccgcaggctttgcaacccttggcgactggcaagcagtttatcaaaaatttggtgacggctctattggtgcctttattgatggcggcgcgaccatcttgaatgctggcgttggcattgatatggttttatcacagacgatgcttacggtaatggcagcattgttcgctggtaccacgatggatactggggtacgtctgcaacgttatatcttccaagagtttggtgagatttataaactgcccgtactgaataaaagtgtggtagcaacgttgcttgccgttggcagctgtctgttattagcatttggtgccggtggcatcgatggtgctggtggcatgattatctggccgctatttggcacgacaaatcagctaatggcagcattaaccttgatgattgtcacagtcatcttgttacgtaagggcagaccagtatggtatactttaggacccttatctttcttactagtcatgactgtttttgcgttattaattcagctaaaaacttttttcaatgacggtaattggctacttgtcattatggatatcattattttggtcgccacgattttagtgacgtttgagagtctatcagtactacgcaaagaatggtcgatacacaagggcaaaagtaacctctaa

SEQ ID NO: 36599 - protein, 559 aa, Psychrobacter arcticum 273-4
MNSAIVLLFAVAAMLGGYVFYSKFIATKILALDNSIPTPAHTMKDGVDYIPTNKYVLWGHHFTSVAGAAPIIGPAIAVIWGWVPAIIWVVLGTIFMAGVHDMSAIWASMRNRGQSIGSIAGTVMGTRVRSLMMIVIFLLLLMVNAVFGVAIANMMIKTPSAVLPVWGALIVAFIIGQCIYRYKMSLVWVSIIGVTALYGLIYLGPMFPIVLPETFLGLPDNAVWIIILFAYAAIASLLPVWMLLQPRDYINGLQLFVGLILLYAAIFIATPNIVAPAINTALPIGTPSMLPLLFVTIACGAISGFHGLVATGTTSKQIDKEEDVRFVGYFGAMGEGMLALGAILAATAGFATLGDWQAVYQKFGDGSIGAFIDGGATILNAGVGIDMVLSQTMLTVMAALFAGTTMDTGVRLQRYIFQEFGEIYKLPVLNKSVVATLLAVGSCLLLAFGAGGIDGAGGMIIWPLFGTTNQLMAALTLMIVTVILLRKGRPVWYTLGPLSFLLVMTVFALLIQLKTFFNDGNWLLVIMDIIILVATILVTFESLSVLRKEWSIHKGKSNL

SEQ ID NO: 36600 - DNA, 2076 bp, Pseudomonas syringae pv. phaseolicola 1448A
  CDS (1)..(2076): transl_table=11
atgaaaaataataatagtcttatgcgccatgttccctggctcatcgtcgcaattgtcggggcatgtgcccttggggtcgtggccttgcgtcgcggagaagcgatcaacgctttgtggatagtggtcgctgcggtggctatctatctggttgcctatcgttactacagtctgttcatcgccacccatgtcatgcagctcgatccgctgcgcgcgacaccggcggtggtcaacaacgatggtctggactacgtgccgaccaacaaacacatccttttcggtcatcactttgctgccatcgccggtgcaggcccgctggtcggcccggtactggccgcgcaaatgggttatctgcccggtacgctctggctgatcgccggtgtggtgctggccggtgcggtacaggatttcatgatcctgttcctctccacgcgccgtaacggtcgctcgctgggcgacatggttcgcgaggaaatgggccgtattcccggcaccatcgccctgttcggctgtttcctgatcatgatcatcatcctggcggtgctggcgctgatcgtggtcaaggccttggccgagagcccgtggggcatgttcacggtcatggcgacgatcccgatcgcgatgttcatgggcatctatatgcgctacatccgcccgggtcgtatcggtgaaatctctattatcggtgtcattctgctactcggttcgatctgggtcggcggcatggtagcggccgatccgacctgggggccgatgttcaccttcaccggcgtgcagatcacctggatgttggtgggctatggttttgtagcagcgatgctgccggtctggctgctgcttgcgccacgtgactacctgtcgaccttcctgaaaatcggcaccattctggcactggcaatcggcatcctgattctggctcccgagctgaaaatgccggccctgacccagttcaccaacggcacaggcccggtctggaagggcgcactgttcccgttcctgttcatcactatcgcttgcggtgcggtatcgggtttccacgcgctgatctcttcgggcaccacgcccaagctgctggataacgaaaagaacgctcgttacatcggttacggcggcatgctgatggagtcgttcgtggccatcatggcaatggttgccgcctcggtgatcgagccaggcgtgtacttcgctatgaacagcccggctgcggtggttggcagtgacgtggtgactgtcgcgcagactgtctccagctggggctttgccatcacgccggagcaattgactgctgtcgcgaaagacatcggtgaaaacactgtgctggcgcgtgccggtggtgcgccgacgctggcggttggtatcgcgcagatcctccatcaggtgctgccgggtgaaaacaccatggcgttctggtaccacttcgcgattctgttcgaggcgttgttcattctgaccgcagtcgacgccggtacacgagccggacgcttcatgctgcaggatctgctgggcagtttcgttccggctttgaaacgcaccgagtcgtggacggccaacgctatcggcaccggtggttgcgtggcgctgtggggctatcttctgtaccaaggtgtaatcgacccgctgggcggcatcaataccctgtggccgctgttcggcatctccaaccagatgctcgccggtattgccctgatgctggccagcgtcgtgctgatcaagatgaagcgtcagcgctatgtgtgggtgaccatgctgcctgccacctggctgctgatctgcaccgtgacggctggtctgatcaagctgttcgacgccaatcctgcggtgggctttctggccctggccaagaaatacagcgcggcggcggatgccggccagatcctggccccggccaagaccatggaccagatgcagcatgtgatcttcaacgcttacaccaatgccgggctgaccgtgctgttcctgttcgtggtgttcagcattctgttctacgcccttaaagtaggccgtgcggcgtggaccaccaaggcgcgtaccgacaaggaagctccttaccaggccatgccgccagcgtcgcaggtgtga

SEQ ID NO: 36601 - protein, 691 aa, Pseudomonas syringae pv. phaseolicola 1448A
MKNNNSLMRHVPWLIVAIVGACALGVVALRRGEAINALWIVVAAVAIYLVAYRYYSLFIATHVMQLDPLRATPAVVNNDGLDYVPTNKHILFGHHFAAIAGAGPLVGPVLAAQMGYLPGTLWLIAGVVLAGAVQDFMILFLSTRRNGRSLGDMVREEMGRIPGTIALFGCFLIMIIILAVLALIVVKALAESPWGMFTVMATIPIAMFMGIYMRYIRPGRIGEISIIGVILLLGSIWVGGMVAADPTWGPMFTFTGVQITWMLVGYGFVAAMLPVWLLLAPRDYLSTFLKIGTILALAIGILILAPELKMPALTQFTNGTGPVWKGALFPFLFITIACGAVSGFHALISSGTTPKLLDNEKNARYIGYGGMLMESFVAIMAMVAASVIEPGVYFAMNSPAAVVGSDVVTVAQTVSSWGFAITPEQLTAVAKDIGENTVLARAGGAPTLAVGIAQILHQVLPGENTMAFWYHFAILFEALFILTAVDAGTRAGRFMLQDLLGSFVPALKRTESWTANAIGTGGCVALWGYLLYQGVIDPLGGINTLWPLFGISNQMLAGIALMLASVVLIKMKRQRYVWVTMLPATWLLICTVTAGLIKLFDANPAVGFLALAKKYSAAADAGQILAPAKTMDQMQHVIFNAYTNAGLTVLFLFVVFSILFYALKVGRAAWTTKARTDKEAPYQAMPPASQV

SEQ ID NO: 36602 - DNA, 1815 bp, Dechloromonas aromatica RCB
  CDS (1)..(1815): transl_table=11
atggatcaagccatctacttcgtagtcttgacagtctgcattctggccctggcatatcgcttctacgggatattcttcgtgcgcaaagtactggctgccgatgacaaggaaatcaccccgtcgcacgagctcgaggacggcaagaactacgtgccgaccaagaaatgggtcaatgccggccagcacttcgccgccattgccgccgccggcccgctggtcggtccggtcctcgccgcccagttcggttacctgccaggcttcctctggctgctgatcggcgccgtggtcggcggcgcggtacacgacaccgtcgtgctcttcgcctcgatgaagcaccagggcaagtcgctctccgaagtcgccaaggccgaactcggcccggtcgccggctggagtaccggtctcgccatgctgttcatcatcaccatcaccatggccggcctctccatcgtggttgtccatgcgctggaacgcaatgcctggggtaccttcgccgtcttcatgacggtgccgattgccatcgccctgggtctttatgaacgctatgtcggttcgtccaagtgggccacctatgtcggcgttgccgccgtgatggcctcggtggccgccggcccgcacctgcagggcaccctgctcggcgactggctgacgctgcacaagaccactgtctgctggatcctgccgatctacgccttcttcgcgacggcgctgccggtgtggatgctgctgaccccccgtggttacctgtccagcttcatgaaggttggcgtcttcctggccctgatcgtcggcgtcgtcgtcatcaacccgaccatccagttccctgccctgaccgagttcatcaacggcggcggccccatcctcaagggttcggtctggccgttcatctcgatcaccatcgcctgcggtgccatctccggtttccatgccttcatcggttccggcacgacgcccaagctggtcgataagtggagcgacatccagccggttgccttcggcgccatgctggccgaatgcctggttgcggtgatggccctgattgccgccacctcgctgcacccggccgactacttcgccatcaactcgacaccggaagtcttcaagaccctgggcatgcaagtcgtcgatctgccgcaactgagcgaagccatgggcatcgacctctacggtcgaaccggtggtgccgtgacgttggccgtcggcatgacctacatcttcaccaagatctcctggttcagccacctggccgcctacttcttccagttcgtgatcatgttcgaagcggtcttcatcctgacggcagtcgattccggcacccgtgtctcgcgctacctgatccaggatctactcggcgacttcttcccgttcatgaagcgcctggactccctgcccgccgccatcatcgccagcatcatcgcctgcgtcctgtggggttacctgctgctctccggtgacatcggttcggtctgggccctgttcggtgtctccaaccagctgatggcctccatcggcctgatgatcggcgccaccatcgtgctccgtctgtccagcaagcgtgcctacatcctgacctgcctgatcccgctcgcttacctgttcgtcacggtgaattacgccggctactggatgatctccaacgtctatctgaatagcgccggcaagggctacaacctgttcaacgctggtatcgcttcggtcatgctggtcctcggcttcgtcatcatggccgcctcgctcaagcgctgggcggtgttgtggaaggcccgcggcgaatcgaacagcatcccgtcagccctgactgtcagtcccgcctga

SEQ ID NO: 36603 - protein, 604 aa, Dechloromonas aromatica RCB
MDQAIYFVVLTVCILALAYRFYGIFFVRKVLAADDKEITPSHELEDGKNYVPTKKWVNAGQHFAAIAAAGPLVGPVLAAQFGYLPGFLWLLIGAVVGGAVHDTVVLFASMKHQGKSLSEVAKAELGPVAGWSTGLAMLFIITITMAGLSIVVVHALERNAWGTFAVFMTVPIAIALGLYERYVGSSKWATYVGVAAVMASVAAGPHLQGTLLGDWLTLHKTTVCWILPIYAFFATALPVWMLLTPRGYLSSFMKVGVFLALIVGVVVINPTIQFPALTEFINGGGPILKGSVWPFISITIACGAISGFHAFIGSGTTPKLVDKWSDIQPVAFGAMLAECLVAVMALIAATSLHPADYFAINSTPEVFKTLGMQVVDLPQLSEAMGIDLYGRTGGAVTLAVGMTYIFTKISWFSHLAAYFFQFVIMFEAVFILTAVDSGTRVSRYLIQDLLGDFFPFMKRLDSLPAAIIASIIACVLWGYLLLSGDIGSVWALFGVSNQLMASIGLMIGATIVLRLSSKRAYILTCLIPLAYLFVTVNYAGYWMISNVYLNSAGKGYNLFNAGIASVMLVLGFVIMAASLKRWAVLWKARGESNSIPSALTVSPA

SEQ ID NO: 36604 - DNA, 1800 bp, Thermobifida fusca YX
  CDS (1)..(1800): transl_table=11
atgcctgccgttgtcgtactggtcgctgttctcgccctcttcgctctgggataccgctactactcgtcgtatctggcccgccgcgtctacgggctggaccccaactatgtgacccccgcccaccgctactccgacggggtcgacttcgtccccaccaaccgttacgtcgttttcagccaccatttcatctccgtggccggagccgcccccatcgtcggccccgcggtcgccgtgttctggggctggggcccggccctgctgtgggtggtgctcggcacgatcttcgctgcgggcgtgcacgacttcggggcgctcgcggtctcggtccgccaccgcgcgaaaagcatcggcacgctcgccggtgaggtggtgagcagacgcgccggcaccctctttctgatcatcatcttcttcctgctgaccctggtgaacgcggtcttctccgtggtcatcgccaacctgttcgtttccacccctagcgtggtgctgcccaccttggtcacgattcccttggcgatcggtgtgggccagtacgtctaccgcacgcgcagcgcggcactgctgccgtccctggtcgtgctgctgctggtgtacgcgtccatcccgctgggcctgctgttcccgatcactatcgacccgctggctgccgcggtcggcctcaccccgaaaaccctgtggatcatcctggtcttcggctacgctttcgcggcgtcccggctgccagtgtggctgctgctgcagccgcgcgactacatcaaccagcagcagatgctggtggcgttggcggtgatcctgctgggcgtggccgtaggcttcgactggatcgtggcgcctctcatcaacgacgtgcccgacggatccccgccctggttccccctgctgttcattaccatcgcctgcggggcgatctccgggttccacagcctggtctcctcggggacgacagcgaagcagatcgaccgggaaaccgacgcccgtttcgtcggctacctgggtgctgtcggggagggcacgctcgcgctgtgcgccatcctggcctgcacggcgggcgtggcggcgacccgcgccgactgggatgcgctctacacggactatgcgaccgcgtcgggcagcgccaccgacaacttcgtcaacggggtggcgaacttcgcgtcccacctgggcattcccgaaaccgtgggtgtggtgttcgccgccgtggtgatcatcagtttcgcgtccaccaccatggacacgggggtgcggctgcaacgctacatcgtgcaggagatcgcggagaccgcccggatccggccgctggcacgcaacctcaccttggcgaccctggtggcggtggcggtgccgttggcgttggcgctcaccccgggcgacttcgcgttcggcaccctttggcagctgttcggcaccaccaaccagctcaccgccggactggcgttggcggtgatcgcagtatgggtcaccaagagcagccgcaacccgctcgcggtgctcatccccctggtgttcctgctcgtcatgacctcgtgggcgctggtcctcaacctggtccggtttgtgaccgctgacgaccccatgcaggtgttcctgctcgcccccttggacgcggtcatcttcgtgcttgcactgtggctgatcgttgaagcgtcgctggcgctgcggaccgcgtggcgggcccgcacggctgccgccggcactccagcagtcccggcagcggacccgaagaccggtacggatgcggccccgcccgcgggggacagcccgacggatccggcggagcctgcgggagcaggggagcagtga

SEQ ID NO: 36605 - protein, 599 aa, Thermobifida fusca YX
MPAVVVLVAVLALFALGYRYYSSYLARRVYGLDPNYVTPAHRYSDGVDFVPTNRYVVFSHHFISVAGAAPIVGPAVAVFWGWGPALLWVVLGTIFAAGVHDFGALAVSVRHRAKSIGTLAGEVVSRRAGTLFLIIIFFLLTLVNAVFSVVIANLFVSTPSVVLPTLVTIPLAIGVGQYVYRTRSAALLPSLVVLLLVYASIPLGLLFPITIDPLAAAVGLTPKTLWIILVFGYAFAASRLPVWLLLQPRDYINQQQMLVALAVILLGVAVGFDWIVAPLINDVPDGSPPWFPLLFITIACGAISGFHSLVSSGTTAKQIDRETDARFVGYLGAVGEGTLALCAILACTAGVAATRADWDALYTDYATASGSATDNFVNGVANFASHLGIPETVGVVFAAVVIISFASTTMDTGVRLQRYIVQEIAETARIRPLARNLTLATLVAVAVPLALALTPGDFAFGTLWQLFGTTNQLTAGLALAVIAVWVTKSSRNPLAVLIPLVFLLVMTSWALVLNLVRFVTADDPMQVFLLAPLDAVIFVLALWLIVEASLALRTAWRARTAAAGTPAVPAADPKTGTDAAPPAGDSPTDPAEPAGAGEQ

SEQ ID NO: 36606 - DNA, 2073 bp, Ralstonia eutropha JMP134
  CDS (1)..(2073): transl_table=11
atgaatcgcatcggagaacacctcgtgtggctggccgtcgccatcttgggcgcgtttgccttcggcacggtcgcgctcgcgcgcggcgaagccgtcagcgcgctatggatcgtggttgccgcgctctgcatctacctgatcgcctaccgctactacagccgcttcattgccgacaaggtgatgcagctcgacccgaaacgcatgacgccggcctggcgccataacgacgggctcgactacgtgccgaccaacaaggcagtgctgttcggccaccacttcgcggcgattgccggcgccggcccgctggtcggccccgtgctggccgcgcagatgggctatatgccgggcatgctttggatcctggcaggcgtggtgttcgccggcgcggtccaggatttcatgatcctgttcatctccacgcgccgcgacggccgttcgctgggcgacctggtcaagtccgagatgggcacggtaccgggcatgatcgcgctgttcggctgcttcatgatcatgatcatcatcctggcggtgctggcgctgatcgtggtgaaggcgctggccggctccccgtggggtacgttcaccgtcgctgtgaccatccccatcgcgctgttcatgggcatctacacgcgctatatccgcccgggccgcatcggtgaggtgtcggtgatcggcttcgtgctgctgatgctggccatcctcggcgggcagtacgtgcacgaaagcgcggtgctggcgccgctgttcacatacgacggcaaggcactgacctggatgctgatcatctacggcttcatcgccgccgtgctgccggtgtggctgctgctggccccgcgcgactacctgtcgaccttcctgaagatcggcaccatcatcgcgctggccatcggcatcctgatcgtcgcgccggaactgaagatgccagccttcacgcagttcgcccagggcggcggtccggtgtggtcgggcaacctgttcccgttcctcttcatcaccatcgcgtgtggcgcggtatcgggcttccatgcgctgatctcgtcgggcaccacgcccaagctgctggaaaacgaatcgcacgcgcgcttcatcggctacggcgcgatgctggccgagtcgttcgtcgccatcatggcgctggtggccgcttcggtgatcgagccgggcgtgtacttcgcgatgaacagcccgagcgcggtgatcggcacctcgccggaagccgtggcgcaagccgtgtcgacctggggctttgtgatcacgcctgatgtgctgatccagaccgccaaggacgtcggcgagaacaccatcatctcgcgcgccggcggcgcgccgacgctggccgtgggcatcgcccacatcctgcaccaggtggtgggcggccaagccatgatggcgttctggtaccacttcgcgatcctgttcgaggcgctgttcatcctgaccgccgtcgacgcaggcacccgcgccggccgcttcatgctgcaggacctgctgggcagcttcgtgccgtcgctcaagcgtaccgactcgctgccggccaacctgatcgctaccgcgctgaccgtggcggcctggggctacttcctgtaccagggcgtggtggatccgctgggcggcatcaacacgctgtggccgctgttcggtatctccaaccaaatgctggccgccgtggcgctggtgctgggcacctgcgtgctggtcaagatgaagcgcggccagtacgcctgggtcacgttggtgccgaccgtctggctgctggtctgcacgctgaccgccggctggcagaagctgttcgacgccgatccgaaggtcagtttcctgacccacgccagcaagttcagcgccgccattgccgaaggcaaggtgctggccccggccaagagcctggagcagatgcagcgcatcgtcttcaatgactacctggacgccggcctgtgcgcgctgttcatgttcgtggtgctgtcgatcgtggcctacggcttcaagaccgccatgcaggcacgcgccgtgaaccgccccaccgacaaggaaacgccgttcgagcccctgccggcggccgcctcggcgcagtcctga

SEQ ID NO: 36607 - protein, 690 aa, Ralstonia eutropha JMP134
MNRIGEHLVWLAVAILGAFAFGTVALARGEAVSALWIVVAALCIYLIAYRYYSRFIADKVMQLDPKRMTPAWRHNDGLDYVPTNKAVLFGHHFAAIAGAGPLVGPVLAAQMGYMPGMLWILAGVVFAGAVQDFMILFISTRRDGRSLGDLVKSEMGTVPGMIALFGCFMIMIIILAVLALIVVKALAGSPWGTFTVAVTIPIALFMGIYTRYIRPGRIGEVSVIGFVLLMLAILGGQYVHESAVLAPLFTYDGKALTWMLIIYGFIAAVLPVWLLLAPRDYLSTFLKIGTIIALAIGILIVAPELKMPAFTQFAQGGGPVWSGNLFPFLFITIACGAVSGFHALISSGTTPKLLENESHARFIGYGAMLAESFVAIMALVAASVIEPGVYFAMNSPSAVIGTSPEAVAQAVSTWGFVITPDVLIQTAKDVGENTIISRAGGAPTLAVGIAHILHQVVGGQAMMAFWYHFAILFEALFILTAVDAGTRAGRFMLQDLLGSFVPSLKRTDSLPANLIATALTVAAWGYFLYQGVVDPLGGINTLWPLFGISNQMLAAVALVLGTCVLVKMKRGQYAWVTLVPTVWLLVCTLTAGWQKLFDADPKVSFLTHASKFSAAIAEGKVLAPAKSLEQMQRIVFNDYLDAGLCALFMFVVLSIVAYGFKTAMQARAVNRPTDKETPFEPLPAAASAQS

SEQ ID NO: 36608 - DNA, 1458 bp, Staphylococcus saprophyticus subsp. saprophyticus ATCC 15305
  CDS (1)..(1458): transl_table=11
atgattacttttattgtagctattattttattggtggtgggttatttcacttatggaaaatacatagacaaaatgtttggaccaaataaagagcgacccacaccagcgtatgatcaaagagatgatgttgattatttaccaatgaagacgcgatctaactcgcttatacaattgttaaatatcgctggtgttggacctatatttggacctattatgggagcactttatggacccatagcatttatttggattgttgtaggctgtatctttgcaggggcagtacatgattatctgaccggtatgatttcaattagaaataaaggggcgcacttaccagaacttgcagggaaatttttaggtcaagtgatgaagcactttgttaatatattttctattttattattactcttaacaggaactgtatttgtgactagtccggcacttctattacataatttaatggatggacgcattgcactgggtattattatttttgttatatttgtgtattatacattatctacaattttacctatagataagatcattggtagaatttatccagtgtttggcgcattattattagtgagtgcggtaggtataggtttccgtcttattcaaacaggggcacctattccagaactaaattttagtaatatgcatcctgatggggcgccagtatttccattactattctttacaataacttgtggtgcattgtctggatttcatgcgacacagacaccgattatttctagaacaacaaataaagaacagaatggtagattcatcttttacggtatgatgattgcggaaggtatcatagcaatgatttgggctgcagcgggtatgagtttatttaatggctataatggtttgaatgatgtcttagcacgtggtgaagctgcattagtagtgagccaggcatcacatctattactgggctctgtattcggtacgatcgccgtgttaggtgttatcattttaccaatcactagcggggatacgtctttcagaagtgctagaatgattattgcagattatttaaactatggtcagcgaaatattgttaaacgtattattgtagcagtaccattgttcgttattagctttggtcttacacaagttgatttcacgattctatggagatatttctcttgggcaaatcaaacaacagcggttgttgcactatgggtaggtgcgatgtatctattgattgcgaaaaagaatttctgggtggcagcaatcccagctgtgtttatgacatggaatatttttacttatattttaagtcagaaaattggattgggtttagacctcaatttaagttatatcatagcctttgtgctaacgattttatgggtagcttatttcagttatcaatacaaaaaaatcacagcaggtgctaaatttgaattggattatcaaatatcttataagcaacaacaaacaacataa

SEQ ID NO: 36609 - protein, 485 aa, Staphylococcus saprophyticus subsp. saprophyticus ATCC 15305
MITFIVAIILLVVGYFTYGKYIDKMFGPNKERPTPAYDQRDDVDYLPMKTRSNSLIQLLNIAGVGPIFGPIMGALYGPIAFIWIVVGCIFAGAVHDYLTGMISIRNKGAHLPELAGKFLGQVMKHFVNIFSILLLLLTGTVFVTSPALLLHNLMDGRIALGIIIFVIFVYYTLSTILPIDKIIGRIYPVFGALLLVSAVGIGFRLIQTGAPIPELNFSNMHPDGAPVFPLLFFTITCGALSGFHATQTPIISRTTNKEQNGRFIFYGMMIAEGIIAMIWAAAGMSLFNGYNGLNDVLARGEAALVVSQASHLLLGSVFGTIAVLGVIILPITSGDTSFRSARMIIADYLNYGQRNIVKRIIVAVPLFVISFGLTQVDFTILWRYFSWANQTTAVVALWVGAMYLLIAKKNFWVAAIPAVFMTWNIFTYILSQKIGLGLDLNLSYIIAFVLTILWVAYFSYQYKKITAGAKFELDYQISYKQQQTT

SEQ ID NO: 36610 - DNA, 2166 bp, Shigella sonnei Ss046
  CDS (1)..(2166): transl_table=11
atgccaggttttactatggatacgaaaaaactattcaagcacataccctgggtgattctcggaatcatcggtgcattctgcctcgcggtagttgcattacgtcggggggagcacgtcagcgccctgtggatcgtggtcgcctctgtgtcggtgtatctggtggcgtatcgctactacagtctgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggtcggtccggttctcgccgcacagatgggccacctgcctggcacgctgtggctgctggcgggggtagtactggccggtgcggttcaggactttatggtgctgtttatctcctctcgccgtaacggcgcatctctcggtgagatgataaaagaagagatgggaccagtaccggggactatcgcgctgtttggctgtttcttaatcatgatcatcatccttgccgtcctggcgctgattgtggttaaagccctggccgaaagtccgtggggtgtcttcaccgtttgctcaaccgtaccgattgcgctgtttatgggtatctacatgcgctttatccgtccggggcgtgtgggtgaagtctctgtcattggtatcgtgctgctggttgcctctatctacttcggtggcgtgattgctcacgatccgtactggggtccggcactgacctttaaagacaccaccattaccttcgcgctgattggctatgcgtttgtttccgcattgctgccggtgtggctgatcctcgcaccgcgcgactatctggcaaccttcctgaaaatcggcgttatcgtcggcctggcgctgggtatcgtggtgctgaacccggaactgaaaatgcctgcgatgacccagtacattgacggtactggcccgctgtggaaaggtgctctgttcccgttcttgttcattaccatcgcctgtggtgcggtatctggcttccacgcactgatctcttccggtacgacgccgaaactgctggctaatgaaaccgacgcgcgtttcattggctacggcgcaatgctgatggagtccttcgtggcgattatggcgctggttgctgcgtccatcatcgaaccgggtctttacttcgcgatgaacaccccgcctgctggccttggcatcaccatgcctaacctgcatgaaatgggtggcgagaacgcgccgatcatcatggcgcagctgaaagacgttaccgcacacgcggcagcgaccgtcagctcttggggcttcgtgatttcgccagagcagatcctgcaaaccgcgaaagacattggtgagccttctgtcctgaaccgtgcaggtggtgcgccaacgctggcggtaggtatcgctcacgtgttccacaaagtgctgccgatggctgacatgggcttctggtatcacttcggtattctgttcgaagccctgttcatcctgaccgcgctggatgcgggtacccgttctggccgttttatgctgcaagacctgctgggtaacttcatcccgttcctgaaaaaaaccgactctctggttgccggtatcatcggtactgcgggctgtgtgggtctgtggggctacctgctgtatcagggcgtggtcgatccgctgggcggcgttaagagcctgtggccgctgttcggtatctccaaccagatgctggcagccgtagcgctggtactgggcaccgttgtgctgattaagatgaagcgcacccaatacatctgggtaactgttgttccggctgtatggctgcttatctgcaccacctgggcgctgggtctgaaactgttcagcaccaacccgcagatggaaggcttcttctacatggcaagccagtacaaagagaagattgctaacggtactgacctgacggcgcagcagattgccaacatgaaccacatcgttgtgaacaactacaccaacgcaggcctgagtattctgttcctgattgtggtgtacagcatcatcttctacggtttcaaaacctggcttgcggtgcgtaacagcgacaaacgtactgacaaagaaactccgtacgttccaatcccggaaggcggcgtgaagatctcttcgcaccactaa

SEQ ID NO: 36611 - protein, 721 aa, Shigella sonnei Ss046
MPGFTMDTKKLFKHIPWVILGIIGAFCLAVVALRRGEHVSALWIVVASVSVYLVAYRYYSLYIAQKVMKLDPTRATPAVINNDGLNYVPTNRYVLFGHHFAAIAGAGPLVGPVLAAQMGHLPGTLWLLAGVVLAGAVQDFMVLFISSRRNGASLGEMIKEEMGPVPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFIPFLKKTDSLVAGIIGTAGCVGLWGYLLYQGVVDPLGGVKSLWPLFGISNQMLAAVALVLGTVVLIKMKRTQYIWVTVVPAVWLLICTTWALGLKLFSTNPQMEGFFYMASQYKEKIANGTDLTAQQIANMNHIVVNNYTNAGLSILFLIVVYSIIFYGFKTWLAVRNSDKRTDKETPYVPIPEGGVKISSHH

SEQ ID NO: 36612 - DNA, 2400 bp, Bifidobacterium longum DJO10A
  CDS (1)..(2400)
atgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcggatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgaccgccatcgccatggcattcctggcgctcgtggccatcaaggccatggccgcctcgccgtgggccgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctctggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcactgaccaacgccaaggccgcgctgtccaacgcgtatctggacggcgtgctctccgtgttcttcctggtcatgatgggcgtcttcgtggtagtcggtatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtag

SEQ ID NO: 36613 - protein, 799 aa, Bifidobacterium longum DJO10A
MTTAAAQAPAPGKLEFKDDYTPDEAERVIRNSKGLPVGVRPKMVWTWKKALLWAAIAIVCACGWAILAVSRGERISAIWFLVVALSSYAIAYRFYAYYIQIKIMRTDDANATPAERVHDGANFERTDRRVLFGQHFAGISGAGPLVGPILAAQMGYLPSTLWIILGVIFAGAVQDMLVLWISAKRRGRSLGQMATDEMGKFGGMILSIFLVVMTAIAMAFLALVAIKAMAASPWAVFSIGMTIPIALIMGCYQRFLRPGRVIETTLLGFVLLVLDIVAGGWIASIPAVAAVFTLDAKQLVIALVIYSFAAAALPHWLLVTPRDYLSTLMKIGTLVLLVIGIIIANPSVKVPGLTELASTSTGPTFSGNLFPFLFITIACGALSGFHGAVSSGLTPKAVEKENQIRMIGYGSMLVESFTAVIALIAAITISQGVYFSTNMSAAQITAASGVSISATSTPGEQADAAVKAVESMKVSDIEGNQMQVTWDSVDENGAAKTYEGAAALEQAAADIGETSIVSRTGGATTFAMGMANFLKSYLGGHDSMAFWYHFAIMFEALFILTTVDNGTRVARYQIGEMLGNVRKLKKFADPTWKPGNIITTLIATALWGGLLWMGVSDANGGINAMVPIFGISNQLLAAACFVLITVCVAKMGYWKHLWIPVVPLVWDIAVTFTADFQKIFGPLSYFTTASKYQAQIDSGELTGEALTNAKAALSNAYLDGVLSVFFLVMMGVFVVVGIVVVARTFAAGKYGAETTSEEPFVESQWFAPSSLVATALEKKVQREYSAKLHELVRNGQVAA

SEQ ID NO: 36614 - DNA, 2055 bp, Pseudomonas syringae pv. syringae B728a
  CDS (1)..(2055)
atgcgccatgttccctggctcatcgttgcaattgtcggggcatgtgcccttggggtcgtggccttgcgccgcggagaggcgatcaacgccttgtggatagtggtcgctgcggtagctatctacctggttgcctatcgttactacagtcttttcatcgccactcacgtcatgcagctcgatccgctgcgcgcgacaccggcggtggtcaacaacgacggtctggactatgtgccgaccaacaaacacattctcttcggacaccactttgccgccatcgctggcgcaggcccgctggtcggcccggtactggcagcgcaaatgggctatctgcccggcacgctctggctgatcgcaggcgtggtgctggccggtgcggtgcaggacttcatgatcctgttcctctccacgcgccgtgacggacgctcgctgggtgacatggttcgcgaggaaatgggccgtattcccggcaccatcgcgctgttcggctgcttcctgatcatgatcatcatcctggcggtgctggcgctgatcgtggtcaaggccctggccgagagcccgtggggcatgttcacggtcatggcgacgatcccgatcgcgatgttcatgggcatttatatgcgctacatccgtccggggcgcattggtgaaatctccatcgtcggtgtcattctgttgctcggttcgatctgggtcggcgggatggtagcggcggatccgacctgggggccgatgttcacgttcaccggtgtgcagatcacctggatgctggtcggttacggctttgtagcggccatgctgccggtctggctgctgcttgcgccccgtgactacctgtcgaccttcctgaaaatcggcaccattctggcactcgcgatcggcatcctgatcctggcgcccgagctgaaaatgccggccctgacccagttcaccaacggcacaggcccggtctggaagggcgcattgttcccgttcctgttcatcaccattgcctgcggtgcagtgtcgggtttccacgcactgatctcctcgggcaccacgcccaagctgctggataacgagaagaacgcccgttacatcggttacggcggcatgttgatggagtccttcgtggccatcatggcgatggttgccgcttcggtgatcgagccgggcgtgtacttcgccatgaacagcccggctgccgtggtcggcagtgacgtggtgaccgtcgcgcagacggtgtccagctggggctttgccatcacgccggagcaactgacggctgtggcgaaagacattggtgaaaacaccgtgctggcgcgggctggtggtgctccgacgctggccgtcggtatcgcacagatcctccatcaggtgctgccgggtgaaaacaccatggcgttctggtaccactttgcgattctgttcgaggcgctgttcatcctgaccgccgtcgacgccgggacacgtgccggacgcttcatgctgcaggacctgctgggcagcttcgttccggccttgaaacgcaccgagtcgtggacggccaacgccatcggcaccggcggttgcgtggcgctgtggggctatctgctctatcagggcgtcatcgacccgctgggcggcatcaataccttatggccgctgttcggtatctccaaccagatgctcgccggtatcgccctgatgctggccagcgtggtgctgatcaagatgaagcgtcagcgctacgtctgggtgaccatgctgcctgccgtctggctgctgatctgcaccgtgaccgctggcttgatcaagctgttcgacgccaaccctgcggtaggtttcctggccctggccaagaaatacagcgcggcggccgatgccggtcagattctggccccggccaagaccatggaccagatgcagcacgtgatcttcaacgcttacaccaacgccgggctgaccgtgctgttcctgttcgtggtgttcagcatcctgttctacgccattaaagtcggccgtgcggcctggagcaccaaggagcgcaccgacaaggaagcgccattccaggccatgccgccagcgtcgcaggtgtga

SEQ ID NO: 36615 - protein, 684 aa, Pseudomonas syringae pv. syringae B728a
MRHVPWLIVAIVGACALGVVALRRGEAINALWIVVAAVAIYLVAYRYYSLFIATHVMQLDPLRATPAVVNNDGLDYVPTNKHILFGHHFAAIAGAGPLVGPVLAAQMGYLPGTLWLIAGVVLAGAVQDFMILFLSTRRDGRSLGDMVREEMGRIPGTIALFGCFLIMIIILAVLALIVVKALAESPWGMFTVMATIPIAMFMGIYMRYIRPGRIGEISIVGVILLLGSIWVGGMVAADPTWGPMFTFTGVQITWMLVGYGFVAAMLPVWLLLAPRDYLSTFLKIGTILALAIGILILAPELKMPALTQFTNGTGPVWKGALFPFLFITIACGAVSGFHALISSGTTPKLLDNEKNARYIGYGGMLMESFVAIMAMVAASVIEPGVYFAMNSPAAVVGSDVVTVAQTVSSWGFAITPEQLTAVAKDIGENTVLARAGGAPTLAVGIAQILHQVLPGENTMAFWYHFAILFEALFILTAVDAGTRAGRFMLQDLLGSFVPALKRTESWTANAIGTGGCVALWGYLLYQGVIDPLGGINTLWPLFGISNQMLAGIALMLASVVLIKMKRQRYVWVTMLPAVWLLICTVTAGLIKLFDANPAVGFLALAKKYSAAADAGQILAPAKTMDQMQHVIFNAYTNAGLTVLFLFVVFSILFYAIKVGRAAWSTKERTDKEAPFQAMPPASQV

SEQ ID NO: 36616 - DNA, 1470 bp, Desulfovibrio desulfuricans G20
  CDS (1)..(1470)
atgctgtacttttttctggctgttgcagcactgctggtcggctacgccgtatacagcaaggtagtggaacgcgccttcggcgcggatgaatgccgggccacaccggcctgcaccatggaagacggtgtggactatgtgaagatggatcccaaaaaaatctggctgatccagcttctgaacattgccggtctgggtcccatcttcggccccattctgggtgcgctgtacggtcccgcggccctgctgtggattgtcatcggatctattttcgcgggtgctgtgcacgactacttcgcaggcatgatgtcggtgcgctacagcggcaaatccatccccgacgccgtcggctacaaccttggttctttcgccaagcacttcatgaacgtgttcgccgtcattctgctgctgcttgtgggcgtcgtgtttgttctcggtccggcaaagctgctggcagtcaagctgggcttcggccttgaaggcgacggcgccgtggctaccgccaccatgatctggacgggcatcattttctgttactactttatcgccaccgtactgcccgtggataaaatcatcggccggttgtaccccctgttcgccgtggtgctgcttatcatggcgttcggcctgaccatcatgctcatcgccaagggatacgaattctatccgcagggtctcacgcttgaaaacctgcatcccaaaaacctgcccatgtggccgctgatgttcatcaccatcgcctgcggtgccatttccggcttccatgccacgcagtctccgctgatggcccgctgcgtgcccgatgaaaaatgcggacgccccatattctacggcgccatgatcggcgaaggcatcatcgcccttatctgggcaactctgggcatgagctttttccacacccccggagaactgcaggccgtgctggataacggcggccccgcagccgtggtggatactgtatccatgacccttatggggcccataggcggcttccttgccatcatcggcgtggtggttctgcccatcacttccggtgacacggctttccgttccgcccgtctcatcattgccgacttcatcaagctgcctcagaaggcaccggtcaagcgtctgttcattgccgtgccgctgttcgcagtcggctacgccatcacgctcacgccgtttgcagtcatctggcgctacttcggcttttccaaccagctgctggccaccatcgtgctgtgggcgggcgccatgtatcttgtccgccacggcaaggcacactggatggcatccatccccgccacattcatgacggcagtatgcgcaacctaccttgcctacgccaaaatcggcttcggcctttccatggatatcgcacaggttttcggcattgccgtggctgtgctgtgcgccggtttcttcctggtgaagatccgcagcgtgcccgtggagcccgacgccgccgacggtcccggccgcatcggctga

SEQ ID NO: 36617 - protein, 489 aa, Desulfovibrio desulfuricans G20
MLYFFLAVAALLVGYAVYSKVVERAFGADECRATPACTMEDGVDYVKMDPKKIWLIQLLNIAGLGPIFGPILGALYGPAALLWIVIGSIFAGAVHDYFAGMMSVRYSGKSIPDAVGYNLGSFAKHFMNVFAVILLLLVGVVFVLGPAKLLAVKLGFGLEGDGAVATATMIWTGIIFCYYFIATVLPVDKIIGRLYPLFAVVLLIMAFGLTIMLIAKGYEFYPQGLTLENLHPKNLPMWPLMFITIACGAISGFHATQSPLMARCVPDEKCGRPIFYGAMIGEGIIALIWATLGMSFFHTPGELQAVLDNGGPAAVVDTVSMTLMGPIGGFLAIIGVVVLPITSGDTAFRSARLIIADFIKLPQKAPVKRLFIAVPLFAVGYAITLTPFAVIWRYFGFSNQLLATIVLWAGAMYLVRHGKAHWMASIPATFMTAVCATYLAYAKIGFGLSMDIAQVFGIAVAVLCAGFFLVKIRSVPVEPDAADGPGRIG

SEQ ID NO: 36618 - DNA, 1584 bp, Haemophilus somnus 2336
  CDS (1)..(1584)
atgttatggtttttcttttgtgttgccctattgattttaggctatttcacatacggtaaatttgttgagaaagtatttgttatcaatccgaacaagaaaacgcccgcttattctatgacagatggtgttgactatgttccgatgtctaaaaagaaaatttggctaattcaattattgaatatcgcaggcacaggtccgattttcggaccgattatgggggcattatatggaccggtggcgatgttatggattgtactgggttgtgtatttgccggtgcagtacatgattatttctgtggtatgttgagcgttcgtaatggtggtgcttcaatgcctactcttgccggacgctatttaggtactcccgttaaagtatttattaacgtacttgccgttgttttattattccttgtcgggattgtgtttgtaaccagtcctgctcagttattaagtactattactttagatatgtttggtagtgcaagtatggctacaaccaatgcacatgaggtggtaagtgcggtacaaaacgctggtgagatccgtgtttggggaatggataaaccgacagttgtggcggtttggactggaattattttcctttactatattgtggcgacattgttaccgattgataagattattggacgtatttatccattatttggtggattattattattcatgtctgccggtatggtatatggcttagtatccagccatttaaatggtgctgatccaattgaatttttccgttccgttgatggtatgagttttgaaaaattcttacaaaactttgaaactcgtaaagagctaccattatggccattattattcttaaccatttcttgtggtgcactttccggtttccatgcaactcaatctccattgatggcacgttgtgctgaaaatgagaaagaaggtcgttttattttctacggagccatgattgcagaaggtgttattgctttagtttggtgtactgttggtttaagtttctatgaaaatttgggtgaactattagctgcaacccaacaaggttcaccttccaaagtagtgtatgattcttctatttatttcttagggactattggtggtgtttttgctgtattaggggtagttgtgctacctattacttccggagatacagcattccgttccgctcgtttgattattgcggagttcttaaaaattgaacaacgcactttggtgaaacggttacttattgcagttccgttatttgcagtcggtttttggattattgcatcaaaaattgactttggtgtgttgtggcgttatttcacttgggcaaaccaagcaacagcaatggtgatgctatggacagctgcggcttatctatatcgttacaataaattccattgggtgtgtactattccggcagcatttattagtgcggtatgttttacatacttagcctataacaaaattggttttggtttagattatcaactttccgtttatattggtattggattaactattttgtgtttagtggctttctttattttattgaaaccgttaggttcgaaagatccggatgcctttataaatgatgtagcataa

SEQ ID NO: 36619 - protein, 527 aa, Haemophilus somnus 2336
MLWFFFCVALLILGYFTYGKFVEKVFVINPNKKTPAYSMTDGVDYVPMSKKKIWLIQLLNIAGTGPIFGPIMGALYGPVAMLWIVLGCVFAGAVHDYFCGMLSVRNGGASMPTLAGRYLGTPVKVFINVLAVVLLFLVGIVFVTSPAQLLSTITLDMFGSASMATTNAHEVVSAVQNAGEIRVWGMDKPTVVAVWTGIIFLYYIVATLLPIDKIIGRIYPLFGGLLLFMSAGMVYGLVSSHLNGADPIEFFRSVDGMSFEKFLQNFETRKELPLWPLLFLTISCGALSGFHATQSPLMARCAENEKEGRFIFYGAMIAEGVIALVWCTVGLSFYENLGELLAATQQGSPSKVVYDSSIYFLGTIGGVFAVLGVVVLPITSGDTAFRSARLIIAEFLKIEQRTLVKRLLIAVPLFAVGFWIIASKIDFGVLWRYFTWANQATAMVMLWTAAAYLYRYNKFHWVCTIPAAFISAVCFTYLAYNKIGFGLDYQLSVYIGIGLTILCLVAFFILLKPLGSKDPDAFINDVA

SEQ ID NO: 36620 - DNA, 1587 bp, Actinobacillus pleuropneumoniae serovar 1 str. 4074
  CDS (1)..(1587)
atgttgtggttcttcttttgtgtagcagtccttgtactcggctacttcgtttacggtaaaatcattgaaaagattttcgtgattaaccccaaaaaagcaacacctgcttataccatgaatgacggtgtggactatatgccaatgtctaaaactaagatttggcttattcagttattaaacattgcgggtaccggcccaatcttcggtccgattctcggtgcgttatacggccctgttgcaatgctttggatcgttatcggttgtatttttgccggtgcggtacatgactacttctgcggtatgttaagtattcgtaacggtggcgcgacaatgccggcgttagcgggtaaattcttaggtcgcccggttaaagtatttatcaacgttatggcgttaatccttctattattagtaggtgtggtattcgttgcaagtccggcgcaattaatggcaaccattacaatggatgtattcggtgcagctggcggaacgttacaattaaacgatgcggaagccgttcaccaagcggttgaagccggtggtattacagtttggggtatggataaagcaaccgttatttctgtttggacattaattatcttcggttactatatcttagcaactttacttccaattgataaaattatcggtcgaatctacccattcttcggtgcattattactctttatgtctgtaggtatggtgtacggtttaattaccgctcacttcagtgcaaccgatccaatcgaattcttccgtaccgttaatgcggacggtcaaggcttaacgtgggaaaaattcactcaaaacttccaagtgaagggcgatgttccgatttggcctttattattcttaactatttcttgtggtgcgttatcaggcttccacgcaacccaaaccccattaatggcgcgttgtgcggaaaatgaaagcgaaggtcgtttcattttctacggtgcaatgattaccgagggtgtaatcgcattagtatggtgtatggtcggtcttgcattctatgaaaatccacaagcgttacaagatgcaatttcggcaggttcaccgtctaaagtggtttatgacagttcattacacttcttaggctttatcggcggtattttcgcagtactcggcgtagtagtattaccgattacttcaggcgatacggcattccgtgcggcacgtttacaattggctgaactctttaaaattgatcaacgttcattagctaaacgtttaatgattgcagtaccgttattcgcattaggtttcgtggtatcaaaaattgacttcagtatcttatggcgttacttcacttgggcaaaccaaatgacagcaatggtaatgctttggactgcggcggcatacttatatcgctacaaaaaattccactgggtatgttcaatccctgcgtggtttattacaaccgtatgtgcaacctacttgttctataacaaaatcggcttcggtttagattatgaactttcggtttacttaggtttagcttcaaccgttgtttgtatcgtgctattcttcacaatgcttaaaccgttaggcgagcgtgacgaagatgcttatgcagcaaactaa

SEQ ID NO: 36621 - protein, 528 aa, Actinobacillus pleuropneumoniae serovar 1 str. 4074
MLWFFFCVAVLVLGYFVYGKIIEKIFVINPKKATPAYTMNDGVDYMPMSKTKIWLIQLLNIAGTGPIFGPILGALYGPVAMLWIVIGCIFAGAVHDYFCGMLSIRNGGATMPALAGKFLGRPVKVFINVMALILLLLVGVVFVASPAQLMATITMDVFGAAGGTLQLNDAEAVHQAVEAGGITVWGMDKATVISVWTLIIFGYYILATLLPIDKIIGRIYPFFGALLLFMSVGMVYGLITAHFSATDPIEFFRTVNADGQGLTWEKFTQNFQVKGDVPIWPLLFLTISCGALSGFHATQTPLMARCAENESEGRFIFYGAMITEGVIALVWCMVGLAFYENPQALQDAISAGSPSKVVYDSSLHFLGFIGGIFAVLGVVVLPITSGDTAFRAARLQLAELFKIDQRSLAKRLMIAVPLFALGFVVSKIDFSILWRYFTWANQMTAMVMLWTAAAYLYRYKKFHWVCSIPAWFITTVCATYLFYNKIGFGLDYELSVYLGLASTVVCIVLFFTMLKPLGERDEDAYAAN

SEQ ID NO: 36622 - DNA, 2067 bp, Pseudomonas aeruginosa UCBPP-PA14
  CDS (1)..(2067)
atgaacaataacaatagcctgctacgtcacctcgcctggctggtggtggcgatcgtgggcgccgcggccctgggcgtcgtcgccctgcgtcgtggcgaagcgatcaacgccttgtggatcgtggtggcggcggtggccatctacctggtcgcctaccgttactacagcctgttcatcgccagcaaggtgatgcaactggaccccaaccgcgccactcccgcggtactcaacaacgatggcctggactacgtcccgaccaacaagcacatcctcttcggccaccacttcgccgccatcgccggcgccggtccgctggtcggtccggtccttgccgcgcagatgggctacctgcccggcaccctctggctgatcgccggcgtagtcctcgccggcgcggtgcaggacttcatggtcctgttcatctccagccgccgcaacggccgctcgctgggcgagctggtgcgcgaggaaatgggccaggtggccgggaccatcgcgctgttcggcgccttcctgatcatgatcatcatcctcgcggtgctcgcgctgatcgtggtgaaggctctggccgacagcccctggggcatgttcaccgtcctcgcgaccattcccatcgcgctgttcatgggcgtctacatgcgcttcatccgccccggccggatcggcgagatctcgatcatcggggtgttcctcctgctcggttcgatctggctcggcgggcaggtcgcggccagtccggaatgggcgccgcatttcaccttcagtggaatccagatcacctggatgctgatcggctacggcgccgtcgcctcggtactgccggtgtggctgctgctggcgccgcgcgactacctgtcgaccttcctcaagatcggcaccatcatcggcctggcgatcggcatcctgatcgtcatgccggatctgaagatgccggccctgacccagttcaccgacggcaccggcccggtctggaaaggcagcctgttcccgttcctgttcatcaccatcgcctgcggcgcggtgtccggcttccacgcgctgatctcctcggggaccacgccgaagctgctcaaccgcgagcccgacgcccgctacatcggctacggcggcatgctgatggagtccttcgtggcgatcatggcgatggtcgccgcctcggtgatcgagccgggcatctacttcgccatgaacagcccgccggcggtggtcggcgccgacgtcaacgcggtggccgcgaccgtcagcagctggggcttcgccatcacgccggagcaactcacccagaccgcccaggacatcggcgagaccaccatcctggcccgtgccggcggcgcgccgaccctggcggtggggatcgcgcacatcctccaccaggtgctgccgggcgagaacaccatggccttctggtaccacttcgcgatcctcttcgaggccttgttcatcctcaccgcggtggacgccggcacccgtgccgggcgcttcatgctgcaggacctgctgggcaacttcgtgccggcgctgaagaagaccgagtcgtggaccgccaacatcatcggcaccggcggctgcgtggcgctgtggggctggctgctgtaccagggcgtggtcgacccgctgggtgggatcaataccctgtggccgctgttcggcatttccaaccagatgctcgccggcatcgcgctgatgctcgccaccgtggtcctgatcaagatgaagcgccagcagtatgtctgggtcaccatcctgccggcggcctggctgctgatctgcaccaccaccgcgggcctgatcaagatcttcgacagcaacccggcggtcggcttcgtcgcccttggcgagaagtacgccaccgcgctggatgctggccaggtgctggcgccggccaaggatatcggccagatgcagcacgtggtgctgaacgcctacatcaacgccggtctgaccgtgctgttcctgctggtggtgttcagcgtactgttctacgccatcaaggtcggcatcgcggcctggggcaagagcgagcggaccgacaaggaaaccccgttcgagcccattcccgacgcctga

SEQ ID NO: 36623 - protein, 688 aa, Pseudomonas aeruginosa UCBPP-PA14
MNNNNSLLRHLAWLVVAIVGAAALGVVALRRGEAINALWIVVAAVAIYLVAYRYYSLFIASKVMQLDPNRATPAVLNNDGLDYVPTNKHILFGHHFAAIAGAGPLVGPVLAAQMGYLPGTLWLIAGVVLAGAVQDFMVLFISSRRNGRSLGELVREEMGQVAGTIALFGAFLIMIIILAVLALIVVKALADSPWGMFTVLATIPIALFMGVYMRFIRPGRIGEISIIGVFLLLGSIWLGGQVAASPEWAPHFTFSGIQITWMLIGYGAVASVLPVWLLLAPRDYLSTFLKIGTIIGLAIGILIVMPDLKMPALTQFTDGTGPVWKGSLFPFLFITIACGAVSGFHALISSGTTPKLLNREPDARYIGYGGMLMESFVAIMAMVAASVIEPGIYFAMNSPPAVVGADVNAVAATVSSWGFAITPEQLTQTAQDIGETTILARAGGAPTLAVGIAHILHQVLPGENTMAFWYHFAILFEALFILTAVDAGTRAGRFMLQDLLGNFVPALKKTESWTANIIGTGGCVALWGWLLYQGVVDPLGGINTLWPLFGISNQMLAGIALMLATVVLIKMKRQQYVWVTILPAAWLLICTTTAGLIKIFDSNPAVGFVALGEKYATALDAGQVLAPAKDIGQMQHVVLNAYINAGLTVLFLLVVFSVLFYAIKVGIAAWGKSERTDKETPFEPIPDA

SEQ ID NO: 36624 - DNA, 1425 bp, Fusobacterium nucleatum subsp. vincentii ATCC 49256
  CDS (1)..(1425): transl_table=11
atgtatagttttataggttcaattatagcattggtacttggatattttatctatggaaaatttgttgaaggtgtttttgggatagagccttcaagagaaacacctgcaaaaagattagcagatggtgttgactatatggaaatgagttggccaaaagcatttcttattcaatttcttaatatagctggaacaggtcctatatttggagcagttgctggagcattatggggtccagctgcatttatttggatagtatttggttgtatctttgcaggttcagttcatgattttctaataggaatgatgtctttaagaaaagatggagcatctgtttctgaaatagtaggagaaaatttaggtatgactgcaaaacaaataatgagagttttctctgttatacttctattattagttggtgttgtatttataatgagtccagctcaaattttaactaatataacaggggttaattatacagtttggttaggagtcattataatttattatctttgtgcaactgtattaccaattgatacaattattggtaaaatttatccaatatttggtttatctcttttagtaatggcatttggtataggtggaggcttaataataaataatgctaatattcctgaaatagcttttgtaaatatgaatccagcaggaagatcagttttcccttatctatgtataacaatagcttgtggagcaattagtggtttccatgctactcaatctcctatgatggctagatgtttaaaaacagaaaaatcaggaagaaaagttttctatggtgcaatgatatcagaaggaattatagctcttatttgggctgctgctgcaatgtcattctttggtggaatacctcaacttgcagaagcaggtactgctgctgttgttgttaataaaatatctgttggaattttaggaaaagctggaggtgttttagcattattaggagttgttgcttgtcctataacttctggggatactgcatttagaagtgcaagacttactattgctgattctctaaactataaacaaggacctgttgtaaatagatttgttgttgcaattcctttatttgttcttggaattatattatgtttcacaccatttgatgttatttggagatattttggttgggcaaatcaaactcttgctacaatagctctatgggcagcagttaaatatttggcaaacagaggaaaaaattattggatagctttagttccagcaatgtttatgacagttgttgtaacttcttatatacttgcagcaccagaaggatttgtaagattctttggagataaagatataaaagtaatagaacatattgcaatagcaataggttgtgttgtatcattagtatgtacagctgcattctttatgacaaataaaaaatctaaattaattactgaataa

SEQ ID NO: 36625 - protein, 474 aa, Fusobacterium nucleatum subsp. vincentii ATCC 49256
MYSFIGSIIALVLGYFIYGKFVEGVFGIEPSRETPAKRLADGVDYMEMSWPKAFLIQFLNIAGTGPIFGAVAGALWGPAAFIWIVFGCIFAGSVHDFLIGMMSLRKDGASVSEIVGENLGMTAKQIMRVFSVILLLLVGVVFIMSPAQILTNITGVNYTVWLGVIIIYYLCATVLPIDTIIGKIYPIFGLSLLVMAFGIGGGLIINNANIPEIAFVNMNPAGRSVFPYLCITIACGAISGFHATQSPMMARCLKTEKSGRKVFYGAMISEGIIALIWAAAAMSFFGGIPQLAEAGTAAVVVNKISVGILGKAGGVLALLGVVACPITSGDTAFRSARLTIADSLNYKQGPVVNRFVVAIPLFVLGIILCFTPFDVIWRYFGWANQTLATIALWAAVKYLANRGKNYWIALVPAMFMTVVVTSYILAAPEGFVRFFGDKDIKVIEHIAIAIGCVVSLVCTAAFFMTNKKSKLITE

SEQ ID NO: 36626 - DNA, 1587 bp, Haemophilus influenzae R2846
  CDS (1)..(1587)
atgttatggtttttcttttgtgtagccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcgcgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttctccatctaaagttgtgtatgatagttcgttacatttcttaggttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactgcagcgggatatttatatcgttatcataaattccactgggttgcgtctcttcctgcgtggtttatcacaacagtatgtgcaacttatttgttctacaacaaaattggtttcggcttagattatcagctttctgtgtatcttggtttagcaacaaccatcgtttgtatcgtattgttcttcacaatgcttaaaccattaggtacgcgagatgaagaagcttatataaataattag

SEQ ID NO: 36627 - protein, 528 aa, Haemophilus influenzae R2846
MLWFFFCVAVLIIGYFIYGKIIEKIFVINPKRQTPAYQVNDGVDYMPMSKTKIWLIQLLNIAGTGPIFGPILGALYGPVAMLWIVIGCIFAGAVHDYFCGMLSIRHGGATMPYLAGKFLGRPVKVFINTLALVLLLLVGVVFVASPAQLMGTITMDVFGASQSALVLGDAEAVHHSVEAGGIKVWGMDKATVVALWTAIIFAYYILATLLPVDKIIGRIYPLFGALLLFMSVGMVYGLVVSHFSATDPIEFFRTINADGEGLTWAKFTQNFQVKGDVPIWPLLFLTISCGALSGFHATQTPLMARCTENESEGRFIFYGAMITEGVIALVWCMVGLAFYENPQALQDAISAGSPSKVVYDSSLHFLGFIGGIFAILGVIVLPITSGDTAFRAARLQIAEIFNVDQRSLPKRLLIAVPLFVLGYFISTIDFSVLWRYFTWANQMTAMVMLWTAAGYLYRYHKFHWVASLPAWFITTVCATYLFYNKIGFGLDYQLSVYLGLATTIVCIVLFFTMLKPLGTRDEEAYINN

SEQ ID NO: 36628 - DNA, 1587 bp, Haemophilus influenzae R2866
  CDS (1)..(1587)
atgttatggtttttcttttgtgtagccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgctggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaggtgcgttagtgcttggtgatgcagaggcagttcatcattctgttgaagctggcgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcacgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttctccatctaaagttgtgtatgatagttcgttacatttcttaggttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactgcagcgggatatttatatcgttatcataaattccactgggttgcgtctcttcctgcgtggtttatcacaacagtatgtgcaacttatttgttctacaacaaaattggtttcggcttagattatcagctttctgtgtatcttggtttagcaacaaccatcgtttgtatcgtattgttcttcacaatgcttaaaccattaggtacgcgagatgaagaagcttatataaataattag

SEQ ID NO: 36629 - protein, 528 aa, Haemophilus influenzae R2866
MLWFFFCVAVLIIGYFIYGKIIEKIFVINPKRQTPAYQVNDGVDYMPMSKTKIWLIQLLNIAGTGPIFGPILGALYGPVAMLWIVIGCIFAGAVHDYFCGMLSIRHGGATMPYLAGKFLGRPVKVFINTLALVLLLLVGVVFVASPAQLMGTITMDVFGASQGALVLGDAEAVHHSVEAGGIKVWGMDKATVVALWTAIIFAYYILATLLPVDKIIGRIYPLFGALLLFMSVGMVYGLVVSHFSATDPIEFFRTINADGEGLTWAKFTQNFQVKGDVPIWPLLFLTISCGALSGFHATQTPLMARCTENESEGRFIFYGAMITEGVIALVWCMVGLAFYENPQALQDAISAGSPSKVVYDSSLHFLGFIGGIFAILGVIVLPITSGDTAFRAARLQIAEIFNVDQRSLPKRLLIAVPLFVLGYFISTIDFSVLWRYFTWANQMTAMVMLWTAAGYLYRYHKFHWVASLPAWFITTVCATYLFYNKIGFGLDYQLSVYLGLATTIVCIVLFFTMLKPLGTRDEEAYINN

SEQ ID NO: 36630 - DNA, 2079 bp, Burkholderia cepacia R18194
  CDS (1)..(2079)
atgaatcgggcttccagtaccctgctctggattgcggtcgcgctgctcggcgcgttcgcgttcggcacgatcgcactcgcacacggcgagcgcgtcagtgccctctggatcgtgatcgccgcagtctgcgtgtatctgatcgcgtatcgcttctacagccgtttcatcgccagcaaggtcatgcagctcgacgggctgcggatgacgccggccgtcaagtacaacgatggcctcgactacgtgccgaccaacaagtacgtgctgttcggccatcacttcgccgcgatcgccggcgccggcccgctcgtcgggcccgtgctcgccgcgcagatgggctacatgcccggcatgctgtggatcctggccggcgtcgtgttcgccggtgcggtgcaggacttcatcgtgctgttcatctcgacgcgccgcgacggccgctcgctcggcgatctcgtcaagatggagctcggcacggtgcccggcgtgatcgcgctgttcggcgcgttcctgatcatggtgatcatcctcgcggtgctcgcgctgatcgtcgtgaaggcgctgaccaattcgccgtggggcacgttcaccgtcgccgcgacgattccgatcgcactgttcatgggcgtctatacgcgctacatccgtccgggccgcatcggcgaagtgtcgatcatcggcttcgtgctgctgatggcatcgatcgcgttcggccagcacgtgcacgattcgccgacgctcgccgcgtggttcacgttcacgggcacccagctcacgtggatcctgatcggctacggcttcgtcgcctcggtgctgccggtgtggctactgctcgcgccgcgcgactacctgtcgacgttcctgaagatcggcacgatcctcggcctcgcgatcggcatcctggtcgtcgcaccggaactgaagatgcccgcgctgacgaagttcgtcgatggcacgggccccgtgtggtcgggcggcctgttcccgttcctgttcatcacgatcgcgtgcggtgccgtgtcgggcttccatgcgctgatctcgtcgggcacgacgccgaagctgatcgacaacgaaaccaacgcgcgcttcatcggttacggcgcgatgctgatggagtcgttcgtcgcgatcatggcgctggtcgccgcgagcgtgatcgagccgggcatctacttcgcgatgaacgcgccggccgccgtgctcggctcgacgccggaagcggtcgccaacaccgtcacgcaatggggcttcgtgctgacgccggacatgctgacgcagaccgcgaaggccgtcggtgaaacgacgatcatcgcgcgcgcgggcggcgcgccgacgctggccgtcggcatggcgcacatcctgcaccaggtgatcggcggcgaagcgatgatggcgttctggtatcacttcgcgatcctgttcgaggcgctgttcatcctgacggccgtcgacgccggcacgcgcgcaggccgcttcatgctgcaggacctgctcggcacgttccacccggcgctcaagcgcaccgagtcgctgcccgcgaacctggtcgcgaccgcgctgtgcgtggccgcgtggggctacttcctgtaccagggcgtggtcgatccgctcggcggcatcaacacgctgtggccgctgttcggcatctcgaaccagatgcttgccgcgatcgcgctggtgctcggcaccgtcgtgctgttcaagatgaagcgcgagcgctatgcgtgggtgacgatcgtgccgaccgtgtggctgctgatctgcacgctgaccgccggctggcagaagattttcgacgcgaacccgaaggtcagcttcctcgcgcacgccgcgaagctgcaggccgcggtggacgaaggcaaggtgcttgccccggcgaagtcgatcgcgcagatgaagcggatcatcttcaacgactacatcgatgcggcgctggccgggttgttcatcttcgtcgtcgtggcgatcgcggtgtacggcgtgatcgccgtgctgcgcgcgcgccgcgagtcgaagccgaccgtgcgcgagacgccgtacgaagccatgccggccgcgcaggcgctcggcagcggacgttaa

SEQ ID NO: 36631 - protein, 692 aa, Burkholderia cepacia R18194
MNRASSTLLWIAVALLGAFAFGTIALAHGERVSALWIVIAAVCVYLIAYRFYSRFIASKVMQLDGLRMTPAVKYNDGLDYVPTNKYVLFGHHFAAIAGAGPLVGPVLAAQMGYMPGMLWILAGVVFAGAVQDFIVLFISTRRDGRSLGDLVKMELGTVPGVIALFGAFLIMVIILAVLALIVVKALTNSPWGTFTVAATIPIALFMGVYTRYIRPGRIGEVSIIGFVLLMASIAFGQHVHDSPTLAAWFTFTGTQLTWILIGYGFVASVLPVWLLLAPRDYLSTFLKIGTILGLAIGILVVAPELKMPALTKFVDGTGPVWSGGLFPFLFITIACGAVSGFHALISSGTTPKLIDNETNARFIGYGAMLMESFVAIMALVAASVIEPGIYFAMNAPAAVLGSTPEAVANTVTQWGFVLTPDMLTQTAKAVGETTIIARAGGAPTLAVGMAHILHQVIGGEAMMAFWYHFAILFEALFILTAVDAGTRAGRFMLQDLLGTFHPALKRTESLPANLVATALCVAAWGYFLYQGVVDPLGGINTLWPLFGISNQMLAAIALVLGTVVLFKMKRERYAWVTIVPTVWLLICTLTAGWQKIFDANPKVSFLAHAAKLQAAVDEGKVLAPAKSIAQMKRIIFNDYIDAALAGLFIFVVVAIAVYGVIAVLRARRESKPTVRETPYEAMPAAQALGSGR

SEQ ID NO: 36632 - DNA, 2091 bp, Bacillus cereus G9241
  CDS (1)..(2091): transl_table=11
ttggggggattgtatgtgagaacattgaagtcgattttactttggggagttattgcagcagtaggagcaggtgcctttggtgtgatagctttatcacaaggtgaaactattaatgccgtatggctcttagtagctgcggtatgtgtgtatgcagttgcttatcgcttttatagtagatttatagcgagaaaggtattcggtttagataataatcggcaaacgccagcccatacattaaatgatggaaaagattatgttccgacaaataaatgggtattatttgggcatcattttgcagcaattgctggggctggacctttagtaggaccgattttggcggcacaaatgggatatttaccagggacaatatggattattgttggggtagttgtcgctggagctgtgcaagattttgtcattttatttgcttcgatgagacgtaatggtaaatctctcggtgaaatgattaaagatgagattggtcctgttacaggacttattgcaatgatcggtattttaggcataatgattattttattagcagtattagcattagtagtagtaaaggcgcttgtcggaagcccttggggaatgtttacgatagccgcaacgattcctattgctattttgatgggagtatatatgcgctacattagacctggacgggttggtgagggatcagtaatcggaattattctacttatactatctcttattggagggcagtatgtagcggaaaatccagcgcttgcaagcatgttcacgtttagcggagaaacaattgctattatgcttattgtatatggatttatcgcatcggcattaccagtttggatgcttttagcaccacgtgattatttaagtacatttttaaaagtcggaacaattgtaggattagcaatcggtattttaattgtagcaccagatttacaaatgccagcagtttcgaaatttattgatggaactggtcctgtgttctctggaaacttattcccgttcttatttattactattgcttgtggtgcagtgtctggattccatgctctcgtttcatcaggtacgacgccgaagatgattgagcaagagggacacgcacagccaatcggttatggagcaatgttaatggagtcgtttgtagcggcgatggcgatgattgcagcttgtgtattaacaccgggaacgtattttgcaattaatagtcccgcagcacttatcggtacagatgtctcgcaggcagctcaagttatttcctcatggggatttgctattacaccaaatgaattaaaagatctcgctgtaaacgttggagagcaaacgattttatcacgtacaggtggtgcaccaacgttagcgataggtatggcatatattttctcacaagtaataggtggaacggccatgatggcattttggtatcattttgcgattctctttgaagcgttattcattttaacaacgattgatgctggaacgcgcgtaggtcgatttatgattcaagatattttagggcatgtatataagccatttgggaaaacggattctacattagcgaatgtaatagctacaacgttatgcgtgttaggatggggctatttcttatatcaaggggtagttgatccacttggtggaattaatacattatggccacttttcggtattgcaaatcaaatgttagcaggtattgcgttattacttggaacgacaattttgttcaaaatgggaaaaaaggcatatgtttgggtgacgcttattccaactgtcggattgcttattgtaacgatgacggcgggttatcaaaagttatttcatgaaaaccctaaaataggatttctatcccacgcaaaggtgtttcaaggcgcattagatgaggggaaagtgttagcgccagctaaaaatgtcgctcaaatgaagcaaattattttcaatgattatattgatgcggcactttgtggaatttttatgatagttgtaatcgctgtattaatttctgcaattcgaatttggattcaagtattaagaaataagccgatgccgctaaaagaggcaccatatatccctagagatgaaagtgagtcgaggaactatgcttaa

SEQ ID NO: 36633 - protein, 696 aa, Bacillus cereus G9241
MGGLYVRTLKSILLWGVIAAVGAGAFGVIALSQGETINAVWLLVAAVCVYAVAYRFYSRFIARKVFGLDNNRQTPAHTLNDGKDYVPTNKWVLFGHHFAAIAGAGPLVGPILAAQMGYLPGTIWIIVGVVVAGAVQDFVILFASMRRNGKSLGEMIKDEIGPVTGLIAMIGILGIMIILLAVLALVVVKALVGSPWGMFTIAATIPIAILMGVYMRYIRPGRVGEGSVIGIILLILSLIGGQYVAENPALASMFTFSGETIAIMLIVYGFIASALPVWMLLAPRDYLSTFLKVGTIVGLAIGILIVAPDLQMPAVSKFIDGTGPVFSGNLFPFLFITIACGAVSGFHALVSSGTTPKMIEQEGHAQPIGYGAMLMESFVAAMAMIAACVLTPGTYFAINSPAALIGTDVSQAAQVISSWGFAITPNELKDLAVNVGEQTILSRTGGAPTLAIGMAYIFSQVIGGTAMMAFWYHFAILFEALFILTTIDAGTRVGRFMIQDILGHVYKPFGKTDSTLANVIATTLCVLGWGYFLYQGVVDPLGGINTLWPLFGIANQMLAGIALLLGTTILFKMGKKAYVWVTLIPTVGLLIVTMTAGYQKLFHENPKIGFLSHAKVFQGALDEGKVLAPAKNVAQMKQIIFNDYIDAALCGIFMIVVIAVLISAIRIWIQVLRNKPMPLKEAPYIPRDESESRNYA

SEQ ID NO: 36634 - DNA, 2067 bp, Rubrivivax gelatinosus PM1
  CDS (1)..(2067)
atgacccatctacgcaagcaccttccctgggtgctcgtcgccatcgtcggcgcgttcgcgctggcgaccatcgcgctgcagcgcggtgaagccatcagcgccctgtgggtggtggtggccgccctgtgcgtctacctcatcgcctaccgctactacagcctgttcctggcgaccaaggtgctgggtctcgatccgaaccggcagacgccggcacaccgccacaacgatggcctggactacgtgccgaccaacaagtacgtgctctacggccaccacttcgccgcgatcgcgggcgccggtccgctggtcggcccggtactggccgcacagatgggctacctgccgggcatgctgtggctgctggccggcgtggtgttcgccggcgcggtgcaggacttcatcgtgctgttcatctccacgcggcgcgacggccgttcgctcggcgagctggtgaagcaggagatgggcacggtgccgggcgtcatcacgctgttcggcgccttcatgatcatgatcatcatcctggcggtgctggcgctgatcgtcgtcaaggcgctggcgcactcgccgtggggtgcggtcaccgtgggcctgacgatcccggtcgcgctgttcatgggcatctacagccgctacctgcggccagggcgcatcggcgaggtctcggcgatcggcttcgtgctgctgatggcggccatctggctgggcggctgggtgcacgagcatgcggccctgtccgcgctgttcgacttcgacggcaaggctctcacctggatgctgatcggctacggcttcatcgcctcggtcttgccggtgtggctgctgctggcgccgcgcgactacctgtcgaccttcctgaagatcggcaccatcatcgcgctggcgatcggcatcctgatcgtcgcaccgacgctgcagatgccggcactgacccagttcgcgcagggcaacggcccggtgtggtcgggcaacctgttccccttcctgttcatcaccatcgcctgcggcgcggtgtcgggcttccatgcgctgatctcgtcgggcaccacgcccaagatgctggagaacgagacgcacgcgcgcttcatcggctacggcggcatgctggccgagtccttcgtcgcgatcatggcgctggtggcggcctcggtgatccagccgggcatctacttcgcgatgaacagcccggccgcgctgatcggcacgacgccggaggcggtggcgcagaccctgtcgacctggggcttcgtgatcacgcccgacgtgctgatccagaccgccaaggacgtgggcgagaacaccatcctcgcacgcgccggcggcgcaccgacgctggccgtgggcatggcgcacatcctgcaccaggtggtcggcgggcccgcgatgatggccttctggtaccacttcgcgatcctgttcgaggcgctgttcatcctgaccgcggtcgacgccggcacgcgcgccgggcgcttcatgctgcaggacctgctgggcaacttcatcccggcgatgaagcgcaccgactcgctgcccgccaacctgatcgccaccggcctgtgcgtggcgacctggggctacttcctgtacgccggcgtggtggatccgctgggcggcatcaacacgctgtggccgctgttcggcatctccaaccagatgctggccgccgtggcgctgacgctgggcaccgtggtgctgttcaagatgaagcgccagcgctacgcctgggtcaccatcgtgccggcggcgtggctgctgatctgcacgctgaccgccggctggctgaagctgttctcgccggatccgaaggtcggcttcctggcccacgcgcagaagttcggcgacgcgctggcgcaggggacggtgctggcgccggccaagtcgctcgacgcgatgcgccacatcgtggtcaacgactacatcaacgccagcttgtgcgtgctgttcatgctggtcgtcgtgagcacggtgttctatgcggtcaagtcgatcttgaaggcgctgggcaaccagtcgccgaccgtgcgcgaaacgccgttcgaaccgatgccgcaaggcgccggcggctga

SEQ ID NO: 36635 - protein, 688 aa, Rubrivivax gelatinosus PM1
MTHLRKHLPWVLVAIVGAFALATIALQRGEAISALWVVVAALCVYLIAYRYYSLFLATKVLGLDPNRQTPAHRHNDGLDYVPTNKYVLYGHHFAAIAGAGPLVGPVLAAQMGYLPGMLWLLAGVVFAGAVQDFIVLFISTRRDGRSLGELVKQEMGTVPGVITLFGAFMIMIIILAVLALIVVKALAHSPWGAVTVGLTIPVALFMGIYSRYLRPGRIGEVSAIGFVLLMAAIWLGGWVHEHAALSALFDFDGKALTWMLIGYGFIASVLPVWLLLAPRDYLSTFLKIGTIIALAIGILIVAPTLQMPALTQFAQGNGPVWSGNLFPFLFITIACGAVSGFHALISSGTTPKMLENETHARFIGYGGMLAESFVAIMALVAASVIQPGIYFAMNSPAALIGTTPEAVAQTLSTWGFVITPDVLIQTAKDVGENTILARAGGAPTLAVGMAHILHQVVGGPAMMAFWYHFAILFEALFILTAVDAGTRAGRFMLQDLLGNFIPAMKRTDSLPANLIATGLCVATWGYFLYAGVVDPLGGINTLWPLFGISNQMLAAVALTLGTVVLFKMKRQRYAWVTIVPAAWLLICTLTAGWLKLFSPDPKVGFLAHAQKFGDALAQGTVLAPAKSLDAMRHIVVNDYINASLCVLFMLVVVSTVFYAVKSILKALGNQSPTVRETPFEPMPQGAGG

SEQ ID NO: 36636 - DNA, 1989 bp, Pseudomonas fluorescens PfO-1
  CDS (1)..(1989)
atggcattgcgccgaggcgaggcgatcaacgccttgtggattgtggtcgccgccgtggccatctatctggttgcgtaccgttactacagtctgttcatcgctaacaatgtgatgcaactcgatccgcgtcgggccacccccgccgtgctcaacaacgacggtctggactacgttccaaccaacaaacacattctcttcggtcaccacttcgcggccatcgccggcgcgggacctctggttggcccggtactggcggcgcagatgggctatctgcccggtacgctgtggctgatcgccggcgtggtgctggcgggtgcggtgcaggacttcatggtcctgttcatgtcgacccgtcgcaacggccgttcgctgggtgacatggtgcgtgaagaaatgggccgtatccccggcaccatcgccctgttcggctgcttcctgatcatgatcatcatcctcgcggtgctggcgctgatcgtggtgaaagccctggctgagagcccgtggggcatcttcaccgtgatggcgaccatcccgatcgcgatgttcatgggcatctacatgcgctacatccgtccgggccgcatcggcgagatctcggtagtcggcgtgttgctgctgctgggttcgatctggctgggtgggcagattgccgccgatccggtctgggccaaggccttcaccttcactggcgtgcagattacctggatgctggtcggttacggtttcgtcgccgcttcgctgccggtgtggctgattctggcgccgcgtgactatctctccacgttcctcaagatcggtaccatcgtcgccttggcgatcggcatcctggtgaccatgcccgagctgaaaatgccggcactgacccagttcgtcgacggcaccggcccggtgtggaagggcggtctgttcccgttcctgttcatcaccatcgcttgcggtgcggtatccggtttccacgcgctgatctcttccgggaccacgccgaagctgctggataacgaaaccaacgcccgttacatcggttacggcggcatgctgatggaatcgttcgtggccatcatggccatggtcgctgcctcggtgatcgagccaggcgtgtacttcgccatgaacagcccggccgccgtggtcggcggtgatgtggtgtccgtggcaaccgcagtcagtaactggggctttgcaattaccccggaagccctgcaagccgtggcgcatgacatcggcgaaaccaccattctggctcgtgccggtggtgcaccgaccctggcggtcggtatcgcgcagatcctgcacagtgtcctgccgggtgaaaacaccatggcgttctggtaccacttcgcgatcctgttcgaagcgctgttcattctgaccgcagtcgatgccggtacacgtgccggtcgcttcatgctgcaggacttgctcggctccttcgtgccggcactcaaacgtactgaatcctggtccgccaacctgatcgccaccgccggttgtgtggcgatgtggggctggttgctgtatcagggcgtggtcgatccactgggcgggatcaacaccctgtggccgctgttcggtatctccaaccagatgctcgccggtatcgcgctgatgctcggtaccgtggtcctgatcaagatgaagcgccagcgttacatctgggtcaccctgctgccggccacctggctgctgatctgcaccacgactgcaggcttcatcaagctgttcgacgccaacccggcgatcggcttcctgtcgctggccaagaagtacagcgatgcactggccaacggtcaggtgctggcgccggcgaaaagcgtcgagcagatgcagcacgtgatcttcaacgcctacaccaacgctacattgaccgcgctgttcctgttcgtggtattcagcatcctgttctatgcgctcaaggtcggcatcgccgcctggggcaaaaaagagcgtacggacaaagaatcgccattccaggccctgccggacgcgtaa

SEQ ID NO: 36637 - protein, 662 aa, Pseudomonas fluorescens PfO-1
MALRRGEAINALWIVVAAVAIYLVAYRYYSLFIANNVMQLDPRRATPAVLNNDGLDYVPTNKHILFGHHFAAIAGAGPLVGPVLAAQMGYLPGTLWLIAGVVLAGAVQDFMVLFMSTRRNGRSLGDMVREEMGRIPGTIALFGCFLIMIIILAVLALIVVKALAESPWGIFTVMATIPIAMFMGIYMRYIRPGRIGEISVVGVLLLLGSIWLGGQIAADPVWAKAFTFTGVQITWMLVGYGFVAASLPVWLILAPRDYLSTFLKIGTIVALAIGILVTMPELKMPALTQFVDGTGPVWKGGLFPFLFITIACGAVSGFHALISSGTTPKLLDNETNARYIGYGGMLMESFVAIMAMVAASVIEPGVYFAMNSPAAVVGGDVVSVATAVSNWGFAITPEALQAVAHDIGETTILARAGGAPTLAVGIAQILHSVLPGENTMAFWYHFAILFEALFILTAVDAGTRAGRFMLQDLLGSFVPALKRTESWSANLIATAGCVAMWGWLLYQGVVDPLGGINTLWPLFGISNQMLAGIALMLGTVVLIKMKRQRYIWVTLLPATWLLICTTTAGFIKLFDANPAIGFLSLAKKYSDALANGQVLAPAKSVEQMQHVIFNAYTNATLTALFLFVVFSILFYALKVGIAAWGKKERTDKESPFQALPDA

SEQ ID NO: 36638 - DNA, 2046 bp, Rhodospirillum rubrum
  CDS (1)..(2046)
atgctgggctggctggcaaccgctgttctgggagcgatcgccctcggcgtcgttgctttgcagcggggggaaagcatcaacgccatttggctggtgatcgccgccgtctgtacctacttcatcgcctatcgcttctacggactgttcatcgccaagcgtgttttgggcgttgacgccaatcgtcagacgcccgccgtccgccgcaacgacggcctggattacgtgccgacgaaccgctacgtgttgtttggccaccatttcgccgccattgccggcgccggtccgctggttggtccggtgcttgccgcgcagatgggctatatgcccggaaccttgtggatcctggccggcgtggtcttcgccggcgccgtccaggactcgatggtgctgttctgctcgacccggcgcgacggtcggtcgctgggcgacatgatccgtaccgaaatgggtccggtggccggcgccatcggtctggtcggcgtgctgctgatcatgatcatcatcctggccattctggctttggtggtggtcaaggctttggcgggcagcccttggggtaccttcacggtcttctcaactattcccatcgccctgatcatgggcgtctattcgcgcttcatccggcccggccgcatcgccgagatgagcgggatcggcttcgtgctgctgatgctggctttggtctatggccagtcggtggccgaaagcccgaccctggccccgttgttcacctatacgggcaccgaactggcgctgatcatcatcggctatggcttcgtcgcctcggtcttgccggtctggctgctgctggcgccgcgtgactatctgtcgaccttcctcaagatcggcgtcatcgtcggcttggccatcggcatcgtcatcgtcatgcccgacatgaagatgccggcggtgaccaaattcatcgatggcaccggcccggtgttcagcggcgcgctgttcccgttcctgttcatcaccatcgcctgcggcgccgtttccggcttccacgccctgatctcctcgggcaccacgcccaagatgatcgagaacgagaatcaggtcgccttcatcggctatggcggcatgttgatggaaagcttcgtggcgatcatggccatggtcgccgcctgcgtcatcgatcccggcgtctatttcgccatgaacagcccggcggcgctgatcggcaccgatgcggtcaacgccgcggcggtgatctcgtcgtggggcttcgccgtgacccccgacatcctcacccagaccgccgccgacgtcggcgaatcctcgatcctgtcgcgggccggcggcgcgccgaccctggccgtgggcatggcccatatcttctcggcggtcatcggcggcaaggcgatgatgggcttttggtaccacttcgccatcttgttcgaggccctgttcatcctgaccgccgtcgacgccggcacgcgggcctgccgcttcatggttcaagacatgatcggcagcgtcgttcccgccttcaaggccacccggtcgtggggcaataatctgctcgccacgggcatctcggtgtcgctgtggggctatatcctctatacgggcgttaccgatccctttggcggcatcaacagcctgtggccgttgtttggcatctccaaccagatgctggcgggcatggcgctgatcatgatcaccgtcattttgttcaagatgaagcgtcagcgtcacgcctgggtctcgatcatcccggccacctggctgctcatctgcaccacctatgccgggctgctcaaggtgttctcgcccgatccgaagatcggcttctgggcccaggcccagcgcttttcgacggccctggacgagggcaagatccttggccccgccaagacggtggaccatatgcgtcaggtgatgttcaataactatctcgacgccgccctggccttcgccttcgtccttgtcgtggcggcgaccctggtctacgcggtgatcgccatccgcaaggcgcaggcgacgagccggccgacggccctggaggttggcggcccaacggaggttagaacgcatgcttga

SEQ ID NO: 36639 - protein, 681 aa, Rhodospirillum rubrum
MLGWLATAVLGAIALGVVALQRGESINAIWLVIAAVCTYFIAYRFYGLFIAKRVLGVDANRQTPAVRRNDGLDYVPTNRYVLFGHHFAAIAGAGPLVGPVLAAQMGYMPGTLWILAGVVFAGAVQDSMVLFCSTRRDGRSLGDMIRTEMGPVAGAIGLVGVLLIMIIILAILALVVVKALAGSPWGTFTVFSTIPIALIMGVYSRFIRPGRIAEMSGIGFVLLMLALVYGQSVAESPTLAPLFTYTGTELALIIIGYGFVASVLPVWLLLAPRDYLSTFLKIGVIVGLAIGIVIVMPDMKMPAVTKFIDGTGPVFSGALFPFLFITIACGAVSGFHALISSGTTPKMIENENQVAFIGYGGMLMESFVAIMAMVAACVIDPGVYFAMNSPAALIGTDAVNAAAVISSWGFAVTPDILTQTAADVGESSILSRAGGAPTLAVGMAHIFSAVIGGKAMMGFWYHFAILFEALFILTAVDAGTRACRFMVQDMIGSVVPAFKATRSWGNNLLATGISVSLWGYILYTGVTDPFGGINSLWPLFGISNQMLAGMALIMITVILFKMKRQRHAWVSIIPATWLLICTTYAGLLKVFSPDPKIGFWAQAQRFSTALDEGKILGPAKTVDHMRQVMFNNYLDAALAFAFVLVVAATLVYAVIAIRKAQATSRPTALEVGGPTEVRTHA

SEQ ID NO: 36640 - DNA, 1812 bp, Rhodospirillum rubrum
  CDS (1)..(1812)
atggacaacgccctaacgttcgtgatctcgacactgtgtatcctcgcgctttgttaccgcttctatggcgtgttctttgtgcggaaggtactgcgtgccgatgattcagtcgtaaccccctcgcatacgttcgaggacggcaagaattacgtacccacgaaaaagtgggtcaacgccggtcagcatttcgccgccatcgccgccgccggtccgctggtcggtccggttctggccgcccagttcggctaccttcccggtttcctgtggttgctcgtcggctgcgtcgtcggcggcgccgttcacgacacggtcgtgctcttcgcctcgatgaagcacaacggcaagtcgctctccaatgtcgccaaggccgaattgggcccggtggcggggtggtgcaccggtctggcgatgctgttcatcatcaccatcaccatggccggcctgtcgatggtggtcgttcacgcgctggaacggaacccctggggaaccttcgccgtgttcatgaccattcccatcgccatcgccgtgggtctgtacgaacgcttcaccggcaaccacaagggcgccacctgggttggcatcatcgccatcatggtcgcggttctggccggtccctatatccagggcacgctgcttggcgattggctgacgctgcgcgtcgactccgtcgccctcgccctgccgatctacgccttcttcgccagcgccctgccggtgtggctgctgctgacgccgcgcggctatctgtcgagcttcatgaagatcggcgtcttcggcgccctggtcgtcggcgtcgtcatcatcaacccgaccatccagttccccgccctgaccgatttcatccacggcggtggtccggtcctggccggcccggtgtggcccttcatctcgatcaccatcgcctgcggcgccatctcggggttccacgccttcatcggctcgggcaccacgcccaagctggtcgataagtggagcgacatccgccccgtcgcctttggcgccatgctcgccgaatgcatggtcgccgtgctggccctggtcgccgccaccgccctgcaccccgccgattacttcgccatcaacgccagccccgccgccttcgccagcctgggcatggaggtcgtcgacctgccgcacctcagccaggagatcggcatggatctggccggccgcaccggcggcgccgtcaccctggccgtcggcatgaccttcatcttcaccaagctgccctggttcgccacgctgtcgtcctacttcttccagttcgtcatcatgttcgaggcggtgttcatcctgaccgccgtcgactcgggtacccgggtcgcccgctacctgatccaggacctgggtggcgatctttacgccccgctcaagcgcctggactggatccccggttcgatcggcgccagcgtcgccgcctgcgcgctgtggggctacctgctgacctcgggcgatatcaactcggtctgggcgctgtttggagtgtcgaaccagctgatggcctcgatcggcctgatcatcggcgccacgatcatcctgcgggtcgccgccaagcgcatctacatgctgacctgcctgatcccgctggcctacctgttcgtcacggtgaattacgccggctactggatgatcgccaacgtttatctgaacacccaggcccgcggctacaacccgatcaacgccggcatctcggccatcatgatggtgctcggcctgatcatcctgatcaccgcttttggcaaatggaaaacgatgctcgccctgcccaagagcctgcgctcgggtgaggtgccggccccgtcgctgccctga

SEQ ID NO: 36641 - protein, 603 aa, Rhodospirillum rubrum
MDNALTFVISTLCILALCYRFYGVFFVRKVLRADDSVVTPSHTFEDGKNYVPTKKWVNAGQHFAAIAAAGPLVGPVLAAQFGYLPGFLWLLVGCVVGGAVHDTVVLFASMKHNGKSLSNVAKAELGPVAGWCTGLAMLFIITITMAGLSMVVVHALERNPWGTFAVFMTIPIAIAVGLYERFTGNHKGATWVGIIAIMVAVLAGPYIQGTLLGDWLTLRVDSVALALPIYAFFASALPVWLLLTPRGYLSSFMKIGVFGALVVGVVIINPTIQFPALTDFIHGGGPVLAGPVWPFISITIACGAISGFHAFIGSGTTPKLVDKWSDIRPVAFGAMLAECMVAVLALVAATALHPADYFAINASPAAFASLGMEVVDLPHLSQEIGMDLAGRTGGAVTLAVGMTFIFTKLPWFATLSSYFFQFVIMFEAVFILTAVDSGTRVARYLIQDLGGDLYAPLKRLDWIPGSIGASVAACALWGYLLTSGDINSVWALFGVSNQLMASIGLIIGATIILRVAAKRIYMLTCLIPLAYLFVTVNYAGYWMIANVYLNTQARGYNPINAGISAIMMVLGLIILITAFGKWKTMLALPKSLRSGEVPAPSLP

SEQ ID NO: 36642 - DNA, 2106 bp, Campylobacter lari RM2100
  CDS (1)..(2106): transl_table=11
atgagtgtaacaaacaaaatactttggttttttgtcgctattgttgctgctgtatgttttagtatattagcgctccaaaatggcgaaagtatttcagcaatttaccttgttattgctgctttatgtatttatatcataggatatagattttatggtagatatattgcatataaagtcttagaactagataaaaatagagcaactcctgctaccgttaaaaatgatggatgtgactttgtccctactaacaaaattgtactttttgggcatcattttgcagctattgcaggagctggtcctttagtaggtcctatactggctgctcaaatgggttatttaccttccatgctttggattttaatcggcggagtactagctggagcagtgcatgactttgttgttttgtttatctctacacgccgtaatggaaaatctttaggtgaaatgataaaagatgaacttggtaagcttactggtggatttgctatgcttgctatctttggaatcatgttaatcattatagcaattttggcaatggttgttgttaaagccttggctgagtcaccttggggattgtttaccatagccatgacaatacctattgctatttttatgggtatttatatgagatttttaagacctggtaaagtaggtgaagcttctataataggttttatacttcttatacttgctatacattatggtagtgaaatagctgctaatccttattgggctaatattttcacactaagcgctccaactctagcccttataatgatggcttatggttttatagcagcgattttaccagtttggtttttacttgctccaagagattatttatcaacttttttgaaaatcggtgttattgtaattatggctttggctattatctttgtagcacctgatttacaaatgccaaaaatcaattctcaatatttagatggaagtggtcctgtgtttgctggagctatttttccatttttatttatcactatagcatgtggagctattagtggttttcatgctttaatttcaagtggtacaactcctaaaatgcttgaaaatgaaacccatgctttagctgttggatatggctccatgcttatggaaagtgctgtggctatcatggctttaatttgtgcttgtattttacatcctggtctttattttgctattaactctcctgcagctgttatagggactgatgttgtcaatgccgctgctactatttctagctggggctttaaaataacacctgaagaaattacaactcttactaccaatataggagaacaaagtatactttcaagaactggtggagcaccaacattcgccgtaggtgtagctttaattttacacgagctttttggtggagtaaatttaatgggcttttggtatcactttgctattttatttgaggctttatttattttaactgcagttgatgcaggaacgagagcttgcagatttatggctcaagatatattaggcaatatatataaacctttaggaaatatcaataacacttttgcaggtatttttgccactgcattgagtgttgcaggttggggatattttctttatcaaggagccattgatccaaaaggtggaatttactcactttggccactttttggagtgagcaaccaaatgcttgctggcatggctttacttttagctagtgcgattttatttaaaatgggcaaggcaaaatatacttgggtaacgctggtcccagctacttttgttctagttgcaactctttatggaggatttcaaaaaatacttccatataaagaaggcgataaagtacataatgccgtaagccatgtagctgctgtacaagttaatgctcaaaaaataaaagatttaaatttaaaattagagcaaacaactgatcaaatacaaattgaacaaattaaaaaagatttaaaactagcctcacaagctaaaacatctaatcttgtcaatgcaatactttgtgtgtttttcatgattaccactttgcttgttatactttcttgctttggaatttttatcaaaaaattaaacattcctttaaaagaaagcccttatatagcattaaaaaaggaaaaagcatga

SEQ ID NO: 36643 - protein, 701 aa, Campylobacter lari RM2100
MSVTNKILWFFVAIVAAVCFSILALQNGESISAIYLVIAALCIYIIGYRFYGRYIAYKVLELDKNRATPATVKNDGCDFVPTNKIVLFGHHFAAIAGAGPLVGPILAAQMGYLPSMLWILIGGVLAGAVHDFVVLFISTRRNGKSLGEMIKDELGKLTGGFAMLAIFGIMLIIIAILAMVVVKALAESPWGLFTIAMTIPIAIFMGIYMRFLRPGKVGEASIIGFILLILAIHYGSEIAANPYWANIFTLSAPTLALIMMAYGFIAAILPVWFLLAPRDYLSTFLKIGVIVIMALAIIFVAPDLQMPKINSQYLDGSGPVFAGAIFPFLFITIACGAISGFHALISSGTTPKMLENETHALAVGYGSMLMESAVAIMALICACILHPGLYFAINSPAAVIGTDVVNAAATISSWGFKITPEEITTLTTNIGEQSILSRTGGAPTFAVGVALILHELFGGVNLMGFWYHFAILFEALFILTAVDAGTRACRFMAQDILGNIYKPLGNINNTFAGIFATALSVAGWGYFLYQGAIDPKGGIYSLWPLFGVSNQMLAGMALLLASAILFKMGKAKYTWVTLVPATFVLVATLYGGFQKILPYKEGDKVHNAVSHVAAVQVNAQKIKDLNLKLEQTTDQIQIEQIKKDLKLASQAKTSNLVNAILCVFFMITTLLVILSCFGIFIKKLNIPLKESPYIALKKEKA

SEQ ID NO: 36644 - DNA, 2112 bp, Campylobacter upsaliensis RM3195
  CDS (1)..(2112): transl_table=11
atgaattctcttactacaaaaattttatggctttttgtggcagctttgggtgctgtttgttttggctacttagccttgcaaaatggagaaagtgtttcagcgatttatttggtcgttgcggcggtgtgtatctatatgataggatatagattttatgggcgttttgtggcttatagggttttagagcttgataaaacgcgtgccactccagcccttacacaaaatgacggacgcgattttgtccctacaaataaagtcgttctttttggacaccattttgcagcgattgctggagcgggtcctttggtaggtcctattttggcggctcaaatgggctacttgccttctatgctttggattttagtcggtggtgttttagcgggtgctgtgcatgattttgtcgtgctttttatctctacaaggcgtaatggtcgctctttaggggagatgataaaagatgagatgggaaatttcacaggcggcgtagctatggtggcgatttttggcattatgcttattattattgctattttggctatggttgtcgttaaggctttagcggagtctccttggggtttatttactattgcgatgacgattcctattgcgatttttatgggaatttatatgagatttttgcgtcctggtagagtaggagaggcttctattataggttttgtgcttttgattttatccattcattatggtagcgttgtaactgctgatgcgtattggaaagaatttttcacccttgacgcaccgactttggctattgtgatgatgatttatggttttgtagcggctgttttacctgtgtggtttttgttagcacctagggattatctttcgacttttttaaaaatcggcgttatagttttgatggctgtggctattgtgatagtcgctccggatttacaaatgcctaaggcaaatacgcagtattttgacggaactggtcctgtttttgcgggagctattttccctttcttgtttattaccatagcttgtggggcgattagtggttttcacgctttaatttcaagtggaacaacccctaaaatgcttgaaaatgaaacacacgctttagcggtgggttatggttctatgcttatggaaagtgccgtggctattatggctttgatttgtgcttgtattttgcatccgggaatttattttactgttaattcttcaagtgctttaataggcacggatttagctggtgttgcggcgactatttctagctggggctttagcgttagctctgaagagattatgagtcttacaaaaagcataggcgaagagaccatactttcaagaacgggtggtgcgccgacttttgctatcggtgtggctttgattttgcatgagttatttagcggtgtggatttaatggcgttttggtatcactttgccattttatttgaagctttatttattttaacggcagttgatgctggcactagggcgtgtcgttttatggtgcaagatattttgggtaatgtttataagcctttaggaaatatacacagcattcctgcgggaatttttgcgactgctttgagtgtggctggctggggttattttctttatcaaggggcgattgatcctaagggtggaatttatacgctttggcctttatttggtgtgagcaatcaaatgcttgcaggtatggctttgcttcttgctacaactatacttgtaaaaatgggcaaggcaagatatacttgggtaacctttgtgccagcgacctttgttttaatcgccacactttatggtggtattcaaaaaatcctaccttatgaagagggtaatagggtgcgtaatgccataagccatgttgccacagcaaaaattcaaagtgataaaatcactactttagaagctaagttagccactatcactgatgaggcggaaaaagcgaaaattcaaaaagatatttctgtcgccactcaggcgaaatttgcaaatattttaaatgctatattgtgcgtgttctttatgataacaaccctacttgtcattatctcttgtgtgggaatttgctttggtaggataagaattccactcaaagaaagcccttatataaagcttgatagcaaacaaattgtttaa

SEQ ID NO: 36645 - protein, 703 aa, Campylobacter upsaliensis RM3195
MNSLTTKILWLFVAALGAVCFGYLALQNGESVSAIYLVVAAVCIYMIGYRFYGRFVAYRVLELDKTRATPALTQNDGRDFVPTNKVVLFGHHFAAIAGAGPLVGPILAAQMGYLPSMLWILVGGVLAGAVHDFVVLFISTRRNGRSLGEMIKDEMGNFTGGVAMVAIFGIMLIIIAILAMVVVKALAESPWGLFTIAMTIPIAIFMGIYMRFLRPGRVGEASIIGFVLLILSIHYGSVVTADAYWKEFFTLDAPTLAIVMMIYGFVAAVLPVWFLLAPRDYLSTFLKIGVIVLMAVAIVIVAPDLQMPKANTQYFDGTGPVFAGAIFPFLFITIACGAISGFHALISSGTTPKMLENETHALAVGYGSMLMESAVAIMALICACILHPGIYFTVNSSSALIGTDLAGVAATISSWGFSVSSEEIMSLTKSIGEETILSRTGGAPTFAIGVALILHELFSGVDLMAFWYHFAILFEALFILTAVDAGTRACRFMVQDILGNVYKPLGNIHSIPAGIFATALSVAGWGYFLYQGAIDPKGGIYTLWPLFGVSNQMLAGMALLLATTILVKMGKARYTWVTFVPATFVLIATLYGGIQKILPYEEGNRVRNAISHVATAKIQSDKITTLEAKLATITDEAEKAKIQKDISVATQAKFANILNAILCVFFMITTLLVIISCVGICFGRIRIPLKESPYIKLDSKQIV

SEQ ID NO: 36646 - DNA, 2112 bp, Campylobacter coli RM2228
  CDS (1)..(2112): transl_table=11
atggctcgttttggaactaaaattttatggttgtttgtcgcagctttaggtgctatttgttttgctcatttagctttacaaaatggcgagagtgtatcagcaatttatctagtagttgctgctgtgtgtatctatatgataggatatagattttatggacgctttgtagcgtataaggttttagaacttgacaaaaatcgtgctacacctgcagttttagaaaatgatggacgcgattttgttcctacaaatagaacagttttgtttggacatcattttgctgctattgcaggtgctggtcctttagtgggtcctattttggctgctcagatgggatatttaccttctatgctttggattttagtgggaggtgttttagcaggtgcggttcatgactttgttgtgctttttatatccactcgtagaagaggtagaagtttaggcgaaattatcaaagatgaaatgggtaaatttaccggtggtgttgcaatggtagcaatttttggtatcatgcttattatcatcgctattttagctatggtagttgtaaaagctctcgcagagtcaccttggggattatttaccattgcaatgactattcctatagcaatttttatgggagtatatatgcgctttattcgtccaggtagagtaggtgaggcttcagttataggttttatacttttgattctagcgattcattatggtagtgttatagctgctgatccttattgggcgaaaatattcacattagaagctccaactttggcaattattatgatggcttatggctttatcgcagctgttttacctgtatggtttttattggctccaagagattatctttctactttcttaaagattggtgttattgttgtaatggctgtagctattattatcgttgcacctgatttgcaaatgccaaaaaccaatgctcagtattttgatggaacaggtcctgtatttgcgggtgctatttttccatttttgtttataaccattgcttgtggtgctattagtggttttcatgctcttatttcaagtggaactactccaaaaatgcttgaaaatgaaactcatgctttgcctgttggatatggctctatgcttgcagaaagtgctgtagcaattatggctttaatttgtgcttgtattttacatcctggactttattttgctataaattcaagttctgctttaataggatctgatgttgcaagtgcggcgcaagctatttcaagttggggatttagtatcactcctgaagaaatttctactttaactgcaaatataggagaatacactatactttctagaacaggtggggctccaacttttgctataggcgtagctttaattttacatgagctttttggtggtattgatctaatggctttttggtatcattttgctatattgtttgaagctttatttatcttaacagctgtggatgctggaactagagcttgccgttttatggtgcaagatatcttaggtaatgtctataaacctttgggaaatattcataattatccagctggacttttagcaactgcattgagtgttgcaggatggggatattttctttatcaaggtgcgattgatcctaaaggcggtatttataccctttggcctctctttggtgtaagcaatcaaatgcttgcaggtatggctttacttcttgctacagccatacttgtaaaaatgggcaaggcaaaatacacttgggtaactttaattcctgctacatttgttttggtagcaaccctatatggaggaatacaaaaagttatgccttacgaagaaggaaataaagtaggaaatgctgtaagccatgtggcagcagttactatacaaagtcaaaaaattcaagatttagaattgaaattaaacaatgccaaagatgaaaatgaaattgcagcaattgaaaaagaaatttctgtagctactcaaagtaagatcggaaatttaatcaatgccattctttgtgtgtttttcatgttggccacattgcttgtcatactctcttgcataggaatttgcctaggtaagattaaaattccactaaaagaaaccaaatatattaaacttgatgaatttcaaaaagtttaa

SEQ ID NO: 36647 - protein, 703 aa, Campylobacter coli RM2228
MARFGTKILWLFVAALGAICFAHLALQNGESVSAIYLVVAAVCIYMIGYRFYGRFVAYKVLELDKNRATPAVLENDGRDFVPTNRTVLFGHHFAAIAGAGPLVGPILAAQMGYLPSMLWILVGGVLAGAVHDFVVLFISTRRRGRSLGEIIKDEMGKFTGGVAMVAIFGIMLIIIAILAMVVVKALAESPWGLFTIAMTIPIAIFMGVYMRFIRPGRVGEASVIGFILLILAIHYGSVIAADPYWAKIFTLEAPTLAIIMMAYGFIAAVLPVWFLLAPRDYLSTFLKIGVIVVMAVAIIIVAPDLQMPKTNAQYFDGTGPVFAGAIFPFLFITIACGAISGFHALISSGTTPKMLENETHALPVGYGSMLAESAVAIMALICACILHPGLYFAINSSSALIGSDVASAAQAISSWGFSITPEEISTLTANIGEYTILSRTGGAPTFAIGVALILHELFGGIDLMAFWYHFAILFEALFILTAVDAGTRACRFMVQDILGNVYKPLGNIHNYPAGLLATALSVAGWGYFLYQGAIDPKGGIYTLWPLFGVSNQMLAGMALLLATAILVKMGKAKYTWVTLIPATFVLVATLYGGIQKVMPYEEGNKVGNAVSHVAAVTIQSQKIQDLELKLNNAKDENEIAAIEKEISVATQSKIGNLINAILCVFFMLATLLVILSCIGICLGKIKIPLKETKYIKLDEFQKV

SEQ ID NO: 36648 - DNA, 1728 bp, Brevibacterium linens BL2
  CDS (1)..(1728)
atgagtcccgtcctcctgatggtgatcggtctcgcgatcctggcactcggataccttgtgtattccaagtacctcgcgaaacgcgtctatcgcctgaatgacgatttccgcacaccctcccacgaacttaccgacggggtcgactacgtccccacgaacaaattcatcctctggggccaccacttcacttcggttgcaggcgccgcgcccatcgtcgggccagccgtcgcgctgatctggggctgggtgcctgcgttcctctgggtcacactcggcactgtcttcttcgccggtatgcacgacttcggcgcgctatgggcctcagttcgcaacaagggccagtcaatcggtgcgctgtccggccgctatatcggcaaacgcggcgctggtctgttcctgattgtaatcttcatcctgcttctgatggtgatcgcagcattcgctgttgtcatcacgggactcctcatctccactccgaccgcggtcattccgacgtggggcgcgatcggcgttgctctgctcgtcggcgtggccgtataccgtctgcgtatgccgttggtggcggtgaccatcgtcggcgtcgtcgcgctctacggactcatcgtcctcggcgatgctgtacccgtggtcctgccggagaccttcctcggcatgacgccgactgtattctggatcctgacgctgttcatctacggagcgttcgcttctctgctgccggtgtgggtgctgctgcagccgcgcgattacatcaatggcgtgcagctgttcatcggactcatcctcctctacggggctgtggtcatcggcatgttcgtcgccgacggtgcccacgacatcgtgaccccggccatcaacatgaatgtcccggagggcacccccagcatcgtgccgctgctcttcgtcacaatcgcctgtggcgctatctcaggtttccacggcatggtctcctcaggaaccagctccaaacagctggacaaggagacggactcccgcttcgtcggttatttcggcgcagtcggtgagggcctcctggctctgggaacaatcatcgcgatctccgccggacttcgcaccgtggctgagtgggaagagctttacagcaagttcggtgaagccggtgtgcagtcgttcgtccagggcggcggcatgctcatggaatccggtctgggcctgcctgcgtcattgagcaccacggtgctcgccacgatggcagtgctgttcgccgcaacctcgctcgacaccggattccgtctcatgcgattcgtcgttcaagagatgggcgaacgcgtcaacctcaggatcggcaagtacacggcgacaggagtcgtcgtcgtcctcggcatgggcctcacattctcacaggggctgggaggagaaggcggtctgcgcatctggccgctcttcggtacgaccaatcagctgatggcatcgttgacgttgatgatcctcgcggtcatgctcatccgaaagcggcgcaatccgtggccggcgctcataccgttggccatcgtattcgtcatgtcgttctgggccgcgatcgaccagctcttcagcttcgcgaccccgggaagcgcggactggctgctcttcgccatcgactgcatcatcatcgtcagcagcgtgttcgtagcgatcgaaggcatcagagcgatcatccgagctcgatcggacccgccggagcccgaggacgccgacgagaagatcgaagccgtacgcgaagaggtctga

SEQ ID NO: 36649 - protein, 575 aa, Brevibacterium linens BL2
MSPVLLMVIGLAILALGYLVYSKYLAKRVYRLNDDFRTPSHELTDGVDYVPTNKFILWGHHFTSVAGAAPIVGPAVALIWGWVPAFLWVTLGTVFFAGMHDFGALWASVRNKGQSIGALSGRYIGKRGAGLFLIVIFILLLMVIAAFAVVITGLLISTPTAVIPTWGAIGVALLVGVAVYRLRMPLVAVTIVGVVALYGLIVLGDAVPVVLPETFLGMTPTVFWILTLFIYGAFASLLPVWVLLQPRDYINGVQLFIGLILLYGAVVIGMFVADGAHDIVTPAINMNVPEGTPSIVPLLFVTIACGAISGFHGMVSSGTSSKQLDKETDSRFVGYFGAVGEGLLALGTIIAISAGLRTVAEWEELYSKFGEAGVQSFVQGGGMLMESGLGLPASLSTTVLATMAVLFAATSLDTGFRLMRFVVQEMGERVNLRIGKYTATGVVVVLGMGLTFSQGLGGEGGLRIWPLFGTTNQLMASLTLMILAVMLIRKRRNPWPALIPLAIVFVMSFWAAIDQLFSFATPGSADWLLFAIDCIIIVSSVFVAIEGIRAIIRARSDPPEPEDADEKIEAVREEV

SEQ ID NO: 36650 - DNA, 2355 bp, Lactococcus lactis subsp. cremoris SK11
  CDS (1)..(2355): n means a or g or c or t/u, s means g or c
atgaaagatattggaaactcttcaaactttaccgaagatgaagagctatttttgttacggaataaacaaggaaaaattgtcggaattaaagatttaaagcaggcaaattttcaagaaacaatgaaagactggaaaaaacatttaccaaaacccagtcttctatcaattatcatttgggtggcggtcgctttactaggtggtcttgcttggtcgttgattgctctggctcaaggagagacgattaatgcgatttggtttgttattgcagcagtttgttcttatttgattggctatcgtttttatgctttatatattcaacgtaagattatgcgtccaaatgatttacgggcaactccttcggaaagccataatgacggaaaagaattcgacccaaccaatcgagttgttttattcggtcaccattttgcttcaattgctggagctgggcctttggttggaccagttttagcggcacaaatgggttacttaccagggacaatttggattattttcggagttatttttgctggaggggtacaagatatgcttgttctctggtattctcatcgtcgtcgagcaaaatctattggggcaatggctcatgatgaagttggcagatttgctggtggcttgacttcatttattgtatttatcatgacaatgattgttcttgctgttttagctttgatttgtgtgacagcgatggcaaattctgcttgggcagtcttttcgattgggatgaccattccaattgccttattaatgggaatttatttgaaatatattcgtccagggcatgtgaatgaaatttcagcgattggttttattctccttttagttgctattttcggtggccgttgggtttcagaatcttcatttgcgcatattttcatgctttcgccaactgctttagtttggtgggtcatgggctatacttttattgcagccattatccccgcttggattttacttacgcctcgtgattacttatccatgtttatgaaaattggtacaattgctgttttagcaatagctgtagttggtgtgcgtccagatgttacaattccagctctgactaattttgcacataatacagatggtcctgcttttgctggttccctctttcccttcttatttgttacgattgcctgtggggccttgtctggtttccatgtaatgatgtcttctggaacaacgcctcatttgattgctaaagagtcacaaacgcgaatgattggttatggtgggatgctctttgaatcatttgttgctattatggctttagtcgctgcgatttctcttaatcctggaatttattattctatgaatacccctcaagctagtattcaaaaactcgcagcttcaagttatcaagcagataaaagtgctgaatataatgctgccaaagcaattccaaatgtagccatgatgcctgacggttcaaaactcagtattgactgggaaggaacgactggtgaaaaggcacttgagcaagtggcaaaagatgtaggtgaacaatcaatcgtttcacggactggtggtgcaccaactttagccgtttcaatgtcaaatattctacataaggttccacttattggtgggacaaatatgatgggattctggtatcattttgcgattatgtttgaggcgctctttatcctgtcagctgtttcagcggcaacaaaatcgactcgttatttacttaatgatgccctgcgtggcttcaaaaaattaggtcgcttaggtgatgatgattggttacctagtaaaattataacgacagcagtgattgttggagtttggggtgctttgcttttgatgggcgtttctgatccgaatggtggaataaaaatcatgtatccgctctttgggatttctaatcaattaattgcggcggtagctctggctattgtttgtgtcatggttatccgtaaaggttatcttaaatgggtttggattccagcacttcctttagtttgggatgtttgtgtaacttttgcgngccagttggcaaaaatcttttcaaatgatgtcaatattggttactttgcttcttattcagcagcaaaagcccaagtggcttctggtaaaatatctggtctagcattaacgaatacgcaagcaaccatgcgtaatacaatgattcaaggaagtctgtcagtcattttcttactttgtgtggctatattattagtcatctgtgcctttaaagttgctaaaattttaagaacaaatgaagttggtgataaatttagctcagaagaagtttttgaagaatcaaatctttttgaaacttcaagtttctggcctagtaagcttgaacataaggttttaaaaagtaaagttaatgaataa

SEQ ID NO: 36651 - protein, 784 aa, Lactococcus lactis subsp. cremoris SK11
  Xaa in the position 668 is unknown
MKDIGNSSNFTEDEELFLLRNKQGKIVGIKDLKQANFQETMKDWKKHLPKPSLLSIIIWVAVALLGGLAWSLIALAQGETINAIWFVIAAVCSYLIGYRFYALYIQRKIMRPNDLRATPSESHNDGKEFDPTNRVVLFGHHFASIAGAGPLVGPVLAAQMGYLPGTIWIIFGVIFAGGVQDMLVLWYSHRRRAKSIGAMAHDEVGRFAGGLTSFIVFIMTMIVLAVLALICVTAMANSAWAVFSIGMTIPIALLMGIYLKYIRPGHVNEISAIGFILLLVAIFGGRWVSESSFAHIFMLSPTALVWWVMGYTFIAAIIPAWILLTPRDYLSMFMKIGTIAVLAIAVVGVRPDVTIPALTNFAHNTDGPAFAGSLFPFLFVTIACGALSGFHVMMSSGTTPHLIAKESQTRMIGYGGMLFESFVAIMALVAAISLNPGIYYSMNTPQASIQKLAASSYQADKSAEYNAAKAIPNVAMMPDGSKLSIDWEGTTGEKALEQVAKDVGEQSIVSRTGGAPTLAVSMSNILHKVPLIGGTNMMGFWYHFAIMFEALFILSAVSAATKSTRYLLNDALRGFKKLGRLGDDDWLPSKIITTAVIVGVWGALLLMGVSDPNGGIKIMYPLFGISNQLIAAVALAIVCVMVIRKGYLKWVWIPALPLVWDVCVTFAXQLAKIFSNDVNIGYFASYSAAKAQVASGKISGLALTNTQATMRNTMIQGSLSVIFLLCVAILLVICAFKVAKILRTNEVGDKFSSEEVFEESNLFETSSFWPSKLEHKVLKSKVNE

SEQ ID NO: 36652 - DNA, 2355 bp, Lactococcus lactis subsp. cremoris SK11
  CDS (1)..(2355)
atgaaagatgatggaaactcttcaaactttactgatgaagaagagctgtttttgttgcgcaataaagaaggaaaaattgtcggaatcaaggatttaaagcaggcaaattttcaagaaaccatgaaagactggaaagaacatctgccaaaacctagcttattatcaattattatttgggtggctgttgctttactgggtggtcttgcttggtcattaattgcgctagctcaaggggaaacgattaatgcgatttggtttgttattgcagctgtttgttcttatttaattggttatcgtttctatgctttatatattcaacgcaaaatcatgcgtcctaatgacttgcgagcaacaccgtcagaagctcataatgacggaaaagaattcaacccaaccaatcgagtggttttattcggacaccattttgcatcaatcgctggagctgggcctttggttggaccagttttagcggcacagatgggttacttaccagggacaatttggattatttttggggttatttttgctggtggggtacaagatatgcttgttctctggtattctcatcgtcgtcgtgcaaaatcaattggggcaatggctcatgatgaagtaggtagatttgctggtggcttgacatcatttattgtttttatcatgaccatgattgttcttgctgttttagcgctgatttgtgtgacggcaatggaaaattctgcttgggcagtcttttcgattggaatgacgattccaattgctttactaatggggatttatctaaaatacatccgtccaggtcatgttaatgaaatttcagcaattggttttattttacttttagtggctatttttggtggtcgttgggtttcagaatcttcatttgctcatattttcatgctttcgccaacggctttggtatggtgggtcatgggatatacttttattgcggcgattattcccgcttggattttacttacaccacgtgattacttatccatgtttatgaaaattggtacaattgctattttagcaatagcagtcgttggtgtgcgtcctgatgtcacgattccagctttgacaaatttcgcacataatacagatggtcctgcttttgctggttcactctttccatttttattcgtcacgattgcctgtggggccttgtcaggctttcacgtcatgatgtcttctgggacgacgccccatttgattgccaaagaatcgcaaacgcgcatgattggttatggcgggatgttatttgagtcatttgttgccattatggctttagtcgctgcgatttctcttaatccggggatttattattcaatgaacaccccccaagccagtattcaaaaactagcagcttcaagttatcaagcagataaaagtgccgaatataatgcttctaaagccattcccaatgttgcgatgatgccagatggctcaaaactcagtattgattgggaaggaacgactggcgaaaaagcgctccaacaagttgcaaaagatgttggcgaaaaatcgattgtttcacggactggtggggcaccaacgctggctgtttcaatgtcaaacattctacataaggtgccagttattggtgggacaaatatgatgggcttctggtatcattttgccattatgtttgaggctctctttatcctgtcggccgtttcagccgcaactaagtccactcgttatctactcaatgatgcgcttcgaggcttcaaaaaattaggacggttgggggatgatgattggctaccaagtaaaatcgtgacaactgcggtcattgttggtgtttggggagctttacttttgatgggcgtttctgaccccaatggtggaataaaaatcatgtatccgctctttgggatttctaatcagctgattgcagctgtggctctagccattgtctgtgtcatggttattcgtaaaggttatctcaaatgggtttggattcctgccattccattggtctgggatgtttgtgtgacctttgctgccagctggcaaaaaatcttttctacggatgtaaatattgggtattttgcttcttattcagcagcgaaaagtcaagtagattcaggaaaattgacaggtttattattaaccaatgcgcaagcaaccatgcgaaatacgatgattcaaggaattctgtcagtaattttcttgctttgcgtggccatattattagcaatttgtgccgttaaagttgtcaagattttgcaaaccaataaagtcggtgataagttcagctcagaagaagcttttgaagagtccaacctttttgaaacttcaagtttatggccaagtcatcttgaacataaggttttaaaaagcaaagttaaaaattaa

SEQ ID NO: 36653 - protein, 784 aa, Lactococcus lactis subsp. cremoris SK11
MKDDGNSSNFTDEEELFLLRNKEGKIVGIKDLKQANFQETMKDWKEHLPKPSLLSIIIWVAVALLGGLAWSLIALAQGETINAIWFVIAAVCSYLIGYRFYALYIQRKIMRPNDLRATPSEAHNDGKEFNPTNRVVLFGHHFASIAGAGPLVGPVLAAQMGYLPGTIWIIFGVIFAGGVQDMLVLWYSHRRRAKSIGAMAHDEVGRFAGGLTSFIVFIMTMIVLAVLALICVTAMENSAWAVFSIGMTIPIALLMGIYLKYIRPGHVNEISAIGFILLLVAIFGGRWVSESSFAHIFMLSPTALVWWVMGYTFIAAIIPAWILLTPRDYLSMFMKIGTIAILAIAVVGVRPDVTIPALTNFAHNTDGPAFAGSLFPFLFVTIACGALSGFHVMMSSGTTPHLIAKESQTRMIGYGGMLFESFVAIMALVAAISLNPGIYYSMNTPQASIQKLAASSYQADKSAEYNASKAIPNVAMMPDGSKLSIDWEGTTGEKALQQVAKDVGEKSIVSRTGGAPTLAVSMSNILHKVPVIGGTNMMGFWYHFAIMFEALFILSAVSAATKSTRYLLNDALRGFKKLGRLGDDDWLPSKIVTTAVIVGVWGALLLMGVSDPNGGIKIMYPLFGISNQLIAAVALAIVCVMVIRKGYLKWVWIPAIPLVWDVCVTFAASWQKIFSTDVNIGYFASYSAAKSQVDSGKLTGLLLTNAQATMRNTMIQGILSVIFLLCVAILLAICAVKVVKILQTNKVGDKFSSEEAFEESNLFETSSLWPSHLEHKVLKSKVKN

SEQ ID NO: 36654 - DNA, 2301 bp, Arthrobacter sp. FB24
  CDS (1)..(2301): transl_table=11
atgggcaaaatgccggatggcaaggcgcggacagcattatcggaggacgcgctggtgcctgatccaaagcttccgccaacatcggtggacgagacggtcctcgaggcggaagagcgcaagtggacacccgcgaagatcgccatctgggcggccatcgccctgcttggcggcgttgcctggttcatgctggcgatcatccgcggcgagacagtcaacgcaatctggtttgtcttcgcgtctgtctgcacgtacctgatcggataccgcttttactccaaggtgatcgaacgctacatcaccaagcccaatgaccgccgggccacacccgcggagtacaaagctgacggcaaggactacgtccgcacggaccgcaacgtcctcttcggccaccactttgcggccatcgccggcgccgggccgcttgtcggccctgtccttgcggcccagatgggctacctgcccggcaccatctggatcatcatcggcgtcgtgctggccggagcggtgcaggactacctcgtgctgttcttctccatgcgccgcggaggccgctcgctgggccagatggcccgtgaggaacttggcgtgatcgggggcaccgcagccctcatcgccactctgctgatcatggtgatcatcgtggccatcctggccctcgtcgtcgtgaacgcactggccgaaagcccctggggcgttttctccgtcggcatgacaatccccatcgccctctttatgggcgtgtacctccgcgttcttaggcccggcaaggtcctggaagtgtcgctgatcggcttcgtgctgctgatggctgccatcatcggcggcggcgccgtggccggaacggagtggggcgcagcgttcttcactctggacaaggtcaccatcgcatggggcctggttgtctacggcttcatcgccgccatcctgccggtgtggctcctgctggctcccagggattacctctccacgttcatgaagatcggcgtgatcgtcatgctggcgctggccatcatcgtggtccggcccgaaatcagcgttccggcgttcagcgaattcgcgagccgggagaacgggcccgtgttccccggggcgctcttcccgttcctattcgtcacgattgcctgcggcgcgctgtccggcttccacgcactgattgcctccggcaccaccccgaagctgatcgaaaaggaacgccaggcgcgcctgatcggctacggcggcatgctgatggagtccttcgtggccatcatggccctcgtcgcagccatctccatcgaccgcgggctgtacttcgccatgaactccccggccgccctgaccggtggcacggtgcaaaccgctgccacctgggtcaacagcctgggccttgccggtgtgaacctcactccggacctcctggctgagaccgccaggaatgtcggcgaggaaagcatcgtgtcgcgcacgggcggtgcacccacccttgctgtgggcctggcccacatcatgcagcagttcatcggcggcacggcgatgatggcgttctggtaccacttcgccatcatgttcgaggcgctgttcatcctgaccgccgtggatgccggcacccgcgtggcccgctttatgctgcaggattccatcggcaacttcattcccaagttcaaggaacactcgtggcggccgggagcctggctctgcacggccatcatggtgggcgcctggggtgcggtgctgctgatgggcgtcaccgacccgctgggcggtatcaacacgctgttcccgctgttcggcatagccaaccagctgctcgcggctatcgcgctgtctgtctgcatggccatcgccgccaggcgggcctcgttcaagtacctctggattgtcgcgcttccgctggcttttgcagcagtcgtcaccatcaccgccagcttccagaagatcttctctcctgttccggcggtaggttacttcgccaacaacgcggcgttcgccaaggcgctggctgacggcaagaaggaattcggcacggccaagaccgtcgcggccatggaagccgtggtgcgcaacaccatgatccagggctggctgtcggtgatcttcgtggtgctgagcatcattgtcatcatgacggcgatcgtggcaaccgcaaaggcgttccgcaacgcacgcgacggcatcgcccacacggaccacgaggacccggccgtgccttcccggacgtatgctccagcgggattcatacccacggcggccgaacgggagctcgtgggcgaatggaacaaacttcccgccgagctgcgtctcgaaaagccagcacaccactga

SEQ ID NO: 36655 - protein, 766 aa, Arthrobacter sp. FB24
MGKMPDGKARTALSEDALVPDPKLPPTSVDETVLEAEERKWTPAKIAIWAAIALLGGVAWFMLAIIRGETVNAIWFVFASVCTYLIGYRFYSKVIERYITKPNDRRATPAEYKADGKDYVRTDRNVLFGHHFAAIAGAGPLVGPVLAAQMGYLPGTIWIIIGVVLAGAVQDYLVLFFSMRRGGRSLGQMAREELGVIGGTAALIATLLIMVIIVAILALVVVNALAESPWGVFSVGMTIPIALFMGVYLRVLRPGKVLEVSLIGFVLLMAAIIGGGAVAGTEWGAAFFTLDKVTIAWGLVVYGFIAAILPVWLLLAPRDYLSTFMKIGVIVMLALAIIVVRPEISVPAFSEFASRENGPVFPGALFPFLFVTIACGALSGFHALIASGTTPKLIEKERQARLIGYGGMLMESFVAIMALVAAISIDRGLYFAMNSPAALTGGTVQTAATWVNSLGLAGVNLTPDLLAETARNVGEESIVSRTGGAPTLAVGLAHIMQQFIGGTAMMAFWYHFAIMFEALFILTAVDAGTRVARFMLQDSIGNFIPKFKEHSWRPGAWLCTAIMVGAWGAVLLMGVTDPLGGINTLFPLFGIANQLLAAIALSVCMAIAARRASFKYLWIVALPLAFAAVVTITASFQKIFSPVPAVGYFANNAAFAKALADGKKEFGTAKTVAAMEAVVRNTMIQGWLSVIFVVLSIIVIMTAIVATAKAFRNARDGIAHTDHEDPAVPSRTYAPAGFIPTAAERELVGEWNKLPAELRLEKPAHH

SEQ ID NO: 36656 - DNA, 2058 bp, Azotobacter vinelandii AvOP
  CDS (1)..(2058): transl_table=11
atgaaccgactggtctctcatctcgcctggctcgccctggcggtgctgggcgccgccgccctgggtgtcgtggccctacggcgtggcgaagccatcaatgccttgtggatcgtggtcgccgcgacggcgatctatctggtcgcctaccgctactacagcctgttcatcgccaaccgggtgatgcagctcgatccacgccgcgccaccccggcggtgctcaacaacgatggtctggatttcgtgccgaccaacaagcacgtgctcttcggccatcacttcgccgccatcgccggcgccggcccgctggtcggcccggtgctcgccgcgcagatgggctacctgcccggcaccctgtggctgatcgccggggtggtgctggccggcgcggtgcaggatttcctggtgctgtgcatctccacccgccgcaacgcccgctcgctgggcgacatggtgcgcgaggaaatgggccgtgttcccggcaccatcgcgctgttcggctgtttcctgatcatgatcatcatcctcgcggtgctggcgctgatcgtggtcaaggctctggcccacagtccctggggcatgttcacggtgatcgcgaccattccgatcgccatgttcatgggcctgtacatgcgctacatccgtcccggacgcatcggcgagatctcgctgatcggcatcgtcctgctgctggcctcgatctggctgggcggcgtgatttccaccgacccctactggagcggagtgttcaccttcagcggcgtgcagatcacctggatgctgatcggctacggcttcgtcgccgcggtgttgccggtatggctgatcctcgccccgcgcgactatctgtcgaccttcctgaagatcggcaccatcgccgccctggcggtcggcatcgtgatcctcaaccccgacctgaagatgccggcggtgacccagttcatcgatggtagcggtccggtgtggaagggggcgctgtttcccttcctgttcatcaccatcgcctgcggcgcggtgtccggcttccatgcgctgatcgcctcgggtaccacgcccaagctgctggccagcgagggccacgcccgctacatcggctacggcggcatgctgatggagtcgatggtggcgatcatggccatggtcgccgccgcggtgatcgagcccggcgtgtacttcgccatgaacagcccgccggccatcgtcggcgccgatgccgccagcgtggcggcggcggtcagcggctggggtttcgccatcacgcccgaagcgctggaaagcgtcgcccgcgacatcggcgaaaccaccatcctggcgcgtgccggcggtgcgccgaccctggccgtgggcatcgcgcagatcctccaccaggtgctgccgggggcgacctccatggcgttctggtatcacttcgccattctgttcgaggcgctgttcatcctgaccgccgtggacgccggcacccgcgccgggcgcttcatgctccaggacctgctcggcaacttcgtgccggtcctgcgccgcaccgactcctggggcgccaacgtactggccaccgccggttgcgtggcgctctggggctatctgctgtaccagggcgtggtcgatccgctgggcggcatcaacaccctgtggccgctgttcggcatctccaaccagatgctcgccggcatcgccctgatgctctgcagcgtggtgctgatcaagatgaagcgccagaactacgtctgggtcaccctgctgccggccgtctggctgctgatctgcaccacggtggcgagcctgatcaagctgttcgatccgaacccggcggtcggcttcctcgccctggccagcaaatacgccgcggcgatggacaccggccaggtcctggctccggccagggacatcggccagatgcagaacgtgatcatgaacgcctataccaacgccggtctcagcgtgctgttcctggtggtggtgttcagcatcctgttctactcgctgaaggtcggccgtgccgcctggatcgtcgagcagcgcaccgacaaggaaacgcccttccaggcgattcccggcgcctga

SEQ ID NO: 36657 - protein, 685 aa, Azotobacter vinelandii AvOP
MNRLVSHLAWLALAVLGAAALGVVALRRGEAINALWIVVAATAIYLVAYRYYSLFIANRVMQLDPRRATPAVLNNDGLDFVPTNKHVLFGHHFAAIAGAGPLVGPVLAAQMGYLPGTLWLIAGVVLAGAVQDFLVLCISTRRNARSLGDMVREEMGRVPGTIALFGCFLIMIIILAVLALIVVKALAHSPWGMFTVIATIPIAMFMGLYMRYIRPGRIGEISLIGIVLLLASIWLGGVISTDPYWSGVFTFSGVQITWMLIGYGFVAAVLPVWLILAPRDYLSTFLKIGTIAALAVGIVILNPDLKMPAVTQFIDGSGPVWKGALFPFLFITIACGAVSGFHALIASGTTPKLLASEGHARYIGYGGMLMESMVAIMAMVAAAVIEPGVYFAMNSPPAIVGADAASVAAAVSGWGFAITPEALESVARDIGETTILARAGGAPTLAVGIAQILHQVLPGATSMAFWYHFAILFEALFILTAVDAGTRAGRFMLQDLLGNFVPVLRRTDSWGANVLATAGCVALWGYLLYQGVVDPLGGINTLWPLFGISNQMLAGIALMLCSVVLIKMKRQNYVWVTLLPAVWLLICTTVASLIKLFDPNPAVGFLALASKYAAAMDTGQVLAPARDIGQMQNVIMNAYTNAGLSVLFLVVVFSILFYSLKVGRAAWIVEQRTDKETPFQAIPGA

SEQ ID NO: 36658 - DNA, 2079 bp, Burkholderia vietnamiensis G4
  CDS (1)..(2079): transl_table=11
atgaatcgggcttccagtaccttgctatggaccgcggtcgcgctgctcggcgccttcgcgttcggcacgatcgcacttgcgcacggcgaacgcgtcagcgcgctgtggatcgtgatcgcagcagtctgtgtctatctgatcgcatatcgcttctacagccgtttcatcgccagcaaggtgatgcagctcgacgggctgcggatgacgccggccgtcaaatacaacgacggcctcgactacgtaccgaccaacaaatacgtgctgttcggccatcacttcgccgcgatcgccggcgccgggccgctcgtcggcccggtgctcgccgcgcagatgggctacacgccggggatgctgtggatcctgggcggcgtcgtgttcgccggcgcggtgcaggacttcatcgtgctgttcatctcgacgcgtcgcgacggccgttcgctcggcgacctcgtcaagatggagctcggcacggtgcccggcgtgatcgcgctgttcggcgcgttcctgatcatggtgatcatcctcgcggtgctcgcgctgatcgtcgtgaaggcgctgacgaattcgccatggggcacgttcaccgtcgccgcgacgattccgatcgcgctgttcatgggcatctacacgcgctacatccgcccgggccgcatcggcgaagtgtcgatcatcggcttcgtgctgctgatggcgtcgatcgcgttcggtcaggccgtgcacgattcgccgacgctcgccgcatggttcacgttcagcggcacgcagctcacctggatcctgatcggctacggcttcatcgcgtcggtgctgccggtgtggctgctgctcgcgccgcgtgactacctgtcgacgttcctgaagatcggcacgatcctcggcctcgcgatcggcatcctggtcgtcgcgccggaactgaagatgccggcgctgacgaagttcgtcgacggcaccggccccgtctggtcgggcaatctgtttccgttcctgttcatcacgatcgcgtgcggcgcggtgtcgggcttccacgcgctgatctcgtcgggcacgacgccgaagctgatcgacaacgaaaccaacgcgcgcttcattggctatggcgcgatgctgatggaatcgttcgtcgcgatcatggcgctggtcgccgcatgcgtgatcgagccgggcgtctacttcgcgatgaacgcgccggcggccgtgctcggctcgacgccggaagcggttgccaacaccgtcacgcaatggggcttcgtgctgacgcccgacatgctcacgcagacggcgaaggccgtcggcgaaacgacgatcatcgcccgcgcgggcggcgcaccgacgctggccgtcggcatggcgcacatcctgcatcaggtgatcggcggcgaagcgatgatggcgttctggtatcacttcgcgattctgttcgaggcgctgttcatcctgacggccgtcgatgcaggcacgcgcgccggacgcttcatgctgcaggatctgctcggcacgttccacccggcgctcaagcgcacggaatcgctgccggcgaacctggtcgccaccgcgctgtgcgtggccgcgtggggctacttcctgtatcagggcgtggtcgatccgctcggcggcatcaacacgctgtggccgctgttcggcatctcgaaccagatgctcgccgcgatcgcgctggtgctcggcaccgtcgtgctgttcaagatgaagcgtgagcgctacgcatgggtgacgatcgtgccgaccgcatggctgctgatctgcacgctcacggccggctggcagaagatcttcgacgcgaacccgaaggtcagcttcctcgcgcatgcggccaagctgcaggcgtcggtggaccagggcaaggtgctcgcgccggcgaagtcgctcgcgcagatgaagcggatcatcttcaacgactacgtcgatgcggcgctggccgggctgttcatcttcgtcgtcgtggcgatcgcggtgtacgggctgctcgccgtgctgcgcgcgcgccgcgaggcgaagccgagcgtgcgcgagacgccgtacgagccgatgccggccgcgcaggcgctcggcagcggacgctga

SEQ ID NO: 36659 - protein, 692 aa, Burkholderia vietnamiensis G4
MNRASSTLLWTAVALLGAFAFGTIALAHGERVSALWIVIAAVCVYLIAYRFYSRFIASKVMQLDGLRMTPAVKYNDGLDYVPTNKYVLFGHHFAAIAGAGPLVGPVLAAQMGYTPGMLWILGGVVFAGAVQDFIVLFISTRRDGRSLGDLVKMELGTVPGVIALFGAFLIMVIILAVLALIVVKALTNSPWGTFTVAATIPIALFMGIYTRYIRPGRIGEVSIIGFVLLMASIAFGQAVHDSPTLAAWFTFSGTQLTWILIGYGFIASVLPVWLLLAPRDYLSTFLKIGTILGLAIGILVVAPELKMPALTKFVDGTGPVWSGNLFPFLFITIACGAVSGFHALISSGTTPKLIDNETNARFIGYGAMLMESFVAIMALVAACVIEPGVYFAMNAPAAVLGSTPEAVANTVTQWGFVLTPDMLTQTAKAVGETTIIARAGGAPTLAVGMAHILHQVIGGEAMMAFWYHFAILFEALFILTAVDAGTRAGRFMLQDLLGTFHPALKRTESLPANLVATALCVAAWGYFLYQGVVDPLGGINTLWPLFGISNQMLAAIALVLGTVVLFKMKRERYAWVTIVPTAWLLICTLTAGWQKIFDANPKVSFLAHAAKLQASVDQGKVLAPAKSLAQMKRIIFNDYVDAALAGLFIFVVVAIAVYGLLAVLRARREAKPSVRETPYEPMPAAQALGSGR

SEQ ID NO: 36660 - DNA, 2079 bp, Burkholderia cenocepacia AU 1054
  CDS (1)..(2079): transl_table=11
atgaatcgggcttccagtaccctgctatggatcgcggtcgcgctgcttggcgcgttcgcattcggcacgatcgcactcgcgcacggcgagcgcgtcagtgccctctggatcgtgatcgccgcagtctgcgtgtatctgatcgcgtatcgcttctacagccgtttcatcgccagcaaggtcatgcagctcgacgggctgcggatgacgccggcggtcaagtacaacgacggcctcgactacgtgccgaccaacaagtacgtgctgttcggccatcacttcgccgcgatcgccggcgccgggccgctggtcggccccgtgctcgccgcgcagatgggctacacgcccggcatgctgtggattctggccggcgtcgtgttcgccggcgcggtgcaggatttcatcgtgctgttcatctcgacgcgtcgcgacggccgttcgctcggcgacctcgtcaagatggagctcggcacggtgcccggcgtgatcgcgctgttcggcgcgttcctgatcatggtgatcatcctcgcggtgctcgcgctgatcgtcgtgaaggcgctgaccaattcgccgtggggcacgttcaccgtcgccgcgacgattccgatcgcgctgttcatgggcgtctatacgcgctacatccgtccgggccgcatcggcgaagtgtcgatcatcggcttcatcgggctgatggcggcgatcgcgttcggccagaacgtggccgcctcgccggcggttgccgcgtggttcacgttcagcggcacgcagctcacgtggatcctgatcggctacggcttcgtcgcatcggtgctgccggtgtggctgctgctcgcgccgcgcgactacctgtcgacgttcctgaagatcggcacgatcctcggcctcgcgatcggcatcctggtcgtcgcaccggaactgaagatgcccgcgctgacgaagttcgtcgacggctcgggcccggtgtggtcgggcaacctgttcccgttcctgttcatcacgatcgcgtgcggcgcggtgtcgggcttccacgcgctgatctcgtcgggcacgacgccgaagctgatcgacaacgaaaccaatgcgcgcttcatcggttacggcgcgatgctgatggaatcgttcgtcgcgatcatggcgctggtcgccgcgtgcgtgatcgaaccgggcatctacttcgcgatgaacgcgccggccgcggtgctcggctcgacgccggaagcggtcgcgaacaccgtcacgcaatggggcttcgtgctgacgcccgacatgctgacgcagacggccaaggccgtcggcgaaacgacgatcatcgcgcgtgcgggcggcgcgccgacgctggccgtcggcatggcgcacatcctgcaccaggtgatcggcggcgaagcgatgatggcgttctggtatcacttcgcgatcctgttcgaggcgctgttcatcctgacggccgtcgacgcgggcacgcgtgcgggccgcttcatgctgcaggatctgctcggcacgttccacccggcgctcaagcgcaccgagtcgctgcccgcgaacctcgtcgccaccgcgctgtgcgtggccgcgtggggctacttcctgtaccagggcgtggtcgatccgctcggcggcatcaacacgctgtggccgctgttcggcatctcgaaccagatgctcgccgcgatcgcgctggtgctcggcaccgtcgtgctgttcaagatgaagcgcgagcgctatgcgtgggtcacgatggtgccgaccgcatggctcttgatttgcacgctgacggccggctggcagaagattttcgacgcgaacccgaaggtcagcttcctcgcgcacgccgcgaagctgcaggccgcggtggacgaaggcaaggtgctcgcgccggcgaagtcgatcgcgcagatgaaacggatcatcttcaacgactacatcgatgcggcgctggccgggctgttcatcttcgtcgtcgtggccatcgcggtgtacggcgtgatcgccgtgctgcgcgcgcgccgcgagtcgaagccgaccgtgcgcgagacgccgtacgaagcgatgccggccgcgcaggcgctcggcagcggacgttga

SEQ ID NO: 36661 - protein, 692 aa, Burkholderia cenocepacia AU 1054
MNRASSTLLWIAVALLGAFAFGTIALAHGERVSALWIVIAAVCVYLIAYRFYSRFIASKVMQLDGLRMTPAVKYNDGLDYVPTNKYVLFGHHFAAIAGAGPLVGPVLAAQMGYTPGMLWILAGVVFAGAVQDFIVLFISTRRDGRSLGDLVKMELGTVPGVIALFGAFLIMVIILAVLALIVVKALTNSPWGTFTVAATIPIALFMGVYTRYIRPGRIGEVSIIGFIGLMAAIAFGQNVAASPAVAAWFTFSGTQLTWILIGYGFVASVLPVWLLLAPRDYLSTFLKIGTILGLAIGILVVAPELKMPALTKFVDGSGPVWSGNLFPFLFITIACGAVSGFHALISSGTTPKLIDNETNARFIGYGAMLMESFVAIMALVAACVIEPGIYFAMNAPAAVLGSTPEAVANTVTQWGFVLTPDMLTQTAKAVGETTIIARAGGAPTLAVGMAHILHQVIGGEAMMAFWYHFAILFEALFILTAVDAGTRAGRFMLQDLLGTFHPALKRTESLPANLVATALCVAAWGYFLYQGVVDPLGGINTLWPLFGISNQMLAAIALVLGTVVLFKMKRERYAWVTMVPTAWLLICTLTAGWQKIFDANPKVSFLAHAAKLQAAVDEGKVLAPAKSIAQMKRIIFNDYIDAALAGLFIFVVVAIAVYGVIAVLRARRESKPTVRETPYEAMPAAQALGSGR

SEQ ID NO: 36662 - DNA, 2058 bp, Burkholderia pseudomallei 1655
  CDS (1)..(2058)
ttggtctggatcgcggtcgcgctgctcggcgcgttcgcgttcggcacgatcgcgctcgcgcacggcgagcggatcagcgcgctatggatcgtgatcgccgccgtttgcgtgtatttgatcgcgtaccgcttctacagccgcttcatcgcgagcaaggtcgtccagctcgacggcctgcgcatgacgcccgccgtcaagtacaacgacggcctcgattacgtgccgaccaacaaatacgtgctgttcggccatcatttcgccgcgatcgccggcgcgggcccgctcgtcggcccggtgctcgccgcgcagatgggctacacgcccggcatgctgtggattctcgcgggcgtcgtgttcgcgggcgcggtgcaggacttcatcgtgctgttcatctcgacgcgccgcgacggccgctcgctcggcgacctcgtcaagatggagctcggcacggtgcccggcgtgatcgcgctgttcggcgcgttcctgatcatggtgatcattctcgcggtgctcgcgctgatcgtcgtgaaggcgctcaccaattcgccgtggggcacgttcaccgtcgccgcgacgattccgatcgcgctgttcatgggcgtctacacgcgctacatccggccgggccggatcggcgaagtgtcgatcatcggcttcgtgctgctgatggcgtcgatcgcgtacggccagcacgtgcacgattcggccgcgctcgccgcgtggttcacgttcagcggcacgcagctcacgtggatcctgatcggttacggcttcgtcgcgtcggtgctgccggtgtggctgctgctcgcgccgcgcgactacctgtcgacgttcctgaagatcggcacgatcgtcggcctcgcgatcggcatcctgatcgtcgcgccggagctgaagatgccggcgctcacgaagttcgtcgacggcacgggcccggtctggtcgggcaacctgttcccgttcctgttcatcacgatcgcgtgcggcgcggtgtcgggcttccattcgctgatctcgtcgggcacgacgccgaagctgctcgacaacgaaaccaacgcgcgcttcatcggctatggcgcgatgctgatggaatcgttcgtcgcgatcatggcgctcgtcgccgcgtgcgtgatcgagccgggcgtctacttcgcgatgaacgcgccggccgccgtgctcggcacgacgccggaagcggtcgcgcacaccgtcacgcagtggggcttcatgctgacgcccgacatgctcacgcagacggcgaaggccgtcggcgagacgacgatcatcgcgcgcgccggcggcgcgccgacgctcgcggtcggcatggcgcagatcctgcatcaggtgatcggcggcgaggcgatgatggcgttctggtatcacttcgcgatcctgttcgaggcgctgttcatcctgaccgcggtcgacgcgggcacgcgcgcgggccgcttcatgctgcaggatttgctcggcacgttccacccggcgctcaagcgcaccgaatcgctgccggcgaacctgaccgcgaccgcgctgtgcgtggccgcgtggggttacttcctgtatcagggcgtggtcgatccgctcggcggcatcaatacgctgtggccgctgttcggcatctcgaaccagatgctcgccgcgatcgcgctggtgctcggcaccgtcgtgctgttcaagatgaagcgcgagcgctacgcgtgggtgacgatcgtgccgacggcgtggctgctgatctgcacgctgacggccggctggcagaaggtgttcgattcgaatccgaaggtgagcttcctcgcgcacgcggcgaagctgcaggcggccgcggccgacggcaaggtgctcgcgccggcgaagtcgctcgcgcagatgcagcggatcatcttcaacgactacgtggacgcggcgctctcggcgctgttcatcctggtcgtcgtgagcatcgcggtgtacggcgtggtcgcggtcgtgcgcgcgcggcgcgcggtgcagcccacgtcgcgcgaaacgccgtacgaaccgatgccggtcgcgcaggcgctcggcagcggacgctga

SEQ ID NO: 36663 - protein, 685 aa, Burkholderia pseudomallei 1655
MVWIAVALLGAFAFGTIALAHGERISALWIVIAAVCVYLIAYRFYSRFIASKVVQLDGLRMTPAVKYNDGLDYVPTNKYVLFGHHFAAIAGAGPLVGPVLAAQMGYTPGMLWILAGVVFAGAVQDFIVLFISTRRDGRSLGDLVKMELGTVPGVIALFGAFLIMVIILAVLALIVVKALTNSPWGTFTVAATIPIALFMGVYTRYIRPGRIGEVSIIGFVLLMASIAYGQHVHDSAALAAWFTFSGTQLTWILIGYGFVASVLPVWLLLAPRDYLSTFLKIGTIVGLAIGILIVAPELKMPALTKFVDGTGPVWSGNLFPFLFITIACGAVSGFHSLISSGTTPKLLDNETNARFIGYGAMLMESFVAIMALVAACVIEPGVYFAMNAPAAVLGTTPEAVAHTVTQWGFMLTPDMLTQTAKAVGETTIIARAGGAPTLAVGMAQILHQVIGGEAMMAFWYHFAILFEALFILTAVDAGTRAGRFMLQDLLGTFHPALKRTESLPANLTATALCVAAWGYFLYQGVVDPLGGINTLWPLFGISNQMLAAIALVLGTVVLFKMKRERYAWVTIVPTAWLLICTLTAGWQKVFDSNPKVSFLAHAAKLQAAAADGKVLAPAKSLAQMQRIIFNDYVDAALSALFILVVVSIAVYGVVAVVRARRAVQPTSRETPYEPMPVAQALGSGR

SEQ ID NO: 36664 - DNA, 1758 bp, Chromohalobacter salexigens DSM 3043
  CDS (1)..(1758): transl_table=11
atgaacgctatctggattgccctgttcggcgccgtgtgtttcgtgatgggctatcgcttctattcgaagttcatcgccgaacgcatttatcgactcgatgccgacttccagacgccggcgcacgcctatcgcgacggcgtcgactacgtgcccaccaacaagtggattctctggggccaccatttcacgtcggtggccggagcggcgcccatcgtggggcctgccatcgcgatctactggggctggctgccggccatcctgtgggtcgtgctggggaccgtcttcgccgccggggtgcacgatttcggcgcggtggtgctctccaaccgccacaagggccattcgatcggcacgctggccaacaagctgatcggacagcgcgccaaactgctgttcctgttcatcatcttgatcctggtgttgatggtcaacgcggtcttcgcctgggtcatcgccaagctgttcatcaccttcccggccagtgtgctgtcggtcttcatccagatcccgctcgccgtgtggatcggctaccgcgtctatcgccattcgggctcgatgctgctgccgtcggtgattgcactggccgtgatgtatggcgcagcgctgctggccagcgagattcccctgctgcagatcgatctggtgagctggttcggcggtgccgaggcgccggtcgtgggtggcttcaacggcacctcgatggcctttctggtgtggatcgtggtgctgatgacatacgtctacatcgcctcgacgctccccgtctggaagctgttgcagccgcgcgattacatcaattcgcaccagctcgtggtcggcctggcgctgctgtatctggggctgctgttcggtgcaccggaaatgaccgcccccagcgtcaacggcgaagcggacatcagctggtacccgctgctgttcatcaccatcgcctgcggggcgatttccggcttccacggcctggtcgcctcgggcaccacgtccaagcagctcgacaaggaaaccgatgcccgcatggtcggctacgggggcgctctgggtgaaggcatgctggcgatgatcgcgatcatcgcggtgggcaccctgttcgcctccggtaccgatttcaccgcgacgtactcgagcttttccgcggccggctccaacggcctgggctcgttcgtgaaaggcgctggccagcttgccggcaatctgggcattcccgagcacatgggctcgaccctggtcgcggtgatcgtggtgagcttcgccgccaccacgctcgacaccgccgtgcgcctgatgcgttacatcatcgccgagctgggcaacgagtacggcatgccggtgatcgcccgcaagcacgtcgcgaccagcatcgccgtcatcgccagcgccgcgctggtcatcctgcccgaaggccccaacggcttcggctccggcggctacctgctgtggccgttgttcggcaccagcaaccagctgctggccggcatcacgctgatgctggtctcggtatggctcaagcgccagggccgcccggtggtcttcaccctggttcccatgctgttcctgctggtcatgacactgtgggccatggggcagcaggtgatcttcacctggtcgggcttcggcgatgccgaccgcaacctgctgctgttcaccttcggcagcctgatcatggtgttcacgctgtggatcctgctcgaggcgtcgcgaagcttccgtcagggtgacccggccgcgcagcagcaaccgctgagttccgatgaatcacgctga

SEQ ID NO: 36665 - protein, 585 aa, Chromohalobacter salexigens DSM 3043
MNAIWIALFGAVCFVMGYRFYSKFIAERIYRLDADFQTPAHAYRDGVDYVPTNKWILWGHHFTSVAGAAPIVGPAIAIYWGWLPAILWVVLGTVFAAGVHDFGAVVLSNRHKGHSIGTLANKLIGQRAKLLFLFIILILVLMVNAVFAWVIAKLFITFPASVLSVFIQIPLAVWIGYRVYRHSGSMLLPSVIALAVMYGAALLASEIPLLQIDLVSWFGGAEAPVVGGFNGTSMAFLVWIVVLMTYVYIASTLPVWKLLQPRDYINSHQLVVGLALLYLGLLFGAPEMTAPSVNGEADISWYPLLFITIACGAISGFHGLVASGTTSKQLDKETDARMVGYGGALGEGMLAMIAIIAVGTLFASGTDFTATYSSFSAAGSNGLGSFVKGAGQLAGNLGIPEHMGSTLVAVIVVSFAATTLDTAVRLMRYIIAELGNEYGMPVIARKHVATSIAVIASAALVILPEGPNGFGSGGYLLWPLFGTSNQLLAGITLMLVSVWLKRQGRPVVFTLVPMLFLLVMTLWAMGQQVIFTWSGFGDADRNLLLFTFGSLIMVFTLWILLEASRSFRQGDPAAQQQPLSSDESR

SEQ ID NO: 36666 - DNA, 2058 bp, Burkholderia pseudomallei 1710a
  CDS (1)..(2058)
ttggtctggatcgcggtcgcgctgctcggcgcgttcgcgttcggcacgatcgcgctcgcgcacggcgagcggatcagcgcgctatggatcgtgatcgccgccgtttgcgtgtatttgatcgcgtaccgcttctacagccgcttcatcgcgagcaaggtcgtccagctcgacggcctgcgcatgacgcccgccgtcaagtacaacgacggcctcgattacgtgccgaccaacaaatacgtgctgttcggccatcatttcgccgcgatcgccggcgcgggcccgctcgtcggcccggtgctcgccgcgcagatgggctacacgcccggcatgctgtggattctcgcgggcgtcgtgttcgcgggcgcggtgcaggacttcatcgtgctgttcatctcgacgcgccgcgacggccgctcgctcggcgacctcgtcaagatggagctcggcacggtgcccggcgtgatcgcgctgttcggggcgttcctgatcatggtgatcattctcgcggtgctcgcgctgatcgtcgtgaaggcgctcgccaattcgccgtggggcacgttcaccgtcgccgcgacgattccgatcgcgctgttcatgggcgtctacacgcgctacatccggccgggccggatcggcgaagtgtcgatcatcggcttcgtgctgctgatggcgtcgatcgcgtacggccagcacgtgcacgattcggccgcgctcgccgcgtggttcacgttcagcggcacgcagctcacgtggatcctgatcggttacggcttcgtcgcgtcggtgctgccggtgtggctgctgctcgcgccgcgcgactacctgtcgacgttcctgaagatcggcacgatcgtcggcctcgcgatcggcatcctgatcgtcgcgccggagctgaagatgccggcgctcacgaagttcgtcgacggcacgggcccggtctggtcgggcaacctgttcccgttcctgttcatcacgatcgcgtgcggcgcggtgtcgggcttccattcgctgatctcgtcgggcacgacgccgaagctgctcgacaacgaaaccaacgcgcgcttcatcggctatggcgcgatgctgatggaatcgttcgtcgcgatcatggcgctcgtcgccgcgtgcgtgatcgagccgggcgtctacttcgcgatgaacgcgccggccgccgtgctcggcacgacgccggaagcggtcgcgcacaccgtcacgcagtggggcttcatgctgacgcccgacatgctcacgcagacggcgaaggccgtcggcgagacgacgatcatcgcgcgcgccggcggcgcgccgacgctcgcggtcggcatggcgcagatcctgcaccaggtgatcggcggcgaggcgatgatggcgttctggtatcacttcgcgatcctgttcgaggcgctgttcatcctgaccgcggtcgacgcgggcacgcgcgcgggccgcttcatgctgcaggatttgctcggcacgttccacccggcgctcaagcgcaccgaatcgctgccggcgaacctgaccgcgaccgcgctgtgcgtggccgcgtggggttacttcctgtatcagggcgtggtcgatccgctcggcggcatcaatacgctgtggccgctgttcggcatctcgaaccagatgctcgccgcgatcgcgctggtgctcggcaccgtcgtgctgttcaagatgaagcgcgagcgctacgcgtgggtgacgatcgtgccgacggcgtggctgctgatctgcacgctgacggccggctggcagaaggtgttcgattcgaatccgaaggtgagcttcctcgcgcacgcggcgaagctgcaggcggccgcggccgacggcaaggtgctcgcgccggcgaagtcgctcgcgcagatgcagcggatcatcttcaacgactacgtggacgcggcgctctcggcgctgttcatcctggtcgtcgtgagcatcgcggtgtacggcgtggttgcggtcgtgcgcgcgcggcgcgcggtgcagcccacgtcgcgcgaaacgccgtacgaaccgatgccggtcgcgcaggcgctcggcagcggacgctga

SEQ ID NO: 36667 - protein, 685 aa, Burkholderia pseudomallei 1710a
MVWIAVALLGAFAFGTIALAHGERISALWIVIAAVCVYLIAYRFYSRFIASKVVQLDGLRMTPAVKYNDGLDYVPTNKYVLFGHHFAAIAGAGPLVGPVLAAQMGYTPGMLWILAGVVFAGAVQDFIVLFISTRRDGRSLGDLVKMELGTVPGVIALFGAFLIMVIILAVLALIVVKALANSPWGTFTVAATIPIALFMGVYTRYIRPGRIGEVSIIGFVLLMASIAYGQHVHDSAALAAWFTFSGTQLTWILIGYGFVASVLPVWLLLAPRDYLSTFLKIGTIVGLAIGILIVAPELKMPALTKFVDGTGPVWSGNLFPFLFITIACGAVSGFHSLISSGTTPKLLDNETNARFIGYGAMLMESFVAIMALVAACVIEPGVYFAMNAPAAVLGTTPEAVAHTVTQWGFMLTPDMLTQTAKAVGETTIIARAGGAPTLAVGMAQILHQVIGGEAMMAFWYHFAILFEALFILTAVDAGTRAGRFMLQDLLGTFHPALKRTESLPANLTATALCVAAWGYFLYQGVVDPLGGINTLWPLFGISNQMLAAIALVLGTVVLFKMKRERYAWVTIVPTAWLLICTLTAGWQKVFDSNPKVSFLAHAAKLQAAAADGKVLAPAKSLAQMQRIIFNDYVDAALSALFILVVVSIAVYGVVAVVRARRAVQPTSRETPYEPMPVAQALGSGR

SEQ ID NO: 36668 - DNA, 2049 bp, Solibacter usitatus Ellin6076
  CDS (1)..(2049): transl_table=11
ttggggtatctcttctgggccgttgtcgcctccgtggcggcattctgcctcggcaccattgcgctcagccgcggtgaacacatcaatagcctgtggctggtgctcgcggccgcctgcagctacgccacggcctaccggttttacgcgaagttcatttcggctcgcgtgatgatgttgaacgacaagcgcgccacccccgccgagcgcctccagaacggccatgatttcgagcccaccaacaagtggattctcttcggccaccacttcgcggctattgccggacccggtccgctggttggcccggtgctcgccgcgcaattcggttatctgcccgggacgctctggatcatcatcggcgcctgcctcggcggcgccgtgcaggatttcgtgatcctcttcgcctccatgcgccgcgacggcaaatcgctcggccagatggcgcgcgaggagatcggcaaggtcggcggcttcatcgccctggtcaccgtcctgctcatcatggtcatcctgctcgcagtggtcgcgctggtcgtggttaacgcgctcagaggcagcccctggggagccttcacgatcgccgccaccatgccgatcgcggtgttcatgggcctctatctgcgctactggcggcccggaaaagttctggagtgctccgccatcgggttcgtgctcgtgatgggcagcatcttcgccggccaggccgtcggcgaatcggccaccctcgcgccggtcttcacgctgagcgcgatgactatcgccttcgccatcattctctatggcttcctcgccagcgcgctgccggtttggctgctgctcgcgccccgcgattacctcagcaccttcgtgaaactcggcgtggtcctcatgctcgcgatcggcattctcttcgtgcgtcccgagttgcagctacccgccttcacgcgattcaccgatggcaccggaccgattttcgcgggtaagatcttccccttctgcttcatcacgatcgcctgcggcgcgatctcgggcttccattcgttgatctcttcgggcaccacgccgaaaatgatcgccaaggaatcccacgcctggcccgtcggctacggctccatgctgctcgaaagcttcgtcgcgatcatggcgatcatcgctgcctgcgtgctgcagcccggcatctacttcgcggtcaactcccccgcgggcgtcgtcggcgccactccggcggcggccgcggccaccatcaccgcctggggctttccggtgacggcggccgacatggcgcttctcgcgcacaacgtcggcgaacagtcactcttctcgcgcaccggcggcgcgccctctctggccctcgggatggcccacatctttgccagctccggcggcggccaggccgtgatcggcttctggtaccacttcgccatcatgttcgaagccctcttcatcctgaccatcatcgatgccggcacccgcgtgggccgcttcatgctccaggacctgctcggccacatcgcgccgcccctcggccgcaccagttggatgcccggcgtcatcggcacttccgccgtggtggtcggcgcctggggctacttcctggtgcagggcgtgcgcgacccgctcggcggcatcaattcgctgtggccgctgttcggcatctccaaccagttgctggcggcgatcgcgctctgcgtcgcaaccaccatcctgctcaaaatgcatggcgcgaaattcatgtggatcacgtgcgtccccctggtctggctggtcagcgccaccttcaccgccgcctggcagaagatcttctccccgattccagcgatcgggtttctctctcaggccgaccgcctcgaggcagccctgcgcgccggcaaggcggccagtccggcggcgacccagacgttgatcttcaacgcccgcctcgacgccgccatctgcggcgtcttcatggtcctggtggccgttatcctggcggattccctgcgcgtctgggcgggcatcctgtggggcgcaggcgaacgccgcatccacgaagcccccttcgtggcatcccaactgcgcgcggaggagctatga

SEQ ID NO: 36669 - protein, 682 aa, Solibacter usitatus Ellin6076
MGYLFWAVVASVAAFCLGTIALSRGEHINSLWLVLAAACSYATAYRFYAKFISARVMMLNDKRATPAERLQNGHDFEPTNKWILFGHHFAAIAGPGPLVGPVLAAQFGYLPGTLWIIIGACLGGAVQDFVILFASMRRDGKSLGQMAREEIGKVGGFIALVTVLLIMVILLAVVALVVVNALRGSPWGAFTIAATMPIAVFMGLYLRYWRPGKVLECSAIGFVLVMGSIFAGQAVGESATLAPVFTLSAMTIAFAIILYGFLASALPVWLLLAPRDYLSTFVKLGVVLMLAIGILFVRPELQLPAFTRFTDGTGPIFAGKIFPFCFITIACGAISGFHSLISSGTTPKMIAKESHAWPVGYGSMLLESFVAIMAIIAACVLQPGIYFAVNSPAGVVGATPAAAAATITAWGFPVTAADMALLAHNVGEQSLFSRTGGAPSLALGMAHIFASSGGGQAVIGFWYHFAIMFEALFILTIIDAGTRVGRFMLQDLLGHIAPPLGRTSWMPGVIGTSAVVVGAWGYFLVQGVRDPLGGINSLWPLFGISNQLLAAIALCVATTILLKMHGAKFMWITCVPLVWLVSATFTAAWQKIFSPIPAIGFLSQADRLEAALRAGKAASPAATQTLIFNARLDAAICGVFMVLVAVILADSLRVWAGILWGAGERRIHEAPFVASQLRAEEL

SEQ ID NO: 36670 - DNA, 1929 bp, Geobacter metallireducens GS-15
  CDS (1)..(1929): transl_table=11
atgctcggaaagctcgtctggctggtgatttcggcggttgcggccggttcccttgctgtagtggccggcgtcgtgaacccgggggagaaggtgaacgccctctggctcgtgacggccgccgcctgtttctacctagttgcctaccggttctatggcgcctttctggcggcgaaggtcctctccctggatccccgcctgaagaccccggcccggcgcctggctgacggcatggattaccaccccaccaaccgctgggtcctcttcggtcaccactttgcggccatcgctggcgccggtcccctcatcggtcccatgctggcggcccagttcggctatctccccggcttcctctggcttctggtgggggccgtcatggtgggggcggtgcacgacatggtgatcctggcggcgtcggtgcggcgcaacggccgctccctggctaggatcgccaaggatgagatcgggccggtgggggggctggcggcctctctcgccatcctcttcatcctgatcgtggccttggctgggctggggctcgcggtggtgaactccctggccaagagcccctgggggacctttaccattttccttaccatccccatcgccctcttcatggggctctacctctacaagatccgccccggccgggtgggggaggtgagcgccatcggctttgtgcttttgctggcggcggtcttcagcggccacttcatccccggctctcccctggagcccatcttcagtctcgggaagggggggctgaccctggccatggccgcctacggcctcatcgcctccatccttccggtctggatgctcctctgcccccgggactacctctctacctacatgaagatcggcacggtgatcctcctggccttcggggtcgtcttcatggcccccaccatccagatgccggcaatgacccggttcgtggccggcggtgggccggtgatccccggcaagctcttcccctttatgttcatcaccatcgcctgcggggcggtctccgggttccattccctcatctcctcggggaccacgccgaagatgatcatgagcgagcgggagatccccatgatcgggtatggcgccatgctggccgagggattcgtgtcggtcatggccctggtggcggccacgatcctcatcccgggggactacttcgccatcaatacgaagctctccttcgacgccatcgcggccctgggcttcccggtggaacgggtgcgtgagctgtcggccatggtggggaccgacgtggccggccgccccggcggcgccgtctcccttgccgtgggtatggcctccatcctgtcgtccctccccggcatgaaggggctcatgccctactggtacaacttcgccctcatgttcgaggccctcttcatcctcaccaccgtcgacaccggcacccgggtggcgcggtttctcctccaggagctggggagccgggctttcccccgcctgggccagcagaactggctccccggcatcatcatcaccagctttctcgtggtggccgcctggtcgtacctgatctggtccggcaacgtctccaccatctggcccatgttcggggtatcgaatcagctcctggcggccatcgccctggggatcggcaccacgatcctcatcaagagcggcaaggcgcgctatgcctggaccacggtcctccccatggtgttcatgtacgccaccaccttcaccgccgcgtggaagctgaccggcagcttcctcggcaaggccgccgcagctgccacggctgccgaggccttcaccttgaggatgaacgccggcctggtggtgttgatggccatcctggcggtggtgactctgctcgacatgctcctcaagtggcgcggctacctctccgagcggagacccatcaccacgagcgaggtgctggagttcgaggagccggcatga

SEQ ID NO: 36671 - protein, 642 aa, Geobacter metallireducens GS-15
MLGKLVWLVISAVAAGSLAVVAGVVNPGEKVNALWLVTAAACFYLVAYRFYGAFLAAKVLSLDPRLKTPARRLADGMDYHPTNRWVLFGHHFAAIAGAGPLIGPMLAAQFGYLPGFLWLLVGAVMVGAVHDMVILAASVRRNGRSLARIAKDEIGPVGGLAASLAILFILIVALAGLGLAVVNSLAKSPWGTFTIFLTIPIALFMGLYLYKIRPGRVGEVSAIGFVLLLAAVFSGHFIPGSPLEPIFSLGKGGLTLAMAAYGLIASILPVWMLLCPRDYLSTYMKIGTVILLAFGVVFMAPTIQMPAMTRFVAGGGPVIPGKLFPFMFITIACGAVSGFHSLISSGTTPKMIMSEREIPMIGYGAMLAEGFVSVMALVAATILIPGDYFAINTKLSFDAIAALGFPVERVRELSAMVGTDVAGRPGGAVSLAVGMASILSSLPGMKGLMPYWYNFALMFEALFILTTVDTGTRVARFLLQELGSRAFPRLGQQNWLPGIIITSFLVVAAWSYLIWSGNVSTIWPMFGVSNQLLAAIALGIGTTILIKSGKARYAWTTVLPMVFMYATTFTAAWKLTGSFLGKAAAAATAAEAFTLRMNAGLVVLMAILAVVTLLDMLLKWRGYLSERRPITTSEVLEFEEPA

SEQ ID NO: 36672 - DNA, 1848 bp, Geobacter metallireducens GS-15
  CDS (1)..(1848): transl_table=11
atgaatgcgttgacactcatttttgtggcactgtgcgtctttgcgcttgcctaccgctactatggcctgtttctggcgaacagggtgctggggctgcgggaggaccgcgcaacgcctgccaccaccatggcggacgggcacgactacgtgaagaccaacaagtacgtcctgttcggccaccacttcgcggccatcgccgcggcgggccccctcctggggccggtgctcgctgcccagttcgggttcctgccgggggccctctggattatcgtcggggccgttctggccggcgcggtccacgatgccatcgtcctcttcgcctcggtgcggcaccggggcaagagcctttcgcgcatcgccgagaccgagatcggcaaagccgcggggaaggtggcttccgtggccattctcttcattctcatcctgaccctggccggcctctccattgccgtcgtgaacgccatgttcaacagcccctggggaacctacaccgtcttctgcaccattcccatcgccatggtcatgggggtttacatgcagaagatccggccgggggacgtgaagggggggagcatcatcggcgttgcactcctcgccctggcgatcctgaccgggccctacgtggccgccaatcccgagctggcggcgttcttcaccttttccaagaagcagatcgcgctcatcatccccatctacggattcttcgcctcggtgctgccggtctggttcctcctggtcccccgcgactatctctcaacctacctgaagatcggcaccatcgccctgctggccctcgggatcgtcgccgtgcatccccagctccagatgcccgccatcaccagctatgtgagcggcggcggtccggtgatccccggcgcggtcttccccttcatcttcgtgaccattgcctgcggcgccctctccggtttccacgccatcatcggctccggcaccaccccgaagatgatcgccaacgagcgggatatcctcttcgtcggctacggcgccatgctgaccgaagggtttgtggcgatcatggccctcatcgccgcctgtgtgctggtcccggccgactacttcgccatcaacgccgcccccaaggcgttccaggccctcaatatggcccccgtgaacctgccggcactctcccaggcggtgggcgagcaggtccaggggcggcccggcggcgcggtctccctggcggtggggatggcctacatcttctcgtcgattccggtcatgaagagcatgatggcctactggtaccacttcgccatcatgttcgaggcggtctttattctcactgccgtcgatgccggtacccgggtcggccgctatctcctccaggagatgctcggcaagctctatccgcgctttgccgataacacgtggacgccaggggtcatcgttacgagtatcctctttacctccgcctggggctacctggtctacaccggcgacatcaccaccatctggcccctgttcggcatgagcaaccagctcctcgccacctgcgccctcatcgtcggcaccaccatgctcatcaggctcggcaaggcccgctacgcctgggtcaccgcggtcccggggatcttcatgattccggtcaccatgaccgcagggtacctgaacatcaccaagaacttcctgcccaaggggcttaccctgctcgtggtcctgtccgtcgtgctgatggtgctgatggccatcgtcttcatcgaggcgttccgtaaatggtatgcgttgttgcagatccgggagaaggtgcttgatgccaacggcgacctggttctggtgccggtggagtcgccggccgagaggtacgagccgctccccttgcaggagtaa

SEQ ID NO: 36673 - protein, 615 aa, Geobacter metallireducens GS-15
MNALTLIFVALCVFALAYRYYGLFLANRVLGLREDRATPATTMADGHDYVKTNKYVLFGHHFAAIAAAGPLLGPVLAAQFGFLPGALWIIVGAVLAGAVHDAIVLFASVRHRGKSLSRIAETEIGKAAGKVASVAILFILILTLAGLSIAVVNAMFNSPWGTYTVFCTIPIAMVMGVYMQKIRPGDVKGGSIIGVALLALAILTGPYVAANPELAAFFTFSKKQIALIIPIYGFFASVLPVWFLLVPRDYLSTYLKIGTIALLALGIVAVHPQLQMPAITSYVSGGGPVIPGAVFPFIFVTIACGALSGFHAIIGSGTTPKMIANERDILFVGYGAMLTEGFVAIMALIAACVLVPADYFAINAAPKAFQALNMAPVNLPALSQAVGEQVQGRPGGAVSLAVGMAYIFSSIPVMKSMMAYWYHFAIMFEAVFILTAVDAGTRVGRYLLQEMLGKLYPRFADNTWTPGVIVTSILFTSAWGYLVYTGDITTIWPLFGMSNQLLATCALIVGTTMLIRLGKARYAWVTAVPGIFMIPVTMTAGYLNITKNFLPKGLTLLVVLSVVLMVLMAIVFIEAFRKWYALLQIREKVLDANGDLVLVPVESPAERYEPLPLQE

SEQ ID NO: 36674 - DNA, 1794 bp, Exiguobacterium sp. 255-15
  CDS (1)..(1794): transl_table=11
atgagtgctacacccattgttattgccgtcatttgtattttattgatcgtttatcgtctttatggcacattcatggctgtcaaagtcttaaaaatcaaagaggaccgggaaacaccggctcataagtttgcggatggaaaagattatgtcccgaccaacaaatgggtgtcgttcggtcaccacttcgcagcgatcgctgctgccggcccgctcgtcggtcctgtacttgctgcccagttcggttatttaccgggactgttatggctcttgattggtgccgtcatcggtggcgccgtccacgatatggtcgtcttgttcgcttccatgcgtcaagatggacagtcgttatctgaagtcgctaaaaaagagctcggacctgtcgccggtttttgtgccggtctcgcgatgctcttcatcatcaccatcacgatggccggattatcaatggtcgtcctgcatgccctggagcataatccatggggaacatttgctgtcttctcgaccattccgatcgcaatgggggtcggcatctacttacgaaaaggcggcaatctcgccttggcttccgtcgtcggtttcctattgattcttgctgcaatcggtttcggtccccagttgactgacacgttcatcggaacatggttcgacctgtcgtcacgtcaactcgcgattgcgttaccgatttatgccttcttcgctgcagcactgccggtctggttgttgcttgcaccgcgtgattacttatcaagtttcatgaaaatcggtgttttctttgccttgatcgtcggtgtcttcatcatcaatccggatatccgtttcccggcgttcacgaaattcgtcaacggtggcggtccgatcattgccggtccggtctggccattcatctcgatcacgattgcctgtggcgcgatttccggtttccacgctttcgtcggctccggaacgacaccgaagatgatcaatcgttggagtgatatcaaaccggtcgccttcggtgcgatgcttgttgagtgtctcgtcgctgtcatggcgttgattgccgcaacgtctcttgaagtcggagattacttcgccatcaattcgacaccggaagtctttgcgacactcggtatgagcaccgtttaccttgatgaattatcacgggaaatcggactcgatctcgccggacggaccggtggagccgtttcactggccgtcggtatgacgttcatcttccgggccattccctggttccgtgaaattgccggcttcttcttccaattcgtcattctgtttgaagcggtcttcattttgacggcgatcgatgccggaacacgcgttgcccgctacttgatccaagatttcttcggtgaattctacaaaccgttaaaacgggtcgactggatcccgggtgcgattttcgccagtgcgcttggtacgttcttctgggggtacctgctcttctccggcgacatcggttcgatttgggccttgttcggtgtctccaatcagttgatggcgtcgatcggcttaattatcggaacgacaatcatcctgaagattgccgacaaaaaagtgtatgccttgacgacattcattccgcttgtctacttgcttgtaacagtgacgttcgctgatatctggatggtcgccaatgtctatgcgaatccggcttctgccggcttcagtatcctgaatacgattctgtcgttcacgatggggatcttagctatcgtcatcacgatttcagcggtccggaaatggattgaattgctcaactcaccgcgttgggaaaaagtgaaaaaatcagcttaa

SEQ ID NO: 36675 - protein, 597 aa, Exiguobacterium sp. 255-15
MSATPIVIAVICILLIVYRLYGTFMAVKVLKIKEDRETPAHKFADGKDYVPTNKWVSFGHHFAAIAAAGPLVGPVLAAQFGYLPGLLWLLIGAVIGGAVHDMVVLFASMRQDGQSLSEVAKKELGPVAGFCAGLAMLFIITITMAGLSMVVLHALEHNPWGTFAVFSTIPIAMGVGIYLRKGGNLALASVVGFLLILAAIGFGPQLTDTFIGTWFDLSSRQLAIALPIYAFFAAALPVWLLLAPRDYLSSFMKIGVFFALIVGVFIINPDIRFPAFTKFVNGGGPIIAGPVWPFISITIACGAISGFHAFVGSGTTPKMINRWSDIKPVAFGAMLVECLVAVMALIAATSLEVGDYFAINSTPEVFATLGMSTVYLDELSREIGLDLAGRTGGAVSLAVGMTFIFRAIPWFREIAGFFFQFVILFEAVFILTAIDAGTRVARYLIQDFFGEFYKPLKRVDWIPGAIFASALGTFFWGYLLFSGDIGSIWALFGVSNQLMASIGLIIGTTIILKIADKKVYALTTFIPLVYLLVTVTFADIWMVANVYANPASAGFSILNTILSFTMGILAIVITISAVRKWIELLNSPRWEKVKKSA

SEQ ID NO: 36676 - DNA, 2271 bp, Frankia sp. CcI3
  CDS (1)..(2271): transl_table=11
atgactacccatctcgatactgccggaaccggtcttccgcctggcggcggtcgtgcgcctggccatggccggaggaccggccggctccgatcgatagccatctggaccacggtgtcggcggtcggcgcgatcagctgggctgtgctcgcgatgtcccgccacgagtcgatctctgcggcgtggatcctgctcgccggcctgggatccttcgccatcgcctaccgcttctacgcccggttcatcgcaaaccgggtgctgcgggtggatgacagccgggcgacgccggccgaacgcctcgacaacggcgtcgactacgagccgaccgaccggcgggtcctgtttggccaccacttcgctgccatcgccggggccggtccgctcgtcggcccggtgctcgccgtacagatggggtatctgcccgggacgatctggatcatcgccggtgttattttcgccggtgccgtgcaggacatggtgacgttgttcttctccatgcggcgggacggcaagagcctgggccagatggcgcgcgacgagatcggcccggtgggcgggacggcggcactagtcgccgtcttcgccataatgatcattttgctggcggtgctggcgcttgtcgtggtgaacgcgctcgccgcctctgcatggggcaccttctcgatcgcgatgaccatcccgatcgccctgttcatgggcatttacctgcgggtgctgcgacccggccgggtcgctgaggccaccgccgtcggtgtcgccggactgttcgcggcccttgtcggcggccgctggatccaggactccgccctcgcctccgcctttacactcagcccgaaggcattggtcgcctgccttgtcggctacggctttgtcgcctcggtgctgccggtgtggctcctgctcgcgccccgcgactacctctcgacctttatgaaggtcggcaccatcgggctgctcgccatcggcgttctcgtcgaatttccggtacttcaggcggacgcagtcagtactttcgcgaccaggggaaacgggccggtgttcgccggcagcctgttcccgttcgtcttcatcaccatcgcctgcggtgccctgtccggattccactccctcatcgcgtccggcaccacgccgaagatgattcaaaaggagtcccaggtccggttcatcggttatggggcgatgctgaccgagtcccttgtcgcactgatggcgctgatcgcggcggcggtgctcagcccgggcctctactacgccatgaatgcgcccggtggggtcgtcggcaagaccgcggcgtcggctgcgtccgcggtcaccgacctcggtttcaccatcaccccggacgccctcgactccgcggcccgggccgtcggtgaatcgacgctggtagcccgcaccggaggtgcaccgacgctcgctgtcggcatgtccaacatcctttcaggcgcattcgggggcggccgcctcgccgccttctggtaccacttcgcgatcatgttcgaggcgctgttcatcctgaccactgtcgacgccggaacccgggtcggccgattcatgttgcaggacatgctcgggaacgtatggaagccaatcggccgggtgagctggtggcccggggtctggctgagcagcgtgctggtggtcggcacctggggctacttcctctggaccggggcaaccgacccgctcggcggcatcaaccagctgttcccgctgttcgggatggccaaccagatgcttgccgccatcgcattggcggtcgtcaccaccctgttcgtcaagagtgggcgagcgcggtgggcctgggtgcccggcgtcccgctcggctgggatgtcgccgtcaccttcaccgcggcctggcagaaggttttctcggacgatcccaagctcggcttcctcgcccaacggcaccgctatgccgacgcgctcgacgacggcagggttctggcgcccgcgaggagtatcagcgacatgcacaaagtcgtccagaactcgaccgtggacgggatcatagcgatagtgttcgctctgctagtgctcgtcgtgctcgccgatgcggtacgggtgtgcatacgggctgtccgcacccgggcgccgataaccaccaccgaagcggactatgtagcctcccgttttgtcgcgtccgggggattgttggcgatcgctgaagagcgccaactgctcgcggatgcggtccaggcggccggggcccctcagcccgagcccgtcacaccgccgctgcgccgctgcgccgctgacaacattccgcgaaaatag

SEQ ID NO: 36677 - protein, 756 aa, Frankia sp. CcI3
MTTHLDTAGTGLPPGGGRAPGHGRRTGRLRSIAIWTTVSAVGAISWAVLAMSRHESISAAWILLAGLGSFAIAYRFYARFIANRVLRVDDSRATPAERLDNGVDYEPTDRRVLFGHHFAAIAGAGPLVGPVLAVQMGYLPGTIWIIAGVIFAGAVQDMVTLFFSMRRDGKSLGQMARDEIGPVGGTAALVAVFAIMIILLAVLALVVVNALAASAWGTFSIAMTIPIALFMGIYLRVLRPGRVAEATAVGVAGLFAALVGGRWIQDSALASAFTLSPKALVACLVGYGFVASVLPVWLLLAPRDYLSTFMKVGTIGLLAIGVLVEFPVLQADAVSTFATRGNGPVFAGSLFPFVFITIACGALSGFHSLIASGTTPKMIQKESQVRFIGYGAMLTESLVALMALIAAAVLSPGLYYAMNAPGGVVGKTAASAASAVTDLGFTITPDALDSAARAVGESTLVARTGGAPTLAVGMSNILSGAFGGGRLAAFWYHFAIMFEALFILTTVDAGTRVGRFMLQDMLGNVWKPIGRVSWWPGVWLSSVLVVGTWGYFLWTGATDPLGGINQLFPLFGMANQMLAAIALAVVTTLFVKSGRARWAWVPGVPLGWDVAVTFTAAWQKVFSDDPKLGFLAQRHRYADALDDGRVLAPARSISDMHKVVQNSTVDGIIAIVFALLVLVVLADAVRVCIRAVRTRAPITTTEADYVASRFVASGGLLAIAEERQLLADAVQAAGAPQPEPVTPPLRRCAADNIPRK

SEQ ID NO: 36678 - DNA, 2070 bp, Methylobacillus flagellatus KT
  CDS (1)..(2070): transl_table=11
atgaataaaatcttgcaatacttgatctggctacttgtcgccgtcgtcggggcttctgcggtgggtggcattgccctgcaccgcggcgaaagcatcaatgccttgtggtttgtggcggcggcggtctgtgtgttcgcgcttgcctatcgtttctatgcggcctggattgccgcccgtgtcctgatggtggatgccacccgggcgaccccggcggagcgtctggacaatggccgagactacgtcccgaccaacaaatgggtggtattcggtcatcatttcgccgcgattgcaggtccggggccgctggtggggccgacgctggcggcgcagttcggttacctgccgggcaccttgtggatattggtgggtgccgtgctgggtggtgcggtgcaggacatggtgaccctattcctgtcaacacggcgcaatggccgcagcctgggtcagatggcgcgagacgagctggggccggttggtggctttgccgccttggtgggaacgttcaccatcatggtgatcctgattgcggtgctcggactggtggtagtcaacgccatgaagcatagtccctgggcgacatcgaccgtggcggccacgataccgattgccatgatcgtcggcctctatatgcgtcatttgcggccaggccgtgtgctggaagcctcggtactcggggtggtgttgctgctgctctcggtcttcggtggcggatacatcgatcatcatccctacttgggcagcctgttcaatcatgacgggctcacgcttgcctggtgggtcatcgcttatggctttgccgccgctatcctgccggtttggttattgctggcgccgcgcgattatctttcgaccttcatgaagctgggcaccattttcctgctggctgtcgcgatcatcctgctgcagcccgaggtcaagatgccggcgttgacccagttcattgacggcaccgggccgattttcggcggggccttgtttccgttcgtcttcatcactattgcctgcggcgcggtatccggctttcatgccttgatcgcttcgggcacgacgcccaagctgattgccaatgaaggggatatccgcctcattggctatggtgccatgctgctggagtcctttgtcgccatcatggcaatgattgccgctacggtgctcgatccgggtgtgtttttcgcgatcaacagcccggccggcttggtgggcaaggaggccgcagatgcggtggcggtaatttccagctgggggttcccggtcacagtggcgcagatggaaaccctcgcgcgccagatgggcgaggctaccttgtttgcgcgaaccggtggtgcgccctctcttgctgtgggtatggcgagtattttcggcagcgcattcggcgagcacttgctggcattgtggtaccacttcgccatcatgttcgaggcaatcttcatcctcacgacgctggatgccggcacccgcgtgggacggttcatgctgcaggacatgctgggaaatgtctggcccaggatcggccggacctcgtggtatccctcagtgctgctgaccagcgcgattgtagtggccggctggggctatttcctttacatcggtgtcatcgacccgaacggcggagtgaatatcctctggccgttgttcggcatttctaaccagatgctggcggcgattgcgttatcggcagggacaggcattctcatcaagtccggcagactcaagtatgcctgggtgactggcttgccgctgagctggctggtggtggtgacgacgacggccgcctgggaaaagatcaccagtacggacgtccgcgttggcttcattgccgctgccaatgatatgtcggcaaagcttgcggcgggggtgctgcctcccgagaaggccgccgtggcgccgcagttgatattcaatcagcagctcgatgccgtgttgaccttgttcttcgtggcggtgctatggatcgtgatcatcgatatgctacgcgtgagttgccgcagcctcagcggcaagtccgtgcgcccttccgctgaggcggcttatgtcgaaaccaagctcggtgcagcctgggggcgggattga

SEQ ID NO: 36679 - protein, 689 aa, Methylobacillus flagellatus KT
MNKILQYLIWLLVAVVGASAVGGIALHRGESINALWFVAAAVCVFALAYRFYAAWIAARVLMVDATRATPAERLDNGRDYVPTNKWVVFGHHFAAIAGPGPLVGPTLAAQFGYLPGTLWILVGAVLGGAVQDMVTLFLSTRRNGRSLGQMARDELGPVGGFAALVGTFTIMVILIAVLGLVVVNAMKHSPWATSTVAATIPIAMIVGLYMRHLRPGRVLEASVLGVVLLLLSVFGGGYIDHHPYLGSLFNHDGLTLAWWVIAYGFAAAILPVWLLLAPRDYLSTFMKLGTIFLLAVAIILLQPEVKMPALTQFIDGTGPIFGGALFPFVFITIACGAVSGFHALIASGTTPKLIANEGDIRLIGYGAMLLESFVAIMAMIAATVLDPGVFFAINSPAGLVGKEAADAVAVISSWGFPVTVAQMETLARQMGEATLFARTGGAPSLAVGMASIFGSAFGEHLLALWYHFAIMFEAIFILTTLDAGTRVGRFMLQDMLGNVWPRIGRTSWYPSVLLTSAIVVAGWGYFLYIGVIDPNGGVNILWPLFGISNQMLAAIALSAGTGILIKSGRLKYAWVTGLPLSWLVVVTTTAAWEKITSTDVRVGFIAAANDMSAKLAAGVLPPEKAAVAPQLIFNQQLDAVLTLFFVAVLWIVIIDMLRVSCRSLSGKSVRPSAEAAYVETKLGAAWGRD

SEQ ID NO: 36680 - DNA, 1821 bp, Moorella thermoacetica ATCC 39073
  CDS (1)..(1821): transl_table=11
atgaatgcactggtactgttaattatagcggcgctggtatttgtcctggcctaccgcttttacggcgcctttatggccgccaaggtcctggccctggacccggggcaccagaccccggccctgatccataacgacggccgggactatgtgccgaccaaccgctggttggttttcggccatcactttgcagccatagccggcgccggacccctcatcggcccggtcctggcggcccagttcggctacctgcccgggttcctgtggatcctcatcggcgccgtggtcgccggcgccgtccatgatatggtgatcctcttcgcttccgtgcgccatgacggccagtcgctggcggaaatagcgcgcagcgaagtgagcaacttttcctactggatggcttcaatcgcccttttgtttcttttaattgtcgtcctggccggcaccagtgtctcggtagtcaatgccctctatcagagcccctgggggacttttaccgtaggcgtgactatccctatcgccatttttatcggtgcttatctgaaatggctgcgccccggccgtatcggggaggctactgttatcggcgtagccctgattgtcgccggcgtcgtcctgggaccggtcatccagcattcgtccctggcttccttactaacctttgataaacaacagctctccctgctcatcgccgcctacggttttctggcggcggtgctgccggtatggctcctgctggtacccagggactacctgagcacttatatgaaaatcggcaccatgttattgctggccgttggcgtcattgccgtcaaccccgtcctgcagatgccttcggtgactaaatttgtggccggcggcggcccggtcattccgggcaaagtttggccctttatgtttatcaccatcgcctgcggggccctctccggtttccacgccatggtctccagcggcactacgccgaaaatgatcaccagtgaggctgacatcaaggttgtcggttacggggccatgctggtggaaggctttgtggccctcatggccctgatcgcggctaccgtcctggccccggcagactactttgccattaacagcgccccggaggtctttgccaaactgggtatgcatgtccaggacctgcccgtgctttcccagctggtgggagaaaacctggccggcaggccgggcggcgctgtatccctggcggcgggcatggcccacattttctccagcatcggcggtttaaggcacctgatgggttactggtaccatttcgccattatgtttgaagccctgttcattctgacgttgattgacgccggtacccgggtcgggcgctacctgctgcaggaaattggtggggtaatctacaaacctttgaaagacaccaattggtggccgggtattatcctcaccagtggtatctttactctagcctggggttatctcctttacggaggtaccatatccaccatctggccccttttcggggtaaacaaccagctcctgggaagcatggccctggccatcggcaccaccatgctcatcaggatgggcaaggtccgctacgcctggacgacctttatccctatggtctttttgacggtaactactataaccgcaggttatcaaaatatctttataaactatctaccggcccataattacctgctggcagtaatttccatcattatgcttctgatggtcatcgctatcattatcgactctgtaagggtgtggttccagctcctctccgggagcaaaacggaactggaaaagggccgggctgcttcattaaacgaaaccggttcggcccacacttattaa

SEQ ID NO: 36681 - protein, 606 aa, Moorella thermoacetica ATCC 39073
MNALVLLIIAALVFVLAYRFYGAFMAAKVLALDPGHQTPALIHNDGRDYVPTNRWLVFGHHFAAIAGAGPLIGPVLAAQFGYLPGFLWILIGAVVAGAVHDMVILFASVRHDGQSLAEIARSEVSNFSYWMASIALLFLLIVVLAGTSVSVVNALYQSPWGTFTVGVTIPIAIFIGAYLKWLRPGRIGEATVIGVALIVAGVVLGPVIQHSSLASLLTFDKQQLSLLIAAYGFLAAVLPVWLLLVPRDYLSTYMKIGTMLLLAVGVIAVNPVLQMPSVTKFVAGGGPVIPGKVWPFMFITIACGALSGFHAMVSSGTTPKMITSEADIKVVGYGAMLVEGFVALMALIAATVLAPADYFAINSAPEVFAKLGMHVQDLPVLSQLVGENLAGRPGGAVSLAAGMAHIFSSIGGLRHLMGYWYHFAIMFEALFILTLIDAGTRVGRYLLQEIGGVIYKPLKDTNWWPGIILTSGIFTLAWGYLLYGGTISTIWPLFGVNNQLLGSMALAIGTTMLIRMGKVRYAWTTFIPMVFLTVTTITAGYQNIFINYLPAHNYLLAVISIIMLLMVIAIIIDSVRVWFQLLSGSKTELEKGRAASLNETGSAHTY

SEQ ID NO: 36682 - DNA, 1473 bp, Shewanella baltica OS155
  CDS (1)..(1473): transl_table=11
atgttaattttctttatttgtatcgcactcttagtgcttgcgtacaagttctatagcccctttgtggaacgtcaagcgggtatagatcctaaagccaagacgccgcaggcgagattcgaagatggcgtcgattatgttccggttcatccggctaaagcgtttctgatccaattcctcaatgtcgcaggtgtgggaccgatatttggcccgatcctcggtgccttgtacggtcccattgccttagtgtggattgtgttggggaacattattggcggtgcggtgcacgattatttttctggcgtgctcagcattaaagaagacggtaagagtttgcctgagatcgctggccactactttaatatctactttaaaggcgtgatgttgctgtttaccgccatgctactgttttttgtgggcgtggtctttatcatgagcccagcaggtttgctgagtaatctcgattatttcaaagacaccatctttggcaataacaccttctgggtgttagtgattttagcctattactttttggcgactatgctgccgatcgataaaattatcactaaactgtatcccgcatttggtttgttgatgatagtgatgacggtttctatcgcagttgccctgatgctcaatgcgccgcagttacctgaaatgggtgatgtgtttgcttattttgatcacagccattacaacaacgagttacttgagccaaatccagacggcttacctgtatggccactgttgtttgtgactattacctgtggtgcgatcagtggtttccattcgacccaagcgcctatcatggcccgttgtttgaccaacgagaagtatgtgcgtcccgtgtactatggcgctatggttgctgaaggtattgttgcttgtgtatgggcaacggccggtattgcggctttccctggtggttatgttgagcttaagagtctgctcgaccaaggtggcccaggtttagtggttaaccaagtggcgacgacttatctcggtgtggtgggcggcattatggcgattgtggccgtggctatcttcccgatcacctctggtgataccgcgttccgttcgctgcgactgacgattatcgacgccttccatattccgcaaagtatgcgtaatcgtttacttgtcgcggtacctatcctcacgattgcgtactttatgacgaagatcgatttctccttgatttggcgctactttgccttctcaaatatgctgctatcaaccagtgtattgtggttagcgactaagtatttgttcgatcgcgggaccttccattggattgtcagcctgccagccattggcggcaccagcgtcacggtttcttacattatgactgcgggtattggtctgggtttaccacaacctttgagccagcctgtgggtatcgcagtcggggttatctgtttagttgcgctgatcattgcgcacaaccgccgcaaacctgtggcagacgtgaaatag

SEQ ID NO: 36683 - protein, 490 aa, Shewanella baltica OS155
MLIFFICIALLVLAYKFYSPFVERQAGIDPKAKTPQARFEDGVDYVPVHPAKAFLIQFLNVAGVGPIFGPILGALYGPIALVWIVLGNIIGGAVHDYFSGVLSIKEDGKSLPEIAGHYFNIYFKGVMLLFTAMLLFFVGVVFIMSPAGLLSNLDYFKDTIFGNNTFWVLVILAYYFLATMLPIDKIITKLYPAFGLLMIVMTVSIAVALMLNAPQLPEMGDVFAYFDHSHYNNELLEPNPDGLPVWPLLFVTITCGAISGFHSTQAPIMARCLTNEKYVRPVYYGAMVAEGIVACVWATAGIAAFPGGYVELKSLLDQGGPGLVVNQVATTYLGVVGGIMAIVAVAIFPITSGDTAFRSLRLTIIDAFHIPQSMRNRLLVAVPILTIAYFMTKIDFSLIWRYFAFSNMLLSTSVLWLATKYLFDRGTFHWIVSLPAIGGTSVTVSYIMTAGIGLGLPQPLSQPVGIAVGVICLVALIIAHNRRKPVADVK

SEQ ID NO: 36684 - DNA, 1434 bp, Shewanella amazonensis SB2B
  CDS (1)..(1434): transl_table=11
atgacttggtttttactctgtgtcggcctgcttctcgtcggctactttgtttacggcgccttcgtcgagaaggtattcggaattaacgccaaacggcaaaccccggcgtttgcccaaaccgatggcgtggactatgtgcccatgtccaaaggcaaggtctatctgatccaactgctgaatatcgccggtgtcggccccatcttcggcccgatcctcggtgccctatacggcccagccgccatgttgtggattgtgattggctgtatttttgccggtgcggtacacgactacttctccggtatgctgtcggtgcgaaacggtggccagtctgtgcccaaccttgccggtaaatacctgggtaaaagtgctaaacactttatgaacgtgtttgccaccattctgctgctgctcgtgggtgtggtatttatttccgctccagcgggcctgcttggaaaactcactggccttagcgtcagcctgtttgtgggcatcattttcgtttactacctgattgcgaccattgtgccggtagacaaaatcatcggtcgtctgtaccccttcttcggcgccctgttgctgtttatgtctgtgggtctgactgtggcactcatcgtctcttctgagcacagcttgctgcccggtgttgaagcctctgatttcctcaccaacctcaaccccaatgacatgccactgtggcctgctctctttatcaccatcgcctgcggcgccgtatctggcttccacgccactcagtctcccctgatggcacgctgcatggaaaacgaaaccaatggccgctttgtgttttacggcgccatgattggtgaaggcatcatcgcccttatttggtgtgccattgccctgtcgttcttcggaggtgttgaaggcctggcaaccggtatggccggtaaccctgccaacgtggtgtacgaagcgtctaccggcctgctgggtgcagtgggtggctttatggcggtgcttggagtgattattctgcccattacctctggtgatactgcattccgttcagcgcgtcttatcctggctgaattcttcaacatgccacaaacccaactgcctaagcgattgatgctggccatcccgctgttcgtgctgggcggcatactgactcaggtcgatttcggtgtgatctggcgttacttcggtgtggctaaccaggcaacagccgtgctgatgctgtggactgcctcagcctatctgctgcgccacaacaagctgcactggatttgcaccattccggccatgttcatgacctcagtggtagtgaccttcctgctgaactccgcaaccctgggtgcaggcctgccaatgaccatctccacggtcgtgggtgtgctggtcgccttcgcagtggctacgctgctggtgattaaaatcaagggtaaatcggtggaactggctgaagaagcctaa

SEQ ID NO: 36685 - protein, 477 aa, Shewanella amazonensis SB2B
MTWFLLCVGLLLVGYFVYGAFVEKVFGINAKRQTPAFAQTDGVDYVPMSKGKVYLIQLLNIAGVGPIFGPILGALYGPAAMLWIVIGCIFAGAVHDYFSGMLSVRNGGQSVPNLAGKYLGKSAKHFMNVFATILLLLVGVVFISAPAGLLGKLTGLSVSLFVGIIFVYYLIATIVPVDKIIGRLYPFFGALLLFMSVGLTVALIVSSEHSLLPGVEASDFLTNLNPNDMPLWPALFITIACGAVSGFHATQSPLMARCMENETNGRFVFYGAMIGEGIIALIWCAIALSFFGGVEGLATGMAGNPANVVYEASTGLLGAVGGFMAVLGVIILPITSGDTAFRSARLILAEFFNMPQTQLPKRLMLAIPLFVLGGILTQVDFGVIWRYFGVANQATAVLMLWTASAYLLRHNKLHWICTIPAMFMTSVVVTFLLNSATLGAGLPMTISTVVGVLVAFAVATLLVIKIKGKSVELAEEA

SEQ ID NO: 36686 - DNA, 2076 bp, Ralstonia metallidurans CH34
  CDS (1)..(2076): transl_table=11
atgaatcgcatcggacaacacctgttgtggctggccgtcgccgtgctcggcgccttcgccttcgccactgtcgcgctgtcgcgcggcgaggccgtcagtgccctgtggatcgtggttgccgcgctctgcatctacctgatcgcctaccgctactacagccgcttcatcgccgacaaggtgatgcagctcgaccccaatcgcatgacgcccgcctggcgccacaacgatggcctggactacgtgccgaccaacaaggcggtgctgttcggccaccatttcgccgccatcgccggcgccgggccgctggtgggccccgtgctggccgcgcaaatgggctatatgccgggcatgttgtggattctggccggcgtggtattcgccggtgcggtgcaggatttcatgatcctgttcatctcaacgcgccgcgacggccgttcgctgggcgacctggtcaagtccgagatgggcaccgtgccgggcatgatcgccctgttcggctgcttcatgatcatgatcatcatcctggccgtgctggcgctgatcgtggtgaaggcactggccggctcgccgtggggcaccttcaccgtggcggtgacgattcccatcgcgctgttcatgggcatctacacgcgctacatccgtcccggccgcatcggcgaagtgtcggtcatcggcttcgtgctgctgatgctcgccatcatcggcggccagtacgtacatgaaagcgccgtgctggcaccgctgttcacgtacgacggcaaggccctgacatggatgctgatcatctacggcttcatcgccgccgtgctgccggtgtggctgctgctggccccgcgtgactacctgtcgaccttcctgaagatcggcacgatcatcgcactggccatcggcatcctgatcgtcgcgccggaactgaagatgccggcgttcacgcagttcgcccaaggtggcggcccggtgtggtcgggcaacctgttcccgttcctcttcatcacgatcgcctgcggcgccgtttcgggcttccacgcgctgatctcgtcgggcaccacgccgaagctgctggaaaatgaatcgcacgcgcgcttcattggctacggcgcgatgctggccgagtcgttcgtcgccatcatggcgctggtggccgcctcggtgatcgagccgggcgtgtacttcgcgatgaacagcccggcggccgtgatcggcaacacgccggaagccgtggcgcacgtggtctccacctggggcttcgtgatcacgccggacgtgctgatccagaccgccaaggacgtgggcgagaacacgatcatctcgcgcgccggtggcgcaccgacgctggccgtcggcatcgcccacatcctgcatcaggtggtgggtggccaggccatgatggccttctggtaccacttcgcgatcctgttcgaggcgctgttcatcctgaccgccgtggacgcgggcacccgtgccggccgcttcatgctgcaggatctgctgggcagcttcgtgccgtccctgcagcgtaccgactcgctgccggccaacctgatcgccaccgcgctgacagtggcggcctggggctacttcctgtaccagggcgtggtcgatccgctgggcggcatcaacacgctgtggccgctgttcggtatctccaaccagatgctggcagccgtggcgctggtgctgggcacctgcgtgctggtcaagatgaagcgcgggcagtacgcctgggtaacgctgctgccgacctgctggctgctgatctgcacgctgaccgccggctggcagaagctgttcgacgccgatccgaaggtcagcttcctgacccacgcatcgaagttcagcgccgcgatcgccgaaggcaaggtactggctccggccaagacgatggagcagatgcaccgcatcgtcttcaacgactacctggatgccggcctgtgcgcgctgttcatgttcgtggtgctgtcgatcgtgttctatgggttcaagaccgcgatgtcggcccgcgccatctcgaagcgcacggaccgcgaaacgccgttcgagccgatgcctgcccaggcttcggcggcgtcgcactga

SEQ ID NO: 36687 - protein, 691 aa, Ralstonia metallidurans CH34
MNRIGQHLLWLAVAVLGAFAFATVALSRGEAVSALWIVVAALCIYLIAYRYYSRFIADKVMQLDPNRMTPAWRHNDGLDYVPTNKAVLFGHHFAAIAGAGPLVGPVLAAQMGYMPGMLWILAGVVFAGAVQDFMILFISTRRDGRSLGDLVKSEMGTVPGMIALFGCFMIMIIILAVLALIVVKALAGSPWGTFTVAVTIPIALFMGIYTRYIRPGRIGEVSVIGFVLLMLAIIGGQYVHESAVLAPLFTYDGKALTWMLIIYGFIAAVLPVWLLLAPRDYLSTFLKIGTIIALAIGILIVAPELKMPAFTQFAQGGGPVWSGNLFPFLFITIACGAVSGFHALISSGTTPKLLENESHARFIGYGAMLAESFVAIMALVAASVIEPGVYFAMNSPAAVIGNTPEAVAHVVSTWGFVITPDVLIQTAKDVGENTIISRAGGAPTLAVGIAHILHQVVGGQAMMAFWYHFAILFEALFILTAVDAGTRAGRFMLQDLLGSFVPSLQRTDSLPANLIATALTVAAWGYFLYQGVVDPLGGINTLWPLFGISNQMLAAVALVLGTCVLVKMKRGQYAWVTLLPTCWLLICTLTAGWQKLFDADPKVSFLTHASKFSAAIAEGKVLAPAKTMEQMHRIVFNDYLDAGLCALFMFVVLSIVFYGFKTAMSARAISKRTDRETPFEPMPAQASAASH

SEQ ID NO: 36688 - DNA, 2124 bp, Rubrobacter xylanophilus DSM 9941
  CDS (1)..(2124): transl_table=11
atgggtagccggctcaagcgctacggcatctgggtgctcgtggccgtcgtgggtgcggtgtgctggggtgttctggcgctcgcccgcggggagaccatcaacgccgggtggctgctgttcgcggccatagcatcctatgcgatagcctaccggttctacgccaggttcatccagacccgggtgctcgagaccgacgacagccgggccacgcccgccgagcggctcgagaacgggcgggacttcgtcccgatggaccgcaggatactcttcgggcaccacttcgccgccatagccggggcgggcccgctcgtcgggcccgtgctggcggcgcagatgggcttcctgccggggaccatctggatcatcttcggcgtcatcctcgccggcgcggtccaggacatgaccaccctcttcttctccatgcgccgggacgggaagaccctcggccagatggcgcgggaggagatcgggcccgtcggcggggcggcggcgctcatcgccgtcatgtccatcatggtcatcctgctggcggtgctggcgctggtggtcgtcaacgccctgaccgcctccccgtggggctccttctcgctgctgatgaccgtgcccatagcgatctttatgggcttctacctgcggttcttgcggcccgggcgggtcatcgaggtgtcgctcatagggtttgcgctgctcatcctcgcgatagtggggggcggttggatctcggagtccggctacgccgaggcctggacgttcgagggcaccacgataacctgggccctcataatctacggctttgtggcctccgtgctgccggtgtgggtgctgctcgccccgcgcgactacctctccaccttcatgaagatcgggaccgtgctgctgctggcggtcggcatcgcgctcaccctgccggcgatgcagatgccccgcaccacccagttcgccttcaacggcgaggggccggtcttctccgggccgctgttcccgttcgtgttcatcatcgtggcctgcggggcgctctccggcttccactccctcatcgccagcggaaccaccccgaagctgatcgccaaggagtcgcaggtgcggatgatcggctacggggcgatgctcatggagtccttcgtggcggtgatggcgatgatcgccgcctgcatcctggaccccggcgtgtacttcgcgatgaacgccccggcgggggtgctcggcgagaccgcccggtcggcggccgaggcggtgcggggcttcgggttcaccgtcaccccggagaccctcaaccagatcgcccagaacgtcggtgaggagtcgatcatcgcccgcaccggcggcgccccgacgctggcggttgggatgagccagatcctctcctccctcctcggcggcacgacgctgcaggcgttctggtaccacttcgccatcatgttcgaggcgctgttcatcctcaccacggtggacgccgggacgcgggtgggccgcttcatgctgcaggacatgatcggcaacgtatggcggcccttcgcccgcacctcctggctgccggccaacatcgtggcgagcgccctcatcgtggcggcctggggttacttcctctacgccggcgtcaccgacccgctgggcggcatcaaccagctcttcccgctcttcgggatcgcgaaccagctcctggcggcggtcgcgctcaccgtcgggaccaccatcctgataaagatgggcaagctgaagtgggcctgggtgacggccctgccgctggcctgggacgcctcggtgaccctgacggcgagctggtacaagatcttctcccccgatccctccatcggcttcttcgcccagcgggcggccttccaggaggcgctcgccaacggcgaggtcgtcgcccccgcccagtcgctggaggacatgcggcaggtggtgctgaactcgacggtggacgggatactctccatcctgttcgccctgatgatcatcatcgtcatcctggacgccgccagggtgtgggtcggcgtgatcacgggccgcaagccggccgagaccaccgaggccccctacgagcgttcgcggctggaccacgaggggaagcccctggagcccgagccggtgggcgcgggcggctctccgtcctcctcatag

SEQ ID NO: 36689 - protein, 707 aa, Rubrobacter xylanophilus DSM 9941
MGSRLKRYGIWVLVAVVGAVCWGVLALARGETINAGWLLFAAIASYAIAYRFYARFIQTRVLETDDSRATPAERLENGRDFVPMDRRILFGHHFAAIAGAGPLVGPVLAAQMGFLPGTIWIIFGVILAGAVQDMTTLFFSMRRDGKTLGQMAREEIGPVGGAAALIAVMSIMVILLAVLALVVVNALTASPWGSFSLLMTVPIAIFMGFYLRFLRPGRVIEVSLIGFALLILAIVGGGWISESGYAEAWTFEGTTITWALIIYGFVASVLPVWVLLAPRDYLSTFMKIGTVLLLAVGIALTLPAMQMPRTTQFAFNGEGPVFSGPLFPFVFIIVACGALSGFHSLIASGTTPKLIAKESQVRMIGYGAMLMESFVAVMAMIAACILDPGVYFAMNAPAGVLGETARSAAEAVRGFGFTVTPETLNQIAQNVGEESIIARTGGAPTLAVGMSQILSSLLGGTTLQAFWYHFAIMFEALFILTTVDAGTRVGRFMLQDMIGNVWRPFARTSWLPANIVASALIVAAWGYFLYAGVTDPLGGINQLFPLFGIANQLLAAVALTVGTTILIKMGKLKWAWVTALPLAWDASVTLTASWYKIFSPDPSIGFFAQRAAFQEALANGEVVAPAQSLEDMRQVVLNSTVDGILSILFALMIIIVILDAARVWVGVITGRKPAETTEAPYERSRLDHEGKPLEPEPVGAGGSPSSS

SEQ ID NO: 36690 - DNA, 2229 bp, Kineococcus radiotolerans SRS30216
  CDS (1)..(2229): transl_table=11
gtgggtcgcgggcgcggcgcagcgcccgcagcgacccgcgaggaggcggccgtgagccgggtgcagaccgaccccaccgatcccaccgacaccgtccggcggcggccctcgccgcggtcggtggccgtctggagcgcggtggccctcgtcggggcggtcgcctggaccgtcctcgccctggcccggggggagtcggtcaacgcgctgtggatcctcttcgccgcgctcgcctcctacgccatcggctaccgcttctactcccggttcatcacctaccgcgtgctgcgcgccgacgaccggcgcgcgacccccgcggagcggtacgagaacggcgtcgacttcgaggtcaccgaccggcgggtgctcttcgggcaccacttcgccgcgatcgccggggcgggcccgctggtcgggccggtgctggccgcgcagatggggtacctgccggggacgatctggatcgtcgtcggggtcctgttcgccggggcggtgcaggacctcacggtgctgttcttctcgatgcgccgcggcggcaagagcctggggcagatggtgcgcgaggagatcggggtcgtcggcggcgtcgccgcgctcgtcgccgtgttcgccatcatgatcatcatcctggcggtgctggccctcatcgtcgtcaactccctcgccgagtccccctggggcgtgttctccatcgccctgacgatccccatcgccctgttcatgggcgtctacctgcgcttcctgcgcccgggccgggtgctggaggccaccgcgatcggcgtcgtcctgctgctggcggcgatcgtcgggggcggctacgtcgaggcgtggggcctcggcgacgccctgaccctcacccccgagaccctggtcgtcgccctcgtcggctacggcttcgtcgcctcggtgctgccggtctggctgctgctgaccccccgcgactacctgtccacgttcatgaagatcggcgtcatcgtcctgctcgcggtgagcctgctggtggcccggccggtgctcgccaacgacgcggtgacctccttcgcccgggaggggaacggccccgtgttcgcggggtcgctgttcccgttcgtcttcatcaccatcgcctgcggggcgctgtccggcttccacgccctcatctcctcggggaccaccccgaagatggtcgccaaggagcgccaggtccgcctcatcggctacggcgggatgctcgtggagagcttcgtcgccatcagcgcgctcatcgcggcctcggtcatcgaccagggcatctactacgcggtgaactccccggccggggccaccggtggcacccccgccaccgccgcgcagttcgtcaccggcctgggcttcacgacctccccggaggcgatcgaggccgcggcccgggcggtgggggaggagagcgtcgtctcccgcaccgggggcgcgcccgcgctggcgctggggatctcccaggtgttccaccaggcgttcggcggggggttgcaggcgttctggtaccacttcgcgatcatgttcgaggcgctgttcatcctcaccgccgtggacgcgggcacccgggtcgggcggttcatgctgcaggacaccctcggcaacgtctggaagaagatgggcgacctgtcctggcggcccggcaacgtcatcgccagcgccgtcgtcgtcggcgcctggggctacttcctccataccggcgtcaccgaccccctgggcgggatcaaccagctgttcccgctgttcggcatcgccaaccagctcctcgcggcgatcgcgctgaccctcgtcaccacgctgctggtcaagcacggccgcgcccgctacgcctgggtcaccggggtgccgctggtgtgggacctcgtcgtgacgatgaccgccagcgcccagaaggtgttctccgacgacccgaagatcggcttcttcgcccagcgcgagcgctacgccgacgcgctggccgccggcgaggtcctggccccggccaaggacgcggggcagatgcagcaggtcgtcacgaactccacggtcaacggggtgctgcaggcgctgttcgccctcctggtcgtcgtgatcgccgtcaacgcggccgtcgtggtggtccgcgccctgcgcgcgggcgggctggcgacgacggaggaaccggccgtgccctcccgcctggtcgaaccctccgggctggtcgtcacggccgaggagcgccaccgcctcgccgcgctgcgcgaggagctgaccccgtga

SEQ ID NO: 36691 - protein, 742 aa, Kineococcus radiotolerans SRS30216
MGRGRGAAPAATREEAAVSRVQTDPTDPTDTVRRRPSPRSVAVWSAVALVGAVAWTVLALARGESVNALWILFAALASYAIGYRFYSRFITYRVLRADDRRATPAERYENGVDFEVTDRRVLFGHHFAAIAGAGPLVGPVLAAQMGYLPGTIWIVVGVLFAGAVQDLTVLFFSMRRGGKSLGQMVREEIGVVGGVAALVAVFAIMIIILAVLALIVVNSLAESPWGVFSIALTIPIALFMGVYLRFLRPGRVLEATAIGVVLLLAAIVGGGYVEAWGLGDALTLTPETLVVALVGYGFVASVLPVWLLLTPRDYLSTFMKIGVIVLLAVSLLVARPVLANDAVTSFAREGNGPVFAGSLFPFVFITIACGALSGFHALISSGTTPKMVAKERQVRLIGYGGMLVESFVAISALIAASVIDQGIYYAVNSPAGATGGTPATAAQFVTGLGFTTSPEAIEAAARAVGEESVVSRTGGAPALALGISQVFHQAFGGGLQAFWYHFAIMFEALFILTAVDAGTRVGRFMLQDTLGNVWKKMGDLSWRPGNVIASAVVVGAWGYFLHTGVTDPLGGINQLFPLFGIANQLLAAIALTLVTTLLVKHGRARYAWVTGVPLVWDLVVTMTASAQKVFSDDPKIGFFAQRERYADALAAGEVLAPAKDAGQMQQVVTNSTVNGVLQALFALLVVVIAVNAAVVVVRALRAGGLATTEEPAVPSRLVEPSGLVVTAEERHRLAALREELTP

SEQ ID NO: 36692 - DNA, 1473 bp, Shewanella denitrificans OS-217
  CDS (1)..(1473): transl_table=11
atgttgatttttttgatttgtattggcctgctattactcgcctataagttttacagcccctttgtcgagcgtcaagcgggcatagaccccaaggctcaaacgcctcaggcacggtttgatgatggggtggattatgtcaaagtgcatccccttaaagcttaccttattcaatttcttaatgtggctggggtcgggcctattttcggcccgattttaggcgcactttatgggcctatcgccttagtctggattgtgctgggtaatatcatcggcggcgcagtgcatgattatttctcgggtgtgttgagcattaaggaagatggcaagagcctgcctgaaatcgccggtcattactttaatggctactttaaagccgtcatgctgctgttcaccgccatgctgctgttcttcgtcggggtggtgtttatcatgagcccggcgggattactcagtaatctagcactgtttgaaggcacaatactggccaataacaccttttgggtgttggttattttagcctattactttttggcgaccttactgccgattgataaaattatcactaagttgtatcccgcttttggcctcttgatgatagtcatgacagtctctattgggctggcaattctttttaatgcaccagagttacctgtgatgggagatgtgctggcttactttgatcatagccattataacaatgagttgttggcgcctaatcccgatggcttgcctgtgtggcccttgttgtttgtgactatcacttgcggcgctatcagtgggtttcattccactcaagcgccgataatggcgcgctgtttaaccaatgagcgttatgtgcggcctgtatattacggcgctatgatttctgaaggtgtggtggcctgtgtttgggcgaccgcgggcatggcggcatttcccggtggttatcttgagctcaaaactttgcttgatcaaggcggcccaggtttagtggttaaccaagtggccagcagttatttaggggttgctggcggcgtgatggccattattgccgtggccgtgttccctattacgtcgggcgataccgcctttagatcgctgcgcctcaccctgatagatgcctttaatattccccagagtgtgcgtaatcgtttgctggtggcgattcccattttggttatcgcttacttaatgacaaaaatcgatttctccttgatttggcgctattttgccttttctaacatgctgttatccactagcgtcctgtggcttgccactaaatatttatttgatcgaggtgccttccattggatagtgagcttgccggctattatgggcaccagcgtgactgtctcttacatagtcaccgccggcataggcctaggtttaccgcaatcattgagccagcctgtggggatagctgtggctgtgattggtttgatggccttaacactcactcatgttaagcataagcgtcaacggcaagtgctttag

SEQ ID NO: 36693 - protein, 490 aa, Shewanella denitrificans OS-217
MLIFLICIGLLLLAYKFYSPFVERQAGIDPKAQTPQARFDDGVDYVKVHPLKAYLIQFLNVAGVGPIFGPILGALYGPIALVWIVLGNIIGGAVHDYFSGVLSIKEDGKSLPEIAGHYFNGYFKAVMLLFTAMLLFFVGVVFIMSPAGLLSNLALFEGTILANNTFWVLVILAYYFLATLLPIDKIITKLYPAFGLLMIVMTVSIGLAILFNAPELPVMGDVLAYFDHSHYNNELLAPNPDGLPVWPLLFVTITCGAISGFHSTQAPIMARCLTNERYVRPVYYGAMISEGVVACVWATAGMAAFPGGYLELKTLLDQGGPGLVVNQVASSYLGVAGGVMAIIAVAVFPITSGDTAFRSLRLTLIDAFNIPQSVRNRLLVAIPILVIAYLMTKIDFSLIWRYFAFSNMLLSTSVLWLATKYLFDRGAFHWIVSLPAIMGTSVTVSYIVTAGIGLGLPQSLSQPVGIAVAVIGLMALTLTHVKHKRQRQVL

SEQ ID NO: 36694 - DNA, 1470 bp, Shewanella frigidimarina NCIMB 400
  CDS (1)..(1470): transl_table=11
atgctgattttcctcatttgtatcgggctgctcgtgctcggattcaaattttacagtccgttcgttgagcgacaagctggtatcgaccctactgctaaaacccctcaagaacgatttactgatggcgttgactatgttcctgttcatccagttaaagctttcttaattcaatttcttaatatcgccggtgtcggaccgatattcgggccaattttaggtgcattatatggccctattgcactggtttggattgtgattggtaacgtacttggtggcgccgttcacgattacttctctggtgtgatgagtattaaagaagacggtaaaagtttacctgaaattgccggccattatttcaatgtgtactttaaaggtgccatgttgatatttaccgcgatgttgctcttcttcgttggtgttgtatttatcatgagcccagcagggctgctaagtaacttagattattttaaagacacctttttgagtaacaataccttttgggtattacttattttaggttactacttcctcgcgactttgttaccgatagataaaattattacaaaactgtatccattatttggtttactaatgattgtaatgacaacatcaattgctgttgcattgctaatccatgcgccgcaactacctactgttgacggtatctttgcttatttcgatcacagtcactacaacaatgatttattggagcctaatcctagtggtttaccagtatggccattgttgtttgtcactattacctgtggcgcaatcagcggattccattcaactcaagcaccgattatggcgcgttgtttaactaacgaaaaatacgttcgtcctgtgtactatggtgcaatggttgcggaaggtgttgtggcatgtgtgtgggctactgcaggtatcgcagctttccctggtggttatatcgaacttaagagtgttctcgatattggtggccctggtatggttgttaaccaagtggcgaccacttacttaggtgtcgcgggtggtattatggcaattatcgcggttgcggttttcccaattacctcaggtgacactgcgtttagagcattgcgattaaccattattgatgcgtttaaaattccgcaaagcgtcagaaaccgtttactggttgccattcctattctgattattgcttattttatgactaagattgatttcaccctaatctggcgttatttcgcattctcaaatatgttgttatcaactagcgtattgtggcttgcgactaagtatctgtttgatcgcggtaccttccattggattgtcagtattccagcgattattggtacttgtgtgacagtgtcgtacatcatgaccgcaggtataggttttggattgccgcaagcgctgagccagcccgtgggtattactgtaggtgtaatatgtcttattgcgctgattatcgcgcacaataaacgtaaagtgattactactcagtaa

SEQ ID NO: 36695 - protein, 489 aa, Shewanella frigidimarina NCIMB 400
MLIFLICIGLLVLGFKFYSPFVERQAGIDPTAKTPQERFTDGVDYVPVHPVKAFLIQFLNIAGVGPIFGPILGALYGPIALVWIVIGNVLGGAVHDYFSGVMSIKEDGKSLPEIAGHYFNVYFKGAMLIFTAMLLFFVGVVFIMSPAGLLSNLDYFKDTFLSNNTFWVLLILGYYFLATLLPIDKIITKLYPLFGLLMIVMTTSIAVALLIHAPQLPTVDGIFAYFDHSHYNNDLLEPNPSGLPVWPLLFVTITCGAISGFHSTQAPIMARCLTNEKYVRPVYYGAMVAEGVVACVWATAGIAAFPGGYIELKSVLDIGGPGMVVNQVATTYLGVAGGIMAIIAVAVFPITSGDTAFRALRLTIIDAFKIPQSVRNRLLVAIPILIIAYFMTKIDFTLIWRYFAFSNMLLSTSVLWLATKYLFDRGTFHWIVSIPAIIGTCVTVSYIMTAGIGFGLPQALSQPVGITVGVICLIALIIAHNKRKVITTQ

SEQ ID NO: 36696 - DNA, 1461 bp, Shewanella frigidimarina NCIMB 400
  CDS (1)..(1461): transl_table=11
atgacgtggtttttactctgtgtaggcctgctaattggtggctattttatttatggcgcttttgtcgaaaaagtgttcggcattaacactcaaagacaaacgcccgctttcactcaaacagacggtgtcgacttcgtaccgatgtctaaagggaaagtctatttaattcaattgttaaacattgctggtgtcggtccaatttttggcccaattctaggtgccctttatggcccagcggcgatgctatggattgtatttggttgtatttttgccggtgcagtgcacgattacttttcggggatgttatcggtacgcaataatggtcaatcagttcctaacttggccggtaaatacttaggtaacaacgccaagcactttatgaacttgtttgccattatcttattgttactagttggcgtagtgtttatctctgctcctgcaggattactaagcaaacttaccggactggatgtcactctctttgttggtatcatttttgtttattatttaattgctaccatcgtacctatcgacaagattattggtcgcttatacccattctttggcgcattactggtctttatgtcactcggactgattatagcgttagcattatcaaccgaacataccatgttacctggttttgaaatgggtgacttctttaccaacttaaaccctaatgacatgccattatggccagccttattcatcacgattgcatgtggtgcagtatcgggtttccatgcaactcaatcacctttaatggcgcgttgtgttgaaaatgaatcaaacggtcgctttgtgttttttggtgccatgattggtgaaggtgttattgcattaatttggtgtgcaattgcattatcattctttggtggtgtagaaggattgaatgccggaatggcaggcaacccagcaaacgttgtgtacgaagcatctaatgggctattaggaacatttggtggcttcttggctatcttaggtgtcattgtattgcctatcacctctggcgatacagcatttcgctcagcgcgattaatattggcagagttctttaacatcaagcaaatcgagttaccgaagcgtttaatgctcgcgttaccattatttgtcgtcggtgccgtgttaacccaagtagactttggcattatctggcgctactttggtgttgcaaaccaaaccacagcggtattgatgttatggaccgcttcagcttacttactacgacacaataaattccattggatttgtactgtaccggctatgttcatgacctgtgttgtgattagctttatgttgaactcatcaacattgggtgctggtttaccaatgacagtgtcaactattgcaggtttagtcactaccgcaatcattgcgacaatgattattattaagaccaaaggcaaaggcgatattgatactgacgaagaagacaaagttgaactagccaacgagttatag

SEQ ID NO: 36697 - protein, 486 aa, Shewanella frigidimarina NCIMB 400
MTWFLLCVGLLIGGYFIYGAFVEKVFGINTQRQTPAFTQTDGVDFVPMSKGKVYLIQLLNIAGVGPIFGPILGALYGPAAMLWIVFGCIFAGAVHDYFSGMLSVRNNGQSVPNLAGKYLGNNAKHFMNLFAIILLLLVGVVFISAPAGLLSKLTGLDVTLFVGIIFVYYLIATIVPIDKIIGRLYPFFGALLVFMSLGLIIALALSTEHTMLPGFEMGDFFTNLNPNDMPLWPALFITIACGAVSGFHATQSPLMARCVENESNGRFVFFGAMIGEGVIALIWCAIALSFFGGVEGLNAGMAGNPANVVYEASNGLLGTFGGFLAILGVIVLPITSGDTAFRSARLILAEFFNIKQIELPKRLMLALPLFVVGAVLTQVDFGIIWRYFGVANQTTAVLMLWTASAYLLRHNKFHWICTVPAMFMTCVVISFMLNSSTLGAGLPMTVSTIAGLVTTAIIATMIIIKTKGKGDIDTDEEDKVELANEL

SEQ ID NO: 36698 - DNA, 1680 bp, Psychrobacter cryohalolentis K5
  CDS (1)..(1680): transl_table=11
atgaatagtgcaatcgtgctattgtttgctgttgccgctatgctttgcggttatctgttttactcaaaatttatcgccactaaaatcttggcattggataatagtatccccacgccagcacatactatgaaggatggggtagattatattcccactaataaatatgtgttgtggggacaccattttacttcagtcgcaggggcagcaccgattattggtcctgccattgcggttatttggggctgggtacctgctatcatttgggtggtattaggtactatttttatggcaggtgtccacgacatgtctgccatttgggcaagtatgcgcaatcgaggtcaatcgattggctcgattgccggtacggtcatgggtacacgtgtgcgcagcttgatgatgatcgtcatctttttattattactaatggtaaatgcggtattcggcgtcgctattgctaatatgatgataaaaaccccatccgctgtactgccagtttggggtgctttgatagtcgcctttatcatcggtcaatgcatttatcgctataagatgaatctggtttgggtatcaatcattggggtcacggctttatatgggcttatctatcttggtcctatgttccccattgtgttacctgagacatttttaggcttacctgacaatgctgtttggattattattttatttgtctatgcggcaatcgcgtctttgttaccagtctggatgctgttgcagccgcgcgattacatcaatggcttgcagttatttgtcggtctgattttattatatgccgctatctttattgcgactcctaatattgtcgcgccagcgatcaacacagcattgccaatcggtacgccatctatgctgcctttattgtttgtgaccattgcttgtggtgcaatctcaggctttcatggtttggtagcgacaggtacgacgtctaagcaaattgataaagaagaagatgtgcgattcgttggttacttcggtgccatgggtgagggcatgctagcactcggtgcgatacttgcggcaacagcaggctttgcaacccttggcgactggcaagccgtttatcaaaaatttggcgacggctctattggtgcctttatcgatggcggtgcgactatcttgaatgcaggtgttggcattgatatggttttatcgcagacgatgctgacggtaatggcagcattgttcgctggtaccacgatggatactggagtacgtttgcaacgctatatcttccaagaatttggtgaaatttataaactgcctgttctaaataaaagtgtggtggccacattgcttgccgttggtagctgtttgttattagcattcggtgctggtggcatcgatggtgctggtggtatgattatttggccgttatttggcacgacgaatcagctcatggcagcattaaccttaatgattgtaaccgttattttattacgtaaaggcagaccagtatggtataccttagggccattgtcgttcttactggtcatgacggtttttgcattattgattcagctaaaaacctttttcaatgacggtaattggctgcttattattatggatatcattatcttgatagccacaattttagtgacgtttgagagtttatcagtactccgtaaagaatggtcgatacacagaggcaaaagcaacctctaa

SEQ ID NO: 36699 - protein, 559 aa, Psychrobacter cryohalolentis K5
MNSAIVLLFAVAAMLCGYLFYSKFIATKILALDNSIPTPAHTMKDGVDYIPTNKYVLWGHHFTSVAGAAPIIGPAIAVIWGWVPAIIWVVLGTIFMAGVHDMSAIWASMRNRGQSIGSIAGTVMGTRVRSLMMIVIFLLLLMVNAVFGVAIANMMIKTPSAVLPVWGALIVAFIIGQCIYRYKMNLVWVSIIGVTALYGLIYLGPMFPIVLPETFLGLPDNAVWIIILFVYAAIASLLPVWMLLQPRDYINGLQLFVGLILLYAAIFIATPNIVAPAINTALPIGTPSMLPLLFVTIACGAISGFHGLVATGTTSKQIDKEEDVRFVGYFGAMGEGMLALGAILAATAGFATLGDWQAVYQKFGDGSIGAFIDGGATILNAGVGIDMVLSQTMLTVMAALFAGTTMDTGVRLQRYIFQEFGEIYKLPVLNKSVVATLLAVGSCLLLAFGAGGIDGAGGMIIWPLFGTTNQLMAALTLMIVTVILLRKGRPVWYTLGPLSFLLVMTVFALLIQLKTFFNDGNWLLIIMDIIILIATILVTFESLSVLRKEWSIHRGKSNL

SEQ ID NO: 36700 - DNA, 1644 bp, Prosthecochloris vibrioformis DSM 265
  CDS (1)..(1644): transl_table=11
atgaacaccattcttcttgcagctctttccctcctgctgctctacctcggttaccgttactacagcccggttctcgcccgtcagcttggcattgatgaatcggaagagactccggccgtcaaacagcatgacggtgtcgatttcgtgccggcaaaacattggctgattcttttcggccatcattttgcctccattgcaggggcggctcccattatcggcccggtcatcgcctgcctttattggggctggcttcccgctctggcatggatagtgttcggcagcatcttcatgggtgctgtgcacgaccttgcttcccttgccatctccgccaaaaacgaggggcgttcaatagctgaccttacggaaaacatcctcgaccgcaatgcaaaaatcgtcttcagcctctttgttttcctgacactcatcctcattgtggcggtgtttgctgccatagctggccagacccttgccaacacccctgaagtggtgcttcccacccttggcctcattcctgttgctgcgctcatcggctggttgatgtaccatcgtggcttctcgattctcctctcttcgctgctgggtgttgccatgctgtttggtctcatcgtcctcggctacagccaccccctgagcctgccggtgtcgaacccggcacaatggtggaccatcattctcatcatttacggcatgattgcctctgtcactccggttaccctgctcctgcagccgcgcgaccatcttgccgcccttgtcctgtttgccggcatgtttttcggcttccttgggctgctgctctcccgtcctgaactccacgctcctccggtggtctccttttcctccgatcagggctggatgttccccatgcttttcatcactatcggctgcggagcggtatcgggcttccacagccttgtagccagcggcaccaccgccaagcagcttcccacaatgaaagatatccgggccgtcggttacggggccatggtcactgaatctgctcttgctgttctggcaattgttgccgttacagcaggtctctactggaaagagattccggttggtcagcacgggttcgtttatcaggaggtgtttcagaaggggggatggataaagaccttcggcctcggctatggtgaaattaccaagccggtgctcggtgctttcggcgctctcatcggcatcaccatgctgaaaacttttgtgatgaccacgctcgactctgccacccgcattacgcgctatataggaactgagcttctcggtgagactttcggtattccgggcatgaaaaataaatacggggttacccttcttataggatttctggccggagtactggcacttggcaactggaaggccatctggcccatattcggttcagccaaccagcttgtcgcgagcgtggtgttcatagtcacaagcgtgtggctgttcgcaagggggaagaactggaaactgaccgctgtgccggcagtcctgatgctcatcaccaccatcagtgctctcgtcgtgaaaaccaatgagttcctcaccgccgagccggctaaatacctgctcgcctcaatagccgttatccttatcgccctggcgctcttcatccttgtgcagagcatccgcgttgtgcggagccgtgggccggtctag

SEQ ID NO: 36701 - protein, 547 aa, Prosthecochloris vibrioformis DSM 265
MNTILLAALSLLLLYLGYRYYSPVLARQLGIDESEETPAVKQHDGVDFVPAKHWLILFGHHFASIAGAAPIIGPVIACLYWGWLPALAWIVFGSIFMGAVHDLASLAISAKNEGRSIADLTENILDRNAKIVFSLFVFLTLILIVAVFAAIAGQTLANTPEVVLPTLGLIPVAALIGWLMYHRGFSILLSSLLGVAMLFGLIVLGYSHPLSLPVSNPAQWWTIILIIYGMIASVTPVTLLLQPRDHLAALVLFAGMFFGFLGLLLSRPELHAPPVVSFSSDQGWMFPMLFITIGCGAVSGFHSLVASGTTAKQLPTMKDIRAVGYGAMVTESALAVLAIVAVTAGLYWKEIPVGQHGFVYQEVFQKGGWIKTFGLGYGEITKPVLGAFGALIGITMLKTFVMTTLDSATRITRYIGTELLGETFGIPGMKNKYGVTLLIGFLAGVLALGNWKAIWPIFGSANQLVASVVFIVTSVWLFARGKNWKLTAVPAVLMLITTISALVVKTNEFLTAEPAKYLLASIAVILIALALFILVQSIRVVRSRGPV

SEQ ID NO: 36702 - DNA, 1758 bp, Syntrophobacter fumaroxidans MPOB
  CDS (1)..(1758): transl_table=11
atgaacgccgcagttctaatggtcgtagcattcgttttattcttcattgcgtatcgtatttacgggaaatacatctccaaggtgttcgaggaaaacgacgcaaatcccacaccggcatgcgcaatgaaggatgattgcgattatgtgcccacaaagccgattgttctcttcgggcaccactttgccagcatcgcgggcggtggtcccatcatcggacccacggtggccatgcttttcggattcatacccgtatggctgtgggcggtgttcgggagtatcttcgtcggtgcggtgcacgacatgacgacgcttttcgcaagcgtccgggagaaggggaaatccgttgccgaaatcgcgaaggcgaccctgggaaacacggggttctttctcttcatttcatttaacatactcatgctcctgctggtcacgtccgcatttctgggcctgacggcaacggccctgacttccctgctgcccctggacgtgctcaagctcgaaccttcgcaaaccctggtgaagaccatagaggccggcggggtcgtcaaggcgcagataggcggcatcgcctccacctcggtcatcatcatcacctgctgtgcgccctttctcggttttctggtgtacaagaagggaatcaacgcatatctcgcctccgccatcgcgatcgtcgtatgtattgtttccgttgtcgttggaatggaaattccggtttccttcaacgccaacacatggatgatcatactctgcttttacacgttgctggccgcgggcattcccgtctggctgatcttgcagccccgggatttcaccaactcgttcctgctctacgcgggagttgcgggactgttcatcgcgagcatcgcggcgggtttcaaaggggttaccttcaacgccccgttgacgaacctcgcggcggggtcggccaagctgggacccatatggccgttcctgttcattactgtggcctgcggcgccatttcgggctttcattgcctggttgcgggcggcacgtcgtccaaacagatctcgaaagaatcggacgtcaggagaatcggttacgggggcatgctgctggaaggcctgctcgccatcggcgtcctggtcgccgtcggatgcggcatcgcctttcaggattattcgaacatcgtgttcccgacgaccgccggggtaagatcgaacccgatcctggcctttgccgccggcgcgggcggcctgttcgacaaagggcttggtatatcgcccgtgtacggaacgattttcggaatccttctcgtggagggtttcgtggtcacgacgctggatacggccgttcggctcaaccggtacttgttcgaagagctgtggcaggtgatgttcacgaatgttccgaagatcatgaaaacctatttgttcaactcggcgctttgcgtgttcctcatgtatattttggcctacaacaatgcgttcctggttatatggcccgcgttcggctccgcgaatcaattgcttgcctcgctggccctgatagccgtatcggtgtggttggtgaacaaggggaaaaatgccgtgtttaccgtgatcccggccattttcatgatggtgacgaccttgtattccctggtcagtctgcttgtaaacacctatcttcccaagcagaactacatgttggccgctgttgcgatattgctgaccattctctcgatcggcgtcatttcaatggcgttcaacgcgtggaggaagatcaggagggaagctgtagtgcccgcccgcgcggcatga

SEQ ID NO: 36703 - protein, 585 aa, Syntrophobacter fumaroxidans MPOB
MNAAVLMVVAFVLFFIAYRIYGKYISKVFEENDANPTPACAMKDDCDYVPTKPIVLFGHHFASIAGGGPIIGPTVAMLFGFIPVWLWAVFGSIFVGAVHDMTTLFASVREKGKSVAEIAKATLGNTGFFLFISFNILMLLLVTSAFLGLTATALTSLLPLDVLKLEPSQTLVKTIEAGGVVKAQIGGIASTSVIIITCCAPFLGFLVYKKGINAYLASAIAIVVCIVSVVVGMEIPVSFNANTWMIILCFYTLLAAGIPVWLILQPRDFTNSFLLYAGVAGLFIASIAAGFKGVTFNAPLTNLAAGSAKLGPIWPFLFITVACGAISGFHCLVAGGTSSKQISKESDVRRIGYGGMLLEGLLAIGVLVAVGCGIAFQDYSNIVFPTTAGVRSNPILAFAAGAGGLFDKGLGISPVYGTIFGILLVEGFVVTTLDTAVRLNRYLFEELWQVMFTNVPKIMKTYLFNSALCVFLMYILAYNNAFLVIWPAFGSANQLLASLALIAVSVWLVNKGKNAVFTVIPAIFMMVTTLYSLVSLLVNTYLPKQNYMLAAVAILLTILSIGVISMAFNAWRKIRREAVVPARAA

SEQ ID NO: 36704 - DNA, 1845 bp, Pelobacter propionicus DSM 2379
  CDS (1)..(1845): transl_table=11
atgagtgtcatctggctgctgctctccgccctctgtgtgcttgtcctggcgtaccgctactatgctgctttcattgccgccagggtgttgatgctggatgatcgcaacgtcacgccgtcggttacccgcaatgacggcaaggattttgttccaacgaacaagtgggtcgtgttcggccatcacttcgccgccatcgccggagctgggccaatgatcggtcccaccctggcggcccagtacggctgggggccgggctttttctggatcctcttggggtcggtcttcgccggctgcgtccatgacatgatccttctgttcgcctccatccgtcaccagggggagtccctgtcggtcatcgcccgcagggacgtgagcaggttgaccggcgtaaccaccgccttcgtgaccctgttcatcatcatcgtcgccctggccggtcttgctgtggcggtcaccaatgccctgtacaacaacccctggggcgtgttcaccatcggcatgaccatccccatcgccatgatcaccgggctctatatgttcaaactcaggccgggcgcgatcctgtccggctccctggccggagtcacggccgtggttgccgccgtatacttcggggctcccgtcgcccagtcgtccatcgccggatggttcaccttcagcaaggagagtctggcgatcatcctgccgctgtacggcttctgcgcggctgccctgccggtgtggttgctgcttgcgccccgggattacctgagcacctacatgaaaatctcggtcatcggcgggctggccctggggctcttctttgtcaacccgagcgtgcagatgcccttcgcgacccggttcatcgccggcggaggaccgatcatccccggccccgtctggccctatgtgttcatcaccatcgcctgcggcgccatttccgggttccacgcactgatcggctccggcacgacccccaagatgctggagaaggagagtcagatccccctggtggggtacggcgccatgctgaccgaggcctttgtggggctgatggcgctcctggcggcggtgacgctggtgcccaatgactactttgccatcaactcatcggccgaagccttcgcgcgcctgaacatgccggtgcgggatctgccggaattgtgccgcctggtggggctcgacgtcagccaccgtcccggcggggcgatatcgctggctgtgggcatggcccacatcttttcccgtgtcggtgtggggttgcagcacacgatgaaatactggtttcagttcatcatcatgttcgaggcgctcttcatcctgactaccatcgacgcgggaaccagggtggcgcgctacctcctgcaggatatcctggcaaacgtccaccaaaagctgggacagaccgattgggtgccgggcatcgtcctgaccagcgccgccgtctcctctgcctggggatacatgctctacaccggggatgtttcctccatctggcccatgttcggcgttaccaaccaggcactggcatgtctggctctggccattgggacaaccatcctcctgcgcatcgccaggaaaaaacgctatgccctggttacggcgctgccttgcgccttcatggccgtgaccagctttgccgcgggtttcatgaacatcaggctctacctctccagggggatggtgctcaacgccgctctcagtatggttatcattgctctggtcgcggttatcatcgtggaaaacatccgggtctggctggccctgttcgggaacgagcgtgccatgggtatgaacgacgggcgggacgaaatctttcctctggcggttccggtccgcgtttccaacgacgcgacgcgggagtga

SEQ ID NO: 36705 - protein, 614 aa, Pelobacter propionicus DSM 2379
MSVIWLLLSALCVLVLAYRYYAAFIAARVLMLDDRNVTPSVTRNDGKDFVPTNKWVVFGHHFAAIAGAGPMIGPTLAAQYGWGPGFFWILLGSVFAGCVHDMILLFASIRHQGESLSVIARRDVSRLTGVTTAFVTLFIIIVALAGLAVAVTNALYNNPWGVFTIGMTIPIAMITGLYMFKLRPGAILSGSLAGVTAVVAAVYFGAPVAQSSIAGWFTFSKESLAIILPLYGFCAAALPVWLLLAPRDYLSTYMKISVIGGLALGLFFVNPSVQMPFATRFIAGGGPIIPGPVWPYVFITIACGAISGFHALIGSGTTPKMLEKESQIPLVGYGAMLTEAFVGLMALLAAVTLVPNDYFAINSSAEAFARLNMPVRDLPELCRLVGLDVSHRPGGAISLAVGMAHIFSRVGVGLQHTMKYWFQFIIMFEALFILTTIDAGTRVARYLLQDILANVHQKLGQTDWVPGIVLTSAAVSSAWGYMLYTGDVSSIWPMFGVTNQALACLALAIGTTILLRIARKKRYALVTALPCAFMAVTSFAAGFMNIRLYLSRGMVLNAALSMVIIALVAVIIVENIRVWLALFGNERAMGMNDGRDEIFPLAVPVRVSNDATRE

SEQ ID NO: 36706 - DNA, 2079 bp, Burkholderia ambifaria AMMD
  CDS (1)..(2079): transl_table=11
atgaatcgggcttccagtaccctgctctggatcgcggtcgcgctgctcggcgcgttcgcattcgggacgatcgcacttgggcacggcgaacgtgtcagcgcgctatggatcgtgatcgccgcagtctgcgtgtatctgatcgcatatcgcttctacagccgcttcatcgccagcaaggtcatgcagctcgacgggctgcggatgaccccggcggtcaagtacaacgacggcctcgactacgtaccgaccaacaagtacgtgctgttcggccatcacttcgccgcgatcgccggcgccgggccgctcgtcggccccgtgctcgccgcgcagatgggctacacgcccggcatgctgtggatcctggccggcgtcgtgttcgccggcgcggtgcaggacttcatcgtgctgttcatctcgacgcgccgcgacggccgctcgctcggcgacctcgtcaagatggagctcggcacggtgcccggcgtgatcgcgctgttcggcgcgttcctgatcatggtgatcatcctcgcggtgctcgcgctgatcgtcgtgaaggcgctgacgaattcgccgtggggcacgttcacggtcgccgcgacgattccgatcgcgctgttcatgggcatctacacgcgctacatccgtccgggccgcatcggcgaagtgtcgatcatcggcttcgtgctgttgatggcatcgatcgcgttcggccaacacgtgcacgattcggcgacgctcgccgcgtggttcacgttcaacggcacgcagctcacgtggatcctgatcggctacggcttcgtcgcatcggtgctgccggtgtggctgctgctcgcgccgcgcgactacctgtcgacgttcctgaagatcggcacgatcctcggcctcgcgatcggcatcctggtcgtcgcaccggaactgaagatgcccgcgctgacgaagttcgtcgacggcacgggcccggtgtggtcgggcaacctgttcccgttcctgttcatcacgatcgcgtgcggcgcggtgtcgggtttccacgcgctgatctcgtcgggcacgacgccgaagctgatcgacaacgaatccaacgcgcgcttcatcggttacggtgcgatgctgatggaatcgttcgtcgcgatcatggcgctcgtcgccgcgtgcgtgatcgagccgggcatctacttcgcgatgaacgcgccggcggccgtgctcggctcgacgccggaagccgtcgcgaacacggtcacgcaatggggcttcgtgctgacgcccgacatgctgacgcagaccgcgaaggccgtcggcgagacgacgatcatcgcgcgcgcgggcggcgcaccgacgctggccgtcggcatggcgcacatcctgcaccaggtgatcggcggcgaagcgatgatggcgttctggtatcacttcgcgatcctgttcgaggcgctgttcatcctgacggccgtcgacgccggcacgcgcgcgggccgcttcatgctgcaggacctgctcggcacgttccatccggcgctcaagcgcaccgagtcgctgcccgcgaacctggtggccaccgcgctgtgcgtggccgcgtggggctacttcctgtaccagggcgtggtcgatccgctcggcggcatcaacacgctgtggccgctgttcggcatctcgaaccagatgctcgccgcgatcgcgctggtgctcggcaccgtcgtgctgttcaagatgaagcgcgagcgctacgcgtgggtgacgatcgtgccgaccgcgtggctgctgatctgcacgctgacggccggctggcagaagattttcgattcgaatccgaaggtcagcttcctcgcgcacgccgcgaagctgcaggccgcggtggacgaaggcaaggtgctcgcgccggcgaagtcgatcgcgcagatgcagcggatcatcttcaacgactacatcgatgcggcgctggccggcctgttcatcttcgtcgtcgtggcgatcgcggtgtacggcctgctcgccgtgctgcgcgcgcgccgcgagtcgaagccgaccgtgcgcgagacgccgtacgaggcgatgccggccgcgcaggcgctcggcagcggccgataa

SEQ ID NO: 36707 - protein, 692 aa, Burkholderia ambifaria AMMD
MNRASSTLLWIAVALLGAFAFGTIALGHGERVSALWIVIAAVCVYLIAYRFYSRFIASKVMQLDGLRMTPAVKYNDGLDYVPTNKYVLFGHHFAAIAGAGPLVGPVLAAQMGYTPGMLWILAGVVFAGAVQDFIVLFISTRRDGRSLGDLVKMELGTVPGVIALFGAFLIMVIILAVLALIVVKALTNSPWGTFTVAATIPIALFMGIYTRYIRPGRIGEVSIIGFVLLMASIAFGQHVHDSATLAAWFTFNGTQLTWILIGYGFVASVLPVWLLLAPRDYLSTFLKIGTILGLAIGILVVAPELKMPALTKFVDGTGPVWSGNLFPFLFITIACGAVSGFHALISSGTTPKLIDNESNARFIGYGAMLMESFVAIMALVAACVIEPGIYFAMNAPAAVLGSTPEAVANTVTQWGFVLTPDMLTQTAKAVGETTIIARAGGAPTLAVGMAHILHQVIGGEAMMAFWYHFAILFEALFILTAVDAGTRAGRFMLQDLLGTFHPALKRTESLPANLVATALCVAAWGYFLYQGVVDPLGGINTLWPLFGISNQMLAAIALVLGTVVLFKMKRERYAWVTIVPTAWLLICTLTAGWQKIFDSNPKVSFLAHAAKLQAAVDEGKVLAPAKSIAQMQRIIFNDYIDAALAGLFIFVVVAIAVYGLLAVLRARRESKPTVRETPYEAMPAAQALGSGR

SEQ ID NO: 36708 - DNA, 2061 bp, Rhodoferax ferrireducens DSM 15236
  CDS (1)..(2061): transl_table=11
atgaatctcgtttccaaacatgccatttggttgtttttgacggtggtcggggtattttcccttggcaccgtggcgttgtcccggggcgaaaccatcaacgccttgtggatcattacggctgcagttgctatctacctggtcgcgtaccggtactacagcctgtttatcgccgaaaaggtcttgcaaattgatccgacgcgggcgacgccagcggtgcgccacaacgacggtcttgatttcgttccaaccaacaagtacgtcctgttcggccatcactttgccgccattgccggtgcgggccccctggtcgggccggtgctggcagcgcagatgggctacctgccgggaacgctctggatcatcgtcggtgtcgtgcttgcgggcgcggtgcaggacttcatggtgctgtttgtatcaatgcgtcgggacggacgctcacttggcgacctcgtcaagtcggaactcggtctcgttccgggcatgattgctctggtcggcacttttgtgatcatggtgatcatcctcgcggtgctggcactgattgtggtcaaggcgctggccgcaagcccatggggaaccttcaccgtggccgctacgattgtcattgccatgttcatgggcgtctacagccgttatatccgccccggacgtgtgggcgaaatatcgatcatcggctttgtgttgcttatcgcctccatcatccttggtggccaggtcgcgcaaagcgcgacgtgggcgccgctgttcactttcgacgccaaacagctgagttggatgctgatcatctacggttttgtggcctcggtcctgcccgtgtggctgctgctcgcgccgcgtgactatctgtcgaccttcctgaagatcggaaccatcgtcggcttggcgctggccatggtctttgtcgcaccgaatttgcgcatgccagcggtcacccagtttatcgatggcaccggtccggcttggtcgggtagcctctttccgttcatttttatcacgattgcctgcggcgcggtctcgggattccatgcgttgatcgcgtccggaaccacccccaagctgctcgacaacgagaagaatacccgcatgatcggttatggcgccatgttgatggagtcctttgtggccatcatggcgatcgtgacagcctcggtgatcgatccgggcgtctatttcgccatgaacagcccggccgcaatcattggcacgagtgtcgacggcgccgcacagatcatttcccagtggggttttatcatcacgcctgacgtgctgcttcaaaccgcaaaggatgtgggtgagagttccattctttcgcgtgcgggcggtgcgcccacgctggcagttggcatggcccaaatattctctcaggtgattggcggcaaggccatgatggccttctggtaccacttcgccatcctgttcgaggcgctattcatcctgaccgcctgtgacgccggtacgcgtgccggacgcttcatgctgcaggacctgctgggcaccttcgttccctccttgaagcggaccaactcctggggcgccagcctgaccgccaccggtctgtgcgtcgcggcctggggatatattctttaccagggtgtagtcgatcctcttgggggcatcaacagcctgtggccgctcttcggcatttccaaccagatgctcgctagcgttgcgctcatgctttgcacggtggtgctgttcaaaatgaagcggcaaaaatacgcatgggtcacgattttgccaacatcctggctgctgatttgcaccctggcggcgggctgggaaaaggtttttgacagcaatccaaaaattggtttcctcgcccttgccaacaagttccaggcggctgtggacaaaggcgttcttctcgctccggcaaaaagccttgaacagatgaagcagattgttttcaataattatttggacgccgcactggccgtcttcttcatcttcgtggtggttagcatgttgtactacacggtcatcgcctgcatgaaggctttgcgtgaggacaagatgaccagttgtgaactgccgtacgtggccatacctgccgcgctttga

SEQ ID NO: 36709 - protein, 686 aa, Rhodoferax ferrireducens DSM 15236
MNLVSKHAIWLFLTVVGVFSLGTVALSRGETINALWIITAAVAIYLVAYRYYSLFIAEKVLQIDPTRATPAVRHNDGLDFVPTNKYVLFGHHFAAIAGAGPLVGPVLAAQMGYLPGTLWIIVGVVLAGAVQDFMVLFVSMRRDGRSLGDLVKSELGLVPGMIALVGTFVIMVIILAVLALIVVKALAASPWGTFTVAATIVIAMFMGVYSRYIRPGRVGEISIIGFVLLIASIILGGQVAQSATWAPLFTFDAKQLSWMLIIYGFVASVLPVWLLLAPRDYLSTFLKIGTIVGLALAMVFVAPNLRMPAVTQFIDGTGPAWSGSLFPFIFITIACGAVSGFHALIASGTTPKLLDNEKNTRMIGYGAMLMESFVAIMAIVTASVIDPGVYFAMNSPAAIIGTSVDGAAQIISQWGFIITPDVLLQTAKDVGESSILSRAGGAPTLAVGMAQIFSQVIGGKAMMAFWYHFAILFEALFILTACDAGTRAGRFMLQDLLGTFVPSLKRTNSWGASLTATGLCVAAWGYILYQGVVDPLGGINSLWPLFGISNQMLASVALMLCTVVLFKMKRQKYAWVTILPTSWLLICTLAAGWEKVFDSNPKIGFLALANKFQAAVDKGVLLAPAKSLEQMKQIVFNNYLDAALAVFFIFVVVSMLYYTVIACMKALREDKMTSCELPYVAIPAAL

SEQ ID NO: 36710 - DNA, 1521 bp, Actinobacillus succinogenes 130Z
  CDS (1)..(1521)
atgttgtggttttttatctgcgtgacgattttacttctgggttatttcctttacagtaaagttgtcgaaaaaatttttgtgattaatccggcacgtaaaacacccgcctattctatgggcgacggtgtggactatgtgccgatgtcaaaaaataaaatctggctgattcagttattgaatattgctggtacggggccgattttcggtccgattttgggtgcgttatacgggccttccgctatgctttggattgtcttcggttgcgtatttggcggtgcggtacacgattatttcagcggtatgctgagtattcgcaacggcggtgccaatattcctttcttggcggggaaatatctcgggcgcccggcaaaacattttatgaatttcattgcgattttactgcttttgttggttggagtggtattcgtggcgagcccggcctcgctgttaaccaatatcaccggtgatatcatgaattccggcggtgtcggtgcggcggcggtaagtgatgcgagcggcgtaagcaataccaatactctgatgatgtggacgggaattatcttcgtttattacatcattgccacattggtgccgatcgataaaattatcggtcgggtttacccgattttcggcgctttattgatgtttatgacattgggtatgttattcggtttattattcgaaggtattccgttcttccgtaccattacggcggaactgggccatgaggttactttggcggatttccttgccaacttacatccgaaagaggggacgccgctttggccgttattattcgtcaccattgcctgcggtgcggtttcaggtttccatgcgacccaatctccgttaatggcacgttgtacgcaaaacgaaaaagaaggtcgtttcattttctatggcgcaatgatcggtgaaggtataatcgcgttaatttggtgtatggtgggtctaagtttctacgatgatcaggcttcattgcttgaggctttaaaaggtacaccgtctaaagtggtctatgattcggccataggtatgcttggcgtattcggcggtatcttggcggtattaggtgtggtggtattgccgattacctccggcgataccgcgtttcgtgcggcacgtttgttaattgcggattttttcaaatttgagcaacgttcgttaataaaacgtttggtcattgcgattccgttatttattatcggtttctgggtatccaccgtggacttccaagtgttatggcgttatttcggctgggctaaccaaacgacggcgatggtgatgttatggaccgcatccgcttacttgttccgtcatcaaaaattccattggattacgacgattccggccatctttatgactttggtttgtgcaacctatattgccaatgctcaaatcggtttcggtttgtcttatgacgtatccgtttgggtcggtatcgcagccactattgttgcgttgatttctttctttgtattcttaaaaccgattcctaaagatcaacaggaaaacgattaa

SEQ ID NO: 36711 - protein, 506 aa, Actinobacillus succinogenes 130Z
MLWFFICVTILLLGYFLYSKVVEKIFVINPARKTPAYSMGDGVDYVPMSKNKIWLIQLLNIAGTGPIFGPILGALYGPSAMLWIVFGCVFGGAVHDYFSGMLSIRNGGANIPFLAGKYLGRPAKHFMNFIAILLLLLVGVVFVASPASLLTNITGDIMNSGGVGAAAVSDASGVSNTNTLMMWTGIIFVYYIIATLVPIDKIIGRVYPIFGALLMFMTLGMLFGLLFEGIPFFRTITAELGHEVTLADFLANLHPKEGTPLWPLLFVTIACGAVSGFHATQSPLMARCTQNEKEGRFIFYGAMIGEGIIALIWCMVGLSFYDDQASLLEALKGTPSKVVYDSAIGMLGVFGGILAVLGVVVLPITSGDTAFRAARLLIADFFKFEQRSLIKRLVIAIPLFIIGFWVSTVDFQVLWRYFGWANQTTAMVMLWTASAYLFRHQKFHWITTIPAIFMTLVCATYIANAQIGFGLSYDVSVWVGIAATIVALISFFVFLKPIPKDQQEND

SEQ ID NO: 36712 - DNA, 1749 bp, Escherichia coli
  CDS (1)..(1749): transl_table=11
atgccaggttttactatggatacgaaaaaactattcaagcacataccctgggtgattctcggaatcatcggtgcattctgcctcgcggtagttgcattacgtcggggggagcacgtcagcgccctgtggatcgtggtcgcctctgtgtcggtgtatctggtggcgtatcgctactacagtttgtatatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggttggtccggttctcgccgcgcagatgggcatcctacctggcacgctgtggctgctggcgggggtagtactggccggtgcggttcaggactttatggtgctgtttatctcctctcgccgtaacggaccatctctcggtgagatgatcaaagaagagatgggaccactaccggggactatcgcgctgtttggctgtttcttaatcatgatcatcatcctcgccgtcctggcgctgattgtggttaaagccctggccgaaagtccgtggggtgtcttcaccgtttgctcaaccgtaccgattgcgctgtttatgggtatctacatgcgctttatccgtccggggcgtgtgggtgaagtctctgtcattggtatcgtgctgctggttgcctctatctacttcggtggcgtgattgctcacgatccgtactggggtccggcactgacctttaaagacaccaccattaccttcgcgctgattggctatgcgtttgtttccgcactgctgccggtgtggctgatcctcgcaccgcgcgactatctggcaaccttcctgaaaatcggcgttatcgtcggcctggcgctgggtatcgtggtgctgaacccggaactgaaaatgcctgcgatgacccagtacattgacggtactggcccgctgtggaaaggcgctctgttcccgttcctgttcatcaccatcgcctgtggtgcggtatctggcttccacgcgctgatctcttccggtacgacgccaaaactgctggctaacgaaaccgacgcgcgtttcattggctacggcgcaatgctgatggagtccttcgtggcgattatggcgctggttgcagcgtccatcatcgaaccgggtctttacttcgcgatgaataccccgcctgctggccttggcatcaccatgcctaacctgcatgaaatgggtggcgagaacgcgccgatcatcatggcgcagctgaaagacgttaccgcacacgcgcagaccgtcacctcctggggcttcgtgatttcgccagagcagatcctgcaaaccgcgaaagacattggtgagccttctgtcctgaaccgtgcaggtggtgcgccaacgctggcggtaggtatcgctcacgtgttccacaaagtgctgccagtggctgacatgggcttctggtatcacttcggtattctgttcgaagccctgttcatcctgaccgcgctggatgcgggtactcgttctgcccgctttatgctgcaagacctgctgggtaacttcatcccgttcctgaaaaaaaccgactctctggttgccggtatcatcggtactgcgggctgtgtgggtctgtggggctacctgctgtatcagggcgtggtcgatccgctgggcgcgttaagagcctgtggccgctgttcggtatttccaaccagatgctggcagccgtag

SEQ ID NO: 36713 - protein, 582 aa, Escherichia coli
MPGFTMDTKKLFKHIPWVILGIIGAFCLAVVALRRGEHVSALWIVVASVSVYLVAYRYYSLYIAQKVMKLDPTRATPAVINNDGLNYVPTNRYVLFGHHFAAIAGAGPLVGPVLAAQMGILPGTLWLLAGVVLAGAVQDFMVLFISSRRNGPSLGEMIKEEMGPLPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAQTVTSWGFVISPEQILQTAKDIGEPSVLNRAGGAPTLAVGIAHVFHKVLPVADMGFWYHFGILFEALFILTALDAGTRSARFMLQDLLGNFIPFLKKTDSLVAGIIGTAGCVGLWGYLLYQGVVDPLGALRACGRCSVFPTRCWQP

SEQ ID NO: 36714 - DNA, 2214 bp, Erwinia amylovora
  CDS (1)..(2214): transl_table=11
atgcctgctatcagcatgcattgctcgcttgactttttcctgcataaaaccgggttcactatgcataaaaataaaattcttaaacatattccctggatgatcgtcgggatcatcgctgcctgctgcctggccgtggttgccctgcggcgtggtgagcatatcagtgcgctgtggatcgttgtggcatccgtctcggtctatctggtggcatatcgctactacagcctgtttatcgcgcaaagggtcatgaaactggatgcgagccgtgccacgcctgccgtggtcaacaacgacgggctgaactacgtacccacgcaccgcaacgtattgtttggtcaccactttgcggcgattgccggggcggggccgctggttggcccggtactggcggcacagatgggttacctgcccggcgtactgtggctgctggctggcgtggtgctggccggggcagtacaggattttatggtgctgtttatctcttctcgccgcaatggcgcatcgctcggcgagataatcaaaaatgagatgggcgccatacccggtagtgtcgcgctgttcggctgcttcctgatcatgattattatcctcgcggtgctggcgctgattgtcgtgaaggcgttggcggaaagtccgtggggcgtatttaccgtgtgctcaacgctgccgatagccctgtttatgggcatttatatgcgctttatccgccccggacgcgtgggcgaaattgcactgattggcgtgttactgctgatcgccagcatctggtttggcggcgtgattgcgcaagatgcttactggggaccggcgctgacctttaaagacaccacgattaccttcaccctgatcggctacgcgtttgtttctgcactgctgccggtgtggttaatcctcgccccgcgtgactatctggcgactttcctgaaaattggcgttatcgtcggcctggcggtcggcatcatcatcctgaatccgcagctgaagatgccagcgctgactccttttatcgatgggtcagggccgctatggaaaggcgcgctgttcccgttcctgtttatcactatcgcctgcggcgcggtctccggtttccacgccctgattgcctccggcaccacgccgaagctgctggcttgtgaaagcgatgcgcgctttatcggctacggtgccatgctgatggaatccttcgtcgcggtaatggcgctggtggccgcttcgattatcgagccagggctttactttgccatgaacacgcctcccgccgggttgggaattaccatgccgaacctgcaccagttgggtggggctggtgcaccgctgattatggcgcagctccagcaggtcaccgcccaggctgcggcgaccgtcagttcctggggctttgtcatcagtcctgaacagatcatgcaaaccgctaaagacatcggggagccttcggtgcttaaccgtgccgggggagcaccaacgctggcggtcggcattgcttacgtttttgacaaaatgatgccgatcgccgatatggggttctggtatcacttcggcattttgtttgaagccctgtttatccttaccgcgctggatgccggtacgcgctccggccgctttatgctgcaggatctgctgggtcattttctgccgttcctgaaaaaaaccgactcgctgctggcgggcgtcgtcagcacggctggctgcgtggggctttggggttacctgttgtatcagggcgtggtcgatccgctgggcggtgtgaaaagcctgtggccactgttcggcatttcgaaccagatgctggccgccgtggcgctggtgctggctaccgtcgtgctgattaaaatgaagcgcatgcgttacatttgggtaaccgtgatccctgccgtctggctacttatctgcaccacctgggcgctggggctgaagctgttcagccagaatccacagatggaaggcttcttctacatggcgggcgagtaccgggcaaaagtggccgctggcggcgcaaatcatagcgcccgcgagattgccgatatgcatcatatcgtggttaacaactacaccaatgccgggctgagtattctgtttctggtcgtggtgtacagcattctcttttacggcatcaaagcctggctgcgcgcacgccagattgaccagcggacagatactgaaacagcctgtgtcgcggtgcccgaagaaggggtagaactctcttctggccactga

SEQ ID NO: 36715 - protein, 737 aa, Erwinia amylovora
MPAISMHCSLDFFLHKTGFTMHKNKILKHIPWMIVGIIAACCLAVVALRRGEHISALWIVVASVSVYLVAYRYYSLFIAQRVMKLDASRATPAVVNNDGLNYVPTHRNVLFGHHFAAIAGAGPLVGPVLAAQMGYLPGVLWLLAGVVLAGAVQDFMVLFISSRRNGASLGEIIKNEMGAIPGSVALFGCFLIMIIILAVLALIVVKALAESPWGVFTVCSTLPIALFMGIYMRFIRPGRVGEIALIGVLLLIASIWFGGVIAQDAYWGPALTFKDTTITFTLIGYAFVSALLPVWLILAPRDYLATFLKIGVIVGLAVGIIILNPQLKMPALTPFIDGSGPLWKGALFPFLFITIACGAVSGFHALIASGTTPKLLACESDARFIGYGAMLMESFVAVMALVAASIIEPGLYFAMNTPPAGLGITMPNLHQLGGAGAPLIMAQLQQVTAQAAATVSSWGFVISPEQIMQTAKDIGEPSVLNRAGGAPTLAVGIAYVFDKMMPIADMGFWYHFGILFEALFILTALDAGTRSGRFMLQDLLGHFLPFLKKTDSLLAGVVSTAGCVGLWGYLLYQGVVDPLGGVKSLWPLFGISNQMLAAVALVLATVVLIKMKRMRYIWVTVIPAVWLLICTTWALGLKLFSQNPQMEGFFYMAGEYRAKVAAGGANHSAREIADMHHIVVNNYTNAGLSILFLVVVYSILFYGIKAWLRARQIDQRTDTETACVAVPEEGVELSSGH

SEQ ID NO: 36716 - DNA, 2166 bp, Escherichia coli
  CDS (1)..(2166): transl_table=11
atgccaggttttactatggatacgaaaaaactattcaagcacataccctgggtgattctcggaatcatcggtgcattctgcctcgcggtagttgcattacgtcggggggagcacgtcagcgccctgtggatcgtggtcgcctctgtgtcggtgtatctggtggcgtatcgctactacagtctgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggtcggtccggttctcgccgcacagatgggctacctgcctggcacgctgtggctgctggcgggggtagtactggccggtgcggttcaggactttatggtgctgtttatctcctctcgccgtaacggcgcatctctcggtgagatgatcaaagaagagatgggaccagtaccggggactatcgcgctgtttggctgtttcttaatcatgatcatcatcctcgccgttctggcgctgattgtggttaaagccctggccgaaagtccgtggggtgtcttcaccgtttgctcaaccgtaccgattgcgctgtttatgggtatctacatgcgctttatccgtccggggcgtgtgggtgaagtctctgtcattggtatcgtgctgctggttgcctctatctacttcggtggcgtgattgctcacgatccgtactggggtccggcactgacctttaaagacaccaccattaccttcgcgctgattggctatgcgtttgtttccgcattgctgccggtgtggctgatcctcgcaccgcgcgactatctggcaaccttcctgaaaatcggcgttatcgtcggcctggcgctgggtatcgtggtgctgaacccggaactgaaaatgcctgcgatgacccagtacattgacggtactggcccgctgtggaaaggcgctctgttcccgttcctgttcatcaccatcgcctgtggtgcggtatctggcttccacgcgctgatctcttccggtacgacgccgaaactgctggctaacgaaaccgacgcgcgtttcattggctacggcgcaatgctgatggaatccttcgtggcgattatggcgctggttgctgcgtccatcatcgaaccgggtctttacttcgcgatgaacaccccgcctgcgggccttggcatcaccatgcctaacctgcatgaaatgggtggcgagaacgcgccgatcatcatggcgcagctgaaagacgttaccgcacacgcggcggcgaccgtcagctcctggggctttgtgatttcgccagagcagatcctgcaaaccgcgaaagacattggtgagccttctgtcctgaaccgtgcaggtggtgcgccgacgctggcggtaggtatcgctcatgtgttccacaaagtgctgccgatggctgacatgggcttctggtatcacttcggtattctgttcgaagcactgttcatcctgaccgcgctggatgcgggtacccgttctggccgctttatgctgcaagatctgctgggtaacttcatcccgttcctgaaaaaaaccgactctctggttgccggtatcatcggtactgcgggctgtgtgggtctgtggggctacctgctgtatcagggcgtggtcgatccgctgggcggcgttaagagcctgtggccgctgttcggtatctccaaccagatgctggcagccgtagcgctggtactgggcaccgttgtgctaattaagatgaagcgcacccaatacatctgggtaactgttgttccggctgtatggctgcttatctgcaccacctgggcgctgggcctgaaactattcagcaccaacccgcagatggaaggcttcttctacatggcaagccagtacaaagagaagattgctaacggtactgacctgacggcgcagcagattgccaacatgaaccacatcgttgtgaacaactacaccaacgcaggtctgagtattctgttcctgattgtggtgtacagcatcatcttctacggtttcaaaacctggcttgcggtgcgtaacagcgacaaacgtactgacaaagaaacaccatacgttccaatcccggaaggcggcgtgaagatcttttcgcaccactaa

SEQ ID NO: 36717 - protein, 721 aa, Escherichia coli
MPGFTMDTKKLFKHIPWVILGIIGAFCLAVVALRRGEHVSALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGPVPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFIPFLKKTDSLVAGIIGTAGCVGLWGYLLYQGVVDPLGGVKSLWPLFGISNQMLAAVALVLGTVVLIKMKRTQYIWVTVVPAVWLLICTTWALGLKLFSTNPQMEGFFYMASQYKEKIANGTDLTAQQIANMNHIVVNNYTNAGLSILFLIVVYSIIFYGFKTWLAVRNSDKRTDKETPYVPIPEGGVKIFSHH

SEQ ID NO: 36718 - DNA, 2205 bp, Corynebacterium glutamicum
  CDS (1)..(2205): transl_table=11
gtgaagaagtcccctaaaatgtcaccgaccgcccgcgttggtctccttgtctttggggttatcgcggcggtgggttggggagcaatcgctttctcccgtggcgaaacaatcaactctgtgtggctggttttggcggcagttggttcctatatcattgcgttttctttctatgcccgactgattgaatacaaagttgttaagccgaaagatcagcgagcaaccccggcggaatacgttaatgacggcaaggactatgtcccaacggatcgtcgtgtgctttttggccaccactttgcagctattgcaggtgccggtccattggttggacctgtcatggccgcgcagatgggctacctgccaggcaccttgtggattatcctcggtgtgattttcgccggtgcagtgcaggactacctagtgctgtgggtgtctactcgtaggcgtggacgctcacttggccagatggttcgtgatgaaatgggcacggtcggtggagctgccggtatcttggcgaccatctccatcatgatcatcattatcgcggtgctcgcattgatcgtggttaatgcactggctgattcaccatggggcgttttctccatcaccatgaccatcccaattgcactgttcatgggtgtgtacttgcgttacctgcgcccaggtcgtgttactgaagtgtccatcatcggtgtggcactgctcctgctggctatcgttgctggtggttgggttgcagacacctcatggggcgtggaatggttcacctggtctaagaccactttggcgttggccttgatcggttacggaatcatggctgcgattttgccggtgtggctgctgcttgcaccgcgcgattacctgtctacctttatgaagatcggcgtcatcggtctgttggcagtgggtattttgttcgcacgtcctgaggtgcagatgccttccgtgacctccttcgcacttgagggcaacggtccggtgttctctggaagtctgttcccattcctgttcatcacgattgcctgtggtgcactgtctggtttccacgcactgatttcttcaggaaccacaccaaagcttgtggagaaggaatcccagatgcgcatgctcggctacggcggcatgttgatggaatctttcgtggcgatgatggcactgatcaccgctgttattctggatcgtcacctgtacttctccatgaacgctccgctggcactgactggtggagatccagcaaccgcagctgagtgggttaactccattgggctgacaggtgcggatatcaccccggaacagctgtcggaagctgctgaaagtgtcggagaatccactgttatttcccgtaccggtggcgcaccaaccttggcgttcggtatgtctgaaatcctctccggattcatcggcggcgctggaatgaaggcgttctggtaccacttcgccatcatgtttgaggctctgttcatcctcactactgtggatgcaggtactcgtgtggctcgctttatgatgaccgataccttgggcaatgttccaggtctgcgccgtttcaaggatccttcatggactgtcggtaactggatttctaccgtgtttgtgtgtgctctatggggtgctattttgctcatgggtgttaccgatccactgggcggcatcaacgtgcttttcccactattcggtatcgctaaccagctgctcgccgctattgcacttgctctcgtgctggttgttgtggtgaagaagggcctgtacaagtgggcgtggattccagctgttcctttggcatgggatctcattgtcacgatgactgcgtcatggcagaagattttccactctgatccggctattggctactgggctcagaacgcgaacttccgcgatgcaaagtctcaaggccttaccgaatttggtgccgctaaatctcctgaggcaatcgatgcggttatccgaaacaccatgattcagggcatcttgtccatcctgttcgcggtgctcgtcctcgttgttgtcggcgcagccattgcggtgtgcatcaagtccatcagggctcgtgcagccggaacacctttggagaccactgaagagcctgatactgaatctgagttcttcgccccaactggattccttgcatcttccagggataaggaagtccaggccatgtgggacgagcgctacccaggcggtgcgcccgtgtcttctggagggcactaa

SEQ ID NO: 36719 - protein, 734 aa, Corynebacterium glutamicum
MKKSPKMSPTARVGLLVFGVIAAVGWGAIAFSRGETINSVWLVLAAVGSYIIAFSFYARLIEYKVVKPKDQRATPAEYVNDGKDYVPTDRRVLFGHHFAAIAGAGPLVGPVMAAQMGYLPGTLWIILGVIFAGAVQDYLVLWVSTRRRGRSLGQMVRDEMGTVGGAAGILATISIMIIIIAVLALIVVNALADSPWGVFSITMTIPIALFMGVYLRYLRPGRVTEVSIIGVALLLLAIVAGGWVADTSWGVEWFTWSKTTLALALIGYGIMAAILPVWLLLAPRDYLSTFMKIGVIGLLAVGILFARPEVQMPSVTSFALEGNGPVFSGSLFPFLFITIACGALSGFHALISSGTTPKLVEKESQMRMLGYGGMLMESFVAMMALITAVILDRHLYFSMNAPLALTGGDPATAAEWVNSIGLTGADITPEQLSEAAESVGESTVISRTGGAPTLAFGMSEILSGFIGGAGMKAFWYHFAIMFEALFILTTVDAGTRVARFMMTDTLGNVPGLRRFKDPSWTVGNWISTVFVCALWGAILLMGVTDPLGGINVLFPLFGIANQLLAAIALALVLVVVVKKGLYKWAWIPAVPLAWDLIVTMTASWQKIFHSDPAIGYWAQNANFRDAKSQGLTEFGAAKSPEAIDAVIRNTMIQGILSILFAVLVLVVVGAAIAVCIKSIRARAAGTPLETTEEPDTESEFFAPTGFLASSRDKEVQAMWDERYPGGAPVSSGGH

SEQ ID NO: 36720 - DNA, 2304 bp, Pseudomonas putida
  CDS (1)..(2304): n means a or g or c or t/u, s means g or c
atgaacaacaataatagcctgctacgccatattccgtggctggcgctggcagtcataggcgcctgcgcactgggtgtggttgccctgcgtcgcggcgaggcgatcaacgccttgtggatcgtggtcgcggcagtggccatctacctggtcgcctatcgttactacagcctgttcatcgccwccaaggtgatgcamctcgacccgcgccgtgccaccccggcggtgctcaacarcgacggcctggactacgtcccgaccaacaaacacattcttttcggtcaccacttcgctgccatcgccggcgcaggccccttggtcgggccggtactcgccgcgcaaatgggctacctgcccggcacgctctggctgatcgccggcgtggtgctggccggtgcggtgcaggacttcatggtcctgttcctgtctacccgccgcaacgggcgctcgctgggcgacatggtgcgcgaggaaatgggcagaatcccgggcaccatcgccctgttcggctgtttcctgatcatgatcatcatcctcgcggtgctggcgttgatcgtggtcaaggccctggccgaaagcccatggggcatgttcacggtgatggcgaccatcccgatcgcgatgttcatgggcatctacatgcgctacatccgtccgggccgtattggcgaaatctcggtcgttggtgtggtactgctgctggcctcgatctggctgggcggcgtgatcgctgcggacccggtgtggggcccggcgttcacgttcaccggcgtgcagatcacctggatgctggtgggctacggttttgtcgccgccgtgctgccagtgtggctggtgctggcgccgcgtgactacctgtcgaccttcctcaagatcggcacgatccttggcctggccatcggtatcctgatcatcgcacctgagctgaaaatgccggcgctgacccagttcaccgacggtacgggcccggtgtggaagggtaccctgttcccgttcctgttcatcaccattgcctgtggtgcggtgtccggcttccacgcgctgatttcctcggggaccacccccaagctgctggataacgaaaccaacgcccgctatatcggctacggcggcatgctgatggaatcgttcgtcgccatcatggccatggttgcggcctcggtgatcgaaccgggcgtgtacttcgccatgaacagcccggcggcagtggtcggtaccgatgtcgcgtcggtggcgcagactgtcagcagttggggcttcctgattacacccgagcagctcgaagccgttgcccgtgacatcggcgagcacaccatcctggcccgtgccggcggtgcgccaaccctggcggtcggtatcgcgcagatcctgcaccaggtgttgccaggtgaaaacaccatggccttctggtaccacttcgcgatcctgttcgaggcgctgttcattctcacggcggtagacgctggtacccgtgccgggcgcttcatgctgcaggacctgctgggcagcttcgtgcctgcgctcaaacgcaccgaatcgtggggggcaaacctgcttgccactgctggctgcgtggcgctctggggctatctgctgtaccagggcgtcatcgacccgctgggtggcatcaacaccctgtggccgctgtttggtatctccaaccagatgctggccggtatcgccttgatgctcggtactgtggtgctgatcaagatgaaggctcagcgctacatctgggtcaccctgctgccggccgtatggctgctgatctgcaccacggctgcaggcctgatcaagctgttcgaccccaacccggctgtcggcttcctggccttggccaagaagtacagcactgcgctggacgccggccaggtactggccccggccaaggacatcgggcagatgcagcacgtggatcttcacgcctacaccaacgcgggcctgacgatcttgttcctgctggtggtcttcagcatcctgttcttcgccatcaaggtcggctacgccgccttgggccgcaaagaacgcagcgacaaggaaaccccgttccaggcgttgcctgacgacgtaatcgagaggactgcaatcatatccgttcaacgacttgggtcgactgggcaaatacctggggcaggcagcccgcctgatggtcggcatgcccgactacgacaactatgtcgaacacatgcagaaaacgcatccggacaagccggtgatgagctacgaggcattcttccgcgaacgtcaggaagcacgttacggtggcaagtccgggcccaagtgctgttgagcctgcggttcgtgtaa

SEQ ID NO: 36721 - protein, 767 aa, Pseudomonas putida
  Xaa in positions 61, 65 and 78 is unknown
MNNNNSLLRHIPWLALAVIGACALGVVALRRGEAINALWIVVAAVAIYLVAYRYYSLFIAXKVMXLDPRRATPAVLNXDGLDYVPTNKHILFGHHFAAIAGAGPLVGPVLAAQMGYLPGTLWLIAGVVLAGAVQDFMVLFLSTRRNGRSLGDMVREEMGRIPGTIALFGCFLIMIIILAVLALIVVKALAESPWGMFTVMATIPIAMFMGIYMRYIRPGRIGEISVVGVVLLLASIWLGGVIAADPVWGPAFTFTGVQITWMLVGYGFVAAVLPVWLVLAPRDYLSTFLKIGTILGLAIGILIIAPELKMPALTQFTDGTGPVWKGTLFPFLFITIACGAVSGFHALISSGTTPKLLDNETNARYIGYGGMLMESFVAIMAMVAASVIEPGVYFAMNSPAAVVGTDVASVAQTVSSWGFLITPEQLEAVARDIGEHTILARAGGAPTLAVGIAQILHQVLPGENTMAFWYHFAILFEALFILTAVDAGTRAGRFMLQDLLGSFVPALKRTESWGANLLATAGCVALWGYLLYQGVIDPLGGINTLWPLFGISNQMLAGIALMLGTVVLIKMKAQRYIWVTLLPAVWLLICTTAAGLIKLFDPNPAVGFLALAKKYSTALDAGQVLAPAKDIGQMQHVDLHAYTNAGLTILFLLVVFSILFFAIKVGYAALGRKERSDKETPFQALPDDVIERTAIISVQRLGSTGQIPGAGSPPDGRHARLRQLCRTHAENASGQAGDELRGILPRTSGSTLRWQVRAQVLLSLRFV

SEQ ID NO: 36722 - DNA, 1668 bp, Aquifex aeolicus
  CDS (1)..(1668): transl_table=11
atgcatgcccttccgttaatagggattgctttccttctttacgctttcggttacttcgtttactcaaagtatctggcagaaaagatttttcagcttgacgattcaagacctactcctgcaaaggaaataaacgacggggttgattacgttcctacgaacaagtggatacttctcggacaccactttacttctataacgggagcgggacctattgtgggacctgcaatagctgttatatggggatggcttcctgcctttttgtgggtggttctgggagctgtattcatcggtggagttcacgactttaccgctcttgtaacgtctataagacataaaggaaagtccatcgggactatcctcggtgaatacgcaggagaaaaggcgagggtcttatttttactcctcctgcttgcccttgcgatactcgttaacgcggttttcgcttacgtgatttcccttctctttgtaaagtatccctcaagtgtgcttcccgcgtggcttgtaattccactcgccgtgattttcggttttagcgtttacaggctaagggtgaacttcttaatccttacggtaatttttctgagtatcctgtattttggtatttacctcgggagtgtatccccgatagatgtaaagcctttagcagagtctctgggactttctcccataatgttgtggataatcgttctctttacttacgccttttttgcctcatctctgcccgtttgggttttgctccagccgagggacttcttaaacggtttgcaactccttatccttcttattttactctacatcggtgcggtaattgcaaatcctaagatagtagcccctgcggttaatttaaatccggagggagcaccgcctatattcccgtttctgtttataacgatagcctgcggggcgctgagtggttttcacgctttggtgtcttcgggaacttcatcaaaacagcttgaaaaggagagcgacgcgagggcggtcgggtatctcggatttatgggtgaaagctccctcgcccttgcggttataatcgcaaccactgcgggaatagccatgttttccgctgaaaagttccaggaactctactcttcgtggtcctccataaagtcctcaagtctcgttgcagtagttgacggcggggctaatctgctcggtgccgtcggcattcccgtagacttcgggaaaactgtaattgccactcttgttgttctctttgcagcaactactatggacacgagcgtgaggatacagaggtatatcctcggagagctcggagagatatacggggtgcgtttgcttacgaacccttgggtagcttccggagttgcggtactgacgtccatggctcttgttctttccaaagaaggcgggaagggtggtatggttttctggcccgttttcggtgctgcaaaccagcttctcgctgggctcgctctcctgataggatacctttacctaaaaagggtaaacaggcctactctccctatcctgattcccatgattttcgttctctttataacttccctcgccatggctatgaacgcttggaacaacttaatgaagggagacttactcctcttttccgttagctttataatactgctccttgaaatgtttataatctttgagtccttcagggctgtcaggcgtgctcccgctttttaa

SEQ ID NO: 36723 - protein, 555 aa, Aquifex aeolicus
MHALPLIGIAFLLYAFGYFVYSKYLAEKIFQLDDSRPTPAKEINDGVDYVPTNKWILLGHHFTSITGAGPIVGPAIAVIWGWLPAFLWVVLGAVFIGGVHDFTALVTSIRHKGKSIGTILGEYAGEKARVLFLLLLLALAILVNAVFAYVISLLFVKYPSSVLPAWLVIPLAVIFGFSVYRLRVNFLILTVIFLSILYFGIYLGSVSPIDVKPLAESLGLSPIMLWIIVLFTYAFFASSLPVWVLLQPRDFLNGLQLLILLILLYIGAVIANPKIVAPAVNLNPEGAPPIFPFLFITIACGALSGFHALVSSGTSSKQLEKESDARAVGYLGFMGESSLALAVIIATTAGIAMFSAEKFQELYSSWSSIKSSSLVAVVDGGANLLGAVGIPVDFGKTVIATLVVLFAATTMDTSVRIQRYILGELGEIYGVRLLTNPWVASGVAVLTSMALVLSKEGGKGGMVFWPVFGAANQLLAGLALLIGYLYLKRVNRPTLPILIPMIFVLFITSLAMAMNAWNNLMKGDLLLFSVSFIILLLEMFIIFESFRAVRRAPAF

SEQ ID NO: 36724 - DNA, 1797 bp, Bacillus subtilis
  CDS (1)..(1797): transl_table=11
atgaatgcggttacaattgtgatagcatcaatgtgtattttggctattgcctatcgtttatacggaacatttatgatggtgaaggttctcaaagtgaatgatgacaagccaacacctgctcatgcgcttgaggatgggaaagactatgtgcctacaaataaatgggtttcgttcggccaccactttgccgcgatcgcagcggccgggccgctggtcggaccaattctggcggcgcagtttggctatttgccgggattattgtggctgttaatcggggcggtaattgggggagccgtccatgatattgtggtgttgtttgcatcgatgcgcaaaaacggaaaatcgctgtcggaagtggcgaaggatgagcttggccctgttgcaggattttgtacaggactgtccatgctgtttatcatcacgatcacaatggcgggcctgtcgatggttgtcttgcatgcgcttgaacgtaatccatggggaacatttgcggtggggattacgattccgattgcgatgggtgtgggcttattttataagaaaacgggaaatttaaagctcgcttcaacggtcggctttctctttttaatggcaggagtctttatcggtccatgggtacagactaccgcgctcggtgactttttaacgctagatacgaaaacgcttgcaatcgcgcttcctgtttatgcgttttttgcggctgcgcttcccgtttggctgcttctggctccgcgtgattatttaagcagctttatgaaaatcggtgtttttatcgctttgattgttggtgtgtttgtcgtcaatccgtccattccgttccctgcgtttacagaattcgtaaaaggcggagggccggtgctggcaggacctgtctggccgttcatctcaataaccatcgcctgcggggcgatctctgggttccatgcctttgtcggctcaggaacgacaccgaaaatgctgaataaatggagtgatatgaagccggttgcgtttggcgcaatgcttgttgagtgtcttgtcggtatcatggcgctgattgcagcgaccgctttacagcctgctgattactttgcgattaacagcacgcctgaggttttccgtacgcttggcatgaatgtcgtacatttgcctgaattgagcggggaaatcggtttggacttagaaggaagaacagggggagccgtcacgcttgcggtagggatgacttatatttttaccggaatgccgtttttcagccatttggcctcatactttttccaatttgtcattatgtttgaagcggtctttattttaacagcgattgacgccggcacacgtgtcgcccgttatttgatccaggacttcttcggggaggtgtataagccgctgaagaaaacagactggattccgggctctgtatttgccagcgcgcttgcctgtttgatgtgggggtacttgctgtattcaggagatatcggttccatttgggcgctcttcggcgtttctaatcggctgatggcttcagtggggctgattatcggagcgacgatcgtgctgaaaatcgccgataaacgccggtacattctgacttgccttatcccgcttgcctatttatatgtcactgtcaattatgcgggctattggatggtgcgcaatgtgtatctcaatcctgaagcagcaggatatagtgtattgaatggcgtattatctatcatcatgctggtgttaggcttcatcattatcgtggcggctgtgaaaaaatgggcgcagatgtggaaagatccgagcttaaggatggaagcatctataccgggctag

SEQ ID NO: 36725 - protein, 598 aa, Bacillus subtilis
MNAVTIVIASMCILAIAYRLYGTFMMVKVLKVNDDKPTPAHALEDGKDYVPTNKWVSFGHHFAAIAAAGPLVGPILAAQFGYLPGLLWLLIGAVIGGAVHDIVVLFASMRKNGKSLSEVAKDELGPVAGFCTGLSMLFIITITMAGLSMVVLHALERNPWGTFAVGITIPIAMGVGLFYKKTGNLKLASTVGFLFLMAGVFIGPWVQTTALGDFLTLDTKTLAIALPVYAFFAAALPVWLLLAPRDYLSSFMKIGVFIALIVGVFVVNPSIPFPAFTEFVKGGGPVLAGPVWPFISITIACGAISGFHAFVGSGTTPKMLNKWSDMKPVAFGAMLVECLVGIMALIAATALQPADYFAINSTPEVFRTLGMNVVHLPELSGEIGLDLEGRTGGAVTLAVGMTYIFTGMPFFSHLASYFFQFVIMFEAVFILTAIDAGTRVARYLIQDFFGEVYKPLKKTDWIPGSVFASALACLMWGYLLYSGDIGSIWALFGVSNRLMASVGLIIGATIVLKIADKRRYILTCLIPLAYLYVTVNYAGYWMVRNVYLNPEAAGYSVLNGVLSIIMLVLGFIIIVAAVKKWAQMWKDPSLRMEASIPG

SEQ ID NO: 36726 - DNA, 2064 bp, Helicobacter pylori J99
  CDS (1)..(2064): transl_table=11
atgcaaaaaagtttagtttctttggcttgggtttttgtcgctattttaggggcgatctgtttaggggtgttagccttacacaagggcgagagcattaacacgctatggcttgtagtagcgagcgcttgcatttatagcataggctatcgtttttatagccattttatcgcttatcgggtgttaaagctagacgatagcagagccacgcccgcatgcgtaaggaatgacggaaaggattttgtgccaaccgataaagccatcacctttgggcatcatttcgccgctattgctggggctggccctttagtaggcccgatattagccgctcaaatgggttacttgccctctattctatggattttgataggctcggttttagggggttgcgtgcatgattttgtggtgctttttgcttccattaggcgcgatggcaagtctttaggcgaaatgatcaagcttgaaatgggtaaatttgtagggatgatcgcaagtcttggcattttagggatcatgctcattatcattgcgattttggcgatggtggtggtgaaggctttagcgcattcgccttggggcttttttacgatcgctatgaccattcccattgcgattcttatggggctttacatgcggtttttcaggccgcataagattttagaagtttctgttatcggctttattttgttgattatagcgatttatgcgggtaaatacgtttctttagatcccaaactagcgtcaatttttacttttgaggccggctctttagcgtggatgatcatgggttatggttttgtggcttctattttgccggtatggtttttactcgctccacgagactatttaagcacttttttaaaaattggcgttataggggtgttggttgtggctattgtttttgtcgctccgcccttacaaatccctaaaatcacgccctttgtagatggcagtgggcctgtgtttgcaggaagcgtgttccctttcttgtttatcacggtggcttgcgggacgattagcggattccatgctttaatttcttcaggcacgacccctaaaatgctcgctaaagaaagcgacgccaggctagtgggctatggctctatggtgatggagagcgtcgtggctcttatggcgttggtgtgcgcagggattttacacccagggctttatttcgctatcaattccccagaagtgagcatcggtaaagatatagctgatgcggcttcggtgattagctcatgggggtttagtatcagcgctgaagaaatccgtgagatgactaaaaacattggcgaaagctccattttgagccgcaccggtggggcgcccacttttgcgatcggtttagcgatgatcgtgtatcacattttaggggatccaagcgtgatggcgttttggtaccattttgcgattttgtttgaagctttgttcattttaaccgctgtggatgctggcacacgaaccgctcgttttatgatccaagatttgctcggtaatatttataagcctttgggcgatcttagttcctataaggctgggatttttgccactcttttgtgcgtggcagggtgggggtatttcttgtatcaaggcacgatcgatcctaaaggggggatttatacgctatggcctttatttggcgtgagtaaccagatgttagcgggcatggcgttgttgttggttacggtggtgttgtttaaaatggggcgttttaagggggcgataataagcgccttgccggcagttttgatcttagcaatcactttttatagcggtattttaaaagtgatgccaaagagtaatgatagcgtgcttaataacgtttcgcatgtggcgcaaatgcaaatcatcaaagaaaaaatcgcgctcactacggatgaaaaagcgctaaaaacgctccaaaaatccttttttaaccatgcgattgatgcgattttgtgcgtgtttttcatgctggtggcgcttctagtgctgatcgtgagcgttaggatttgctcaaacgcttattttaaaaatcaaatttacccaccactggctgaaacgccctacatcaaagccgcttga

SEQ ID NO: 36727 - protein, 687 aa, Helicobacter pylori J99
MQKSLVSLAWVFVAILGAICLGVLALHKGESINTLWLVVASACIYSIGYRFYSHFIAYRVLKLDDSRATPACVRNDGKDFVPTDKAITFGHHFAAIAGAGPLVGPILAAQMGYLPSILWILIGSVLGGCVHDFVVLFASIRRDGKSLGEMIKLEMGKFVGMIASLGILGIMLIIIAILAMVVVKALAHSPWGFFTIAMTIPIAILMGLYMRFFRPHKILEVSVIGFILLIIAIYAGKYVSLDPKLASIFTFEAGSLAWMIMGYGFVASILPVWFLLAPRDYLSTFLKIGVIGVLVVAIVFVAPPLQIPKITPFVDGSGPVFAGSVFPFLFITVACGTISGFHALISSGTTPKMLAKESDARLVGYGSMVMESVVALMALVCAGILHPGLYFAINSPEVSIGKDIADAASVISSWGFSISAEEIREMTKNIGESSILSRTGGAPTFAIGLAMIVYHILGDPSVMAFWYHFAILFEALFILTAVDAGTRTARFMIQDLLGNIYKPLGDLSSYKAGIFATLLCVAGWGYFLYQGTIDPKGGIYTLWPLFGVSNQMLAGMALLLVTVVLFKMGRFKGAIISALPAVLILAITFYSGILKVMPKSNDSVLNNVSHVAQMQIIKEKIALTTDEKALKTLQKSFFNHAIDAILCVFFMLVALLVLIVSVRICSNAYFKNQIYPPLAETPYIKAA

SEQ ID NO: 36728 - DNA, 2064 bp, Helicobacter pylori
  CDS (1)..(2064): transl_table=11
atgcaaaaaagtttagtttctttggcttgggtttttgtagctattttaggggcgatctgtttaggggtgttagccttacacaagggtgagagcattaacacgctatggcttgtagtagcgagcgcttgtatttatagcataggctatcgtttttatagccattttatcgcttataaggtgttaaagctagatgatagcagagccacgcccgcatgcgtaaggaatgatggcaaggattttgtgccaaccgataaagcgatcacttttgggcaccatttcgccgctattgctggggctggccctttagtaggcccgatactagccgctcaaatgggttacttgccctctatcttatggattttgataggctcggttttagggggttgcgtgcatgattttgtggtgctttttgcttctattaggcgcgatggcaagtctttaggcgaaatgatcaaacttgaaatgggccaatttgtaggcatgatcgcaagtctgggcattttagggatcatgctcattatcattgcgattttagcgatggtggtggtgaaggctttagcgcattcgccttggggcttttttacgatcgcaatgactattcccattgcgattcttatggggctttacatgcggtttttcaggccacacaagattttagaggtttctgttattggctttatcctattgattatagcgatttatgcgggtaaatacgtttctttagatcctaaattagcgtcaatattcacttttgaggccagttctttagcgtggatgatcatgggctatgggtttgtggcttctattttaccggtatggtttttactcgctccacgagattatctaagcacttttttaaaaattggcgttataggggtgttggttgtggccattatttttgtcgctccgcctttacaaatccctaaaatcacgccctttgtagatggcagtgggcctgtgtttgcaggaagcgtgttccctttcttgtttatcacggtggcttgcgggacgattagcggattccatgctttaatttcttcaggcacgacccctaaaatgctcgctaaagaaagcgacgcaaggctagtgggctatggctctatggtgatggagagcgttgtggctcttatggcgttggtgtgcgcagggatcttgcacccagggctttatttcgctatcaattcgccagaagtgagcatcggtaaagatatagctgatgcggcttcagtgattagctcatgggggtttaatatcagcgctgaagaaattcgtgagatgactaaaaacatcggcgaaagctccattttgagccgcaccggtggggcgcccacttttgcgatcggtttagcgatgattgtgtatcacattttaggggatccaagcgtgatggcgttttggtatcattttgcgattttgtttgaagctttgttcattttaaccgctgtggatgctggcacacgaaccgctcgtttcatgattcaagatttgctcggtaatgtttataagcctttgggcgatcttagctcttataaggctgggatttttgccactcttttgtgcgtggcagggtgggggtatttcttgtatcaaggcacgattgatcctaaaggggggatttatacgctatggcctttatttggcgtgagcaatcagatgttagcgggcatggcgttgttgttggtcacggtggtgttgtttaaaatggggcgttttaagggggcgatgataagcgccttaccggcagttttgattttatccatcactttttatagcggtattttaaaggtggtgccaaagagcgataacagcgtgctgaataatgtttcccatgtggcgcaaatgcaaatcatcaaagaaaaaatggctaccactaccgatgaaaaagcgctcaaaacgctccaaaaatccttttttaaccacgctattgatgcgattttgtgcgtgtttttcatgcttgtggcgctattggttttaatcgtgagcgttaggatttgctcaaacgcttattttaaaaacaaaatttacccaccgctggctgaaacgccctacatcaaagcctcttga

SEQ ID NO: 36729 - protein, 687 aa, Helicobacter pylori
MQKSLVSLAWVFVAILGAICLGVLALHKGESINTLWLVVASACIYSIGYRFYSHFIAYKVLKLDDSRATPACVRNDGKDFVPTDKAITFGHHFAAIAGAGPLVGPILAAQMGYLPSILWILIGSVLGGCVHDFVVLFASIRRDGKSLGEMIKLEMGQFVGMIASLGILGIMLIIIAILAMVVVKALAHSPWGFFTIAMTIPIAILMGLYMRFFRPHKILEVSVIGFILLIIAIYAGKYVSLDPKLASIFTFEASSLAWMIMGYGFVASILPVWFLLAPRDYLSTFLKIGVIGVLVVAIIFVAPPLQIPKITPFVDGSGPVFAGSVFPFLFITVACGTISGFHALISSGTTPKMLAKESDARLVGYGSMVMESVVALMALVCAGILHPGLYFAINSPEVSIGKDIADAASVISSWGFNISAEEIREMTKNIGESSILSRTGGAPTFAIGLAMIVYHILGDPSVMAFWYHFAILFEALFILTAVDAGTRTARFMIQDLLGNVYKPLGDLSSYKAGIFATLLCVAGWGYFLYQGTIDPKGGIYTLWPLFGVSNQMLAGMALLLVTVVLFKMGRFKGAMISALPAVLILSITFYSGILKVVPKSDNSVLNNVSHVAQMQIIKEKMATTTDEKALKTLQKSFFNHAIDAILCVFFMLVALLVLIVSVRICSNAYFKNKIYPPLAETPYIKAS

SEQ ID NO: 36730 - DNA, 2277 bp, Mycobacterium tuberculosis
  CDS (1)..(2277): transl_table=11
gtggcagcgccgaccccgtcgaatcggatcgaagaacgctccggacacgccagctgcgtccgcgccgatgccgacctgccacccgtggccatcctcggtcgctcccccatcacgcttcggcacaagatcttcttcgtggccgttgccgtgatcggcgctctcgcctggaccgtcgtcgcgttcttccgcaacgagccggtcaacgcggtctggatcgtggtcgcagcgggctgcacctacatcatcgggttccggttttatgcgcggctgatcgaaatgaaagtcgtccgtccccgcgacgatcacgccaccccggccgaaatcctcgacgacggcaccgactacgtgcccaccgaccggcgggtggtattcggacaccacttcgccgccatcgccggtgccgggccgcttgtcggaccagtactggccacccagatgggttacttacccagcagcatctggattgtcgtcggcgcggtgctggccggatgtgtccaggactacctggtgttgtggatctccgtgcggcggcgtggccgctccctgggtcagatggttcgcgacgaactcggcgccaccgccggagtggccgccctcgttggaatcccggtcattatcaccattgtgatcgcggtgctggcgctggtggtcgtgcgggccctggccaagagcccatggggcgtcttctcgatcgccatgaccatccccatcgccatcttcatgggctgctacttgcggttcctacgtcccgggcgggtgtcggaagtttcattgatcgggatcggactgctgctgctcgccgttgtctccggtgattgggttgcccatacctcctggggcgcagcgtggttcagcttgtcaccggtgacactgtgttggcttctcatcagctatggcttcgcagcttcggtgctgccggtgtggctgctgctcgcgccacgcgactacctgtcaacgttcatgaaggtcggcaccatcgcgcttctcgcgatcggtgtttgtgcggctcacccgatcatcgaggccccagcggtgtcgaaattcgccggtagcggcaacggcccggtgttcgccggctcactgtttccattcctgttcatcaccatcgcgtgcggggcgctgtctggattccacgcgctcatctgctcgggcacgacgccgaagatgctggagaaggaaggccagatgcgcgtgatcggctacggcggcatgatgaccgagtccttcgtcgccgtcatagcactactcaccgcggcgatcctcgaccagcacctatacttcaccctcaacgcgccgtccctgcatacccacgacagcgcagccaccgccgccaagtacgtcaacgggctcggtttgacgggctcaccggtgaccccagaccacatcagccaggccgccgccagcgtcggcgaacagacgatcgtgtcgcgcaccggcggtgcgccgacgctggcgttcggcatggcggagatgctgcatcgagtggtcggcggtgtgggcctcaaggcgttctggtatcacttcgcgatcatgtttgaggctctgttcatcctcaccaccgtcgacgccggcaccagggccgcgcgcttcatgatctccgatgcgctgggcaactttggcggtgtgctgcgcaaactgcagaatccgagctggcgtcccggtgcgtgggcttgccgtttggtggtcgtcgcggcgtggggcagcatcctgctgctcggtgtgaccgatccgctgggcggcatcaacacgctgttcccgctgttcggcattgccaaccagttgcttgccggaattgcgctgaccgtcatcaccgtcgtcgtcatcaagaaggggcgactgaagtgggcttggataccgggtattccactgctgtgggatctggcggtcaccctgaccgcatcgtggcagaagatcttctccgctgatccttctgtcggctactggactcagcatgctcactacgcggcagcccagcacgcaggcgagaccgcgttcggctcggccaccaacgccgatgagatcaacgacgtcgtccggaacacattcgtccagggcaccctgtcgatcgtcttcgtggtggtcgtcgtgctggttgttgtcgccggagtcatagtggcgctgaagacaattcgcggccgcggcataccgttggccgaggacgatccggcgccgtcgacgttgttcgcgcccgctggcctgattcctacagccgcagagcgaaagttgcaacgacgtttgggcgcgccggcctcggcttccgtcgcggcgcccgactag

SEQ ID NO: 36731 - protein, 758 aa, Mycobacterium tuberculosis
MAAPTPSNRIEERSGHASCVRADADLPPVAILGRSPITLRHKIFFVAVAVIGALAWTVVAFFRNEPVNAVWIVVAAGCTYIIGFRFYARLIEMKVVRPRDDHATPAEILDDGTDYVPTDRRVVFGHHFAAIAGAGPLVGPVLATQMGYLPSSIWIVVGAVLAGCVQDYLVLWISVRRRGRSLGQMVRDELGATAGVAALVGIPVIITIVIAVLALVVVRALAKSPWGVFSIAMTIPIAIFMGCYLRFLRPGRVSEVSLIGIGLLLLAVVSGDWVAHTSWGAAWFSLSPVTLCWLLISYGFAASVLPVWLLLAPRDYLSTFMKVGTIALLAIGVCAAHPIIEAPAVSKFAGSGNGPVFAGSLFPFLFITIACGALSGFHALICSGTTPKMLEKEGQMRVIGYGGMMTESFVAVIALLTAAILDQHLYFTLNAPSLHTHDSAATAAKYVNGLGLTGSPVTPDHISQAAASVGEQTIVSRTGGAPTLAFGMAEMLHRVVGGVGLKAFWYHFAIMFEALFILTTVDAGTRAARFMISDALGNFGGVLRKLQNPSWRPGAWACRLVVVAAWGSILLLGVTDPLGGINTLFPLFGIANQLLAGIALTVITVVVIKKGRLKWAWIPGIPLLWDLAVTLTASWQKIFSADPSVGYWTQHAHYAAAQHAGETAFGSATNADEINDVVRNTFVQGTLSIVFVVVVVLVVVAGVIVALKTIRGRGIPLAEDDPAPSTLFAPAGLIPTAAERKLQRRLGAPASASVAAPD

SEQ ID NO: 36732 - DNA, 2166 bp, Escherichia coli
  CDS (1)..(2166): transl_table=11
atgccaggttttactatggatactaaaaagatattcaagcacataccctgggtgattctcggaatcatcggtgcattctgcctcgcggtagttgcattacgtcggggggagcacatcagcgccctgtggatcgtggtcgcctctgtatcggtgtatctggtggcgtatcgctactacagtctgtacatcgcccagaaggtgatgaaactcgaccccacgcgcgcgacgcctgcggttattaacaacgacggtctgaactacgttccgaccaaccgttacgtgttgtttggtcaccacttcgccgctatcgccggtgctggtccgctggtgggtccggttctcgccgcgcagatgggctacctgcctggcacgctgtggctgctggcgggggtcgtgctggccggtgcggttcaggactttatggtgctgtttatctcctctcgccgtaatggcgcatctcttggtgagatgatcaaagaagagatgggaccagtaccggggactatcgcgctgtttggctgtttcttaatcatgatcatcatcctcgccgtcctggcgctgattgtggttaaagccctggccgaaagtccgtggggtgtcttcaccgtttgctcaaccgtaccgattgcgctgtttatgggtatctacatgcgctttattcgtccggggcgtgtgggtgaagtctctgtcattggtatcgtgctgctggttgcctctatctacttcggtggcgtgattgctcacgatccgtactggggtccggcactgacctttaaagacaccaccattaccttcgcgctgattggctatgcgtttgtttccgcactgctgccagtgtggctgatcctcgcaccgcgcgactatctggcaaccttcctgaaaatcggcgttatcgtcggcctggcgctgggtatcgtggtgctgaacccggaactgaaaatgcctgccatgacccagtacattgacggtactggcccgctgtggaaaggcgctctgttcccgttcctgttcatcaccatcgcctgtggtgcggtatctggcttccacgcgctgatctcttccggtacgacgccaaaactgctggctaatgaaaccgacgcgcgtttcatcggctacggcgcaatgctgatggagtccttcgtggcgattatggcgctggttgctgcgtccatcatcgaaccgggtctttacttcgcgatgaacaccccgcctgctggccttggcatcaccatgcctaacctgcatgaaatgggtggcgagaacgcgccgatcatcatggcgcagctgaaagacgttaccgcacacgcggcagcgaccgtcagctcctggggcttcgtgatttcgccagagcagatcctgcaaaccgcgaaagacattggtgagccttctgtcctgaaccgtgcaggtggcgcgccgacgctggcggtaggtatcgcgcacgtgttccacaaagtgctgccgatggctgacatgggcttctggtatcacttcggtattctgttcgaagccctgttcatcctgaccgcgctggatgcgggtacccgttctggccgctttatgctgcaagacctgctgggtaacttcatcccgttcctgaaaaaaaccgattctctggttgccggtatcatcggtactgcgggctgtgtgggtctgtggggctacctgctgtatcagggcgtggttgatccgctgggcggcgttaagagcctgtggccgctgttcggtatctccaaccagatgctggcagccgtagcgctggtactgggcaccgttgtgctgattaagatgaagcgcacccaatacatctgggtaactgttgttccggctgtatggctgcttatctgcaccacctgggcgctgggcctgaaactgttcagcaccaacccgcagatggaaggcttcttctacatggcaagccagtacaaagagaagattgctaacggtactgacctgacggcgcagcagattgccaatatgaaccacatcgttgtgaacaactacaccaacgcaggtctgagtattctgttcctgattgtggtgtacagcatcatcttctacggtttcaaaacctggcttgcggtgcgtaacagcgacaaacgtactgacaaagaaacaccgtacgttccaatcccggaaggcggcgtgaagatctcttcgcaccactaa

SEQ ID NO: 36733 - protein, 721 aa, Escherichia coli
MPGFTMDTKKIFKHIPWVILGIIGAFCLAVVALRRGEHISALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGPVPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFIPFLKKTDSLVAGIIGTAGCVGLWGYLLYQGVVDPLGGVKSLWPLFGISNQMLAAVALVLGTVVLIKMKRTQYIWVTVVPAVWLLICTTWALGLKLFSTNPQMEGFFYMASQYKEKIANGTDLTAQQIANMNHIVVNNYTNAGLSILFLIVVYSIIFYGFKTWLAVRNSDKRTDKETPYVPIPEGGVKISSHH

SEQ ID NO: 36734 - DNA, 25 bp, Artificial sequence
  (1)..(25): primer
atgaacaaatcagggaaatacctcg

SEQ ID NO: 36735 - DNA, 22 bp, Artificial sequence
  (1)..(22): primer
ttagtgtgcgccttttgcctgc

SEQ ID NO: 36736 - protein, 846 aa, Artificial sequence
  Variant (2)..(7): xaa in position 2 to 7 is any amino acid
  Variant (9)..(12): xaa in position 9 to 12 is any amino acid
  Variant (16)..(17): xaa in position 16 to 17 is any amino acid
  Variant (19)..(20): xaa in position 19 to 20 is any amino acid
  Variant (23)..(32): xaa in position 23 to 32 is any amino acid
  Variant (33)..(35): xaa in position 33 to 35 is any or no amino acid
  Variant (39)..(42): xaa in position 39 to 42 is any amino acid
  Variant (45)..(45): xaa in position 45 is any amino acid
  Variant (50)..(54): xaa in position 50 to 54 is any amino acid
  Variant (55)..(55): xaa in position 55 is any or no amino acid
  Variant (58)..(60): xaa in position 58 to 60 is any amino acid
  Variant (62)..(63): xaa in position 62 to 63 is any amino acid
  Variant (67)..(67): xaa in position 67 is any amino acid
  Variant (71)..(71): xaa in position 71 is any amino acid
  Variant (77)..(82): xaa in position 77 to 82 is any amino acid
  Variant (83)..(84): xaa in position 83 to 84 is any or no amino acid
  Variant (86)..(86): xaa in position 86 is any amino acid
  Variant (91)..(91): xaa in position 91 is any amino acid
  Variant (93)..(93): xaa in position 93 is any amino acid
  Variant (95)..(95): xaa in position 95 is any amino acid
  Variant (100)..(100): xaa in position 100 is any amino acid
  Variant (102)..(107): xaa in position 102 to 107 is any amino acid
  Variant (109)..(109): xaa in position 109 is any amino acid
  Variant (111)..(112): xaa in position 111 to 112 is any amino acid
  Variant (114)..(114): xaa in position 114 is any amino acid
  Variant (117)..(118): xaa in position 117 to 118 is any amino acid
  Variant (120)..(123): xaa in position 120 to 123 is any amino acid
  Variant (126)..(133): xaa in position 126 to 133 is any amino acid
  Variant (134)..(142): xaa in position 134 to 142 is any or no amino acid
  Variant (144)..(146): xaa in position 144 to 146 is any amino acid
  Variant (149)..(149): xaa in position 149 is any amino acid
  Variant (153)..(159): xaa in position 153 to 159 is any amino acid
  Variant (161)..(171): xaa in position 161 to 171 is any amino acid
  Variant (175)..(175): xaa in position 175 is any amino acid
  Variant (177)..(181): xaa in position 177 to 181 is any amino acid
  Variant (182)..(360): xaa in position 182 to 360 is any or no amino acid
  Variant (362)..(363): xaa in position 362 to 363 is any or no amino acid
  Variant (365)..(366): xaa in position 365 to 366 is any or no amino acid
  Variant (369)..(369): xaa in position 369 is any amino acid
  Variant (374)..(375): xaa in position 374 to 375 is any amino acid
  Variant (378)..(382): xaa in position 378 to 382 is any amino acid
  Variant (384)..(384): xaa in position 384 is any amino acid
  Variant (385)..(389): xaa in position 385 to 389 is any or no amino acid
  Variant (391)..(391): xaa in position 391 is any amino acid
  Variant (393)..(397): xaa in position 393 to 397 is any amino acid
  Variant (399)..(400): xaa in position 399 to 400 is any amino acid
  Variant (403)..(411): xaa in position 403 to 411 is any amino acid
  Variant (413)..(421): xaa in position 413 to 421 is any amino acid
  Variant (422)..(442): xaa in position 422 to 442 is any or no amino acid
  Variant (446)..(446): xaa in position 446 is any amino acid
  Variant (462)..(463): xaa in position 462 to 463 is any amino acid
  Variant (464)..(464): xaa in position 464 is any or no amino acid
  Variant (466)..(469): xaa in position 466 to 469 is any amino acid
  Variant (471)..(471): xaa in position 471 is any amino acid
  Variant (473)..(474): xaa in position 473 to 474 is any amino acid
  Variant (476)..(478): xaa in position 476 to 478 is any amino acid
  Variant (480)..(480): xaa in position 480 is any amino acid
  Variant (482)..(482): xaa in position 482 is any amino acid
  Variant (488)..(488): xaa in position 488 is any amino acid
  Variant (490)..(491): xaa in position 490 to 491 is any amino acid
  Variant (496)..(499): xaa in position 496 to 499 is any amino acid
  Variant (501)..(508): xaa in position 501 to 508 is any amino acid
  Variant (509)..(594): xaa in position 509 to 594 is any or no amino acid
  Variant (596)..(601): xaa in position 596 to 601 is any amino acid
  Variant (602)..(604): xaa in position 602 to 604 is any or no amino acid
  Variant (606)..(616): xaa in position 606 to 616 is any amino acid
  Variant (617)..(632): xaa in position 617 to 632 is any or no amino acid
  Variant (636)..(638): xaa in position 636 to 638 is any amino acid
  Variant (640)..(641): xaa in position 640 to 641 is any amino acid
  Variant (644)..(645): xaa in position 644 to 645 is any amino acid
  Variant (647)..(647): xaa in position 647 is any amino acid
  Variant (649)..(649): xaa in position 649 is any amino acid
  Variant (651)..(652): xaa in position 651 to 652 is any amino acid
  Variant (654)..(654): xaa in position 654 is any amino acid
  Variant (657)..(657): xaa in position 657 is any amino acid
  Variant (659)..(687): xaa in position 659 to 687 is any amino acid
  Variant (688)..(710): xaa in position 688 to 710 is any or no amino acid
  Variant (713)..(714): xaa in position 713 to 714 is any amino acid
  Variant (717)..(717): xaa in position 717 is any amino acid
  Variant (721)..(721): xaa in position 721 is any amino acid
  Variant (724)..(724): xaa in position 724 is any amino acid
  Variant (726)..(726): xaa in position 726 is any amino acid
  Variant (728)..(733): xaa in position 728 to 733 is any amino acid
  Variant (735)..(735): xaa in position 735 is any amino acid
  Variant (737)..(742): xaa in position 737 to 742 is any amino acid
  Variant (743)..(746): xaa in position 743 to 746 is any or no amino acid
  Variant (748)..(749): xaa in position 748 to 749 is any amino acid
  Variant (752)..(753): xaa in position 752 to 753 is any amino acid
  Variant (756)..(774): xaa in position 756 to 774 is any amino acid
  Variant (775)..(834): xaa in position 775 to 834 is any or no amino acid
  Variant (836)..(845): xaa in position 836 to 845 is any amino acid
LXXXXXXVXXXXIAYXXYXXFIXXXXXXXXXXXXXTPAXXXXDGXDYVPXXXXXXLFXXXFXXIAGXGPLXGPVLAXXXXXXXXGXLWIVXGXVXAGAVXDXXXXXXSXRXXGXSLXXMXXXXLGXXXXXXXXXXXXXXXXXIXXXVLXLVVXXXXXXXPXXXXXXXXXXXIALXMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXYXXVAXVLPVXXLLXXXXXLXXXXXXLXIXXXXXLXXGIXXXXXXXXXPXXXXXXXXXXXXXXXXXXXXXXXXXXXXXXLFPXLFITIACGAISGFHAXXXSXXXXKXLXXEXXXRXIXYGAMLXEXXVAIMXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXAXXXXXXXXXXXXXXXXXXXXXXXXXXXAILXXXLXXLTXXDXGXRXXRXMLXDXXXXXXXXXXXXXXXXXXXXXXXXXXXXXXXXXXXXXXXXXXXXXXXXXXXXLWXXFGXSNQXLAXIXLXXXXXXLXKXXXXXXXXXXVXXVPXXFLXXXXXXXXXXXXXXXXXXXXXXXXXXXXXXXXXXXXXXXXXXXXXXXXXXXXXXXXXXXXXXXXXXXXXXXXXXXXXXXLXXXXXXXXXXI

SEQ ID NO: 36737 - protein, 88 aa, Artificial sequence
  Variant (3)..(3): xaa in position 3 is Ala or Ser
  Variant (4)..(7): xaa in position 4 to 7 is any amino acid
  Variant (8)..(8): xaa in position 8 is Asp or Asn
  Variant (9)..(9): xaa in position 9 is Asp or Gly
  Variant (10)..(10): xaa in position 10 is any amino acid
  Variant (11)..(11): xaa in position 11 is Asp, Glu or Asn
  Variant (12)..(12): xaa in position 12 is Phe, His or Tyr
  Variant (13)..(24): xaa in position 13 to 24 is any amino acid
  Variant (25)..(25): xaa in position 25 is Phe or Leu
  Variant (26)..(26): xaa in position 26 is Ala, Ile or Leu
  Variant (27)..(27): xaa in position 27 is Ala, Gly, Asn, Ser or Thr
  Variant (28)..(28): xaa in position 28 is Ile or Val
  Variant (29)..(29): xaa in position 29 is Ala or Ser
  Variant (30)..(30): xaa in position 30 is Ala or Gly
  Variant (31)..(31): xaa in position 31 is any amino acid
  Variant (34)..(34): xaa in position 34 is Ile, Leu, Met or Val
  Variant (35)..(35): xaa in position 35 is any amino acid
  Variant (37)..(40): xaa in position 37 to 40 is any or no amino acid
  Variant (42)..(43): xaa in position 42 to 43 is any amino acid
  Variant (45)..(49): xaa in position 45 to 49 is any amino acid
  Variant (50)..(50): xaa in position 50 is any or no amino acid
  Variant (52)..(52): xaa in position 52 is Ile or Leu
  Variant (53)..(53): xaa in position 53 is Gly, Ile, Leu or Val
  Variant (54)..(54): xaa in position 54 is any amino acid
  Variant (56)..(56): xaa in position 56 is Ala, Cys, Gly, Ser, Thr or Val
  Variant (57)..(57): xaa in position 57 is any amino acid
  Variant (58)..(58): xaa in position 58 is Phe, Ile, Leu, Met or Val
  Variant (59)..(59): xaa in position 59 is Ala, Gly, Ile or Val
  Variant (61)..(61): xaa in position 61 is Ala, Cys, Gly or Ser
  Variant (63)..(63): xaa in position 63 is any amino acid
  Variant (65)..(67): xaa in position 65 to 67 is any amino acid
  Variant (68)..(68): xaa in position 68 is Gly or Leu
  Variant (69)..(70): xaa in position 69 to 70 is any amino acid
  Variant (72)..(72): xaa in position 72 is any amino acid
  Variant (73)..(73): xaa in position 73 is Lys or Arg
  Variant (74)..(75): xaa in position 74 to 75 is any amino acid
  Variant (76)..(76): xaa in position 76 is Ala or Gly
  Variant (77)..(78): xaa in position 77 to 78 is any amino acid
  Variant (79)..(79): xaa in position 79 is Ile, Leu, Met or Val
  Variant (80)..(86): xaa in position 80 to 86 is any amino acid
  Variant (87)..(87): xaa in position 87 is Ile, Leu, Met or Val
  Variant (88)..(88): xaa in position 88 is Gly or Ser
TPXXXXXXXXXXXXXXXXXXXXXXXXXXXXXGPXXGXXXXAXXGXXXXXXWXXXGXXXXGXVXDXXXXXXSXXXXXXXXXXXXXXXXX

SEQ ID NO: 36738 - protein, 23 aa, Artificial sequence
  Variant (2)..(4): xaa in position 2 to 4 is any amino acid
  Variant (5)..(5): xaa in position 5 is any or no amino acid
  Variant (7)..(7): xaa in position 7 is any amino acid
  Variant (8)..(8): xaa in position 8 is any or no amino acid
  Variant (11)..(11): xaa in position 11 is Ile or Val
  Variant (12)..(13): xaa in position 12 to 13 is any amino acid
  Variant (14)..(15): xaa in position 14 to 15 is Ile or Leu
  Variant (16)..(22): xaa in position 16 to 22 is any amino acid
  Variant (23)..(23): xaa in position 23 is Ala, Gly, Gln, Ser or Thr
YXXXXAXXLPXXXXXXXXXXXXX

SEQ ID NO: 36739 - protein, 44 aa, Artificial sequence
  Variant (3)..(3): xaa in position 3 is Ala, Ser or Thr
  Variant (7)..(7): xaa in position 7 is Ile, Leu or Val
  Variant (12)..(14): xaa in position 12 to 14 is any amino acid
  Variant (15)..(15): xaa in position 15 is any or no amino acid
  Variant (17)..(17): xaa in position 17 is Gly or Pro
  Variant (18)..(19): xaa in position 18 to 19 is any amino acid
  Variant (20)..(20): xaa in position 20 is Ala, Pro or Ser
  Variant (21)..(21): xaa in position 21 is His, Lys or Arg
  Variant (22)..(31): xaa in position 22 to 31 is any amino acid
  Variant (32)..(32): xaa in position 32 is Ile, Leu or Val
  Variant (33)..(33): xaa in position 33 is any amino acid
  Variant (34)..(34): xaa in position 34 is Phe or Tyr
  Variant (35)..(37): xaa in position 35 to 37 is any amino acid
  Variant (38)..(38): xaa in position 38 is Ile, Leu, Met or Val
  Variant (39)..(39): xaa in position 39 is any amino acid
  Variant (41)..(41): xaa in position 41 is Ala, Cys, Gly or Ser
  Variant (42)..(43): xaa in position 42 to 43 is any amino acid
  Variant (44)..(44): xaa in position 44 is Ala, Gly or Ser
TIXCGAXSGFHXXXXSXXXXXXXXXXXXXXXXXXXXXXXEXXXX

SEQ ID NO: 36740 - protein, 20 aa, Artificial sequence
  Variant (2)..(4): xaa in position 2 to 4 is any or no amino acid
  Variant (6)..(6): xaa in position 6 is Ala, Ser or Thr
  Variant (7)..(7): xaa in position 7 is any amino acid
  Variant (9)..(9): xaa in position 9 is Ala, Ser or Thr
  Variant (10)..(10): xaa in position 10 is Ala or Gly
  Variant (11)..(11): xaa in position 11 is any amino acid
  Variant (13)..(14): xaa in position 13 to 14 is any amino acid
  Variant (16)..(18): xaa in position 16 to 18 is any amino acid
  Variant (19)..(19): xaa in position 19 is Ala, Glu, Gln, Ser or Thr
  Variant (20)..(20): xaa in position 20 is Asp or Glu
LXXXTXXDXXXRXXRXXXXX

SEQ ID NO: 36741 - protein, 39 aa, Artificial sequence
  Variant (2)..(3): xaa in position 2 to 3 is any amino acid
  Variant (5)..(5): xaa in position 5 is Ala, Gly, Ser or Thr
  Variant (6)..(6): xaa in position 6 is any amino acid
  Variant (7)..(7): xaa in position 7 is Ala, Gly, Asn, Ser or Thr
  Variant (9)..(11): xaa in position 9 to 11 is any amino acid
  Variant (12)..(12): xaa in position 12 is Ala, Gly or Ser
  Variant (13)..(15): xaa in position 13 to 15 is any amino acid
  Variant (17)..(22): xaa in position 17 to 22 is any amino acid
  Variant (23)..(23): xaa in position 23 is any or no amino acid
  Variant (25)..(36): xaa in position 25 to 36 is any amino acid
  Variant (37)..(38): xaa in position 37 to 38 is any or no amino acid
WXXFXXXNXXXXXXXLXXXXXXXLXXXXXXXXXXXXXXP

SEQ ID NO: 36742 - DNA, 1386 bp, Escherichia coli
  CDS (1)..(1386)
atgctgacattcattgaactccttattggggttgtggttattgtgggtgtagctcgctacatcattaaagggtattccgccactggtgtgttatttgtcggtggcctgttattgctgattatcagtgccattatggggcacaaagtgttaccgtccagccaggcttcaacaggctacagcgccacggatatcgttgaatacgttaaaatattactaatgagccgcggcggcgacctcggcatgatgattatgatgctgtgtggatttgccgcttacatgacccatatcggcgcgaatgatatggtggtcaagctggcgtcaaaaccattgcagtatattaactccccttacctgctgatgattgccgcctattttgtcgcctgtctaatgtctctggccgtctcttccgcaaccggtctgggtgttttgctgatggcaaccctatttccggtgatggtaaacgttggtatcagtcgtggcgcagctgctgccatttgtgcctccccggcggcgattattctcgcaccgacttcaggggatgtggtgctggcggcgcaagcttccgaaatgtcgctgattgacttcgccttcaaaacgacgctgcctatctcaattgctgcaattatcggcatggcgatcgcccacttcttctggcaacgttatctggataaaaaagagcacatctctcatgaaatgttagatgtcagtgaaatcaccaccactgcccctgcgttttatgccattttgccgttcacgccgatcatcggtgtactgatttttgacggtaaatggggtccgcaattacacatcatcactattctggtgatttgtatgctgattgcctccattctggagttcctccgcagctttaatacccagaaagttttctctggtctggaagtggcttatcgcgggatggcagatgcgtttgctaacgtggtgatgctgctggttgccgctggggtattcgctcaggggcttagcaccatcggctttattcaaagtctgatttctatcgctacctcgtttggttcggcgagtatcatcctgatgctggtattggtgattctgacaatgctggcggcagtcacgaccggttcaggcaatgcgccgttttatgcgtttgttgagatgatcccgaaactggcgcactcttccggcattaacccggcgtatttgactatcccgatgctgcaggcgtcaaacctgggccgtaccctttcgcccgtttctggcgtagtcgttgcggttgccgggatggcgaaratctcgccgtttgaagtcgtaaaacgcacctcggtaccggtgcttgttggtttggtgattgttatcgttgctacagagctgatggtgccaggaacggcagcagcggtcacaggcaagtaa

SEQ ID NO: 36743 - protein, 461 aa, Escherichia coli
MLTFIELLIGVVVIVGVARYIIKGYSATGVLFVGGLLLLIISAIMGHKVLPSSQASTGYSATDIVEYVKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILAPTSGDVVLAAQASEMSLIDFAFKTTLPISIAAIIGMAIAHFFWQRYLDKKEHISHEMLDVSEITTTAPAFYAILPFTPIIGVLIFDGKWGPQLHIITILVICMLIASILEFLRSFNTQKVFSGLEVAYRGMADAFANVVMLLVAAGVFAQGLSTIGFIQSLISIATSFGSASIILMLVLVILTMLAAVTTGSGNAPFYAFVEMIPKLAHSSGINPAYLTIPMLQASNLGRTLSPVSGVVVAVAGMAKISPFEVVKRTSVPVLVGLVIVIVATELMVPGTAAAVTGK

SEQ ID NO: 36744 - DNA, 1350 bp, Pasteurella multocida subsp. multocida str. Pm70
  CDS (1)..(1350): transl_table=11
atggatttaattattggcttaattgccgttattctcgttggttattacattgtcaaaggctattctgccactggcgtgctaatgaccgtcggcttattgttattgctttgtagtgtgttattagacaaagccattctgccgaacagtgtcaaatcaacgggtagtctctacctcgatgtgtttgaatatgtcaaataccttttaatgaatcgtgggggcaaccttggtatgctgattatggtgttgtgtggttttgcggcttacatgactcatataggggcaaacgacatggtagtaaaactcgcctcccaaccgctcaaatacatcaaatccccttatctcttaatgattgttgcttattttcttgcctgtttaatgtcattagccgttccttctgcaacgggattaggggtcttattaatggcaacactgtttcctatcatggtcaatgtgggtatttcacgcggtgccgccgcctctatttgtgcctcccctgctgccattattctgtcgcccacttctggtgatgtcgtacttgcagcagaagtatcaaaaatgccgttattagattttgcttttcatctcaccttaccaatttccattctgacaattatctctatcgcgattgcccatttcttttggcagcgttacctcgatcgtaaagagggacatcgtgcagaaatgttagcagtgagtgaaatccaaacttcagcaccgcgtttttatgcgattttacccttcacccccattgttggcgtactggtctttgatggcaaaatagcaccagaacttcatatcattacgattattgtcatttgtttactcttggtcgccctgatcgattttttaagaacctttagtgcgaaaaaagtctatgaaaacttaaatgttgcttatcaaggtatggcggatgctttctctggcgtggtgattttgcttgtagccgcgggtgtttttgcacaaggattgagtactataggctttatccatgccttaattgattccgtccaatcagtcagcagtggtggtttcctcatgatgctcgcgctagcacttatcactgcactagccgcaattaccactggttcaggcaatgcccctttctatgcgtttgttgaattaattcccaaattagccgcccatatgggaattaacccggcttacctaaccattccaatgttacaagcctccaatattggtcgcagcctctcaccagtatctggtgtggttgtggcagtatcgggcatggcaaaaatctccccatttgaagtggtaaaacggatttcagtaccgatgttagtcggactcattgtcgtgattgttgcgacagaaattatggtggttgcctaa

SEQ ID NO: 36745 - protein, 449 aa, Pasteurella multocida subsp. multocida str. Pm70
MDLIIGLIAVILVGYYIVKGYSATGVLMTVGLLLLLCSVLLDKAILPNSVKSTGSLYLDVFEYVKYLLMNRGGNLGMLIMVLCGFAAYMTHIGANDMVVKLASQPLKYIKSPYLLMIVAYFLACLMSLAVPSATGLGVLLMATLFPIMVNVGISRGAAASICASPAAIILSPTSGDVVLAAEVSKMPLLDFAFHLTLPISILTIISIAIAHFFWQRYLDRKEGHRAEMLAVSEIQTSAPRFYAILPFTPIVGVLVFDGKIAPELHIITIIVICLLLVALIDFLRTFSAKKVYENLNVAYQGMADAFSGVVILLVAAGVFAQGLSTIGFIHALIDSVQSVSSGGFLMMLALALITALAAITTGSGNAPFYAFVELIPKLAAHMGINPAYLTIPMLQASNIGRSLSPVSGVVVAVSGMAKISPFEVVKRISVPMLVGLIVVIVATEIMVVA

SEQ ID NO: 36746 - DNA, 1389 bp, Pasteurella multocida subsp. multocida str. Pm70
  CDS (1)..(1389): transl_table=11
atgctaggactactgcttggattagcggtaaccattcttgttggttatctcattgtcaaaaagtacaaagcacaatttgtgttactgtgtggtggtattatcttgatgtgttttgcggtgctatttggactgggtgaaattctgcctgccaataagtcaactggttgggtcggtttcgatatttttgaatttatcaaaaacctatttagtacacgtgctgccgatttaggtttaatgattatggctgtcggcggatttgctcgttatatggataaaatcggtgccagtgaagcgttagtgaatattgcagtcaagccactcaacgccattaaagcgccttatttagtcttggccttagcctatattgttggacaaatcctcaatatttttattccaagtgcatcaggactcggtcttcttttaatgctcactattttcccgatcttagtcaatttaggcgtaagtcgagaaggtgcagccgcgcttatcgcgactacggcctgtttggatttaggacccgcatctggtaatgcggtattagctgccaaaactgccaatattgacattgcagaatactttgtcggttatcaattaaaattagccattatcacgatgttagtgatttcaacctcacatttcttcgtgcaaaaatggtttgataaaagacaagctctcacgggtggtggttctgaatatgacgcaagtctagaagttaaccttgacaaacaagacaagcaagcctcgccggtacctgctgtttatgtcctgctccccctcctacctttagttctcatcttaacctttagtaaattattggtgagtagcattaaaatgaatgttgccaccgcaatgatcatcagcttatttattgctatgctatttgagtttgtgcgcaaaaaagatgtcaaacaggtgtttgccgaaatgcaagtgttctttgatggcatgggaaaacaatttgcagcggtagtcaccctcattgtggcgggtgaaaccttcgctaaagggttaaccgctgtcggcgcgattgataccattatttcaggtgcacaaacctttggctttggtgttttcttaatgacattggtgatggtcttaattattgccctttctgctattgttatgggttcggggaatgcacctttcttcgcctttgccgctttagcccctaaagtcgctagcggattaggtatttcacctgtcttgatggttctcccaatgcaactggtagcaggtattgcaagaagtatgtcgccaattacggctgtcattgtcgcagtatccggtgtggcgaatgtgtcaccgtttgatttgattaagcgtaccgcgttgccaatggcctttgccttgattacggtattcttgggtaccttcctactctaccactaa

SEQ ID NO: 36747 - protein, 462 aa, Pasteurella multocida subsp. multocida str. Pm70
MLGLLLGLAVTILVGYLIVKKYKAQFVLLCGGIILMCFAVLFGLGEILPANKSTGWVGFDIFEFIKNLFSTRAADLGLMIMAVGGFARYMDKIGASEALVNIAVKPLNAIKAPYLVLALAYIVGQILNIFIPSASGLGLLLMLTIFPILVNLGVSREGAAALIATTACLDLGPASGNAVLAAKTANIDIAEYFVGYQLKLAIITMLVISTSHFFVQKWFDKRQALTGGGSEYDASLEVNLDKQDKQASPVPAVYVLLPLLPLVLILTFSKLLVSSIKMNVATAMIISLFIAMLFEFVRKKDVKQVFAEMQVFFDGMGKQFAAVVTLIVAGETFAKGLTAVGAIDTIISGAQTFGFGVFLMTLVMVLIIALSAIVMGSGNAPFFAFAALAPKVASGLGISPVLMVLPMQLVAGIARSMSPITAVIVAVSGVANVSPFDLIKRTALPMAFALITVFLGTFLLYH

SEQ ID NO: 36748 - DNA, 1299 bp, Pasteurella multocida subsp. multocida str. Pm70
  CDS (1)..(1299): transl_table=11
atggtggcattgaaagcaattattgcgcttactggcattattgttgctgtctatttattaataaagaaatatgaaacacgcacagtattaattggtgtagggttgttcatggcgattgcaacacttaacccaatgggggcactcgatgcatttgcgaaaagcatgacatcggcagggctaattatggcaatttgttcgagtatgggctttgcttatgtgatgaaatatacgcaatgcgatacgcatttagtccatttattaacaaaaccattaagtggcttgaagtttttcttaattcctatcgccacaatcattaccttctttgttaacattgcgattccttctgcagcaggttgtgcggcagccgtgggggcgacgctcattccagtattaaaaagttccggtgttcgtccagcaacagcaggggcagcaattcttgcgggaacgtttggatcgatgatgagtccgggatcgtcgcattcagccatgttaagtgaaatgtcaggtttaacggtgacacaagttaacttatctcatgcgccttatacgatgattgcaggggcgatcggggctgtgatgttaacgattttagcgattgtgtttaaagattatggggaagaacaccgtcaagcgtatttgcttgaaaataaagagagtgagcaaaatgcagaaaatatgaaagtgaatattttttatgcattagcaccattagtacctttagtgattttagttattggtggaacatctttacaaaaaatgccgggtttagaatggacgaaaatgggtgtaccacaagcgatgttaattggttcattatatgctgttgtgatgacacgcatttcaccggtcaaaattacaaatgagttctttaatggaatgggtaattcttatgcgaatgtgttaggtatcatcattgcggcaagcgtctttgttgcgggtttaaaatcaacaggagccattgatagcgcgattgaattcctgaaacattcaaatgaatttgtgcgttggggagcaaccataggaccattcttaatgggcattgtgactggatcgggagatgctgccgcgattgcgttcaataccgcggtgacgcctcatgcagtcgaattaggttatacccacgttaatttaggtatggctgctgcgattgcgggggcaattggacgtacagcctctccaattgctggcgtgacaattgtctgtgcaggtttagcgatggttagtccggttgaaatggtcaaacgcactgcaccaggcatgattctcgcgatcttatttttagcattgtttatgttgtaa

SEQ ID NO: 36749 - protein, 432 aa, Pasteurella multocida subsp. multocida str. Pm70
MVALKAIIALTGIIVAVYLLIKKYETRTVLIGVGLFMAIATLNPMGALDAFAKSMTSAGLIMAICSSMGFAYVMKYTQCDTHLVHLLTKPLSGLKFFLIPIATIITFFVNIAIPSAAGCAAAVGATLIPVLKSSGVRPATAGAAILAGTFGSMMSPGSSHSAMLSEMSGLTVTQVNLSHAPYTMIAGAIGAVMLTILAIVFKDYGEEHRQAYLLENKESEQNAENMKVNIFYALAPLVPLVILVIGGTSLQKMPGLEWTKMGVPQAMLIGSLYAVVMTRISPVKITNEFFNGMGNSYANVLGIIIAASVFVAGLKSTGAIDSAIEFLKHSNEFVRWGATIGPFLMGIVTGSGDAAAIAFNTAVTPHAVELGYTHVNLGMAAAIAGAIGRTASPIAGVTIVCAGLAMVSPVEMVKRTAPGMILAILFLALFML

SEQ ID NO: 36750 - DNA, 1281 bp, Pasteurella multocida subsp. multocida str. Pm70
  CDS (1)..(1281): transl_table=11
atgattgcattcttagttttaattgcacttgttctacttgttatgattaatgtgcctatcgcagtagcaattggtattgtttcactcataggtatgttaattacaaatagttttgatgcaatatataacgtcgcactgtctgtttttgatggcgcctctaatttttcattacttgctattccgcttttcattttagcaggagcattaatgaatacagggggaatatcggttaggctgattaattttgttaatgctttaatcggcttcgtccgaggtgggcttgcaatggtcaatgtgggtgtttccatgatctttgctgaaatttccggatcttctgtagcggatgttgccgcactgggttctatcctcattcctgcaatgaaaaaaagaggttataaatcaagcttttctgctgctgttacttcatcatcggcttccttagcggtgattatcccaccctcacttcccatgattatttatggtgcgatggcggatgtttctatttctaagctttttgtggcaggacttgccgcaggtggtgtagcttcgttaggtatgtttgctgtatgttattattatgcggttaaatataatttaccgagggaagaacacttcagcatgtccaaattatgcacagcattcaaaaatgcgttctgggcgttaacgttacctgttctaattttaggtgggattatttcaggttttaccactgcaacagaagcggccggcttagctgtacttttagcattaatcattggttttttcatttacaaagagctcacactcaatgcagtatataaagcattggtagaaagtgtaaatggaacatccgttgtcatgctactggttgcgacgtcagctgttttgggattgtttttaacagaacagaaagtacctcaacaaatggctgcagcaattttaaatatctcggacaataaatatatcgttttaatgatgctaaatgtcatgttatttattgttggtatgtttttacatggcgcggcggccattattttagtcgtccctattgttatgcctctgattacacaattgggcattgatccgattcattttggtatcatcttaacgttaaacattgcagtgggtcagcaaacaccaccggtggcaagtgtattaatcacagcctcatctatcgcgaaaaaagatatttggagtgtcactaaggataatgtttggtttattgttgtattattaatttctttaatgatggtcacttatattcctgcattgacggttggtatggtggacctattctattaa

SEQ ID NO: 36751 - protein, 426 aa, Pasteurella multocida subsp. multocida str. Pm70
MIAFLVLIALVLLVMINVPIAVAIGIVSLIGMLITNSFDAIYNVALSVFDGASNFSLLAIPLFILAGALMNTGGISVRLINFVNALIGFVRGGLAMVNVGVSMIFAEISGSSVADVAALGSILIPAMKKRGYKSSFSAAVTSSSASLAVIIPPSLPMIIYGAMADVSISKLFVAGLAAGGVASLGMFAVCYYYAVKYNLPREEHFSMSKLCTAFKNAFWALTLPVLILGGIISGFTTATEAAGLAVLLALIIGFFIYKELTLNAVYKALVESVNGTSVVMLLVATSAVLGLFLTEQKVPQQMAAAILNISDNKYIVLMMLNVMLFIVGMFLHGAAAIILVVPIVMPLITQLGIDPIHFGIILTLNIAVGQQTPPVASVLITASSIAKKDIWSVTKDNVWFIVVLLISLMMVTYIPALTVGMVDLFY

SEQ ID NO: 36752 - DNA, 1365 bp, Escherichia coli O157:H7
  CDS (1)..(1365): transl_table=11
atgttcggcataattatatctgtcatcgtattaattacgatgggctatttgatcctgaaaaactacaaacctcaggtggtgctggctgcaggtatcttcctgatgatgtgcggtgtctggttagggttaggtggtgtactcgatcccgccaaaagcagcggctacttgatcgtcgatatttataatgaaatcctgcgcatgctgtccaaccgcattgccggattggggctgtcgattatggcggtgggcggttatgcccgctacatggagcgcacaggagccagtcgcgcgatggtgagcttgttaagccgcccgttaaaactcattcgctcgccgtatattattctgtcggcaacttacgtcatcggccaaatcatggcgcagtttattaccagcgcctccggcctgggtatgttgctgatggtcaccttatttccgacactggtgagtctgggagtaagccgtctctctgcggtggcggttatcgcaaccacaatgtccattgagtgggggattctggaaacgaactccatttttgcagcccaggtagcgggaatgaaaattgccacttacttcttccactaccagcttccggtcgcctcttgcgtcattatctcggtggcgatctcccactttttcgtgcaacgcgcttttgacaaaaaagataaaaatatcaatcacgaacaggcagagcaaaaagctctcgataatgtcccgccgctctattacgccattttacctgtgatgccgttaatcctgatgctcggctcgctattccttgcccacatcgggctgatgcagtcagaactgcatctggtggtggtgatgttactgagtttgacgatgtttgttgagttcttccgcaagcataacttgcgcgaaacaatggacgatgtgcaggcgttttttgacggcatgggtacgcagtttgccaacgtggtaacgctggtggtcgcgggtgaaatatttgcgaaaggcttaacgacgattggcactgtcgatgcggttatcaggggtgcggagcattctggtctgggcggtattggcgtgatgattattatggcgctggtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcggtttcgccgattactgcggtggtggtcgttacgtcaggaattgcaggcgtttcgccttttgcggtggtgaagcggacagcgatccccatggcagtcggtttcgtggtgaatatgattgccacaatcacgctattttattaagtcattaa

SEQ ID NO: 36753 - protein, 454 aa, Escherichia coli O157:H7
MFGIIISVIVLITMGYLILKNYKPQVVLAAGIFLMMCGVWLGLGGVLDPAKSSGYLIVDIYNEILRMLSNRIAGLGLSIMAVGGYARYMERTGASRAMVSLLSRPLKLIRSPYIILSATYVIGQIMAQFITSASGLGMLLMVTLFPTLVSLGVSRLSAVAVIATTMSIEWGILETNSIFAAQVAGMKIATYFFHYQLPVASCVIISVAISHFFVQRAFDKKDKNINHEQAEQKALDNVPPLYYAILPVMPLILMLGSLFLAHIGLMQSELHLVVVMLLSLTMFVEFFRKHNLRETMDDVQAFFDGMGTQFANVVTLVVAGEIFAKGLTTIGTVDAVIRGAEHSGLGGIGVMIIMALVIAICAIVMGSGNAPFMSFASLIPNIAAGLHVPAVVMIMPMHFATTLARGFADYCGGGRYVRNCRRFAFCGGEADSDPHGSRFRGEYDCHNHAILLSH

SEQ ID NO: 36754 - DNA, 1386 bp, Salmonella typhimurium LT2
  CDS (1)..(1386): transl_table=11
atgctaacagttatagagctccttatcggagtcgtcgttattgtgggtgtagcgcgctacatcattaagggatattccgccactggcgttttatttgtcggcggtctggctctgcttattatcagcgcgctgatggggcataaggtattacctgccagcgaaaccagtaccggctataccgcaacagatattgttgaatacatcaaaattttgcttatgagtcgcggcggcgatcttggcatgatgatcatgatgctgtgcggctttgccgcctatatgacgcatatcggcgcgaatgatatggtcgtgaagctggcgtcgaaacctttacagtacataaactcgccctacctgttgatgattgccgcctattttgtcgcctgcctgatgtcgctggccgtctcttccgcgacggggcttggcgtactgctcatggctactctcttcccggtgatggtcaacgtcggcattagccgcggcgcggcggcggctatttgcgcctctccggccgccatcatcctctcgccaacgtctggcgatgtggttttagccgcaaaagcggcggagatgccgttaatcgatttcgcgttcaaaactacgctgccaatttccatcgccgccattatcggtatggcgattgcgcactttttctggcaacgctatctggataaaaaagagaacatttcacatgagatgctggacgtggcggagattaccaccacggccccggcgttttatgcccttttgccgttcacgcccattatcggcgtactgatttttgacggtaaatgggggccgcagttgcacattattaccattctggtgatctgtatgctgctggccgccgtgctggaattcgtgcgcggtttcaacacgcaaaatgtgttttccggcctggaagtggcttatcgcggcatggcggatgcgtttgccggcgttgtgatgctgttggtcgcggcgggcgttttcgcccaggggctgagcaccattggctttatccaaagtctgatctcgattgccacttcttttggctccgccagcattattctgatgctggtcttagtgattttaaccatgctggccgcgatgaccaccggttcaggcaatgcgcctttttacgcctttgttgagatgatccctaaactggcgcactcctccggtatcaacccagcctatttatccatcccaatgctgcaagcctcaaacctggggcgcacgatttcgccggtctccggcgtcgtggtcgctgtcgccgggatggctaaaatatcaccgtttgaagtggtgaagcgcacgtccgttccggttatcgtcggtctgttgatcgtcattatcgccacggaaattatggtgccaggcgcctcttccagcgttactggcggctga

SEQ ID NO: 36755 - protein, 461 aa, Salmonella typhimurium LT2
MLTVIELLIGVVVIVGVARYIIKGYSATGVLFVGGLALLIISALMGHKVLPASETSTGYTATDIVEYIKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILSPTSGDVVLAAKAAEMPLIDFAFKTTLPISIAAIIGMAIAHFFWQRYLDKKENISHEMLDVAEITTTAPAFYALLPFTPIIGVLIFDGKWGPQLHIITILVICMLLAAVLEFVRGFNTQNVFSGLEVAYRGMADAFAGVVMLLVAAGVFAQGLSTIGFIQSLISIATSFGSASIILMLVLVILTMLAAMTTGSGNAPFYAFVEMIPKLAHSSGINPAYLSIPMLQASNLGRTISPVSGVVVAVAGMAKISPFEVVKRTSVPVIVGLLIVIIATEIMVPGASSSVTGG

SEQ ID NO: 36756 - DNA, 1314 bp, Corynebacterium glutamicum ATCC 13032
  CDS (1)..(1314): transl_table=11
atgttgtcgccagcagctgtagcagctttaattcttgtcatcggcattgtggtgctcatcatcgcatcagtgcccgttgccattgccatcggtttgccatcactttttgccgcgatggccgtgcttggcccagaaaacgccgcgcaggccgtcgcgcagcgcatgtttaccggcacaaactcctttacactccttgccattccgttcttcgtgttggcgggtttgctgatgaactcgggtggtattgccacgcggcttatcgacgccgcgaaggtgcttgtcggccgcatgcctgcctccatggccaatacgaatatcgcagcaaatggtctcttcggagcagtttcaggggcagcggtagcatcagcttctgccgtgggaaccgtcatgacaccaaaaatgaaggaagagggctactcgcgcgcttacgcagcggccgtcaacgtggcttcagcacctgcgggcatgctgatcccgccatcaaacacttttattgtgtattccttggtgtcctcgacatcaattgcagcactatttatggccggtgttggacccggtctgctctggattctggcctgtgtcatcgtgggaacttggttagcgcgaaaggaaaactacaagcgcgagcagattcatccaacattcaagcagtcgctcgttgtgctgtggagggcgctgccttcactgctcatgatcgtcattgttgttggaggtatcttgctgggctggttcactccaactgaatccgctgctattgctgtagtgtactgcctggtcttgggctttatttaccgcacaatcaaggtgggagatctggcagatattttgctcaaggcaactcgcaccacatcaattgtcatgttgctcattgcagtttctgcagcactgtcgtgggtgatggcctttgccaagatccctcagatgatctctgatgcgcttctttcggtatccgattccaaggttgtcatcttgttgatcatgatgttcatcctgttactcatcggtaccgtaatggacccaacaccagcaattttgatcttcgtcccgatcttccttccagtggttaccgaacttggtgtggacccagtccacttcggtgcgatggtggtaatgaacctgtccgtgggcgtgattaccccaccagtaggcaacgtgttgttcgttggttcgcaagtggcagggctgcgtgtggaaactgtgatcagacgactgtggccgtatctcattgccattattgttgcgctgttcgtggttgttttcgtaccgcagatctctatctggctgcccacaacaatgggattgatgggaggctaa

SEQ ID NO: 36757 - protein, 437 aa, Corynebacterium glutamicum ATCC 13032
MLSPAAVAALILVIGIVVLIIASVPVAIAIGLPSLFAAMAVLGPENAAQAVAQRMFTGTNSFTLLAIPFFVLAGLLMNSGGIATRLIDAAKVLVGRMPASMANTNIAANGLFGAVSGAAVASASAVGTVMTPKMKEEGYSRAYAAAVNVASAPAGMLIPPSNTFIVYSLVSSTSIAALFMAGVGPGLLWILACVIVGTWLARKENYKREQIHPTFKQSLVVLWRALPSLLMIVIVVGGILLGWFTPTESAAIAVVYCLVLGFIYRTIKVGDLADILLKATRTTSIVMLLIAVSAALSWVMAFAKIPQMISDALLSVSDSKVVILLIMMFILLLIGTVMDPTPAILIFVPIFLPVVTELGVDPVHFGAMVVMNLSVGVITPPVGNVLFVGSQVAGLRVETVIRRLWPYLIAIIVALFVVVFVPQISIWLPTTMGLMGG

SEQ ID NO: 36758 - DNA, 1263 bp, Oceanobacillus iheyensis HTE831
  CDS (1)..(1263): transl_table=11
atgattattgttattttcatccttcttttgattattggtgcaccgattgctgtagcaataggtttgtccagttttgttgccatgatgcaagaaggagtttcaattgatgtattctccagaaccatttttgcaggaatagactcgtttactctcatggccatacctttttttatctttgctggagatttgatgttagccgggggcacgtcgaaaagattaatagattttgctaaaaagttagtcggctggtcaactggtggattacccattgcaggtgtaatgtcttccatgctatttgcagcactatcaggatcaagcccggccacggtagctgcaatcggtggtataatgattccttcattaaatgatgctggctattcacgaaaatttgcaataggtttaatgacgactgccggtaccttaggaattattatcccaccaagtatcacacttttagtgtatggttcatccgctgaggtgtccatcagtaatttgtttcttgctggaatcgttccaggagtttttataggattggtacttattattgtaagttatatcatctcaaaaaaggaaggatttaaaccagaaggcagggcgagcctaggagcagttggaaaatcatttatctctgccatatgggggatattacttccggttattgttttaggaggcatctattttggcgtcttcacgcctacagaagctgctgctgttgcgatcgtttatagcctaattattggattatttgtttataaggaattaacgttaagaagtttgatcgatgttacgaagaaatcagttattacttcttctatgattatgcttgttattgcagcctctaatgtgtttagctggtatctgacctttgagcaaatacctactaatcttgcatctgttttgcttaattatgcgaatacagaagtagctttcttattccttgttatagttattttattactagttggaatgttcatggatacaagtgctgcggtgttaatatttgttcctttattccttcctatggtaagtcaactgggtattgaccccattcattttggaataattatgatagtcgctctatctattggaatgattacaccaccatttggtctgaatctatttgtggcttcagggatcagtaaagtatcattagtagaagtaatcaaaagtacagcgccatttattttggttatgatattcgccttacttgttattacattcgttccagaactttccttatttttactcgggatttttgaataa

SEQ ID NO: 36759 - protein, 420 aa, Oceanobacillus iheyensis HTE831
MIIVIFILLLIIGAPIAVAIGLSSFVAMMQEGVSIDVFSRTIFAGIDSFTLMAIPFFIFAGDLMLAGGTSKRLIDFAKKLVGWSTGGLPIAGVMSSMLFAALSGSSPATVAAIGGIMIPSLNDAGYSRKFAIGLMTTAGTLGIIIPPSITLLVYGSSAEVSISNLFLAGIVPGVFIGLVLIIVSYIISKKEGFKPEGRASLGAVGKSFISAIWGILLPVIVLGGIYFGVFTPTEAAAVAIVYSLIIGLFVYKELTLRSLIDVTKKSVITSSMIMLVIAASNVFSWYLTFEQIPTNLASVLLNYANTEVAFLFLVIVILLLVGMFMDTSAAVLIFVPLFLPMVSQLGIDPIHFGIIMIVALSIGMITPPFGLNLFVASGISKVSLVEVIKSTAPFILVMIFALLVITFVPELSLFLLGIFE

SEQ ID NO: 36760 - DNA, 1431 bp, Bifidobacterium longum NCC2705
  CDS (1)..(1431): transl_table=11
atggaactggtgattatgtacctcgtggcaattgccgcggttggcattgtgggctttatgctcgtgaagaaaatggacatcaagatttccctgttcctcatcggcattgtgctgatgtacatcgcattgctgatgggcaaggacatctcattcaccgacttcgtttccagtggtgtcacttggcttgatccgttcaaggttgtaggcgatcagttcgtgagcacgctcacttctgctggcttcatcatcctcatccttggtggctacaccggctacatgtcccatatcggagccaatgaagtcacggtaagtgtgctcgccaagccgattgcgcacatcaagtccccgtatatactcgtgccgattaccttcttgttgggcaacctgttgtctctggtcattccgagtgcttccaacctggctatcatccttatggcaacgctgtacccggtgcttcgccaagctggtatgagcctgctgagcgcagctgcagtcattgccactactgcaacgattatgccgaccccgcttggctccgacaatgttgccatcgccgctgaactcgctaagaccgacatgttctccggcctgaccgccagcgattacgtcttccgttatcacgtgctcgtttccatcccgaccttgctcgtcatggcactggcacactacttctggcagaagttcatggacaagcgcgctggctcggatttgaccgacggtgatgttgacctggctgaggttaaggctgtcgaaggtagcgctctctaccgcactgtgtatgcgattttgccgctgctgccgatcatcatgcttctcatcgtgttcgccatcacttccaccaccggcgcaaagatcgacctgagtgttgaactcgcttccattctctccttcgtgatcgccattatctgcgagctcatccgcactcgcaagggcaaggaaaccctcgctggcaccgagtccttcttcaagggcatgggtggcgcaatgccgattgtggcactgttggtcgctgcttctgtgttcgtcgttggtcttaagtccattggtctgatcaccgaactgcagaacgcaatgaccggcctgtccggctctggtatgggcttcgtgctgccgcttatccttgtcggcctcactgcgctcatcgtgctactctccggttccggtaccgcactgttcttcgcgatggttccgctcatggttccgctggccgctgctgctggtatcaatgtgctcgctgtgtccatcccgatgggtctcgctggcaatctgctgcgcgctgtctcgccggtctccgctgtggtgatgatcgtcgccggctccatcaagaagagcccaatcgacattgtgcgccgtaccagtgtgccgatgatcgctggcgtaatcgtcatgttcatcctgtccatggcaatcttcctgccgatgggtgcgtga

SEQ ID NO: 36761 - protein, 476 aa, Bifidobacterium longum NCC2705
MELVIMYLVAIAAVGIVGFMLVKKMDIKISLFLIGIVLMYIALLMGKDISFTDFVSSGVTWLDPFKVVGDQFVSTLTSAGFIILILGGYTGYMSHIGANEVTVSVLAKPIAHIKSPYILVPITFLLGNLLSLVIPSASNLAIILMATLYPVLRQAGMSLLSAAAVIATTATIMPTPLGSDNVAIAAELAKTDMFSGLTASDYVFRYHVLVSIPTLLVMALAHYFWQKFMDKRAGSDLTDGDVDLAEVKAVEGSALYRTVYAILPLLPIIMLLIVFAITSTTGAKIDLSVELASILSFVIAIICELIRTRKGKETLAGTESFFKGMGGAMPIVALLVAASVFVVGLKSIGLITELQNAMTGLSGSGMGFVLPLILVGLTALIVLLSGSGTALFFAMVPLMVPLAAAAGINVLAVSIPMGLAGNLLRAVSPVSAVVMIVAGSIKKSPIDIVRRTSVPMIAGVIVMFILSMAIFLPMGA

SEQ ID NO: 36762 - DNA, 1368 bp, Shigella flexneri 2a str. 301
  CDS (1)..(1368): transl_table=11
atgttcggcataattatatctgtcatcgtattaattacgatgggctatttgatcctgaaaaactacaaacctcaggtggtgctggctgccgcaggtgtcttcctgatgatgtgcggagtctggttagggttcggtggtgtactcgatcccgccaaaagcagcggctacttgatcgtcgacatttataatgaaatcctgcgcatgctgtccaaccgcattgccggattggggctgtcgattatggcggtgggcggttatgcccgctacatggagcgcataggagccagttgcgcgatggtgagcttgctaagccgcccgttaaaactcattcgctcgccgtatattattctgtcggcaacttacgtcatcggccaaatcatggcgcagtttattaccagcgcctccggtctgggtatgttgctgatggtcaccttatttccgacgctggtgagtctgggagtaagtcgcctctctgcggtggcggttatcgcaaccacgatgtccattgagtgggggattctggaaacgaactccatttttgcagcccaggtcgcgggaatgaaaattgccacatacttcttccactaccagcttccggtcgcctcttgcgtcattatctcggtggcgatctcccactttttcgtgcaacgcgcttttgacaaaaaagataaaaatatcaatcacgaacaggcagagcaaaaaactctcgataatgtcccgccgctctattacgccattttacctgtgatgccgttaatcctgatgctcggctcgctgttcctcgcccacgtcgggctgatgaagtcagaactgcatctggtggtggtgatgttactaagtttgacggtgacgatgtttgttgagttcttccgcaagcataacttgcgcgaaacaatggacgatgtgcaggcgttttttgacggcatgggtacgcagtttgtcaacgtggtaacgctggtggtcgcgggtgaaatatttgcgaaaggcttaacgacgattggcactgttgatgcggttatcaggggtgcggagcattctggtctgggcggtattggcgtgatgattattatggcgctagtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcgcggtttcgccgattactgcggtggtggtcgttacgtcaggaattgcaggcgtttcgccttttgcggtggtgaagcggacagcgatccccatggcagtcggtttcgtggtgaatatgattgccacaatcacgctattttattaa

SEQ ID NO: 36763 - protein, 455 aa, Shigella flexneri 2a str. 301
MFGIIISVIVLITMGYLILKNYKPQVVLAAAGVFLMMCGVWLGFGGVLDPAKSSGYLIVDIYNEILRMLSNRIAGLGLSIMAVGGYARYMERIGASCAMVSLLSRPLKLIRSPYIILSATYVIGQIMAQFITSASGLGMLLMVTLFPTLVSLGVSRLSAVAVIATTMSIEWGILETNSIFAAQVAGMKIATYFFHYQLPVASCVIISVAISHFFVQRAFDKKDKNINHEQAEQKTLDNVPPLYYAILPVMPLILMLGSLFLAHVGLMKSELHLVVVMLLSLTVTMFVEFFRKHNLRETMDDVQAFFDGMGTQFVNVVTLVVAGEIFAKGLTTIGTVDAVIRGAEHSGLGGIGVMIIMALVIAICAIVMGSGNAPFMSFASLIPNIAAGLHVPAVVMIMPMHFATTLARAVSPITAVVVVTSGIAGVSPFAVVKRTAIPMAVGFVVNMIATITLFY

SEQ ID NO: 36764 - DNA, 1284 bp, Vibrio vulnificus CMCP6
  CDS (1)..(1284): transl_table=11
atggctggttcaatttttggttggctaggcttgctttttgctggcatgccagttggcttttctctgatttttgtggcgttggtttttcttattgttaccaacagcacaggtattaacttcgcagcgcagcagatgctgggcggcattgataattttacgttattggccgtaccattcttcgtcctaacgggccatttgatgaacagtgccggtattactgagcgaatttttaactttgccaaatccatggttggccatatcacaggtagtctagggcatgtaaacatcatggcgagtttactattttctggtatgtctggctctgcgcttgccgatgccggaggcttggggcagcttgaaatcaaatcgatgcgtgacgcgaaatacgatgatgactttgctggtggtctcacggcggcctcgtgcatcattggtccgcttgttccgccttctgtgccattggtgatttatggtgtagtgtccaacacatcgattggtgcgctgtttttagccggtgcaataccaggcattttgtgctgcgtggctttgatggtgatgagctatttcatctgtaagaaacgtggctacatgaccttgcccaaagcgtcgagaaaagagcagttcacatcgttcaaagaggcatttctttctctaatgactccggtcatcatcattggcgggatcttttcgggtaagttcaccccgacggaagcagcagtggtttcctctctttatgcgctgttccttggtaccgtggtgtacaaacagctgaccttgacggggtttgtggaaattcttcgcgaaaccgtgaataccaccgccgttgttgccttgatggtgatgggggtaacggtgtttggctggatcgtggcgcgtgagcaattgccacagatgcttgcggattatttcttgtcaatcagtgaaaacccattggtactactgctactcatcaacttgctcttactgtttttgggaaccttcattgaatcactcgcgttattgctattgctggttccatttttagtcccagtggcatcggcggtcgggattgaccctgtgcactttggtgttatggccattttgaacttgatgatcggcattctcacgccaccaatgggcatggctttatatgtggtatcacgtgtcggagacattccatttcataccttaactcgaggcgtacttcctcttctggtgccattgtttattgtgctggcgttggtggcggtattccctcaaatcaccttgctattgcctgagctgcttttgggttacggacaataa

SEQ ID NO: 36765 - protein, 427 aa, Vibrio vulnificus CMCP6
MAGSIFGWLGLLFAGMPVGFSLIFVALVFLIVTNSTGINFAAQQMLGGIDNFTLLAVPFFVLTGHLMNSAGITERIFNFAKSMVGHITGSLGHVNIMASLLFSGMSGSALADAGGLGQLEIKSMRDAKYDDDFAGGLTAASCIIGPLVPPSVPLVIYGVVSNTSIGALFLAGAIPGILCCVALMVMSYFICKKRGYMTLPKASRKEQFTSFKEAFLSLMTPVIIIGGIFSGKFTPTEAAVVSSLYALFLGTVVYKQLTLTGFVEILRETVNTTAVVALMVMGVTVFGWIVAREQLPQMLADYFLSISENPLVLLLLINLLLLFLGTFIESLALLLLLVPFLVPVASAVGIDPVHFGVMAILNLMIGILTPPMGMALYVVSRVGDIPFHTLTRGVLPLLVPLFIVLALVAVFPQITLLLPELLLGYGQ

SEQ ID NO: 36766 - DNA, 1467 bp, Vibrio vulnificus CMCP6
  CDS (1)..(1467): transl_table=11
atgagcttaattattgcgttattagggctggtgtttgctggccgtttgatcttgaagaattacaacccgcaagcggtcctattctttactgggattgtgttgatggcgatctccatcttcaccaacaacgccagctttgttgcgaaatcgaccggttgggtgggcttcgacatttttgagtacatcagccaagtgtttagcaagcaaagtggtggtttgggtttgaacatcatgctgattggtggttttgcgctgttcatgtcggccattggcgccagtcaggtgatggtcaaagtggcagctaagccgttgatgaagctcaattcaccctatttgatgctggcgttggccttcattcttggtcaagctttgtcgctgtttatctcaagcgcgacggggttagctctgctgcttatggcgacgttatacccagtgttgattcgcttgggctgtagcaaagcgggcgtggcggcggtgctggccagtacctgtgcgattgagtttggcccagcgtcaggtaactcgattcttgccgcgcaaactgcgggcatggacatcacggcgttttttgttggcgagcagctgccgattgtcactgtgctgatcatcgctgtggcactgattcacgccttaacgcagcgctactttgacagattggatgagaagtcgaatgccgagcaagactcgctggctcacgtggacgatgcacaaagtgatgcccccatgttctatttgctgctgccgatgttgccgctgttcttcatgctgactttcagcaaattgggcattgagagcattaaggtgagcttagccaatgcgattttgctgagtattttcattggattggtgtgcgagtttgttcgagtcaaacaagccaaaccggtgtttgacaagcttcaaggcatcttcaatgacatgggtaaggtgttcgcagcagtagtgaccttgattgtcgcgggtcagacgttttcgatgggtttgaaatcgattggtgccattgatgccatgcttgagatggccagcggggcgggcctatctgccgccatcatcatcctgtttatggcgatcttaaccttcaccatttctgccttaatgggctcggggaatgcagcctttttctcctttgctcctatggtgccgcaaatcgcgcagaaaattggtgccaacgcggcagacatgattttgcctatccagctttctgcgggaatggggcgtacaatctctcccatcgccggggtgatcatcgcggttgctggtatttctgggctctcgccttttgatatcgtgcgcagaacctttatcccgatgtttattggctggctattgatgttggcgatgacgtttgcacgtggcggccaactgatgcaactgttgccgttcttggtgctgatgctagtggccgtcggcgttggtgcatggctgttgcgtaagcgcaaagccgttcaaccagagcaggcgtctgcgtag

SEQ ID NO: 36767 - protein, 488 aa, Vibrio vulnificus CMCP6
MSLIIALLGLVFAGRLILKNYNPQAVLFFTGIVLMAISIFTNNASFVAKSTGWVGFDIFEYISQVFSKQSGGLGLNIMLIGGFALFMSAIGASQVMVKVAAKPLMKLNSPYLMLALAFILGQALSLFISSATGLALLLMATLYPVLIRLGCSKAGVAAVLASTCAIEFGPASGNSILAAQTAGMDITAFFVGEQLPIVTVLIIAVALIHALTQRYFDRLDEKSNAEQDSLAHVDDAQSDAPMFYLLLPMLPLFFMLTFSKLGIESIKVSLANAILLSIFIGLVCEFVRVKQAKPVFDKLQGIFNDMGKVFAAVVTLIVAGQTFSMGLKSIGAIDAMLEMASGAGLSAAIIILFMAILTFTISALMGSGNAAFFSFAPMVPQIAQKIGANAADMILPIQLSAGMGRTISPIAGVIIAVAGISGLSPFDIVRRTFIPMFIGWLLMLAMTFARGGQLMQLLPFLVLMLVAVGVGAWLLRKRKAVQPEQASA

SEQ ID NO: 36768 - DNA, 1308 bp, Pseudomonas syringae pv. tomato str. DC3000
  CDS (1)..(1308): transl_table=11
atgctgactttccttggctttgccatggtcattgcgttcatgtacctgatcatgagcaagcgcctgactgcgctgatcgccctgattctggtcccgatcatcttcgccctgttcggcggctttgccgcgcagatcggcccgatgatgctcgctggtattaccaagcttgcgccgaccggcgtgatgctgatgttcgccattctgtactttgcgctgatgatcgactccggcctgttcgacccggccgtgcgcaagatcctgaaaatggtcaaaggcgacccggtgcgcatctcggtcggtactgccgtgctggcgctggtggtgtccctcgacggtgacggcgcaaccacctacatgatctgcgtggccgccatgctgccgctgtacagtcgcgttggcatgagcccgcggatcatggccggtctgatcattctggccggtggcgtgatgaacatgacgccctggggcggcccgaccgctcgtgcggccagcgccctgcatgtcgatgcatcggatatcttcgtaccgatgatccccgccatgctggccggtgtggttgcgattctggcaattgcctacttctacggcaaacgcgaacgcgctcgtcttggcgaactgcatcttaaaggcgatgaagtcgatcacagcgaaatcagcgtctcgcagttcccggatgcccgccgtccaaaactgatctggttcaacggcgcactgaccctcgcactgatggtcgccctgatcatgggcctgttgccactgccggtcctgttcatgatcgcgttcagtatcgcgatgatcatcaactacccgaacctgcaggaccagaaagaccgtgtttcggctcacgccggtagcgttctggcggtggtcggcctgatcttcgcggcgggtatcttcaccggtattctgaccggcaccggcatggtcgatgcgatgtcgaaaagcctgctggcagtgatcccggacgcgctgggcccttacctcgccgtcatcaccgcgctggtcagcatgccgttcaccttcttcatgtctaacgatgcgttctactacggcgtattgccggtgctgtcggaagccgctgcccactacggcatcagcccggtcgaaatggcccgcgcttcgatcgtcggtcagccggttcacctgctcagcccgctggtgccatcgacttacctgctggttgcgctggccggtatcgagttcggcgaccaccagcgcttcactctgaaatgggcggttctggtgtgcatgtgcatcctggttgcggcgctgctgatgggtatcttcccgttctatagcagcatgtaa

SEQ ID NO: 36769 - protein, 435 aa, Pseudomonas syringae pv. tomato str. DC3000
MLTFLGFAMVIAFMYLIMSKRLTALIALILVPIIFALFGGFAAQIGPMMLAGITKLAPTGVMLMFAILYFALMIDSGLFDPAVRKILKMVKGDPVRISVGTAVLALVVSLDGDGATTYMICVAAMLPLYSRVGMSPRIMAGLIILAGGVMNMTPWGGPTARAASALHVDASDIFVPMIPAMLAGVVAILAIAYFYGKRERARLGELHLKGDEVDHSEISVSQFPDARRPKLIWFNGALTLALMVALIMGLLPLPVLFMIAFSIAMIINYPNLQDQKDRVSAHAGSVLAVVGLIFAAGIFTGILTGTGMVDAMSKSLLAVIPDALGPYLAVITALVSMPFTFFMSNDAFYYGVLPVLSEAAAHYGISPVEMARASIVGQPVHLLSPLVPSTYLLVALAGIEFGDHQRFTLKWAVLVCMCILVAALLMGIFPFYSSM

SEQ ID NO: 36770 - DNA, 1368 bp, Vibrio parahaemolyticus RIMD 2210633
  CDS (1)..(1368): transl_table=11
atgctagagctcttaattggcttggtagtaaccattgcggtgggctatttcattgtcaaaggttacaaggcagctggcgtacttttaaccgccggtatcagtttgcttcttatgactggctttttgggccatgacgttctgccatcaagcatcacctcaaccggtaacatggtgacagactcgctagaatacgtgaaatacatgctgcaataccgtggcggcggccttggtatgcaaatcatgttgctatgtggtttcgcctcttacatgactcacatcggcgcgaacaacgttgtcgtgaaacagttctctaaaccgctttctgttatcaagtctccttatgtccttttggtagcggcttacattgtggcgtgtttgatgtctctagcggtgagctctgcaacaggtcttggcgttctattgatggctaccctattcccaatgatggttgcgatgggtatctctcgtcctgcggctgtggcagtgtgtgcatctcctgctgctattattctttctcctacttcaggtgacgttgttattgctgcagaaaagtctggcttggcgctagatgtgtttgcggtacaaactgttcttcctgtttcgatttgtgcaatcgtcgtaatggcggcagcagctttcttctggaacaaatacctagataagaaagaaaatacgccgatggaaaaaatcgacgtatcagaaattaaagcagatgcaccagcgttttacgcagcactaccattcttaccaatcatcggtgtgttcctatttaatggccgtacgattcctggtcttagtctagatatctacaccatcgttgtgggttctattttccttggcgcacttatccattatgtcgtgaacaaattcgacggcaaaaaagcgcttgaagatttggattcatgctacgcaggcatggccgatgcatttaaaggcgttgtgatgttgttggttgcggcaggcgtatttgcacaaggtctgatgtctattggtgctatcgataatctacttcaccttgccgataacgcaggtgcgggtggcgttgcactaatgctgatcctaacaggtctaaccgttgcagcggctattgctactggttctggtaacgcgcctttctatgcgtttgtagaacttgcgccttctctagcagcgaaaatgggcatcaacccagcgttcctaatcatcccaatgcttcaagcatcaaacctaggtcgtaccatttcgccagtatctggcgtaatcgttgcgacatcaggtatggcgaacatcagcccatttgaagttgtaaaacgcacttcagtgcctgtgcttgctggcctattgacggtaatcatcggtactatggtacttgttccgatgacagcttag

SEQ ID NO: 36771 - protein, 455 aa, Vibrio parahaemolyticus RIMD 2210633
MLELLIGLVVTIAVGYFIVKGYKAAGVLLTAGISLLLMTGFLGHDVLPSSITSTGNMVTDSLEYVKYMLQYRGGGLGMQIMLLCGFASYMTHIGANNVVVKQFSKPLSVIKSPYVLLVAAYIVACLMSLAVSSATGLGVLLMATLFPMMVAMGISRPAAVAVCASPAAIILSPTSGDVVIAAEKSGLALDVFAVQTVLPVSICAIVVMAAAAFFWNKYLDKKENTPMEKIDVSEIKADAPAFYAALPFLPIIGVFLFNGRTIPGLSLDIYTIVVGSIFLGALIHYVVNKFDGKKALEDLDSCYAGMADAFKGVVMLLVAAGVFAQGLMSIGAIDNLLHLADNAGAGGVALMLILTGLTVAAAIATGSGNAPFYAFVELAPSLAAKMGINPAFLIIPMLQASNLGRTISPVSGVIVATSGMANISPFEVVKRTSVPVLAGLLTVIIGTMVLVPMTA

SEQ ID NO: 36772 - DNA, 1386 bp, Salmonella enterica subsp. enterica serovar Typhi Ty2
  CDS (1)..(1386): transl_table=11
atgctaacagttatagagctccttatcggagtcgtcgttattgtgggtgtagcacgctacatcattaagggatattccgccactggcgttttatttgtcggcggtctggttctgcttattatcagcgcgctgatggggcataaggtattacctgccagcgaaaccagtaccggctataccgcaacagatattgttgaatacatcaaaattttgcttatgagtcgcggcggcgatcttggcatgatgatcatgatgctgtgcggctttgccgcctatatgacgcatatcggcgcaaatgatatggtcgtgaagctggcgtcgaaacctttacagtatataaactcgccctacctgttgatgattgccgcctattttgtcgcctgcctgatgtcgctggccgtctcttccgcgacggggcttggcgtactgctcatggctactctcttcccggtgatggtcaacgtcggcattagccgcggcgcggcggcggctatttgcgcttcgccggccgccatcatcctctcgccaacgtctggcgatgtggttttagccgcaaaagcggcggagatgccgttaatcgatttcgcgttcaaaaccacgctgccgatttccatcgccgccattatcggtatggcgattgcgcattttttctggcaacgctatctggataaaaaagagaacatttcacatgagatgctggacgtggcggagattaccaccacggccccggcgttttatgcccttttgccgttcacgcccattatcggcgtactgatttttgacggtaaatgggggccgcagttgcacattattaccattctggtcatctgtatgctgctggccgccgtgctggaattcgtgcgcggcttcaacacgcaaaatgtgttttccggcctggaagtggcttatcgcggcatggcggatgcgtttgccggcgttgtgatgctgctggtcgcggcgggcgttttcgcccaggggctgagcaccattggctttatccaaagtctgatctcgattgccacttcttttgggtccgccagcattattctgatgctggtcttagtgattttaaccatgctggccgcgatgaccaccggttcaggcaatgcgcctttttacgcctttgttgagatgatccctaaactggcgcactcctccggtatcaacccagcctatttatccatcccaatgctgcaagcctcaaacctggggcgcacgatttcgccggtctccggcgtcgtggtcgctgtcgccgggatggctaaaatatcaccgtttgaagtggtgaagcgcacgtccgttccggtcatcgtcggtctgttgatcgtcattatcgctacggaaattatggtgccaggcgcctcttccgccgtcaccggcggctga

SEQ ID NO: 36773 - protein, 461 aa, Salmonella enterica subsp. enterica serovar Typhi Ty2
MLTVIELLIGVVVIVGVARYIIKGYSATGVLFVGGLVLLIISALMGHKVLPASETSTGYTATDIVEYIKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILSPTSGDVVLAAKAAEMPLIDFAFKTTLPISIAAIIGMAIAHFFWQRYLDKKENISHEMLDVAEITTTAPAFYALLPFTPIIGVLIFDGKWGPQLHIITILVICMLLAAVLEFVRGFNTQNVFSGLEVAYRGMADAFAGVVMLLVAAGVFAQGLSTIGFIQSLISIATSFGSASIILMLVLVILTMLAAMTTGSGNAPFYAFVEMIPKLAHSSGINPAYLSIPMLQASNLGRTISPVSGVVVAVAGMAKISPFEVVKRTSVPVIVGLLIVIIATEIMVPGASSAVTGG

SEQ ID NO: 36774 - DNA, 1374 bp, Enterococcus faecalis V583
  CDS (1)..(1374): transl_table=11
atgattgaaagtttattggtattggtcgttttagttgttgtagcctatttgattgtaaaaaattatcatcccgcactcagcttaattattggtgcgcttgttctacttgcatgtgcatggatgttagggcatcccatttatcctgcaggagaaggaaccggttttggattatttgatattttcttgaagtttaaagatacaattattgcacaagtgagttcagcaggaattgtaattatgattctttttggttattcaggctatatgaatgcaatcggggccaatcagatggctgtcaactttttggtgaaaccattaatgaagattaaacgtaaatcgttatttgtccctgtggtctttttaattggaaatttaatgtcactagtagttcctagtgcatcaagtttagcgattattttaatgtctatattatatccgatgctagccagcatggggatttcatcattaactgctgcaggtgtgattgcaatgacggcaactatcatgccaacacctttaggcgcggataacgtaatcgccgcaaatacccttggttatgatgtgttaaattatgttgtatggaatgccaaaatttcgctgccatcgttattaatcattgcggttgcacagtacttctggcaaaaatactgcgataaaaaagaaggtgaggctgcctatgtctcattaaatgaagagggcttaagcaaacaaaaagaatttgatgttcctaaattttatgcaatattgccaatattaccgctattattaattgttggagtgggaatcgcaggaatgtttattaaaggaataacgatggatatttttgttcttacatttatttctttcttcatcgctgtattggttgagacgcttcgcttgaaatcttttaaaaaggttcaagatacagctgtcgagatgtttaaaggaatggggcaagggtttagtcaagttgtgatgcttgtcgtaggcggttcattattcacgtctgcgattcaaacgttaggaattattgatagtattatggcatctgtcgaagcatcaagttcagcaggaattgtcacgaccttaattttcagcggtgcaacgaccctttttggaattttaagcggtggtggtctggcaatgttttatgcggttatcgaactaatccctgggattgctgaaaaagctgggattgatggcatcttaatttccttgccaatgcagatgattgcgaatttaactagaacgatttctcctgtagcagcagttgtcatgattgtcgcatcaacagtaggagttagtcccatcagaattttaaaacggacgagtgtaccgaccatcattggcattattagtgtgattgtcttgtcgattctattgttaccttattaa

SEQ ID NO: 36775 - protein, 457 aa, Enterococcus faecalis V583
MIESLLVLVVLVVVAYLIVKNYHPALSLIIGALVLLACAWMLGHPIYPAGEGTGFGLFDIFLKFKDTIIAQVSSAGIVIMILFGYSGYMNAIGANQMAVNFLVKPLMKIKRKSLFVPVVFLIGNLMSLVVPSASSLAIILMSILYPMLASMGISSLTAAGVIAMTATIMPTPLGADNVIAANTLGYDVLNYVVWNAKISLPSLLIIAVAQYFWQKYCDKKEGEAAYVSLNEEGLSKQKEFDVPKFYAILPILPLLLIVGVGIAGMFIKGITMDIFVLTFISFFIAVLVETLRLKSFKKVQDTAVEMFKGMGQGFSQVVMLVVGGSLFTSAIQTLGIIDSIMASVEASSSAGIVTTLIFSGATTLFGILSGGGLAMFYAVIELIPGIAEKAGIDGILISLPMQMIANLTRTISPVAAVVMIVASTVGVSPIRILKRTSVPTIIGIISVIVLSILLLPY

SEQ ID NO: 36776 - DNA, 1344 bp, Haemophilus ducreyi 35000HP
  CDS (1)..(1344): transl_table=11
atgtcctcgatgttttttttacaatttgccatagttttactatgtattttaatcggtgcgcgtgtgggtggcatcggattaggtgtatttggtggtttaggtttagcgatcctctctttcggtttcgggttaaaacctgcgggcttgcctattgatgtcatgtttatgattatggcggttgtttctgcagctgctgcaatgcaagcggctggaggtttagattatatgatcaaaatcgccaccaaaatcctacgccgtaatcctaagtacattacttttatcgcgccattagtcacttgtacttttactgtattagcaggcacgggacacgtagcctattctgtcttacccgttattgcggaagtaagccgtcataatggtatccgcccagagcgccctctttctatggcggtgatcgcttcacaatttgcaattgttgctagccctatctccgctgccgtcgtggctgtagtggcattattagaaccacaaggtattacacttcctaatatattaatggtaacgattcctgctaccctattaggcttagcacttgcttgtgtattcgtgaataaaatgggtaaagaacttaaagatgatccagaatatcaacgccgtttgcaagatcctgaatatgtcaaagccaaccataccaacacagattcaacaaacatcgagcttaaaccaacggcaaaactttctgttagtttattcctattcggcgctttattagtggtattaatgggcgccgtgccatcattacgaccaatctttgatggcaagccaatgggaatggcacacaccattgaaattattatgctgacaataagtgccttaatcattttcttctgtaaaccaaatggtaacgaaattaccaaaggttctgtattccatgcaggtatgcgtgcagttatcgccatttttggtattgcctggttaggggatacattaatgcaaagccatataactgaagtgaaaagtatggtatcaggcctcgttgaaactgcgccttgggcatttgcttttgcgctctttattttatctatcttagtaaacagccaaggggcaaccgttgctacacttttcccattggcaattgctatcggtattcctgtacccgttctgattggggtctttgttgccgtaaatggttacttcttcattcctaactatggcccaatcattgcctcaattgactttgatactaccggcaccactaaaattggcaaatatattttcaaccatagctttatgctacctggtttattaagtatggtatttagtatctgctttggtttgctaatcgccaatatgctaccgagtttattaaatatgattatttaa

SEQ ID NO: 36777 - protein, 447 aa, Haemophilus ducreyi 35000HP
MSSMFFLQFAIVLLCILIGARVGGIGLGVFGGLGLAILSFGFGLKPAGLPIDVMFMIMAVVSAAAAMQAAGGLDYMIKIATKILRRNPKYITFIAPLVTCTFTVLAGTGHVAYSVLPVIAEVSRHNGIRPERPLSMAVIASQFAIVASPISAAVVAVVALLEPQGITLPNILMVTIPATLLGLALACVFVNKMGKELKDDPEYQRRLQDPEYVKANHTNTDSTNIELKPTAKLSVSLFLFGALLVVLMGAVPSLRPIFDGKPMGMAHTIEIIMLTISALIIFFCKPNGNEITKGSVFHAGMRAVIAIFGIAWLGDTLMQSHITEVKSMVSGLVETAPWAFAFALFILSILVNSQGATVATLFPLAIAIGIPVPVLIGVFVAVNGYFFIPNYGPIIASIDFDTTGTTKIGKYIFNHSFMLPGLLSMVFSICFGLLIANMLPSLLNMII

SEQ ID NO: 36778 - DNA, 1281 bp, Bordetella parapertussis 12822
  CDS (1)..(1281): transl_table=11
atgacgctggcaatctttgtcttcgtgctgctggcgggcctggccatcggcttgccggtcgcgtacgcgctgatcctcacgggcgtggcgctgatgtaccagctggacttctacgacgcccagatcgtggcccagaacctgctcaacggcgccgacagctttcccctgatggcggtgccgttcttcatgctcgccggcgcggtcatgaacgccggcggcctgtcggcgcgcatcgtcgacctggccctcaaactggtgggccacatcaagggcgggctgggatacgtcaccatcctggccgcctgcattctggccagcctgtcgggctcggcggccgccgatgcggcggccctgtcggccctgctggtgcccatgatgatgaaagccgggcacagccgcgcgcgctccagcgggctggtggcctcgtccggcatcatcgcgctggtcatccccccttccatcggcctggtgctgatcggcgtcaccggcaacatcagcatcaccggcctgttcatggccggcatcgtgcccgggatacttatgggcatgtcgctgtgcgtggcctggtggctgctgtcgcgcaaggaacggatccagcccctgccgcgggtggatcgtgccgaggtccggcagtcgctggtaagaagtttctgggccctgatgctgccggtcatcatcatcgtcggcctgcgcttcggcatcttcacgcccaccgaagcgggcgtggtggccgcggtgtacgccatcttcgtggccacctgcatttaccgcgaactgcccatgcgccggctctacgaggtcttcctgacctccgccaagatgaccgcgatggtgatgttcctggtggccggcgcgctcgtctcgggatggatgatcaccgttgccgggctgccggcgcaggtctccgacatcatcagccccttcagcgacacgccgaccttgctgatgctggtcatcatcggcctggtgatcgtgatcggcatggccatggacatgattcccatcgtcctgatcctgatccccgtgctgctgccttcggtgacggccgccggcatcgacccggtctacttcggcgtcgtcttcatgctggcctgcgccatcggactcatcacgccgccggtgggcgccgttctcaacgtggtggccggcgtgacgggcacccgcatggtcgaactcgtcaagggcgtctggccgttcctgctggcgcaatgcgcgaccctgctgctgctgatcccgtttccgcagctggtgctggccccgtatcgctggatcatgcattga

SEQ ID NO: 36779 - protein, 426 aa, Bordetella parapertussis 12822
MTLAIFVFVLLAGLAIGLPVAYALILTGVALMYQLDFYDAQIVAQNLLNGADSFPLMAVPFFMLAGAVMNAGGLSARIVDLALKLVGHIKGGLGYVTILAACILASLSGSAAADAAALSALLVPMMMKAGHSRARSSGLVASSGIIALVIPPSIGLVLIGVTGNISITGLFMAGIVPGILMGMSLCVAWWLLSRKERIQPLPRVDRAEVRQSLVRSFWALMLPVIIIVGLRFGIFTPTEAGVVAAVYAIFVATCIYRELPMRRLYEVFLTSAKMTAMVMFLVAGALVSGWMITVAGLPAQVSDIISPFSDTPTLLMLVIIGLVIVIGMAMDMIPIVLILIPVLLPSVTAAGIDPVYFGVVFMLACAIGLITPPVGAVLNVVAGVTGTRMVELVKGVWPFLLAQCATLLLLIPFPQLVLAPYRWIMH

SEQ ID NO: 36780 - DNA, 1281 bp, Bordetella bronchiseptica RB50
  CDS (1)..(1281): transl_table=11
atgacgctggcaatctttgtcttcgtgctgctggcgggcctggccatcggcttgccggtcgcgtacgcgctgatcctcacgggcgtggcgctgatgtaccagctggacttctacgacgcccagatcgtggcccagaacctgctcaacggcgccgacagctttcccctgatggcggtgccgttcttcatgctcgccggcgcggtcatgaacgccggcggcctgtcggcgcgcatcgtcgacctggccctcaaactggtgggccacatcaagggcgggctgggatacgtcaccatcctggccgcctgcattctggccagcctgtcgggctcggcggccgccgatgcggcggccctgtcggccctgctggtgcccatgatgatgaaagccgggcacagccgcgcgcgctccagcgggctggtggcctcgtccggcatcatcgcgctggtcatccccccttccatcggcctggtgctgatcggcgtcaccggcaacatcagcatcaccggcctgttcatggccggcatcgtgcccgggatactgatgggcatgtcgctgtgcgtggcctggtggctgctgtcgcgcaaggaacggatccagcccctgccgcgggtggatcgtgccgaggtccggcagtcgctggtaagaagtttctgggccctgatgctgccggtcatcatcatcgtcggcctgcgcttcggcatcttcacgcccaccgaagcgggcgtggtggccgcggtgtacgccatcttcgtggccacctgcatttaccgcgaactgcccatgcgccggctctacgaggtcttcctgacctccgccaagatgaccgcgatggtgatgttcctggtggccggcgcgctcgtctcgggatggatgatcaccgttgccgggctgccggcgcaggtctccgacatcatcagccccttcagcgacacgccgaccttgctgatgctggtcatcatcggcctggtgatcgtgatcggcatggccatggacatgattcccatcgtcctgatcctgatccccgtgctgctgccttcggtgacggccgccggcatcgacccggtctacttcggcgtcgtcttcatgctggcctgcgccatcggactcatcacgccgccggtgggcgccgttctcaacgtggtggccggcgtgacgggcacccgcatggtcgaactcgtcaagggcgtctggccgttcctgctggcgcaatgcgcgaccctgctgctgctgatcctgtttccgcagctggtgctggccccgtatcgctggatcatgcattga

SEQ ID NO: 36781 - protein, 426 aa, Bordetella bronchiseptica RB50
MTLAIFVFVLLAGLAIGLPVAYALILTGVALMYQLDFYDAQIVAQNLLNGADSFPLMAVPFFMLAGAVMNAGGLSARIVDLALKLVGHIKGGLGYVTILAACILASLSGSAAADAAALSALLVPMMMKAGHSRARSSGLVASSGIIALVIPPSIGLVLIGVTGNISITGLFMAGIVPGILMGMSLCVAWWLLSRKERIQPLPRVDRAEVRQSLVRSFWALMLPVIIIVGLRFGIFTPTEAGVVAAVYAIFVATCIYRELPMRRLYEVFLTSAKMTAMVMFLVAGALVSGWMITVAGLPAQVSDIISPFSDTPTLLMLVIIGLVIVIGMAMDMIPIVLILIPVLLPSVTAAGIDPVYFGVVFMLACAIGLITPPVGAVLNVVAGVTGTRMVELVKGVWPFLLAQCATLLLLILFPQLVLAPYRWIMH

SEQ ID NO: 36782 - DNA, 1371 bp, Vibrio vulnificus YJ016
  CDS (1)..(1371): transl_table=11
gtgaaacatatggtcgctttactcgcactgcccatcgtatttggcgcaggatttttaatcataaagaaatacaacactcaagccgtgctgtttggagcgggcattttgatgatgctgatcggtgtgatggcgggcgagccggattttttacccaaaggggtaaaaacatcgggtgcaacagtcgttgatttcttcctagttattcaatccatcagctcttccactctcgctaaactgggtttgatcattatggcggttgggggattctcaaaatacatggggcatatcggcgctgccaatgcccttgttaaagtcaccactaaacctctttctgtgatcagtaatccttacgtaattttggcgctagcctatcttctggggcaatttttaaacgtgtttatccctagcgcagttgggctggccatgttgttgttagttgccttgtacccagttctggtcagtattggttgtacgccagcttcagtcgcggctgtgttagcaacaaccgcttgtttggatttaggaccggcttctggggcctcgaataaagccgcagaagtgattggaattgatgccgcttcctactttgttgagcatcaactctttgttggcgtctgcactgcgttagtgattgccacattgcattttgttgctcaaaaatggttcgacaaacgtgatgagaagaacggtgtctcttatgaactgcaagaaaaagaagacacttcccgtgatgcgcccatttggtttgcggtgctccctgttcttcctctcgttctacttttaacctttagcaagtttgctatcacgtctatcaaaattgatgtcgtaaccgcgatgtttattagcttagcggtcgccatgctgtgtgattttatttactccaaaaatggcagagcagtcgcggcatcgctcaaagtttacctacaaggtatgggcgatgtgtttgccagcgttgtctctttgatcattgccgcgcagacctttgtgattggcttggaaggtatcggttttatctcaggaatgctgggggttgcgactcatcttgggtttggttataccatgatggtgattatgctcgtcggtattattggggtgacagcgctgatgtcaggatcgggtaacgcggctttcttcagcttctctaacttggcacctgaagtggcgacccatgttggcgtctctacggcggctcttgcattacctatgcagctttcagcggggatcttccgctcattttcacctgttgcgggggttgtgattgcttgtgctggagttgcaggcattcctccgattgaactggtcaaacgtacggctatcccaatgctgggtggtttggtgactgtgttagccatcacttttattggagcttag

SEQ ID NO: 36783 - protein, 456 aa, Vibrio vulnificus YJ016
MKHMVALLALPIVFGAGFLIIKKYNTQAVLFGAGILMMLIGVMAGEPDFLPKGVKTSGATVVDFFLVIQSISSSTLAKLGLIIMAVGGFSKYMGHIGAANALVKVTTKPLSVISNPYVILALAYLLGQFLNVFIPSAVGLAMLLLVALYPVLVSIGCTPASVAAVLATTACLDLGPASGASNKAAEVIGIDAASYFVEHQLFVGVCTALVIATLHFVAQKWFDKRDEKNGVSYELQEKEDTSRDAPIWFAVLPVLPLVLLLTFSKFAITSIKIDVVTAMFISLAVAMLCDFIYSKNGRAVAASLKVYLQGMGDVFASVVSLIIAAQTFVIGLEGIGFISGMLGVATHLGFGYTMMVIMLVGIIGVTALMSGSGNAAFFSFSNLAPEVATHVGVSTAALALPMQLSAGIFRSFSPVAGVVIACAGVAGIPPIELVKRTAIPMLGGLVTVLAITFIGA

SEQ ID NO: 36784 - DNA, 1380 bp, Vibrio vulnificus YJ016
  CDS (1)..(1380): transl_table=11
atggagatttctatgctagagctcttaattggactggtagtgaccgttgcggttggttacttcattgtcaagggttataaagcggcaggtgtgctactgaccgcgggtgttcttctactgatcctaacaggcgttcttggccacactgtcttgcctgccaaaatcacctcaacaggtaacatgatcacagactcattagagtacgtgaagtttatgctgcaaaatcgcggtggcggtttagggatgcagatcatgctactttgcggtttcgccgcttacatgacacatatcggcgcgaataatgtcgttgtaaaacagttttctaaacctctttccgtcattaaatcgccttacgttttgttggtagcagcctatattgttgcgtgcttaatgtctcttgccgtgagctctgcaactggtctgggtgtgcttttgatggcaacccttttcccaatgatgactgcaatggggatttctcgcccggcggcagcggccgtgtgtgcgtcacccgccgcgatcattttgtccccgacttctggtgacgttgttattgctgcggaaaaatcaggcctcgctttggatgtgtttgcagtgcaaaccgttttgcctgtctccatttgtgcaatcattgtcatgtcggtcgccgctttcttctggaacaaataccttgataagaaagacaacaccccaatggaaaagatcgatgtttcggaaatcaaagccgatgcacctgcattctatgcgctgcttccattcctaccgatcatcggtgttttcttatttaatggccgcacaattcctggattaagcctcgatatctataccattgttgtactgtcgatctttatcggtgctttggttcactacgtggtgaacaagtttgatggtaagaaatcacttgaagatctcgatgcgtgttacgacggcatggcagatgccttcaaaggcgttgtgatgttattagttgccgctggcgtatttgcccaaggccttatgtcgatcggcgcgattgacaaccttcttcatcttgcagaaaccgcaggtgcaggtggtatcgcgctcatgctgattttgactggtcttacggttgcagccgctattgcaacgggatcgggtaatgcccctttctacgcgtttgtggagctcgccccatctctggccgcaaaaatgggactgaatccagcattcttgattattccaatgttgcaagcctctaaccttggtcgcaccatttctcccgtttctggcgtggtggtggctacctctggtatggcacacatcagcccatttgaagtagtaaaacgcacttctgttcctgtgctagcgggcttgattaccgtcatccttggcacaatgatattggtaccaatgagcgcctaa

SEQ ID NO: 36785 - protein, 459 aa, Vibrio vulnificus YJ016
MEISMLELLIGLVVTVAVGYFIVKGYKAAGVLLTAGVLLLILTGVLGHTVLPAKITSTGNMITDSLEYVKFMLQNRGGGLGMQIMLLCGFAAYMTHIGANNVVVKQFSKPLSVIKSPYVLLVAAYIVACLMSLAVSSATGLGVLLMATLFPMMTAMGISRPAAAAVCASPAAIILSPTSGDVVIAAEKSGLALDVFAVQTVLPVSICAIIVMSVAAFFWNKYLDKKDNTPMEKIDVSEIKADAPAFYALLPFLPIIGVFLFNGRTIPGLSLDIYTIVVLSIFIGALVHYVVNKFDGKKSLEDLDACYDGMADAFKGVVMLLVAAGVFAQGLMSIGAIDNLLHLAETAGAGGIALMLILTGLTVAAAIATGSGNAPFYAFVELAPSLAAKMGLNPAFLIIPMLQASNLGRTISPVSGVVVATSGMAHISPFEVVKRTSVPVLAGLITVILGTMILVPMSA

SEQ ID NO: 36786 - DNA, 1290 bp, Vibrio vulnificus YJ016
  CDS (1)..(1290): transl_table=11
gtggttatggctggttcaatttttggttggctaggcttgctttttgctggcatgccagttggcttttctctgatttttgtggcgttggtttttcttattgttaccaacagcacaggtattaacttcgcagcgcagcagatgctgggcggcatcgataattttacgttattggccgtaccattcttcgtcctaacgggccatttgatgaacagtgccggtattacggagcgaatttttaactttgccaaatccatggttggccatatcacgggcagtctagggcatgtaaacatcatggcgagtttactcttttctggtatgtctggctctgcgcttgccgatgccggaggcttggggcagcttgaaatcaaatcgatgcgtgacgcgaaatacgatgatgactttgctggtggtctcacggcggcctcgtgcatcattggtccgcttgttccgccttctgtgccattggtgatttatggtgtagtgtccaacacatcgattggtgcgctgtttttagccggtgcaataccaggcattttgtgctgcgtggctttgatggtgatgagctatttcatctgtaagaaacgtggctacatgaccttgccaaaagcgtcgagaaaggagcagttcacatcgttcaaagaggcatttctttctctaatgactccggtcatcatcattggcgggatcttttcgggtaagttcaccccgacggaggcggcagtggtttcctctctttacgctttgttccttggtaccgtggtgtacaaacagctgaccttgacggggtttgtggaaattcttcgcgaaacggtgaataccaccgccgttgttgccttgatggtgatgggggtaacggtgtttggctggatcgtggcgcgtgagcaattaccacagatgcttgcggattatttcttgtcgatcagtgaaaacccattggtactactgctactcatcaacttgctcttactgtttttgggaaccttcattgaatcactcgcgctattgctattgctggttccatttttagtcccagtggcatcggcggtcgggattgaccctgtgcactttggtgttatggctattttgaacttgatgatcggcattctcacgccaccaatgggcatggctttatatgtggtatcacgtgtcggagacattccatttcataccttaactcgaggcgtacttcctcttctggtgccattgtttattgtgctggcgttggtggcggtattccctcaaatcaccttgctattgcctgagctgcttttgggttacggacaataa

SEQ ID NO: 36787 - protein, 429 aa, Vibrio vulnificus YJ016
MVMAGSIFGWLGLLFAGMPVGFSLIFVALVFLIVTNSTGINFAAQQMLGGIDNFTLLAVPFFVLTGHLMNSAGITERIFNFAKSMVGHITGSLGHVNIMASLLFSGMSGSALADAGGLGQLEIKSMRDAKYDDDFAGGLTAASCIIGPLVPPSVPLVIYGVVSNTSIGALFLAGAIPGILCCVALMVMSYFICKKRGYMTLPKASRKEQFTSFKEAFLSLMTPVIIIGGIFSGKFTPTEAAVVSSLYALFLGTVVYKQLTLTGFVEILRETVNTTAVVALMVMGVTVFGWIVAREQLPQMLADYFLSISENPLVLLLLINLLLLFLGTFIESLALLLLLVPFLVPVASAVGIDPVHFGVMAILNLMIGILTPPMGMALYVVSRVGDIPFHTLTRGVLPLLVPLFIVLALVAVFPQITLLLPELLLGYGQ

SEQ ID NO: 36788 - DNA, 1413 bp, Corynebacterium diphtheriae NCTC 13129
  CDS (1)..(1413): transl_table=11
gtgctttatcttctcatagccctcatttccttcgccgcagtgatgtacctaattatcaagaaagtcaacgctgctgctgcgattttcttcgtgggtgtacttcttcttatgattgcggctatttctgggaaggccgaaccgtcagtagaaattaaaccatctggtaatagtttttacgatgagctgcttgtcatcgaggcactttttaaatccagattttctggtattggcatggccatcatggtgctctttggttttgtctcctacatgcgcacaatcggtgccgacgccaaagcagtcgttcttttgtccgcaccactccaaaaaatgcgcggttcttactggatggtaccgatcggttttaccattggaactgcgttgtccctgattgtgccatcagcgtccgcactttctctgctattggtcgctaccctattaccagcactcgtcgcagccggtctcaccccactcaccgtggccgctatcatcgtcacctcatcaaccatcgtagctacacctttggaagctggacttatccaaggtgctgatctcgtgggtatgccaatttcagaatatgtgtacggcaacgttgctaaggccactattccaactcttgtgatcactgcttttgtccacatggcttggcaacatcattgcgacaaagtagacgcacgcaaatcagcacttcccacaagtgatgctccttcgattcagcatgacacgtcagcagttgacgacgcgctccggcgcgccgctggcctccccgcatactatgccctactccccttgcttccactccttctcattttggtgacagccgtcttacatcgcgcagacctactatcttttgaagctggcattttgccggtgacaattgtgtcactattcatttcgctgataatcgaagccatccggcatcgaagcctcatgaatgcactagaaacagtgaaactcttttttaaaggcatgggagaaggcgctgcgggtgtggtcgcactattggttgcagctgcggtactcgtcgagggcgtaacccagctaggcgtgatcgatatgctgattaatgctactgaaggatcctctggcgctactgtgattatcattttggcattcgtagcttcaacagcacttatgtcagctttaacgggatctggcactgccccttacttcgcattctctgaagtcgtaccgtcacttgcagcccagactggtgttctccccgttcaaatgcttacggcaatttggggaacgtcgaatttgatgcgccaggtgtcccccgtcaacgcggcagtcattattgtttcgactgcgattaatgtcagccctatcaaactcgtcaaacgtacatctgtaccgatgattgttgccacgattttgaacgttgtgtttgcattccttttcattcacgtttag

SEQ ID NO: 36789 - protein, 470 aa, Corynebacterium diphtheriae NCTC 13129
MLYLLIALISFAAVMYLIIKKVNAAAAIFFVGVLLLMIAAISGKAEPSVEIKPSGNSFYDELLVIEALFKSRFSGIGMAIMVLFGFVSYMRTIGADAKAVVLLSAPLQKMRGSYWMVPIGFTIGTALSLIVPSASALSLLLVATLLPALVAAGLTPLTVAAIIVTSSTIVATPLEAGLIQGADLVGMPISEYVYGNVAKATIPTLVITAFVHMAWQHHCDKVDARKSALPTSDAPSIQHDTSAVDDALRRAAGLPAYYALLPLLPLLLILVTAVLHRADLLSFEAGILPVTIVSLFISLIIEAIRHRSLMNALETVKLFFKGMGEGAAGVVALLVAAAVLVEGVTQLGVIDMLINATEGSSGATVIIILAFVASTALMSALTGSGTAPYFAFSEVVPSLAAQTGVLPVQMLTAIWGTSNLMRQVSPVNAAVIIVSTAINVSPIKLVKRTSVPMIVATILNVVFAFLFIHV

SEQ ID NO: 36790 - DNA, 1296 bp, Wolbachia endosymbiont of Drosophila melanogaster
  CDS (1)..(1296): transl_table=11
atgttttatcttacaaattttttgcctattttactgttcctatttctttttgtaggaagtggtatatattttactattcttggcgtgtcaaatgctttttatcagttatctccactggtagccattgttcctgccatagctctgggttgggttttatacaagggcaatactgaagaaaaaatgtatgcctttctagatggggtaagagatcgtaatattatcactatgtgtatcattttcttacttgcaggtgcattcagtgaagtaactaaagcaatcggtagtgctgatgccacagttaatttggctctttcatttataccaacacaatttttactcataggattattttttgtagcagctttcatctccactgctattggtacatcaatgggcaccattgcaacaattgctcctattgcagttgaactgacacaagctgggatttctccttccttaggagttgcaaccgttgtaggaggagcaatgtttggcgacaatttatctattatctctgatactacaattgcatctgtgatgtctcaaaaggctgatataaagaaaaaattaaaactgaatgcaaaagtggcactaattgcttctatattcacaataattatattattttatagctcaagcaatagtgctgctatttcagttaaggagtattctttattgcttgtgactccttacataatacttatattgcttgcaaactttggaataaatgtatttacggcattggttttaagcataacttttgctggaatcattggatttataaataacaacaatcatggtttattgtttttaagccaaaacatcaccaaagggtttatgagtatgcatgaaattatgctactgtcattgatggttggcgggctttcaggactggtaggtaaaaattctaaggagcttgcagataaactttcatcttgggttatgatacaacgtggtggacaaaaaactgcgcaattatttattgcaaaaatagtcagcatatttgatattttacttgcaaataacaccatcgctataatttttagtggtgaaattgctagagatattgctaagaaatatgaaataccgcctcactatagtgcagcatggctaggcatattttcttgtgtatttcaaggattaataccgtatggcgctcaattgcttttggctagcactattgctggagtttcacctttggcagtcgtgccacacgtatactattgctatgttttaggtattattgcagtgttatatattgtattgaacaaaattgagaaaaaagattgtgcttaa

SEQ ID NO: 36791 - protein, 431 aa, Wolbachia endosymbiont of Drosophila melanogaster
MFYLTNFLPILLFLFLFVGSGIYFTILGVSNAFYQLSPLVAIVPAIALGWVLYKGNTEEKMYAFLDGVRDRNIITMCIIFLLAGAFSEVTKAIGSADATVNLALSFIPTQFLLIGLFFVAAFISTAIGTSMGTIATIAPIAVELTQAGISPSLGVATVVGGAMFGDNLSIISDTTIASVMSQKADIKKKLKLNAKVALIASIFTIIILFYSSSNSAAISVKEYSLLLVTPYIILILLANFGINVFTALVLSITFAGIIGFINNNNHGLLFLSQNITKGFMSMHEIMLLSLMVGGLSGLVGKNSKELADKLSSWVMIQRGGQKTAQLFIAKIVSIFDILLANNTIAIIFSGEIARDIAKKYEIPPHYSAAWLGIFSCVFQGLIPYGAQLLLASTIAGVSPLAVVPHVYYCYVLGIIAVLYIVLNKIEKKDCA

SEQ ID NO: 36792 - DNA, 1353 bp, Erwinia carotovora subsp. atroseptica SCRI1043
  CDS (1)..(1353): transl_table=11
atgctcgaacttttgattggtgttgctgtaacgattctggttggtcgttacattataaaagggtactccgcgacgggcgtgttgctggtgggaggcctcttactcttggcaatcagtgccatgctgggcaaaaacatattgccagccagtgtgaaggcgacgggctggagtgctacggatatttttgaatacgtaaaaattttgctgatgagccgtggtggcgatctcggcatgatgattatggtgctgtgtgggtttgcggcttacatgacgcacatcggggcgaatgatgtcgtcgttaagctggtttcgcgaccgcttaaaatgatcaactcgccttatttgctgatgattgcggcctattttgtcgcctgtttgatgtcgctggcggtgtcatcggccactgggctgggtgtgttattaatggcaacgctgttccctgtcatggtgaatgtcgggattagccgcggtgccgctgcggcaatctgcgcatcccctgtggcgttgatcctgtcgccaacgtcgggcgacgtggtgcttgctgcgcaggcatcgcagatgaaattagtggatttcgcctttaaggctacgctgcccatatccatcattgctatcgtgtgcatggccgtcgcgcatttcttctggcagcgctatttggacaacaaagagaatgctagtcatgagattctggatgtcagcgagatcacgacgaatactccgcgtttttacgccattctgccgtttacgcctatcatgggcgtactggtatttgatggcaaatgggggccggagcttcacattatcaccgtactggttatttgtatggtgttggccgcggtgctggaatttgtccgttcattcaatgcgaaaaaagtatttgatgggttagatgtagcttatcgcggcatggccgatgctttctctagcgtcgtaatcctgctggttgctgctggtgtttttgctcagggacttggcacaattggctttatcagcggactgattggcctcgcgcagtcatttggcagcggtgggttggtgattatgctggtgctggtggtaatcacgatgctggcggcgatgacgacgggttctggcaatgcgccgttctatgcgtttgttgagctgattccaaagctggcgtcacaaatgggtatcaaccctgcctatctggccattccgatgcttcaggcttccaatttaggacgtaccatttctccggtatccggcgtggtggttgcggtggcggggatggcgaagatatcgccgtttgaggtggtgaagcgcacatctgttcctgttctggtcgggctgattgtggtggtggttgccacagaaattatgatacccgcctga

SEQ ID NO: 36793 - protein, 450 aa, Erwinia carotovora subsp. atroseptica SCRI1043
MLELLIGVAVTILVGRYIIKGYSATGVLLVGGLLLLAISAMLGKNILPASVKATGWSATDIFEYVKILLMSRGGDLGMMIMVLCGFAAYMTHIGANDVVVKLVSRPLKMINSPYLLMIAAYFVACLMSLAVSSATGLGVLLMATLFPVMVNVGISRGAAAAICASPVALILSPTSGDVVLAAQASQMKLVDFAFKATLPISIIAIVCMAVAHFFWQRYLDNKENASHEILDVSEITTNTPRFYAILPFTPIMGVLVFDGKWGPELHIITVLVICMVLAAVLEFVRSFNAKKVFDGLDVAYRGMADAFSSVVILLVAAGVFAQGLGTIGFISGLIGLAQSFGSGGLVIMLVLVVITMLAAMTTGSGNAPFYAFVELIPKLASQMGINPAYLAIPMLQASNLGRTISPVSGVVVAVAGMAKISPFEVVKRTSVPVLVGLIVVVVATEIMIPA

SEQ ID NO: 36794 - DNA, 1287 bp, Desulfotalea psychrophila LSv54
  CDS (1)..(1287): transl_table=11
atgagtatgtctgtaacagctgttttattttgctcttttgcgggattactgcttttgggagcacccattaccgtggcgcttggcgtttctgccatggtgtcatttatggtcgtggggcaggatcttggaaccctcattcaaattgcctttacctcggtaaactcctttcctattatggctctgcccgcctttgttttggccggggccttgatggataaggctggtgtttccaagagacttgtcaccgtggctgaaaagatggtaggtcccattcccggtggtcttgctgtttctactgccctcgcctgtgtcttctttggcgcaatttcaggttccggccctgcgacaactgcagcggttggcatgttgatgattcctgccatggtcaataagggttatgataagggatatgctgcggcagctactgctacagcgggtggtgtaggtattattattcctccaagtattccaatggttatctatggtgtagcctctcaggaatctatcaccagaatgtttcttggtggtgttgttcccggtttgatcatcagtcttggcctctgtgcaatgcatctctggatgtgtcgtaagatgaagcctgctgaaggggatgaggcgtggtcagctcaagagctgattaaatctgttaaggatggcttttgggctatcatggccccggttgttatcctcggtggtatctatactggtatctttacccctacagaggctgctatcgtagcaatcttctatgtgctctttgtcggtatctttatttatcgtgaacttaccttcaagtctgtgcagaaatgtctcgagaccacctcttggattaccggtcgtgttcttgttatcatgtttaccgcctatgcctttggtcgtttgctcattcagtaccgtattcccaatcagatcgtagagtggcttttgaccatgacaaccaatgtaaatctggtttggatatttgttcttatccttctccttttctttggtatgttcatggagaccctggccatcatcctcttggtaactcctgtactgcttcctgtaatgacagcatttggggttgacccaattcactttggtgttgttctggtttgttgttgtggtgttggtttctctacaccgcctctgggggaaaatatatttattgcctcgggtattgccgatgtctcaattgagaaaatttccgtgaaggccctgcccttctgtgcggttaccatcggtgtgattctgttgatcaccttctgcccgcaaatcgtactgtggttgcctaatttgttgatgtag

SEQ ID NO: 36795 - protein, 428 aa, Desulfotalea psychrophila LSv54
MSMSVTAVLFCSFAGLLLLGAPITVALGVSAMVSFMVVGQDLGTLIQIAFTSVNSFPIMALPAFVLAGALMDKAGVSKRLVTVAEKMVGPIPGGLAVSTALACVFFGAISGSGPATTAAVGMLMIPAMVNKGYDKGYAAAATATAGGVGIIIPPSIPMVIYGVASQESITRMFLGGVVPGLIISLGLCAMHLWMCRKMKPAEGDEAWSAQELIKSVKDGFWAIMAPVVILGGIYTGIFTPTEAAIVAIFYVLFVGIFIYRELTFKSVQKCLETTSWITGRVLVIMFTAYAFGRLLIQYRIPNQIVEWLLTMTTNVNLVWIFVLILLLFFGMFMETLAIILLVTPVLLPVMTAFGVDPIHFGVVLVCCCGVGFSTPPLGENIFIASGIADVSIEKISVKALPFCAVTIGVILLITFCPQIVLWLPNLLM

SEQ ID NO: 36796 - DNA, 1869 bp, Desulfotalea psychrophila LSv54
  CDS (1)..(1869): transl_table=11
atgtcttcagcgacaccaccacagatgccggcggccaataaaaattggatgcattggcttgatgataattttgaaaagccctttcttatcttgggaatgctctctatcattctcatcagtgtcttccaaacctcctaccgttatatcggcgtacctcttggtgctgacccgagtgctggtgtttggaccgaagaacttgcccgttttatctttatctggatctcttatctggcagttcccatagcgatcaagaatcgaagtaatattcgagttgatattgtttatgatcgccttcctccgcgtttgcaacggataagctgggttgtggttgatgtcttctttttgatcctcacttcagtaattttgtatatgggtatcaagcatatcggtatgcagatcagatatccacagactacagcagccttgcaaataccgtactatataccctatttgattctgcccattgcctttggcctgatgtctctgcgcctgcttcaggatcttttcaagcaggttaaggaaacgggtattcttgattcacttgttggtgtggggctctgtgctgctatctctttgcctataatcttatttagtggctttaacgtattgtcagtgctctttggctactttgccctctttttggtaattggtgtgcccattgccatcagtcttggccttgcagctcttgccaccgttgtggccaacggctctctccccattgagtatgtggcgcaggtgagttttacctccattgatagctttcccatcatggcaattccattttttattgctgccggtgtgttcatgggctgtggtgggctttcccgccgtctactggatcttgccgatgaacttctcggtgccctgcccggtggtctggcccttgcgaccattgcaacctgtatgttctttgccgcaatctctggttctggccctgcaaccgttgctgcaattggctccctgaccattcctgccatgatggcacgtggctatgataagtacttttcctgtgccgttgtggcaaccgccggtgcgatcggggtaatgattcctccatccaacccctttgtcgtctacggtgtttccgcccaggtatcggtaggtgatctctttattgccggtattgttcccggtcttcttaccggacttgccctgatggtttttagtttcttttattcgaagaagcgtggctggaagggtgaggtgaaagaacgtaattttaagacatttgctcgggcattttgggatgcaaagcttgccctgatggtaccggtgattgttctcggtggtatctacggtggtatcatgacccccaccgaagccgctgccgttgcagccttctacggtttggttgttggtatctttgtctaccgcgagctgaacatgaagaatctggctcctgcctttattgaggcctgttcaacctcggcgattgttattgtccttatggccatggccaagatttttggtaacgtcatgaccgtggagcaggtaccggctatgattgccgacttcattcttggcatgacttccaataaaattgttatcctgctcttgatcaacgttctgcttctggtcgttggtacctttatggaggccctggcagccattgttattttggtacccatcctcctgccgattgtcatgaaggtaggtgttgatccactgcattttggtatcatcatggtggtcaacctggccattggttttgttaccccgcctgttggggtcaacctctttgttgccgctggggttgctaatgttaagattgagcaggtctccaaggttgttattccatttttgggcgtcatgatattggtactgcttgctgtaacctttattccgcaactctccctcttcatgatctag

SEQ ID NO: 36797 - protein, 622 aa, Desulfotalea psychrophila LSv54
MSSATPPQMPAANKNWMHWLDDNFEKPFLILGMLSIILISVFQTSYRYIGVPLGADPSAGVWTEELARFIFIWISYLAVPIAIKNRSNIRVDIVYDRLPPRLQRISWVVVDVFFLILTSVILYMGIKHIGMQIRYPQTTAALQIPYYIPYLILPIAFGLMSLRLLQDLFKQVKETGILDSLVGVGLCAAISLPIILFSGFNVLSVLFGYFALFLVIGVPIAISLGLAALATVVANGSLPIEYVAQVSFTSIDSFPIMAIPFFIAAGVFMGCGGLSRRLLDLADELLGALPGGLALATIATCMFFAAISGSGPATVAAIGSLTIPAMMARGYDKYFSCAVVATAGAIGVMIPPSNPFVVYGVSAQVSVGDLFIAGIVPGLLTGLALMVFSFFYSKKRGWKGEVKERNFKTFARAFWDAKLALMVPVIVLGGIYGGIMTPTEAAAVAAFYGLVVGIFVYRELNMKNLAPAFIEACSTSAIVIVLMAMAKIFGNVMTVEQVPAMIADFILGMTSNKIVILLLINVLLLVVGTFMEALAAIVILVPILLPIVMKVGVDPLHFGIIMVVNLAIGFVTPPVGVNLFVAAGVANVKIEQVSKVVIPFLGVMILVLLAVTFIPQLSLFMI

SEQ ID NO: 36798 - DNA, 1257 bp, Symbiobacterium thermophilum IAM 14863
  CDS (1)..(1257): transl_table=11
atgttgccgtgggttggcgtgctcatcgtcatcctcaccgtctacgcgatcctgaagcggtacgagacccgcctggtgctgttcaccgccggcctgctgatggcgctcatcgccctgaagccgatggaggccttcagccagttccagaagtcgatgaccaacgccggcctgatcagcgccatctgctcggtcatgggattcgcctacgtgatgaagctgacccagtgcgaccagcacctggtccacgcggtcgccaacaccgtcgcgcgggcgcgggcgatcctgatcccggcgaccaccatcgccaccttcctgatcaacatcgccctgcccagcgcggcgggctgcgccgccgccgtgggggcggtgatgatcccggtcctgatggccgccggcgtccacccggcggtggccgcggccgccgtgctcgcgggcaccttcggctccgtgctcagccccggcagctcccacatcgtgatggtcgccgagatgtccggcgcctcggtggtggacaccatcgccacggtcacgccggcgacggtggtcaccggcctgatcggcgccggcgtcctgaccatcctggcgttcctccgccgggaggaccgcgggcacgcctctgagaccgtgaccgaatccccgcaattccggcccaaccccctttatgccctggtcccgatcgttcccctggtgctgctggtgctgggcgcgacggtgccggcgatgaagaactggaggctcaccgtgcccgcgtgcatgctcatcggcaccattctcgccctgctcgtgacccgtatgaaccccgccgaggtgaccaagtccttcttcgacggcatgggcaaggcgtacggcgacgtcatcggcatcatcatcgccgcgggcgtgttcgccgcggggctgacccaggtgggcctcatcgacctgctgttgaacgcggccaccggggccaggggcgcgatcggggccgcggggacgtggggccccttcctggtggccatcctcagcggatccggtgacgccgccaccatagccttcaacgaggccgtcaccccccatgccgccagcttcggcctgaccatccccaagctggggacgctggcctccctggccggctcccttggccgctccatgagtcccgtcgcgggcgcggccatcatcgtctccggcatcgcgggcgtgagcccgatagaggtggcgaagcgcaacgcccccggcatgatcctggccagcgtcgtcgcgttcctcatgcaggggctctga

SEQ ID NO: 36799 - protein, 418 aa, Symbiobacterium thermophilum IAM 14863
MLPWVGVLIVILTVYAILKRYETRLVLFTAGLLMALIALKPMEAFSQFQKSMTNAGLISAICSVMGFAYVMKLTQCDQHLVHAVANTVARARAILIPATTIATFLINIALPSAAGCAAAVGAVMIPVLMAAGVHPAVAAAAVLAGTFGSVLSPGSSHIVMVAEMSGASVVDTIATVTPATVVTGLIGAGVLTILAFLRREDRGHASETVTESPQFRPNPLYALVPIVPLVLLVLGATVPAMKNWRLTVPACMLIGTILALLVTRMNPAEVTKSFFDGMGKAYGDVIGIIIAAGVFAAGLTQVGLIDLLLNAATGARGAIGAAGTWGPFLVAILSGSGDAATIAFNEAVTPHAASFGLTIPKLGTLASLAGSLGRSMSPVAGAAIIVSGIAGVSPIEVAKRNAPGMILASVVAFLMQGL

SEQ ID NO: 36800 - DNA, 1278 bp, Mannheimia succiniciproducens MBEL55E
  CDS (1)..(1278): transl_table=11
atgacggtcgtaatttttcttgctgttttattaggtgcgattattttaggtattcctgtcgccttctcattgcttgtgtgcggtgtggcgttaatggttcacctggatttattcgattcgcaaattttagcccaacaaatcgttagcggtgcggacagtttctccctgatggcgattccgttctttattcttgccggcgagctgatgaatgaagggggcttatccaaacgaattattgatttaccgatgaagcttgtcggtcataaacgcggcggattaggcttcgttgccatccttgccgccatgattatggcgagtctttccggttctgcggtggcggatacggcagcggttgccgctatgttgttgccgatgatgaaaaccaccggttatccggaagcccgttccgccggcttaatcggtaccgcagggattattgcgccgattattccgccgtccattccttttatcgttttcggggtggccagcggcgtatctatcaccaaattattcatggccggtattttcccgggcattatgatgggtatttgcttaggcatgctttggtggtggcaggcaaaacgcttaaatttaatgaccttttccaaagccaccagacaagatctttgtatctcctttaaaaacagtatttgggcattgttattaccggttattatcatcggcggattccgtaccggtatctttactccgacggaagccggtgccgtggcgactttctatgctttggtcgtttcaatgtttatttatcgcgaattaaaattcaaagatctttataaagtgctgttggccgctgctaaaacaaccgcagtggtaatgttcttggttgccgccgccaacgttaccggttggttaatcaccgttgccgaattaccggccatgttaaccgagttactcgaacctttacttggtaatccgacagtcttattgcttgttgtgatgttagcggtatttgttatcggtatggtaatggacttaaccccgaccgtgttgatcttaaccccggtattaatgccgttaattgaagaagcgggaatcgacccggtatatttcggcgtactatttatcctaaatacatccatcggcttaattacaccgcctgtgggcaacgtattaaacgtgattacgggtgtgtctaaacttccgtttgaccaagcggcgaaaggcatcttcccgtatttaatcatgatgattttattgcttttattatttgtattcgttccttcacttattctcgttccattaagttggatgttgtaa

SEQ ID NO: 36801 - protein, 425 aa, Mannheimia succiniciproducens MBEL55E
MTVVIFLAVLLGAIILGIPVAFSLLVCGVALMVHLDLFDSQILAQQIVSGADSFSLMAIPFFILAGELMNEGGLSKRIIDLPMKLVGHKRGGLGFVAILAAMIMASLSGSAVADTAAVAAMLLPMMKTTGYPEARSAGLIGTAGIIAPIIPPSIPFIVFGVASGVSITKLFMAGIFPGIMMGICLGMLWWWQAKRLNLMTFSKATRQDLCISFKNSIWALLLPVIIIGGFRTGIFTPTEAGAVATFYALVVSMFIYRELKFKDLYKVLLAAAKTTAVVMFLVAAANVTGWLITVAELPAMLTELLEPLLGNPTVLLLVVMLAVFVIGMVMDLTPTVLILTPVLMPLIEEAGIDPVYFGVLFILNTSIGLITPPVGNVLNVITGVSKLPFDQAAKGIFPYLIMMILLLLLFVFVPSLILVPLSWML

SEQ ID NO: 36802 - DNA, 1293 bp, Mannheimia succiniciproducens MBEL55E
  CDS (1)..(1293): transl_table=11
atggacgtgatcattcctatttcaattttattgattctctttgttattggtacgccggttgcattttgtattttctgttctacgctgacttatttcttaatgagccatcaaccaatggttattttaattcaacgtttagcgggtggattagaaagtgtcacattgcttgcaataccattctttattatggccggtgtctttatgaaccatacagggattagtgagcggttattaaaattctgtgaagtacttaccggtcatatgaacggcggtttagcgcaagtaaacgttgcattaagtacattaatgggtggtttatccggttcaaatattgccgatgcggcaatgaactctaaattgcttgtaccacaaatggttgctcgtggttatagtgcatcattttcagcagcggtaactgcagcaggttcattaatcacacctattattccgcctggcattgcgatgattatttacggttatgtcaataatgtttctattggtcgcttattcttggccggtgtcgttccgggtacaatgctctgtattctaatgatgatcttagtgtcaatcatttctaaaaaacgaggctatttacctatccgtgaaaaacgtgcaagttgcaaagaagtcattgtttcggcaaaagatgccgtattagcacttttacttccgattatcattatcggcggcatccgtatgggggtatttacgcctacggaagctggtgcggtggcggttatttatgcgcttatccttggtatgtttatttaccgcaatatggatgctaagaaattatggttagcaacgcgtgaatcggcattaggtgcggcaaacgtactattaattatttgtgtcgccgttgcattttcaaaattcttaacttgggagcgtgttccacaggctcttgcgagttggatgacaacggtggtagatagtccaatagcatttttgatgctagtgaatgtcgcattattagtcttaggtatgtttttagaaggtaatgcgattatgatcgtattagccccgttgcttgccccgattgcacattcatacggtattgatccaatccattttggtattgtgtttatttttaatggtgcaatcggaacaattaccccgccattaggtacagtaatgtttaccacctgttcaattactgaagttccgattgagaaatttattaaagatgtgcttccattctggggcttacttttattagaacttgttcttttaacttatatcccgacaatcacaacatggttaccaaacttagtttatggcgtagcacaataa

SEQ ID NO: 36803 - protein, 430 aa, Mannheimia succiniciproducens MBEL55E
MDVIIPISILLILFVIGTPVAFCIFCSTLTYFLMSHQPMVILIQRLAGGLESVTLLAIPFFIMAGVFMNHTGISERLLKFCEVLTGHMNGGLAQVNVALSTLMGGLSGSNIADAAMNSKLLVPQMVARGYSASFSAAVTAAGSLITPIIPPGIAMIIYGYVNNVSIGRLFLAGVVPGTMLCILMMILVSIISKKRGYLPIREKRASCKEVIVSAKDAVLALLLPIIIIGGIRMGVFTPTEAGAVAVIYALILGMFIYRNMDAKKLWLATRESALGAANVLLIICVAVAFSKFLTWERVPQALASWMTTVVDSPIAFLMLVNVALLVLGMFLEGNAIMIVLAPLLAPIAHSYGIDPIHFGIVFIFNGAIGTITPPLGTVMFTTCSITEVPIEKFIKDVLPFWGLLLLELVLLTYIPTITTWLPNLVYGVAQ

SEQ ID NO: 36804 - DNA, 1293 bp, Mannheimia succiniciproducens MBEL55E
  CDS (1)..(1293): transl_table=11
atggatgaattgaaacctgttattgccgttgccggtattattgcgaccatttatttgctgattaaaaaatatgaaacccgaaccgtactgatcggggtcgggttgttgatgtcgctccttacgcttaatccgatgggcgcattggacgcattcgccaaaagtatgacttccggcggactgattatggcgatctgttctagtatgggttttgcctatgtaatgaaatatactcaatgcgatactcatttagtacatttgctgaccaaaccactgggaggattaaaattctttttgatcccggtagcgacggtgatcactttctttattaatatcgcgattccttctgcggccggatgcgcggctgcggtgggagcaacgttgattccgatactgaaaagtgccggcgtccgtccggcgacagccggggcggccattctggcggggactttcggttccatgatgagccccggttcttctcactcggcgatgatcagtgaaatgtcgaaactaacgattactgaagttaacctgactcatgctccttatactatggttgcgggcgctatcggtgcggttatgctgacattgttggcgctgttttttaaagattacggcgatgaacaccgtcaagcttatttaagagaacagaaagaagcggaagataaattcgttaaagttaatgttctgtttgctttagcgcctttggtgccgttggtgattctggttattggcggtacatcgttgcaacaggtgtcctggttagggtggacccaaatgggcgtaccgcaggcaatgttaatcggggcgatttacggcattttggtcacccgtatttctccggtgaaaatcaccgaagaattctttaacggaatgggtaattcttatgccaacgtactcggtatcattattgcggcgggcgtgtttgtggccgggttaaaatccaccggcgctattgactctgccatcgggttcctcaaacattccaacgaatttgtgcgctggggtgcgactatcggaccgttcctgatggggatcatcaccggttccggcgatgcggcggcaatcgcctttaactccgccgttacaccgcatgcggtcgaactcggttatactcatgttaatctcggtatggcggcggcaatttcgggcgcgatcggacgtaccgcctcgccgattgcaggtgtcaccatcgtctgtgcgggcctggcaatggtcagcccgatggaaatgatcaaacgtaccgcattgggaatggttttagcaatcttatttcttgctctgtttatgctgtaa

SEQ ID NO: 36805 - protein, 430 aa, Mannheimia succiniciproducens MBEL55E
MDELKPVIAVAGIIATIYLLIKKYETRTVLIGVGLLMSLLTLNPMGALDAFAKSMTSGGLIMAICSSMGFAYVMKYTQCDTHLVHLLTKPLGGLKFFLIPVATVITFFINIAIPSAAGCAAAVGATLIPILKSAGVRPATAGAAILAGTFGSMMSPGSSHSAMISEMSKLTITEVNLTHAPYTMVAGAIGAVMLTLLALFFKDYGDEHRQAYLREQKEAEDKFVKVNVLFALAPLVPLVILVIGGTSLQQVSWLGWTQMGVPQAMLIGAIYGILVTRISPVKITEEFFNGMGNSYANVLGIIIAAGVFVAGLKSTGAIDSAIGFLKHSNEFVRWGATIGPFLMGIITGSGDAAAIAFNSAVTPHAVELGYTHVNLGMAAAISGAIGRTASPIAGVTIVCAGLAMVSPMEMIKRTALGMVLAILFLALFML

SEQ ID NO: 36806 - DNA, 1368 bp, Photobacterium profundum SS9
  CDS (1)..(1368): transl_table=11
atgttagaactattgattggcctggtggttaccatcgcagtaggctatttcattgtaaaaaactataaacctgctggcgtattattaaccgcgggtttagtgcttcttattactgcaggtgctataggccataccgtactaccatcatctattgcatcaacaggtaacatactgacagattcacttgaattcgtgaaatacatgcttaagtaccgtggcggcggcttaggtatgcaaatcatgcttttatgtggcttcgcttcttacatgacacatattggcgcaaacaatgttgtggttaaacagttttctaagcccctttcgttcatcaaatcgccttatattcttttagtcgcagcttatatcgtagcttgtctaatgtctttagctgttagctcagcgactggccttggtgtactactaatggcaacactattcccaatgatgacggcaatgggtatttcccgtcctgccgcagtggcagtgtgtgcgtcaccagcagcaatcattctttcaccaacatctggtgacgttgttgttgcggctgaaaaagcgggtatgccattacacgtatttgctgttgaaacagttcttcctgtatcaatttgtgcaatcatcgtaatggctgccgcggcttatttctggaataaatacctagataaaaaagaaaatacgccaatggaaaaggtcaacatttctgaaatggaagtgaaagcacctgcgtattacgcaatcttgcctttcttacctatcgtgggtgttttcttatttaatggcgaaacaatcaaaggcctatcattagacatttacaccattgttgttgcttctatcttcttgggtgcaatggttgatttcgttgccaagcgtttcaacggtaaagaaacactggaagatctagaatcttgttatgtaggtatggctgatgcattcaaaggcgtggtaatgctattggttgccgctggtgtatttgctcaaggtcttatgtctattggtgctatcgataatctaattggccttgcagaagctgctggtgcgggtggtttcgcattgatggttcttctaacagctctaactgttgctgccgctattgcgacaggttctggtaatgcacctttttacgcattcgtagaactagcgccaacactagccgctaagatgggtttaaaccctgcattcttgattatcccgatgctacaggcttctaaccttggtcgtactatttcaccggtttctggtgttatcgttgcaacatctggtatgggtaaaatcagcccattcgaagttgttaaacgtacatcggttcctgttatttgtggcttaattaccgttattattggcaccgtggttcttgtaccaatgtacacataa

SEQ ID NO: 36807 - protein, 455 aa, Photobacterium profundum SS9
MLELLIGLVVTIAVGYFIVKNYKPAGVLLTAGLVLLITAGAIGHTVLPSSIASTGNILTDSLEFVKYMLKYRGGGLGMQIMLLCGFASYMTHIGANNVVVKQFSKPLSFIKSPYILLVAAYIVACLMSLAVSSATGLGVLLMATLFPMMTAMGISRPAAVAVCASPAAIILSPTSGDVVVAAEKAGMPLHVFAVETVLPVSICAIIVMAAAAYFWNKYLDKKENTPMEKVNISEMEVKAPAYYAILPFLPIVGVFLFNGETIKGLSLDIYTIVVASIFLGAMVDFVAKRFNGKETLEDLESCYVGMADAFKGVVMLLVAAGVFAQGLMSIGAIDNLIGLAEAAGAGGFALMVLLTALTVAAAIATGSGNAPFYAFVELAPTLAAKMGLNPAFLIIPMLQASNLGRTISPVSGVIVATSGMGKISPFEVVKRTSVPVICGLITVIIGTVVLVPMYT

SEQ ID NO: 36808 - DNA, 1284 bp, Geobacillus kaustophilus HTA426
  CDS (1)..(1284): transl_table=11
atggcgttagtcgtctttatcgggtcgcttttaggggtcatggcgctcgggatgccgatcgcgtttgcgctgcttgtcagcggcgttgctctcatgttttacttgaatatttttgatacgcaaatcatcgcgcaaaatttaatcagcggcgcggacagctttcctctgatggcgattccgttctttatgctcgctggggagctgatgaacgccggcggcatttcgaagcggatcatccgctttgccatggcgcttgtcggccatatccgcggcgggctcggatatgtggcgatcatcgcaagcgtgctgtttgccggtttgtcggggtcggcggtggccgatacggcggcgcttggggccattctcatcccgatgatggtgaaagccggatacaaccgcaaccggtcggccggcctcatcgccgccggcggcatcatcgcgccgatcattccgccgagcatcccgatgatcatctttggggtgacgagcggcgtgtcgattacgaaactgtttatggccggcattgttccggggattctgcttgggatttctttggcggtttgttggtggtgggtgacccggagagatcaagtggacgtgcttccgcgccaatcggcgaaagacatttggcgggcgacccgcgaggcgttttgggcgttgctgctgccggtgatcatcgtcggtgggctgcgcggaggagtgtttacgccgaccgaggcggcggtggtggccgcgttttacgcgttgattgtcggcttgtgcatttaccgtgagctgaaagtgaaagacttgtttcacgtgctcgtggccgcggcgaaaacgacaagtgtcgtcatgtttttggtggcagccgccatggtgtcggcctggctcattacggtcgccaacattccggcgatcgtcacggacgtgctcgcgccgctcatcgatcatccgctggcgctgctgctggccattaacgccttggtgctgcttgtggggacggcgatggatttgacgccgacggtgctcattttgacgccggtgttgatgccgattattcaaaaagcgggaatcgacccggtgtacttcggggtgctgtttatcctgaacaactgcatcgggctgctcacgccgccggtcggcacggtgctgaacgtcgcctgcggggtcgggaaaatcagcatggaagacattatgaaaggagtttggccgtttttgcttgtggaaacgctcctgttgcttttgttgattttcttcccgtctcttgtgaccgtgccgctcggatggtttacgggcagttga

SEQ ID NO: 36809 - protein, 427 aa, Geobacillus kaustophilus HTA426
MALVVFIGSLLGVMALGMPIAFALLVSGVALMFYLNIFDTQIIAQNLISGADSFPLMAIPFFMLAGELMNAGGISKRIIRFAMALVGHIRGGLGYVAIIASVLFAGLSGSAVADTAALGAILIPMMVKAGYNRNRSAGLIAAGGIIAPIIPPSIPMIIFGVTSGVSITKLFMAGIVPGILLGISLAVCWWWVTRRDQVDVLPRQSAKDIWRATREAFWALLLPVIIVGGLRGGVFTPTEAAVVAAFYALIVGLCIYRELKVKDLFHVLVAAAKTTSVVMFLVAAAMVSAWLITVANIPAIVTDVLAPLIDHPLALLLAINALVLLVGTAMDLTPTVLILTPVLMPIIQKAGIDPVYFGVLFILNNCIGLLTPPVGTVLNVACGVGKISMEDIMKGVWPFLLVETLLLLLLIFFPSLVTVPLGWFTGS

SEQ ID NO: 36810 - DNA, 1386 bp, Salmonella enterica subsp. enterica serovar Paratyphi A str. ATCC
  CDS (1)..(1386): transl_table=11
atgctaacagttatagagctccttatcggagtcgtcgttattgtgggtgtagcacgctacatcattaagggatattccgccactggcgttttatttgtcggcggtctggttctgcttattatcagcgcgctgatggggcataaggtattacctgccagcgaaaccagtaccggctataccgcaacagatattgttgaatacatcaaaattttgcttatgagtcgcggcggcgatcttggcatgatgatcatgatgctgtgcggctttgccgcctatatgacgcatatcggcgcaaatgatatggtcgtgaagctggcgtcgaaacctttacagtatataaactcgccctacctgttgatgattgccgcctattttgtcgcctgcctgatgtcgctggccgtctcttccgcgacggggcttggcgtactgctcatggctactctcttcccggtgatggtcaacgtcggcattagccgcggcgcggcggcggctatttgcgcctctccggccgccatcatcctctcgccaacgtctggcgatgtggttttagccgcaaaagcggcggagatgccgttaatcgatttcgcgttcaaaaccacgctgccaatttccatcgccgccattatcggtatggcgattgcgcactttttctggcaacgctatctggataaaaaagagaacatttcacatgagatgctggacgtggcggagattaccaccacggccccggcgttttatgccattttgccgttcacgcccattatcggcgtactgatttttgacggtaaatgggggccgcagttgcacattattaccattctggtgatctgtatgctgctggccgccgtgctggaattcgtgcgcggtttcaacacgcaaaatgtgttttccggcctggaagtggcttatcgcggcatggcggatgcgtttgccggtgtcgtgatgctgctggtcgcggcgggcgttttcgcccaggggctgagcaccattggctttatccaaagtctgatctcgattgccacttcttttggctccgccagcattattctgatgctggtcttagtgattttaaccatgctggccgcgatgaccaccggttcaggcaatgcgcctttttacgcctttgttgagatgatccctaaactggcgcactcctccggtatcaacccagcctatttatccatcccaatgctgcaagcctcaaacctgggacgcacgatttcgccggtctccggcgtcgtggtcgctgtcgccgggatggctaaaatatcaccgtttgaagtggtgaagcgcacgtccgttccggtcatcgtcggtctgttgatcgtcattatcgccacggaaattatggtgccaggcgcctcttccgccgttactggcggctga

SEQ ID NO: 36811 - protein, 461 aa, Salmonella enterica subsp. enterica serovar Paratyphi A str. ATCC
MLTVIELLIGVVVIVGVARYIIKGYSATGVLFVGGLVLLIISALMGHKVLPASETSTGYTATDIVEYIKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILSPTSGDVVLAAKAAEMPLIDFAFKTTLPISIAAIIGMAIAHFFWQRYLDKKENISHEMLDVAEITTTAPAFYAILPFTPIIGVLIFDGKWGPQLHIITILVICMLLAAVLEFVRGFNTQNVFSGLEVAYRGMADAFAGVVMLLVAAGVFAQGLSTIGFIQSLISIATSFGSASIILMLVLVILTMLAAMTTGSGNAPFYAFVEMIPKLAHSSGINPAYLSIPMLQASNLGRTISPVSGVVVAVAGMAKISPFEVVKRTSVPVIVGLLIVIIATEIMVPGASSAVTGG

SEQ ID NO: 36812 - DNA, 1281 bp, Silicibacter pomeroyi DSS-3
  CDS (1)..(1281): transl_table=11
atgacccttgctctcttccttggcgttctgttggtttcgatctttctcggactgcctgtcgccttcgcgctcttgctggcgtcgattgccctgatgttccagctggatacgttcagcaccgatattcttgctcaatccttgatcaacggggtcgatagtttccccttgctggcgattcccttctttctggtcgctggcgaggtgatgtccgccggcgggctgtcgcaacggatcgtgcgtctggccaccagccttgtcgggcatcgccgtggcggcctgggatatgtggcgatctttacctcgatcctgcttgccggtctgtcaggatctgcggttgccgatgcggctgcattggtcagtattctttatccgatgatgaagaaggccggctatccagagggccattcgatgggattgctcgcatcgggcggtatcatcgcaccggtcattccgccctcgctgcccctgatccttatcggtgtcgctggtggtatttcgatcaaaagcctgttcctgggcgggatcgtgcccgggctcttgatggggctgactttggtcctggtctggggcgttctgatgcgcaaggaagacctcgaggttgcgccgcgcgccaccgcgggtgaacggctgcgcgctgtcagagagggtttctgggccttgctgcttccggtgatcatcattggcggtattcgcttcggcgttttcaccccgaccgaagcggcggttgtggcggcagtttacgccatttttgtttcaactttggtttatcgtgaactcaacttgaaagccttgttccatgtgctggtcagtgcagggcgggcgacggcgatggtgatgttccttgtggggtgcgccatggttgcggcttggctgatcacgatcgcacagttgccccaacagcttgccgcgatgctcggcccgctggtcgatcatccccggctgttgatggccgtgatcatgctgatcgtgctggccgtgggcatggtgatggatctggccccgacggttctgatcctggtccccttgctgatgccggtggtcaagctggcggggatcgacccggtctacttcggcctcatgttcgtcatcaacacctcgatcggtctgatcacaccgcccgtggggaatgtactgaatgtcgtgtgtggcgtggggcgggtgccgatgtctgctgccgtcaggggcgtcgcgcccttcattctcgcctatctcgcgctgctcgctctctttgtcgtttttccaaacatcatcatcaccccgatgaaattcatcatcggataa

SEQ ID NO: 36813 - protein, 426 aa, Silicibacter pomeroyi DSS-3
MTLALFLGVLLVSIFLGLPVAFALLLASIALMFQLDTFSTDILAQSLINGVDSFPLLAIPFFLVAGEVMSAGGLSQRIVRLATSLVGHRRGGLGYVAIFTSILLAGLSGSAVADAAALVSILYPMMKKAGYPEGHSMGLLASGGIIAPVIPPSLPLILIGVAGGISIKSLFLGGIVPGLLMGLTLVLVWGVLMRKEDLEVAPRATAGERLRAVREGFWALLLPVIIIGGIRFGVFTPTEAAVVAAVYAIFVSTLVYRELNLKALFHVLVSAGRATAMVMFLVGCAMVAAWLITIAQLPQQLAAMLGPLVDHPRLLMAVIMLIVLAVGMVMDLAPTVLILVPLLMPVVKLAGIDPVYFGLMFVINTSIGLITPPVGNVLNVVCGVGRVPMSAAVRGVAPFILAYLALLALFVVFPNIIITPMKFIIG

SEQ ID NO: 36814 - DNA, 1305 bp, Bacillus clausii KSM-K16
  CDS (1)..(1305): transl_table=11
atggatatagcaatattatcggtattacttctttttggaatattcttctttcttcttgcgataggtgttccaatatcaataagcattggtctatcctctattgtatctgttatggtagctacgccgttagacgtgatcctttatacgagtgcgcaacgtttattttctggaatgaacagttttgcgttattagctatcgtcttttttattatgtcaggaagcattatgaataatggaggaatcgcattacgattaattaatttagcaaagttgattgcaggaaggttacctggatcattggcacatacaaatgtagttgggaatatgctttttggctctatttcagggtcagcagtggcttctgcggcagcaattggcagtgttatggctcctttgcagaagaaagaaggctatgacaaaggtttttcggcagctgtaaatataacttcttcaccagtgggcattttgatcccccctagtggtgtattaatcctctattcattagtcagtggaggaacttctgtttctgcattattcatggctggatatttgcctggcattttgatgggattaacagttatgatcgttgcttactttattgctaaaaaaaatcattatacgatttctgaaaaaataggtctaaaagaggcaaacagaatcatcatacaatcaattcctagtttactattgattgttattgtgattggtggaattgtagcaggcatttttactgctacagaaggtgccgcagttgcggttctatattctttaattctttcattgatttatcgctccttaacgtgggcccatattcctaaaattttcaaggaaacaattgtgatgacaggaattgttttatttttagttgctgtctcttctatcatgtcatgggcaatggcattaacaggcatgccggcagctattagtaacgggcttttaagtatctcagataatcgctatattgtattgttgattatgatgttgattttattagttgttggcatttttatggacctcacgccagcagtactcatttttacacctattttcttgccgattgttgtgcaaatgggggtagaccctgtccattttggaatcatgcttgtatttaatctggctattggtgctatgacaccaccggtagggagtgttttatttataggttgtagcgtagggaaagtgtccattgaagaagtgataaaacctttgagctatttctttatagcgcttgttgcagcattatttatagtggtttatatcccttccattagtctaattatccctaaactttttaacctgttataa

SEQ ID NO: 36815 - protein, 434 aa, Bacillus clausii KSM-K16
MDIAILSVLLLFGIFFFLLAIGVPISISIGLSSIVSVMVATPLDVILYTSAQRLFSGMNSFALLAIVFFIMSGSIMNNGGIALRLINLAKLIAGRLPGSLAHTNVVGNMLFGSISGSAVASAAAIGSVMAPLQKKEGYDKGFSAAVNITSSPVGILIPPSGVLILYSLVSGGTSVSALFMAGYLPGILMGLTVMIVAYFIAKKNHYTISEKIGLKEANRIIIQSIPSLLLIVIVIGGIVAGIFTATEGAAVAVLYSLILSLIYRSLTWAHIPKIFKETIVMTGIVLFLVAVSSIMSWAMALTGMPAAISNGLLSISDNRYIVLLIMMLILLVVGIFMDLTPAVLIFTPIFLPIVVQMGVDPVHFGIMLVFNLAIGAMTPPVGSVLFIGCSVGKVSIEEVIKPLSYFFIALVAALFIVVYIPSISLIIPKLFNLL

SEQ ID NO: 36816 - DNA, 1284 bp, Bacillus clausii KSM-K16
  CDS (1)..(1284): transl_table=11
atgatgcttcttttgatcgttagtgtgattgtgcttctaattgtcctgaatgttcctgtagcttacgcgatgcttgcaggtgtggctatttactttattgtcaatccaagctttatgaatgaaacattgacgcaacgggtagtaagcggagttgaatcctttccgttgcttgggattgtcttttttatcactgctggcgttttgatgaactataccggaattacaaaacgaatgcttgtatttgccaaacttgtaaccggacacttgactggcggattggcgaaagtgaatgtgttgcttagtgtgctaatgggtggcttatcgggttcgaatgtagcggacgccgcaatgcaatcaaaaattgtcgtcccagaaatggtcaaaaaagggtacgcgcctggtttttcagcagcattaacagcgacaagctcgctcattacgccgattttgcctccaggaattgctttgatcttatatggctatgtaggcaatgtctctatcggtgatttatttattgccggtattatcccaggttttttgttggcggcgattttactcgtttatgtccactttgccgctaaaaagcgtggctttgagcaagaaatgaaccctttcccttctttcaaacaagtagcgattgcttcaaaagacgctttgcttgctcttttgctgccaattcttattatcggtggcatccgtttagggatgtttggcccgactgaagctggagccgttgcagtcttgtatgcacttgttattggcttgtttatatacagggaaatgacgttcaaggatttagtctccgctgcgaaagaatccgtgcaaattattgccactgtcatgattattattgcagcaggcaccgcattcggctggatgttgacgcttgagcaagtcccacaacagcttgcttccgcaatgactacttcagtcgaacagccacttgcatttttagtgttattgttggtgtttctgctcattgtcgggatgtttattgaaggaaacgtcatgctcattattttaacgccaatctttatgcccatgctagagacatacggaattgaccctgttcattttggaatcttttttattctttgtttgagcattggcacaattacaccaccgatcggcacgattatgttcacaaccgcctcgattacaaaggtgaaaattgaaacgttcattaaagaggtcataccattttggctgctgctgattggcttaactctaatcattattttcatcccggctttgtcgttgtggttgccgtctgtcttgtcttaa

SEQ ID NO: 36817 - protein, 427 aa, Bacillus clausii KSM-K16
MMLLLIVSVIVLLIVLNVPVAYAMLAGVAIYFIVNPSFMNETLTQRVVSGVESFPLLGIVFFITAGVLMNYTGITKRMLVFAKLVTGHLTGGLAKVNVLLSVLMGGLSGSNVADAAMQSKIVVPEMVKKGYAPGFSAALTATSSLITPILPPGIALILYGYVGNVSIGDLFIAGIIPGFLLAAILLVYVHFAAKKRGFEQEMNPFPSFKQVAIASKDALLALLLPILIIGGIRLGMFGPTEAGAVAVLYALVIGLFIYREMTFKDLVSAAKESVQIIATVMIIIAAGTAFGWMLTLEQVPQQLASAMTTSVEQPLAFLVLLLVFLLIVGMFIEGNVMLIILTPIFMPMLETYGIDPVHFGIFFILCLSIGTITPPIGTIMFTTASITKVKIETFIKEVIPFWLLLIGLTLIIIFIPALSLWLPSVLS

SEQ ID NO: 36818 - DNA, 1332 bp, Bacillus clausii KSM-K16
  CDS (1)..(1332): transl_table=11
atgttatcggcgttgctctttgtattgttcttctgtttgttgttgatccacgtgcctgttgcctttgcattaggtgtatcagctttggtcattctcgtgttgggctcggggttttcgtcgttggcgcttctccctagcattatgtattcctccatttcttcatttacgttattggcaattccgtttttcgtgttagctggcgtcattatgagctattcgggcatttctaaacggcttgttgactttgcctacctttgttttggccacaagaaaaacggcatcgtcatcgtcgccattgtcgctgcgttgtttttctcggctatttctggctcagggccggcgacggttgccgcaatgggcgcgatcctcatccctgcccttgttaagaatggctttaacaaaaatagtgcttcggcgttgattgccagttcaggcgcattagggattattttgccgccaagcattgcctttatcatttttggcgtcatagccaatgactttgttggcatctcgattagccgcctgtttgtcgcaggcatcataccgggccttttacttgctgccggtcttctcgttgctagcatttttgcaagtaagcgcgtttctcacttgcaaacagctagcaagcgcccagatgaagcggcagccagcgtggaacgcgcctctttggcagcaattttgaaagcgttttaccgagcgcttttcgggttgcttgtccctgtcatcattatgggcggtatctattcaggcatgtttacgccaacggaggctgccgttgtcgcggtgttttatgcactgctcgtcggcggggtgttttaccgagaaataaaactgaaacatctcggccgaattttagtcgattcgtctgtacaatcagcggtcattatgttcattattggcgctgcttcattgttctcttatctcgtgacgacgcaacatgtagcggaagggatgacgcaagctgtgctagggatgacggaaaaccgcgtcctcctattgcttctgacagccgtgattttgttggtgattggcgcgtttatagacgccatttccgcattttatatctttgtaccgattttgatgccgattttgcttgaagtcggcgttgacccgactacgattggcgtgctcatgacggtcgcattggcaattggcctgtttacgccacctgtcggattgaatttgtttgtggccagtggcatttctggtgtgccatctgaacaaattgtaaggggaattggtccttttctagtttcttctattgttgtgttgctcatcgtcatgtatgttccagctgtatccaattggttgccagatttattgaatctttaa

SEQ ID NO: 36819 - protein, 443 aa, Bacillus clausii KSM-K16
MLSALLFVLFFCLLLIHVPVAFALGVSALVILVLGSGFSSLALLPSIMYSSISSFTLLAIPFFVLAGVIMSYSGISKRLVDFAYLCFGHKKNGIVIVAIVAALFFSAISGSGPATVAAMGAILIPALVKNGFNKNSASALIASSGALGIILPPSIAFIIFGVIANDFVGISISRLFVAGIIPGLLLAAGLLVASIFASKRVSHLQTASKRPDEAAASVERASLAAILKAFYRALFGLLVPVIIMGGIYSGMFTPTEAAVVAVFYALLVGGVFYREIKLKHLGRILVDSSVQSAVIMFIIGAASLFSYLVTTQHVAEGMTQAVLGMTENRVLLLLLTAVILLVIGAFIDAISAFYIFVPILMPILLEVGVDPTTIGVLMTVALAIGLFTPPVGLNLFVASGISGVPSEQIVRGIGPFLVSSIVVLLIVMYVPAVSNWLPDLLNL

SEQ ID NO: 36820 - DNA, 1302 bp, Staphylococcus epidermidis RP62A
  CDS (1)..(1302): transl_table=11
atgaaagagatgaagaatggcaatgcttgggcattaattcctttattgttatttgtcttactatttctaggtgttggtattatttctggtgattttaccactatgccattaaatgttgctattacaattactgttattgttgccttacttatgaaccgcaaggaaacttttgcaaaaaaagtagaggtatttacaaaaggtgcaggtcactctaatatcattttgatgatgcttatttttatccttgctggagctttttcgacgactgctgaaaaaatgggaggcgtgtcatctacagttaatttaggcttatcacttattcctcaaaatctaataattgttgggctatttattatttgtatgtttgtatcaatttcaatggggacttctgttggcacagttgcagctattgcaccagtaggttttggatttgcacaagcaacagatgtaccagctgcattagccatggcaacagttgttgggggagcgatgtttggtgataatctatctatgatttctgataccactattgcagcagtaagaacacaaaaaacaaaaatgagtgataaatttaaagtcaattttaaaattgtactaccaggtgcgattattacaatcatcattttattctttttaacaaatggtatttctatagatcatactaaaaactatgattataatttaattaaagtcataccatacttattagttttgattcttgcgttagttggtattaatgtaattattgtattaataggaggtactgtattagccggtataattggactgattgatggttcttttggttggaatggccttttaaatgctatttctaaaggtattatcggaatggaagatattgctatgattgcattgcttataggtggtctagtaggaattatccaacataatggtggtattgattggttgcttaattttgtaaggtcaaaagtaaaatcaaagcgtggtgcagaactaggtatagcgagtttagtgagtgcagctgacatttcaacagcaaataatacaatttctattattatggctggaccattagctaaaaatattgctgatgaatatgatgtcgatccaaggaaatcagcaagtatattagatatctttggtgggtgttttcaaggattattaccatacagtccacaagtgatttcagcagcaggtgtagccggaatttccccattcctaatgttacaatatagtatttatccaatattattaggtgtttgtggattagtagcaattattttaagagtacctcgtttaaatcaatcgtcaaagaaataa

SEQ ID NO: 36821 - protein, 433 aa, Staphylococcus epidermidis RP62A
MKEMKNGNAWALIPLLLFVLLFLGVGIISGDFTTMPLNVAITITVIVALLMNRKETFAKKVEVFTKGAGHSNIILMMLIFILAGAFSTTAEKMGGVSSTVNLGLSLIPQNLIIVGLFIICMFVSISMGTSVGTVAAIAPVGFGFAQATDVPAALAMATVVGGAMFGDNLSMISDTTIAAVRTQKTKMSDKFKVNFKIVLPGAIITIIILFFLTNGISIDHTKNYDYNLIKVIPYLLVLILALVGINVIIVLIGGTVLAGIIGLIDGSFGWNGLLNAISKGIIGMEDIAMIALLIGGLVGIIQHNGGIDWLLNFVRSKVKSKRGAELGIASLVSAADISTANNTISIIMAGPLAKNIADEYDVDPRKSASILDIFGGCFQGLLPYSPQVISAAGVAGISPFLMLQYSIYPILLGVCGLVAIILRVPRLNQSSKK

SEQ ID NO: 36822 - DNA, 1368 bp, Vibrio fischeri ES114
  CDS (1)..(1368): transl_table=11
atggcttcgttattacttgttcttatcgttgttgttattgcggcaaggatgattttaaaggggtataaagctgaacctactttattaatgtcagggacgatattgattttcgcaactggactttttggctggggcccaatgttgccagcttcggttacatcgactaatttttcaggatttgagccctttaaatacatacaatttttaatggggtatcgagcgggagcgctggggttaatgattatggctttggtcggttttgctgattatatgagtcatattggagctaacgatgttgtcgttcgtttagccactaagccactaagtcgtattcaaaataaaaacattatgttgttctttgcttactgtatggcaagtatcttacaactggcaattccttcagctaccggtcttggcgtgttattgatgggaacactttatcctgtgatgttgggattgggtatttctcgtggtagcgccgcggcggttattgctagttcattagcggtaagttttacgccaacaggggtggatgcaatacgtgcaagtgaagctttaggtatggacttgatgagttatgtttctcattatcaagctccaacatcggtagcaactatggtggttatcggtattatgcatgttatttggcagacacaggttgataaaaagcatcctgaacaattcgaacaagcatcaattgaacagacacaaaaagaggaagtgttagcacctagttattatgtcattttacctttgcttcctattattatggctgttgtgttttctaaactcgtcatttcaacgatcaatatggatgtgacgacgattgtatttgtttcaatgtttgttgctatgttgtgtgaatgcataacgaaaagaagtttaaaaacggtttttgatggtttcaatgtgttctcaaaaggaatggggagtgcatttagcagtgtggttgtattattagttgctgctggtgtttttgcttatggaattcaagcgacaggagcgattaccaacctaatcatgatggctaaatcagtgggcttaccaagtgtagcgatgacatttgtttttgctgttgtgacgttaatggctgcggtgattatggggtcggggaatgcgccattcttggcgtttgttgaattaattcctactatagcttccagtatgggagccaacgcagcggcaatgctaatgccaatgcaacaagcctcagcaataggtcgagcaatgtctcctgtttctgctgttgttattgcttcagcaacgggtgccaagttaagtccatttgaagttgcaaagcgaacatctgttccagtcttagtaggctttgtgtttcattttgttattgtttacgctttttatagctaa

SEQ ID NO: 36823 - protein, 455 aa, Vibrio fischeri ES114
MASLLLVLIVVVIAARMILKGYKAEPTLLMSGTILIFATGLFGWGPMLPASVTSTNFSGFEPFKYIQFLMGYRAGALGLMIMALVGFADYMSHIGANDVVVRLATKPLSRIQNKNIMLFFAYCMASILQLAIPSATGLGVLLMGTLYPVMLGLGISRGSAAAVIASSLAVSFTPTGVDAIRASEALGMDLMSYVSHYQAPTSVATMVVIGIMHVIWQTQVDKKHPEQFEQASIEQTQKEEVLAPSYYVILPLLPIIMAVVFSKLVISTINMDVTTIVFVSMFVAMLCECITKRSLKTVFDGFNVFSKGMGSAFSSVVVLLVAAGVFAYGIQATGAITNLIMMAKSVGLPSVAMTFVFAVVTLMAAVIMGSGNAPFLAFVELIPTIASSMGANAAAMLMPMQQASAIGRAMSPVSAVVIASATGAKLSPFEVAKRTSVPVLVGFVFHFVIVYAFYS

SEQ ID NO: 36824 - DNA, 1290 bp, Vibrio fischeri ES114
  CDS (1)..(1290): transl_table=11
atgcttatgtctatatttatattaacattaatgattttatctctaatatataagagaaaatacatacctttgatttttatattgttagggattgttgtttccttgtttaatggcgtagaattacgagaaatcgctttaaacttctctaatgcattaagctctgtttttttatctatcgggttaaatattgttgttattatagcgttctctgaatatgttaataaaaatggggcaacaaaagatttagttttactcgtttataaaccaataagtaaaataaaagatagatacttaatccttgctatgttttatttaataggattagcattaagcacagtaatcacatccgcatcagctctatctatgatatatatgtctactgtattccctatactgatatctaagggaataagtaaagaaggtgcagcgggaatgatcgcttcagttggagtaatagaatttggtcacttaaaatcgagtactatttttatggctgaagagcaaaatagattaataaatgattatgttattaatggacaattatttttatttattggtatcgctattgtcggtgcaattagccattacttctggcaacgttacctcgataaccgtttgactaatgataacgatgaaaaatcattaacagataatctagattatcagcataaaatcagtatatttacggcactgctaccgttacttccgctatttcttattttacctgaacatctattcactaaactaaacttgccactttggactattgggatgatatgtatttcaatctcgtttattttagatctaaaatccaataaatttaatgttaaagaacaattatctttctttttaactagcattagtaactcatttttctttatcgtatctgtcattgttggcggtaaatttctagtcaattcgttaccgatagaaagtattattaatatttatagccatatgtctttaggttctataaacccgattattttatcatcagtattattattggctatcgtgttattttgtactttgcttggttctggaacggtctcttttattacaataacgtcaataatgtcaaaatttaaaatcgtatcgatgaatcagttcagttcaacatttacatcgatgcaaatgatatcaggaataggaagaacaatatcccctgtatctccaactacattattatgctcccaaatttctggagttacactatctagcataatattaagaaatattgtcccaaccatacttattgtaattttatcaatcatatacagcaatatttga

SEQ ID NO: 36825 - protein, 429 aa, Vibrio fischeri ES114
MLMSIFILTLMILSLIYKRKYIPLIFILLGIVVSLFNGVELREIALNFSNALSSVFLSIGLNIVVIIAFSEYVNKNGATKDLVLLVYKPISKIKDRYLILAMFYLIGLALSTVITSASALSMIYMSTVFPILISKGISKEGAAGMIASVGVIEFGHLKSSTIFMAEEQNRLINDYVINGQLFLFIGIAIVGAISHYFWQRYLDNRLTNDNDEKSLTDNLDYQHKISIFTALLPLLPLFLILPEHLFTKLNLPLWTIGMICISISFILDLKSNKFNVKEQLSFFLTSISNSFFFIVSVIVGGKFLVNSLPIESIINIYSHMSLGSINPIILSSVLLLAIVLFCTLLGSGTVSFITITSIMSKFKIVSMNQFSSTFTSMQMISGIGRTISPVSPTTLLCSQISGVTLSSIILRNIVPTILIVILSIIYSNI

SEQ ID NO: 36826 - DNA, 1461 bp, Vibrio fischeri ES114
  CDS (1)..(1461): transl_table=11
atgagtttatttattgcattatgtgggttgattcttgcgggaagattaattttaaaaaactataacccccaaggcgtactcttctttgttggtatcgttatgatgaccatatcaatctttactaacaatgctacttttgtcgataaatcgacgggttggatagggtttgatgtttttgaatatataagcatggtttttggcaaacaatccggtggtttaggtttaaaaataatgcttataggagggtttgccttattaatgtcagctataggagcaagccaagtaatggtaaagttaacagctaagccattaatgaagctaaattcaccttacttgatgctagcacttgcctttattcttggtcagatgttatcactctttatctcaagcgcaacgggacttggtttattgttgatggcaacactttatcctgtattgattagactgggctgtagtaaagcgggtgttgcttctgtattagcgagtacttgcgctattgagtttggtcctggttcaggaaactcaattttagctgctcaaaccgctggtctagagattacggaatactttgttggggaacaattaccaattattagcgtattgattatagttgtggcaattatgcatgcaattacacaacgtttttttgaccgtaatgacgaaaaaaatcagacattagagccaataaattatgaagatattgaatcggaacaaagtgctcccttctattatgtaatacttccaatgttaccattattttttatgcttacatttagtagccttggcgtgaagacaattaatgtgggtatggcaactgctatcattttgagtatttttattagccttgtatttgaatttattcgagaaagagaagtaaaacctgtatttgaaaaactacaaggagtatttgatgatatgggaaaagtttttgcttctgttgtaactttaattatagcaggccagactttttctatgggattaaagtcaataggagctattgattcaatgttacatatggcaagtagcgttgggctttctgctgctgttattattttgtttatggctctattaactttcattatttctgcattaatgggatcagggaatgcggcctttttctcttttgctccaatggtgccccaaattgctcataaaataggtgcgaatactgtagatatgatcttaccaattcaattatctgcaggttttggtagaacaatatctccgattgcaggtgttatcattgctgttgccggtatttcaggtttgtctccatttgatatagttcgtcgaactttgataccaatggtaagtggttggttattaatgctaattttaactttttctaagggaggacaattagagcaattaatgccatttttgattgtaatattagttctttctgttggtgtcggttggataatgaagagaaagaataatagaacacaattgactcagtaa

SEQ ID NO: 36827 - protein, 486 aa, Vibrio fischeri ES114
MSLFIALCGLILAGRLILKNYNPQGVLFFVGIVMMTISIFTNNATFVDKSTGWIGFDVFEYISMVFGKQSGGLGLKIMLIGGFALLMSAIGASQVMVKLTAKPLMKLNSPYLMLALAFILGQMLSLFISSATGLGLLLMATLYPVLIRLGCSKAGVASVLASTCAIEFGPGSGNSILAAQTAGLEITEYFVGEQLPIISVLIIVVAIMHAITQRFFDRNDEKNQTLEPINYEDIESEQSAPFYYVILPMLPLFFMLTFSSLGVKTINVGMATAIILSIFISLVFEFIREREVKPVFEKLQGVFDDMGKVFASVVTLIIAGQTFSMGLKSIGAIDSMLHMASSVGLSAAVIILFMALLTFIISALMGSGNAAFFSFAPMVPQIAHKIGANTVDMILPIQLSAGFGRTISPIAGVIIAVAGISGLSPFDIVRRTLIPMVSGWLLMLILTFSKGGQLEQLMPFLIVILVLSVGVGWIMKRKNNRTQLTQ

SEQ ID NO: 36828 - DNA, 1371 bp, Vibrio fischeri ES114
  CDS (1)..(1371): transl_table=11
atgttggagttattaattggtttagtaatcaccatatttgttggttactttatcgtaaaaggatataaagctgcaggcgtgttactgacagcaggtttagcactgctaattattgcaggtcttttaggtcattcagttcttcctgcaaaagtaacggctacaggtagcctactaacagatgcgcttgagtatgtaaaatacatgcttcagtaccgtggcggcggcttaggtatgcaaatcatgctactttgtggttttgcctcttacatgactcacatcggtgcaaacaatgtggttgttaagcaattttcaaaaccactggcattcattaaatcaccttacattctattagttgccgcttatatcgtagcatgtctaatgtctcttgctgtaagttcagctacgggccttggggttctattaatggcaaccctattcccgatgatgacggcaatgggtatctcacgccctgcagcagttgcagtgtgtgcatcaccagcagcaatcatcctttcacctacatcaggtgacgtcattgttgcagcagaaaaatcaggtttacctcttcatgttttcgcagttgaaaccgtacttcctgtatcaatttgtgcaatcatcgttatggcagcagccgcgttcttctggaataaataccttgataagaaagaaaacacaccaatggagaaagtcgatatttctgcaatggaagtgaacgcaccatcttactatgcgattcttcccttcttacctatcgtaggtgttttcctgtttaacggcgagacaatcccaggtctatctttagatatttacactatcgttgttggttctatctttattggtgcgttagttaactttacgaccaataaactgaacggtaaaaaaacattagaagatttagaatcttgttatgaaggtatggctgatgcatttaaaggcgtagttatgctattggttgctgcgggtgtatttgctcaaggtctaatgtctgttggcgcaattgataacctacttcacttagctgataaagcaggtgcgggtggtatggctctaatgcttctactaaccggtttaaccgttgctgctgctatcgcaacaggttctggtaatgcgcctttctacgcattcgtagagcttgctcctcagcttgctggtaaaatgggtcttagccctgcattccttatcattccaatgcttcaagcatctaaccttggtcgtactatttcaccagtatctggcgttatcgttgcgacatctggtatggcaaaaatcagcccatttgaagtggtaaaacgtacatctgttccggttatctgtggcttaatcacagtaatcatcggtactatggttcttgttccaatgtacgcgcagtaa

SEQ ID NO: 36829 - protein, 456 aa, Vibrio fischeri ES114
MLELLIGLVITIFVGYFIVKGYKAAGVLLTAGLALLIIAGLLGHSVLPAKVTATGSLLTDALEYVKYMLQYRGGGLGMQIMLLCGFASYMTHIGANNVVVKQFSKPLAFIKSPYILLVAAYIVACLMSLAVSSATGLGVLLMATLFPMMTAMGISRPAAVAVCASPAAIILSPTSGDVIVAAEKSGLPLHVFAVETVLPVSICAIIVMAAAAFFWNKYLDKKENTPMEKVDISAMEVNAPSYYAILPFLPIVGVFLFNGETIPGLSLDIYTIVVGSIFIGALVNFTTNKLNGKKTLEDLESCYEGMADAFKGVVMLLVAAGVFAQGLMSVGAIDNLLHLADKAGAGGMALMLLLTGLTVAAAIATGSGNAPFYAFVELAPQLAGKMGLSPAFLIIPMLQASNLGRTISPVSGVIVATSGMAKISPFEVVKRTSVPVICGLITVIIGTMVLVPMYAQ

SEQ ID NO: 36830 - DNA, 1386 bp, Salmonella enterica subsp. enterica serovar Choleraesuis str
  CDS (1)..(1386): transl_table=11
atgctaacagttatagaactccttatcggagtcgtcgttattgtgggtgtagcgcgctacatcattaagggatattccgccactggcgttttatttgtcggcggtctggttctgcttattatcagcgcgctgatggggcataaggtattacctgccagcgaaaccagtaccggctataccgcaacagatattgttgaatacatcaaaattttgcttatgagtcgcggcggcgatcttggcatgatgatcatgatgctgtgcggctttgccgcctatatgacgcatatcggcgcgaatgatatggtcgtgaagctggcgtcgaaacctttacagtacataaactcgccctacctgttaatgattgctgcctattttgtcgcctgcctgatgtcgctggccgtctcttccgcgacggggcttggcgtactgctcatggctactctcttcccggtgatggtcaacgtcggcattagccgcggcgcggcggcggctatttgcgcctctccggccgccatcatcctctcgccaacgtctggcgatgtggttttagccgcaaaagcggcggagatgccgttaatcgatttcgcgttcaaaaccacgctgccgatttccatcgccgccattatcggtatggcgattgcgcactttttctggcaacgctatctggataaaaaagagaacatttcacatgagatgctggacgtggcggagattaccaccacggccccggcgttttatgcccttttgccgttcacgcccattatcggcgtactgatttttgacggtaaatgggggccgcagttgcacattattaccattctggtgatctgtatgctgctggccgccgtgctggaattcgtgcgcggtttcaacacgcaaaatgtgttttccggcctggaagtggcttatcgcggcatggcggatgcgtttgccggcgttgtgatgctgttggtcgcggcgggcgttttcgcccaagggctgagcaccattggctttatccaaagtctgatctcgattgccacttcttttggctccgccagcattattctgatgctggtcttagtgattttaaccatgctggccgcgatgaccaccggttcaggcaatgcgcctttttacgcctttgttgagatgatccctaaactggcgcactcctccggcatcaacccagcctatttatctatcccaatgctgcaagcctcaaacctggggcgcacgatttcgccggtctccggcgtcgtggtcgctgtcgccgggatggctaaaatatcaccgtttgaagtggtgaggcgcacgtccgttccggtcatcgtcggtctgttgatcgtcattatcgccacggaaattatggtgccaggcgcctcttccgccgttaccggcggctga

SEQ ID NO: 36831 - protein, 461 aa, Salmonella enterica subsp. enterica serovar Choleraesuis str
MLTVIELLIGVVVIVGVARYIIKGYSATGVLFVGGLVLLIISALMGHKVLPASETSTGYTATDIVEYIKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILSPTSGDVVLAAKAAEMPLIDFAFKTTLPISIAAIIGMAIAHFFWQRYLDKKENISHEMLDVAEITTTAPAFYALLPFTPIIGVLIFDGKWGPQLHIITILVICMLLAAVLEFVRGFNTQNVFSGLEVAYRGMADAFAGVVMLLVAAGVFAQGLSTIGFIQSLISIATSFGSASIILMLVLVILTMLAAMTTGSGNAPFYAFVEMIPKLAHSSGINPAYLSIPMLQASNLGRTISPVSGVVVAVAGMAKISPFEVVRRTSVPVIVGLLIVIIATEIMVPGASSAVTGG

SEQ ID NO: 36832 - DNA, 1308 bp, Pseudomonas syringae pv. syringae B728a
  CDS (1)..(1308): transl_table=11
atgctgactttccttggctttgccatggttattgcgttcatgtacctgatcatgagcaagcgcctgactgcgctgatcgctctgatcctggttccgatcatcttcgccctgttcggtggcttcgcgtcgcagatcggcccgatgatgctggcaggtatcaccaagctggcgccgaccggcgtgatgctgatgttcgccattctgtactttgcgctgatgatcgactccggcctgttcgacccggccgtgcgcaagatcctgaaaatggtcaagggcgacccgatgcgcatttcggtcggcaccgccgtactggcgctggtggtgtccctcgacggtgacggcgcgaccacctacatgatctgcgttgccgccatgctgccgctgtacagccgcatcggcatgagcccgcgcatcatggccggcctgatcattctggccggcggcgtgatgaacatgacgccctggggcggcccgaccgctcgtgcggccagtgccctgcatgtcgacgcctccgatatcttcgtgccgatgatcccggccatgctggcaggtgtgatcgcgatcctggcgattgcctatttctacggcaagcgcgaacgtgcccgactgggtgaactgcacctgcagggcgatgaagtcgaccacagcgaaatcagcgtctcgcaattccctgatgcgcgccgtccaaagctgatctggttcaacgctgccctgaccctgaccctgatggtcgccctgatcatgggcctgctgcccctgccggtcctgttcatgatcgcgttcagtatcgcgatgatcatcaactacccgaacctgcaggaccagaaggaccgcgtatcggcccacgccggtagcgtgctggcggtggtcggcctgatcttcgctgcgggcatcttcaccggcatcctgtccggcaccggcatggtcgacgcgatgtcgaaaagcctgctggccgtgatccctgacgcgctgggcccgtacctcgcggtgatcaccgcgctggtgagcatgccgttcaccttcttcatgtccaacgacgcgttctactacggcgtactgccagtgctgtccgaagccgctgcccactacggcatcagcccggtggaaatggcccgcgcgtcgatcgtcggtcagccggttcacctgctcagcccattggtgccttcgacctacctgctggtggccctggccggtatcgagttcggtgaccaccagcgcttcacccttaaatgggcgattctggtgtgcatgtgcatcctggttgccgcactgctgatgggcatcttcccgttctatagcagcatgtaa

SEQ ID NO: 36833 - protein, 435 aa, Pseudomonas syringae pv. syringae B728a
MLTFLGFAMVIAFMYLIMSKRLTALIALILVPIIFALFGGFASQIGPMMLAGITKLAPTGVMLMFAILYFALMIDSGLFDPAVRKILKMVKGDPMRISVGTAVLALVVSLDGDGATTYMICVAAMLPLYSRIGMSPRIMAGLIILAGGVMNMTPWGGPTARAASALHVDASDIFVPMIPAMLAGVIAILAIAYFYGKRERARLGELHLQGDEVDHSEISVSQFPDARRPKLIWFNAALTLTLMVALIMGLLPLPVLFMIAFSIAMIINYPNLQDQKDRVSAHAGSVLAVVGLIFAAGIFTGILSGTGMVDAMSKSLLAVIPDALGPYLAVITALVSMPFTFFMSNDAFYYGVLPVLSEAAAHYGISPVEMARASIVGQPVHLLSPLVPSTYLLVALAGIEFGDHQRFTLKWAILVCMCILVAALLMGIFPFYSSM

SEQ ID NO: 36834 - DNA, 1293 bp, Pseudomonas syringae pv. syringae B728a
  CDS (1)..(1293): transl_table=11
atgctcgccacactcggtgtgataaccattcttgccatgctcgtcagcatcatgagcaaacgcatctctcctctggttgcattgatcgccctgccgatcatcgccgccctcctcgctggtttcggtctgcaaaccagtggcttcatcatcaccggcatcaagaacgttgcgcccgtcgtcgggatgtttgtattcgccattctgttcttcggcatcatgacggatgccggcatgctcgatccgatcatcgatcgcatcctcaaacgggtcggcacacggccaacccgcatcgtcatgggcaccgcactgctggcgctgctggtgcatctggacggctccggcgcggtaacctttcttgtgaccattcccgcaatgctgccgctgtacacgcgccttggcatggataaacgcatactggcgtgtgtgacggcgatggctgcgggggtcaacttcctgccctggacgggaccggtgctgcgctcttccgccgcccttcacgtgccggtttcggatctgtttcagccgctcattccggtgcagatcgtcggactgatcttcgtcttcacctgcgcatttttcctgggacggcgcgaagagcgacgcctgggcctgggccctgacaatcttgatgtaaaaccccaccaacgcgtgctcagcgacgctgagcgtgaactgcgcaaacctcggttgttctggatcaacctgctgctgacgctggtggtgatgggcgtgatgatcgcgggggttgtagacccggtggtgatgttcatgctcggcaccgtgattgccttgtgcatcaactaccctgccgtggacacacagcgggcacgcatcgatgcacacgccaagacagccctgaccatggccagcatcctgctggctgccggggtgtttacaggaatcatgcaaggcaccgggatgctgaaggccatggcagaagtggccgtgggccagatcccggccgggcacggcaagctgatcccggtggttgtaggctttatatcaatgcccttgagcctgcttttcgatccggactccttctacttcggcatcatgcccgtggtcgccgaggtcggcaaagccctcggtgtcgacccgatgcaggtcgcacaggcgtcgttgcttggcgtgcataccaccggcttcccggtcagcccgttgacgccagcgacctttctgctggtcggcctgtgcaagatcgagctggccgatcaccagcgcttcactatccctttcctgtttgcggcctcggtcatcatgaccctgaccgctatggtcataggagttttctga

SEQ ID NO: 36835 - protein, 430 aa, Pseudomonas syringae pv. syringae B728a
MLATLGVITILAMLVSIMSKRISPLVALIALPIIAALLAGFGLQTSGFIITGIKNVAPVVGMFVFAILFFGIMTDAGMLDPIIDRILKRVGTRPTRIVMGTALLALLVHLDGSGAVTFLVTIPAMLPLYTRLGMDKRILACVTAMAAGVNFLPWTGPVLRSSAALHVPVSDLFQPLIPVQIVGLIFVFTCAFFLGRREERRLGLGPDNLDVKPHQRVLSDAERELRKPRLFWINLLLTLVVMGVMIAGVVDPVVMFMLGTVIALCINYPAVDTQRARIDAHAKTALTMASILLAAGVFTGIMQGTGMLKAMAEVAVGQIPAGHGKLIPVVVGFISMPLSLLFDPDSFYFGIMPVVAEVGKALGVDPMQVAQASLLGVHTTGFPVSPLTPATFLLVGLCKIELADHQRFTIPFLFAASVIMTLTAMVIGVF

SEQ ID NO: 36836 - DNA, 1296 bp, Haemophilus influenzae 86-028NP
  CDS (1)..(1296): transl_table=11
atggaattatttaaatccatcgttgcagtgattggcattattgccacaatttattttctgattaaaaaagccgaaacccgaaccgttttgattggtgtcggtttaataatgtccattctaacgcttaatccaatgggtgcattagatgcttttgccaaaagcatgacatctggcggattaattatggctatctgttctagtatgggttttgcttatgtaatgaaatacactcaatgtgatactcatctagtgcatttacttaccaaaccattaagcggattaaaattcttcttaattccaattgcaacagtcattacctttttcatcaatattgctattccttctgctgctggttgtgctgctgcggttggcgcaacattaattcccgttttaaaaagtgcgggtgttcgaccagctactgctggtgcagctattttagcagggacttttggatcaatgatgagtccgggttcttctcactcagcaatgattagtgaaatgtcaggattaactatcactcaagtaaacctttcacatgctccatataacatgattgcgggagcaataggtgctgttgttttaaccattcttgcgcttgtttttaaagattatggtgaacaacatcgccaagcttatcttgcagaacaaaaagaaagtgaaattaaagttgttgaaggcgtcaatgtactttatgcccttgcaccattaataccattagttattttagtgattggtggaacatcattacaacaagtaccgggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggctctggcgatgcagcagcgattgcctttaacactgccgtcacgccacatgctgtagaactcggctacacccatataaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttgtag

SEQ ID NO: 36837 - protein, 431 aa, Haemophilus influenzae 86-028NP
MELFKSIVAVIGIIATIYFLIKKAETRTVLIGVGLIMSILTLNPMGALDAFAKSMTSGGLIMAICSSMGFAYVMKYTQCDTHLVHLLTKPLSGLKFFLIPIATVITFFINIAIPSAAGCAAAVGATLIPVLKSAGVRPATAGAAILAGTFGSMMSPGSSHSAMISEMSGLTITQVNLSHAPYNMIAGAIGAVVLTILALVFKDYGEQHRQAYLAEQKESEIKVVEGVNVLYALAPLIPLVILVIGGTSLQQVPGLEWTKMGVPQAMLIGAIYGIIVTRISPVKITEEFFNGMGNSYANVLGIIIAASVFVAGLKSTGAVDAAISFLKESNEFVRWGATIGPFLMGLITGSGDAAAIAFNTAVTPHAVELGYTHINLGMAAAIAGAIGRTASPIAGVTIVCAGLAMVSPVEMVKRTAPGMILAVLFLALFML

SEQ ID NO: 36838 - DNA, 1308 bp, Pseudomonas syringae pv. phaseolicola 1448A
  CDS (1)..(1308): transl_table=11
atgctgactttccttggctttgccatggttattgcgttcatgtacctgatcatgagcaagcgcctgactgcgctgatcgccctgattctggttccaatcatcttcgccctgttcggtggcttcgcggcccagatcggcccgatgatgctggcaggtatcaccaagctggcgccaaccggcgtgatgctgatgttcgccatcctttattttgcgctgatgatcgactccggcctgttcgacccggccgtgcgcaagatcctgaaaatggtcaagggcgacccgatgcgcatttcggtcggcaccgccgtgctggcgctggtggtgtccctcgacggtgacggcgcgaccacctacatgatctgcgtcgccgccatgctgccgctgtacagccgcgtcggcatgagcccgcgcatcatggccggcctgatcattctggcgggtggcgtgatgaacatgactccgtggggtggcccgaccgctcgtgcggccagtgccctgcatgtcgatgcatccgacattttcgtaccgatgatcccggcaatgctggctggcgtggttgcgatcctggcaattgcctacttctacggcaaacgcgaacgcgctcgtctgggtgaactgcaccttaagggtgatgaagtcgatcacagcgaaatcagcgtctcgcaattcccggatgcacgtcgtccaaagctgatctggttcaacggcgcgctgaccttcgcactgatggttgccctgatcatgggcctgctgccgctgccggtactgttcatgatcgcgttcagtatcgcgatgatcatcaactacccgaacctgcaggaccagaaggaccgcgtatcagcccacgccggtagcgttctggcagtggtcggcctgatcttcgccgcaggtatcttcaccggtattctgtccggcaccggcatggtcgacgccatgtcgaaaagcctgctggcagtgatcccggatgcgctcggcccgtacctcgccgtgatcaccgcgctggtgagcatgccgttcaccttcttcatgtccaacgacgcgttctactacggcgtactgccggtgctgtccgaagccgctgcccactacggcatcagcccggttgaaatggcccgcgcctcgatcgtcggtcagccggtccacttgctcagcccgctggtgccatcgacctacctgctggttgccttggccggtatcgagttcggcgaccaccagcgcttcaccctgaaatgggcgattctggtgtgcatgtgcatcctggttgccgcgctgctgatggggatcttcccgttctatagcagcatgtaa

SEQ ID NO: 36839 - protein, 435 aa, Pseudomonas syringae pv. phaseolicola 1448A
MLTFLGFAMVIAFMYLIMSKRLTALIALILVPIIFALFGGFAAQIGPMMLAGITKLAPTGVMLMFAILYFALMIDSGLFDPAVRKILKMVKGDPMRISVGTAVLALVVSLDGDGATTYMICVAAMLPLYSRVGMSPRIMAGLIILAGGVMNMTPWGGPTARAASALHVDASDIFVPMIPAMLAGVVAILAIAYFYGKRERARLGELHLKGDEVDHSEISVSQFPDARRPKLIWFNGALTFALMVALIMGLLPLPVLFMIAFSIAMIINYPNLQDQKDRVSAHAGSVLAVVGLIFAAGIFTGILSGTGMVDAMSKSLLAVIPDALGPYLAVITALVSMPFTFFMSNDAFYYGVLPVLSEAAAHYGISPVEMARASIVGQPVHLLSPLVPSTYLLVALAGIEFGDHQRFTLKWAILVCMCILVAALLMGIFPFYSSM

SEQ ID NO: 36840 - DNA, 1305 bp, Ralstonia eutropha JMP134
  CDS (1)..(1305): transl_table=11
atgacactggtcgccatcatcctgttcgtggtctttatcggcctgatgctgctgggcgtgcccatcggcgtgtcgctgggccttggcgggcttgtcgccatcggcctgtcgaacctcgatacccagatgttcggcctgctggccgtgccgcagaacttctatgccggtctggccaagtatccgctgctggccattcccatgttcgtgctggtcggatcgatctttgatcgctctggcgtggcgcagcgcctggtgacgtttgccatcgctatcgtcgggcgtggccccggcatgctgccgctggtcgccattctggtggccatgtttctcggcggcatttcgggctctggccccgccaacgcggccgccgtcggcggcgtgatgatcgcggcgatgtcgcgggccggctatccgggttcgtacagcgcggcagtggtcggcgccgcggcggcgaccgacatcctgattccgccttcggtggccttcatcatctacagcgtgctggtgccgggtgcttcggtgcctgcgctgttcgcggccggcatgatcccgggcgtgctggccggcgtggcgctgatcgtgccggcggtgtggctggcccgcaagcacaacatgggcgccatcgaagccgcgctgccgcgcccgccgttctggaagagcctgcgcgaggcagcctggggcctggtcgcgccattcctaattctcggtggcatgcgtgccggctggttcacgccaaccgaagccgcggtggttgcggtggtctatggcctgttcgtgggcatggtgatctaccgcagcattggcatgaaggacctgttcgtgatcttccaggaggcggcggagacctcggccgtgatcctcctggtggtcgcgctggctggcatcttcgcgtatgcgctgtcgacgctcggcgtcattgacccgctcgcaaacgcgatcgccaactccggtctcggcgaatacggcgtgctggcgctgatcgtgctgctgctgatgacggttggcatgttcctggacggcatttctatcttcctgatcttcgtgccgctgctgctgccgatcgccaccgcgttccactggaacccggtgtggttcggggtggtgctcacgctcaaggtggcgctggggcagttcacgccgccgctggccgtgaacctgatggtgtcgtgccggattgcccgcgtgcgcatggaggagaccgtgccctgggtggtctggatgctgctggcgatgttcatcgccatgctgatggtgctggcctatccgccgctggcgacgtggttgccggactatctgggctattga

SEQ ID NO: 36841 - protein, 434 aa, Ralstonia eutropha JMP134
MTLVAIILFVVFIGLMLLGVPIGVSLGLGGLVAIGLSNLDTQMFGLLAVPQNFYAGLAKYPLLAIPMFVLVGSIFDRSGVAQRLVTFAIAIVGRGPGMLPLVAILVAMFLGGISGSGPANAAAVGGVMIAAMSRAGYPGSYSAAVVGAAAATDILIPPSVAFIIYSVLVPGASVPALFAAGMIPGVLAGVALIVPAVWLARKHNMGAIEAALPRPPFWKSLREAAWGLVAPFLILGGMRAGWFTPTEAAVVAVVYGLFVGMVIYRSIGMKDLFVIFQEAAETSAVILLVVALAGIFAYALSTLGVIDPLANAIANSGLGEYGVLALIVLLLMTVGMFLDGISIFLIFVPLLLPIATAFHWNPVWFGVVLTLKVALGQFTPPLAVNLMVSCRIARVRMEETVPWVVWMLLAMFIAMLMVLAYPPLATWLPDYLGY

SEQ ID NO: 36842 - DNA, 1329 bp, Staphylococcus saprophyticus subsp. saprophyticus ATCC 15305
  CDS (1)..(1329): transl_table=11
atgttctgtttgaacttaaaggaaagttggttttgtatggaggagacaaagaaaggtaatgcatgggcactgatacctttaattatttttgtgggtatgtttttaggtgttggtatcattaccggcgatttcactacaatgcccctaaatgttgcgatactagtagcgacaattgtgggacttgtattaaatagaaaagaatcatttcaaaagaaagttgaaatttttactaagggtgcaggacattccaatattatactaatgatgctcattttcttattagcaggagcgttttcgcaaacaactgaagatatgggtggcgtaaaatctacagtgaatttgggactatctttgattcctgagaatttaatcattgtaggtttattcgtgatatgtatgttcgtgtcactttctatgggtacatccgtgggcactgtagcagctatagcgcctgttggctttggactaagccaacaggcggatgtctctgcagccatcactatggcgacggtcgtaggtggggcgatgtttggtgataatttatcaatgatttcagatacaacgatagctgcggtaagaactcaaaaaacaaaaatgagtgataagtttaaggtgaatatcaaaatcgtgttacctggtgccatatttactgtcattgtactttggtttttaacaaatggagcacaaattgatgcatctaagagctacgattatgatcttataaaagtagtaccttatttatttgtactcatactcgcattattcggcgtcaacgttattattgtacttattggcggtattatactttcagcaattataggtttattttatggtacctttgattggattgggttattaagctctatttctaaagggattattggcatggaggatattgccattattgcactattaattggtggtctagtggcattgatacaacacaatggtggtattacatggttacttaattttgtgcgtaatagagtgaaatctaagcgtggcgcagaactaggaattgctggcttagtgagtgtggccgatatttcaactgctaataatacgatttctatattaatggcagggccattagctaaagacatttcagatgaatatggtgtagatccgcgtaaatcagcaagtattctagatatgtttgcaagctgtttccaaggactattaccgtatagtccacagcttattgcagcagcaggtgtggcatctatatcaccgtttgaattggtaccgtatgcgatttatccgatgatattagggatttgtggtctgattgctatcgcctttagattgccgagattggacaagaaataa

SEQ ID NO: 36843 - protein, 442 aa, Staphylococcus saprophyticus subsp. saprophyticus ATCC 15305
MFCLNLKESWFCMEETKKGNAWALIPLIIFVGMFLGVGIITGDFTTMPLNVAILVATIVGLVLNRKESFQKKVEIFTKGAGHSNIILMMLIFLLAGAFSQTTEDMGGVKSTVNLGLSLIPENLIIVGLFVICMFVSLSMGTSVGTVAAIAPVGFGLSQQADVSAAITMATVVGGAMFGDNLSMISDTTIAAVRTQKTKMSDKFKVNIKIVLPGAIFTVIVLWFLTNGAQIDASKSYDYDLIKVVPYLFVLILALFGVNVIIVLIGGIILSAIIGLFYGTFDWIGLLSSISKGIIGMEDIAIIALLIGGLVALIQHNGGITWLLNFVRNRVKSKRGAELGIAGLVSVADISTANNTISILMAGPLAKDISDEYGVDPRKSASILDMFASCFQGLLPYSPQLIAAAGVASISPFELVPYAIYPMILGICGLIAIAFRLPRLDKK

SEQ ID NO: 36844 - DNA, 1383 bp, Staphylococcus saprophyticus subsp. saprophyticus ATCC 15305
  CDS (1)..(1383): transl_table=11
gtgacaacacaagactatcaactattgattattacagtgataagtattttatttctcatctttttaatcacttcaaaattaaaattccatccactacttgcattactactaaccgcaatctttgtcggtttcacttctggattagacattgataaaattgttaaatctatagaaactggggctggttcaacactcggtgaaacgggcgtaaccatcgcgttaggtgccatgctaggtaagatactttctgattcaggtgccagcgacaaaattgcatcttcgatactacacaatgcgtcttacaaaaaattaccatggatgatggcgttagctgcgtttattattgggattccaatgtttttcgaagttggtttaattatgctactgccactgatttttacaattgctaaaaaattagaagatgaacataaaatgaaaggatcagcctatgtagccatcggtgtgcctgttatagcggcattagcaacgatgcatggtatggtgccaccacaccctggaccactaatttcagtgaatcagtttggtgcgaatatcgggataactatggtacttggtgtcatatgtgcaattccaaccattatcattgctggtccactttacggtaaatttattacaccacgattatctgtgaagccaaatcaagatttgttaaatcaatatacgaatgacaacaacgaaaacactcaagcaccatcaacattcatagccttttctactatattagttccagtgattatgatgttattacatgccattgctggtatcttttttggagaaaaaacattacaatacaagattttcgaattcttcggaagcccaatcatcgctatgtttgtgggtgtcctttatgccattatcgttctcggctatttaaaacatcgcgacacacaaaaaattcgagatgctttaggtagtagtttgaaacctatcgccggtatcatgctaatcattgcgggtggtggcgcattcggtcaagtccttgaagattctggcgtaggtacggcaattgttcaccttgcagacaatttctcattatctgcattattaatgggatgggtcgttgctgcattattatctatatcaacaggttccgcaaccgttggtattgttggcgcaaccaatttactttacccattgattcaagcagatccaagtatcaataaagaattattaacgatcgctattggttctggctctttattctttaactacgtaaatcatggtggcttctggttagtcaaagaatcctttggtatgtctatgggagaaacatttaaaacgattacgattgtacaatccattgtcggtatttgtggtctgattatggtactactcttgaatgctattattggtttgttttaa

SEQ ID NO: 36845 - protein, 460 aa, Staphylococcus saprophyticus subsp. saprophyticus ATCC 15305
MTTQDYQLLIITVISILFLIFLITSKLKFHPLLALLLTAIFVGFTSGLDIDKIVKSIETGAGSTLGETGVTIALGAMLGKILSDSGASDKIASSILHNASYKKLPWMMALAAFIIGIPMFFEVGLIMLLPLIFTIAKKLEDEHKMKGSAYVAIGVPVIAALATMHGMVPPHPGPLISVNQFGANIGITMVLGVICAIPTIIIAGPLYGKFITPRLSVKPNQDLLNQYTNDNNENTQAPSTFIAFSTILVPVIMMLLHAIAGIFFGEKTLQYKIFEFFGSPIIAMFVGVLYAIIVLGYLKHRDTQKIRDALGSSLKPIAGIMLIIAGGGAFGQVLEDSGVGTAIVHLADNFSLSALLMGWVVAALLSISTGSATVGIVGATNLLYPLIQADPSINKELLTIAIGSGSLFFNYVNHGGFWLVKESFGMSMGETFKTITIVQSIVGICGLIMVLLLNAIIGLF

SEQ ID NO: 36846 - DNA, 1323 bp, Shigella sonnei Ss046
  CDS (1)..(1323): transl_table=11
atgttcggcataattatatctgtcatcgtattaattacgatgggctatttgatcctgaaaaactacaaacctcaggtggtgctggctgccgcaggtgtcttcctgatgatgtgcggagtctggttagggttcggtggtgtactcgatcccgccaaaagcagcggctacttgatcgtcgacatttataatgaaatcctgcgcatgctgtccaaccgcattgccggattggggctgtcgattatggcggtgggcggttatgcccgctacatggagcgcataggagccagtcgcgcgatggtgagcttgctaagccgcccgttaaaactcattcgctcgccgtatattattctgtcggcaacttacgtcatcggccaaatcatggcgcagtttattaccagcgcctccggtctgggtatgttgctgatggtcaccttatttccgacgctggtgagtctgggagtaagtcgcctctctgcggtggcggttatcgcaaccacgatgtccattgagtgggggattctggaaacgaactccatttttgcagcccaggtcgcgggaatgaaaattgccacatacttcttccactaccagcttccggtcgcctcttgcgtcattatctcggtggcgatctcccactttttcgtgcaacgcgcttttgacaaaaaagataaaaatatcaatcacgaacaggcagagcaaaaaactctcgataatgtcccgccgctctattacgccattttacctgtgatgccgttaatcctgatgctcggctcgctgttcctcgcccacgtcgggctgatgaagtcagaactgcatctggtggtggtgatgttactaagtttgacggtgacgatgtttgttgagttcttccgcaagcataacttgcgcgaaacaatggacgatgtgcaggcgttttttgacggcatgggtacgcagtttgccaacgtggtaacgctggtggtcgcgggtgaaatatttgcgaaaggcttaacgacgattggcactgttgatgcggttatcaggggtgcggagcattctggtctgggcggtattggcgtgatgattattatggcgctagtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcgcggtttcgccgattactgcggtggtaaagcggacagcgatccccatggcagtcggtttcgtggtgaatatgattgccacaatcacgctattttattaa

SEQ ID NO: 36847 - protein, 440 aa, Shigella sonnei Ss046
MFGIIISVIVLITMGYLILKNYKPQVVLAAAGVFLMMCGVWLGFGGVLDPAKSSGYLIVDIYNEILRMLSNRIAGLGLSIMAVGGYARYMERIGASRAMVSLLSRPLKLIRSPYIILSATYVIGQIMAQFITSASGLGMLLMVTLFPTLVSLGVSRLSAVAVIATTMSIEWGILETNSIFAAQVAGMKIATYFFHYQLPVASCVIISVAISHFFVQRAFDKKDKNINHEQAEQKTLDNVPPLYYAILPVMPLILMLGSLFLAHVGLMKSELHLVVVMLLSLTVTMFVEFFRKHNLRETMDDVQAFFDGMGTQFANVVTLVVAGEIFAKGLTTIGTVDAVIRGAEHSGLGGIGVMIIMALVIAICAIVMGSGNAPFMSFASLIPNIAAGLHVPAVVMIMPMHFATTLARAVSPITAVVKRTAIPMAVGFVVNMIATITLFY

SEQ ID NO: 36848 - DNA, 1293 bp, Haemophilus somnus 2336
  CDS (1)..(1293)
atgatacagtttaattctattgtggctattcttggcattatcgccacggtttatcttctcattaaaaaatatgaaactcgtacagtattaatcagtgttggtttgttgatggcaatgttgactttcaaaccaatggaggcgttagatgcttttgctaaatccatgaccagtagcggtttaatcatggctatttgttccagtatggggtttgcttatgtgatgaaatacactcaatgcgatacacatttggtacatttaatgactcgtccgttaagtggtttaaaattctttttaattccgattgcaacagttattacgttctttattaatattgctattccgtcagcagcaggttgtgcagcggctgttggtgccactttaattccagtattgaaaagtgcgggtgtacgtccggcaacggcaggtgcggcgattttggcagggacttttggttcaatgatgagtcctggatcttctcatagtgcaatgattagcgaaatgtcgaaattgaccattaccgaagtgaatttgtctcacgcaccttacactatgattgcaggtgcaatcggcacagtagttttaactttgttagcgattgtatttaaagattacggtgaggaacatcggaaagcctatttacaagaaaatcaagaaacggaaagtactttcagtaaggtgaatatattctatgctttagcacctctcgttccgttgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcttatgccaatgtattagggatcatcattgccgcaagtgtgtttgttgcaggcttaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttagcaatggtaagtcctgtagaaatagtgaaacgtactgcactgggtatgattttggcaaccttatttttaacgttatttatgttataa

SEQ ID NO: 36849 - protein, 430 aa, Haemophilus somnus 2336
MIQFNSIVAILGIIATVYLLIKKYETRTVLISVGLLMAMLTFKPMEALDAFAKSMTSSGLIMAICSSMGFAYVMKYTQCDTHLVHLMTRPLSGLKFFLIPIATVITFFINIAIPSAAGCAAAVGATLIPVLKSAGVRPATAGAAILAGTFGSMMSPGSSHSAMISEMSKLTITEVNLSHAPYTMIAGAIGTVVLTLLAIVFKDYGEEHRKAYLQENQETESTFSKVNIFYALAPLVPLIILVLGGTSLAENPGLAWTKMGVPQAMLIGAIYAILVTRISPVKITEEFFNGMGNSYANVLGIIIAASVFVAGLKATGAVDSAIEFLKHSNEFVRWGATIGPFLMGLVTGSGDAAAIAFNTAVTPHAVELGYTHVNLGMAAAIAGAIGRTASPIAGVTIVCAGLAMVSPVEIVKRTALGMILATLFLTLFML

SEQ ID NO: 36850 - DNA, 1293 bp, Actinobacillus pleuropneumoniae serovar 1 str. 4074
  CDS (1)..(1293)
atggatgaactcaaaccttttgttgccattctcggcattgtggtcacggtttacctgttgattaaaaaatatgaaacccgaacggtattaatcggtatcggtttgattatgtcggttgtaacgcttaatccgatgggagcattagatgcctttgctaaatcaatgacttcaagcggtctgattatggcgatttgttccagtatgggttttgcctatgtaatgaaatatacccaatgcgatacgcatttggtgcatttgctgactaaaccgttaagcggtcttaaattctttttaatcccgattgcgaccattattactttctttattaacattgcgattccgtctgcggcaggttgtgcggctgcggtgggggcaaccttaattccggtattaaaaagtgcgggagtacgccctgcaaccgccggtgcggcgattttggcaggaacattcggttcgatgatgagcccgggttcttctcactcggcaatgattagtgaaatgtcgaatttaactattaccgaagtgaacctttcccatgcgccttataccatgatcgccggcgctatcggcgcagtcgctttgactttaatggcaatcatttttaaagattacggtgaagagcatcgtaaagcttatttagctgaaaaccaaaatgcggaaaccaagtttagcggcgttaatccgttatatgcgcttgctccgttattaccgttaattatccttgttatcggtggtacagaattacaaaaaacaccgggcttagaatggacaaaaatgggcgtaccgcaagcgatgttaatcggtgcgatttatgcaattattgttacgcgtatttcgccagtgaaaattaccgaagaattcttcaacggtatgggtaattcgtatgctaatgttctcggtattattattgccgcaagcgtatttgtatccggcttaaaagcaactggtgcggtagattcggcaattgaattccttaaacactcaaatgaatttgtccgttggggggcgactatcggtccgttcctaatggggattgtgaccggttcgggcgatgcggcggcgattgcgtttaatactgcagtaacgcctcacgcagtggaattgggttatacccatgtgaatttaggtatggcggcagcgatcgccggtgctatcggtcgtacaatgtcaccgattgccggggtaaccattgtttgtgcgggcttggctatggtcagtccggtcgagatggtaaaacgtaccgcaccgggtatgattttagccaccttgttcttggcgttgtttatgttgtaa

SEQ ID NO: 36851 - protein, 430 aa, Actinobacillus pleuropneumoniae serovar 1 str. 4074
MDELKPFVAILGIVVTVYLLIKKYETRTVLIGIGLIMSVVTLNPMGALDAFAKSMTSSGLIMAICSSMGFAYVMKYTQCDTHLVHLLTKPLSGLKFFLIPIATIITFFINIAIPSAAGCAAAVGATLIPVLKSAGVRPATAGAAILAGTFGSMMSPGSSHSAMISEMSNLTITEVNLSHAPYTMIAGAIGAVALTLMAIIFKDYGEEHRKAYLAENQNAETKFSGVNPLYALAPLLPLIILVIGGTELQKTPGLEWTKMGVPQAMLIGAIYAIIVTRISPVKITEEFFNGMGNSYANVLGIIIAASVFVSGLKATGAVDSAIEFLKHSNEFVRWGATIGPFLMGIVTGSGDAAAIAFNTAVTPHAVELGYTHVNLGMAAAIAGAIGRTMSPIAGVTIVCAGLAMVSPVEMVKRTAPGMILATLFLALFML

SEQ ID NO: 36852 - DNA, 1296 bp, Haemophilus influenzae R2846
  CDS (1)..(1296)
atggaattatttaaatccatcgttgcagtgattggcattattgccacaatttattttctgattaaaaaagccgaaacccgaactgttttaattggtgtcggtttaataatgtccattctaacgctgaatccaatgggtgcattagatgcttttgccaaaagtatgacatctggcggattaattatggctatctgttctagtatgggttttgcttatgtaatgaaatacactcaatgtgatactcatctggtacatttacttaccaaaccattaagcggattaaaattcttcttaattccaattgcaaccgtcattacctttttcatcaatattgctattccttctgcagctggttgtgctgctgcggttggtgcaacattaattcccgttttaaaaagtgcgggtgttcgaccagctactgctggtgcagctattttagcagggacttttggatcaatgatgagtccgggttcttctcactcagcaatgattagtgaaatgtcaggcttaactatcactcaagtaaacctttcacatgcaccatataacatgattgcgggagcaataggtgcggttgttttaacaattcttgcgcttgtttttaaagattatggtgaacaacatcgtaaagcttatcttgcagaacaaaaagaaagtgaaattaaagttgttgaaggcgtcaatgtactttatgcccttgcaccattaataccattagttattttagtgattggtggaacgtcattacaacaagtaccaggtcttgaatggactaaaatgggcgttcctcaagcgatgctaattggtgcaatttacggcattatcgtaactcgtatttccccagtaaaaatcacagaagaatttttcaatggtatgggaaattcttatgcaaacgtacttggtattatcattgcagccagtgtatttgtggcaggattaaaatctacgggcgcagtggatgctgcaatttctttcttaaaagaatccaacgaatttgtacgttggggtgcaacaattggaccattcttaatgggcttaattacaggttctggcgatgcagcagcgattgcctttaacacagccgtcacgccacatgctgtagaactcggctacacccatgtaaatcttggtatggcagcagccattgctggtgcaattggtcgtacagcttcaccaattgcaggcgtaactattgtttgtgcaggccttgcgatggtaagcccagtagaaatggtaaaacgtaccgcaccaggcatgatacttgctgttttattcttagcattatttatgttgtag

SEQ ID NO: 36853 - protein, 431 aa, Haemophilus influenzae R2846
MELFKSIVAVIGIIATIYFLIKKAETRTVLIGVGLIMSILTLNPMGALDAFAKSMTSGGLIMAICSSMGFAYVMKYTQCDTHLVHLLTKPLSGLKFFLIPIATVITFFINIAIPSAAGCAAAVGATLIPVLKSAGVRPATAGAAILAGTFGSMMSPGSSHSAMISEMSGLTITQVNLSHAPYNMIAGAIGAVVLTILALVFKDYGEQHRKAYLAEQKESEIKVVEGVNVLYALAPLIPLVILVIGGTSLQQVPGLEWTKMGVPQAMLIGAIYGIIVTRISPVKITEEFFNGMGNSYANVLGIIIAASVFVAGLKSTGAVDAAISFLKESNEFVRWGATIGPFLMGLITGSGDAAAIAFNTAVTPHAVELGYTHVNLGMAAAIAGAIGRTASPIAGVTIVCAGLAMVSPVEMVKRTAPGMILAVLFLALFML

SEQ ID NO: 36854 - DNA, 1296 bp, Haemophilus influenzae R2866
  CDS (1)..(1296)
atggaattatttaaatccatcgttgcagtgattggcattattgccacaatttattttctgattaaaaaagccgaaacccgaactgttttgattggtgtcggcttaattatgtccattctaacgctgaatccaatgggtgcattagatgcttttgccaaaagtatgacatctggcggattaattatggccatctgttccagtatgggttttgcttatgtaatgaaatacactcaatgtgatactcatctggtacatttacttaccaaaccattaagcggattaaaattcttcttaattccaattgcaacagtcatcacctttttcatcaatattgctattccttctgctgctggttgtgctgctgcggttggtgcaacattaattcccgttttaaaaagtgcgggtgttcgaccagctactgctggtgcagctattttagcagggacttttggatcaatgatgagcccaggttcttctcactcagcaatgattagtgaaatgtcaggcttaactatcactcaagtaaacctttcacatgcaccatataacatgattgcgggagcaataggtgcggttgttttaacaattcttgcgcttgtttttaaagattatggtgaacaacatcgccaagcttatcttgcagaacaaaaagaaagtgaaattaaagttgttgaaggcatcaatgtactttatgcccttgcaccattaataccattagttattttagtgattggtggaacgtcattacaacaagtaccaggtcttgaatggactaaaatgggcgttcctcaagcgatgctaattggtgcaatttacggcattatcgtcactcgtatttccccagtaaaaatcactgaagaatttttcaatggtatgggaaattcttatgcaaacgtacttggtattatcattgcagccagtgtatttgtggcaggattaaaatctacaggtgcagtggatgctgcaatttctttcttaaaagaatccaacgaatttgtacgttggggtgcaacaattggaccattcttaatgggcttaattacaggttctggcgatgcagcagcgattgcctttaacacagccgtcacgccacatgctgtagaactcggctacacccatgtaaatcttggtatggcagcagccattgctggtgcaattggtcgtacagcttcaccaattgcaggtgtaaccattgtttgtgctggccttgcgatggtaagcccagtagaaatggtaaaacgtaccgcaccaggcatgatacttgctgttttattcttagcattatttatgttgtaa

SEQ ID NO: 36855 - protein, 431 aa, Haemophilus influenzae R2866
MELFKSIVAVIGIIATIYFLIKKAETRTVLIGVGLIMSILTLNPMGALDAFAKSMTSGGLIMAICSSMGFAYVMKYTQCDTHLVHLLTKPLSGLKFFLIPIATVITFFINIAIPSAAGCAAAVGATLIPVLKSAGVRPATAGAAILAGTFGSMMSPGSSHSAMISEMSGLTITQVNLSHAPYNMIAGAIGAVVLTILALVFKDYGEQHRQAYLAEQKESEIKVVEGINVLYALAPLIPLVILVIGGTSLQQVPGLEWTKMGVPQAMLIGAIYGIIVTRISPVKITEEFFNGMGNSYANVLGIIIAASVFVAGLKSTGAVDAAISFLKESNEFVRWGATIGPFLMGLITGSGDAAAIAFNTAVTPHAVELGYTHVNLGMAAAIAGAIGRTASPIAGVTIVCAGLAMVSPVEMVKRTAPGMILAVLFLALFML

SEQ ID NO: 36856 - DNA, 1347 bp, Pediococcus pentosaceus ATCC 25745
  CDS (1)..(1347)
atgttattaaagaaaaatgatattaaaatgatacttttatcactaggtttaattttgatgtacatcgctatattgttgggtaatgagctaaaggtaacgcaacctactggtacaaatttattaaatccatttcaggcaattgttgatcaattttcatcaactttagtaggaccaggatttgttattttaattttaggtggttatagcgcttatatgaaccacataggtgctaatcaagttaccgtacatgcacttaccaaaccgatcactaaaattaaatctatttatttactagctcccattgtttttcttattggaaacctattatcacttgtaattccaagtgcttcaaatctagcaattattctccttgcaactctatatcccgtattgcgttctgcaggcatgtcgcgactaacatcagcagctatcatcggaacttcagctacaatagttccaactcccttaggtgcagataacgtagctattgcatcccaatttcacatgtctgtaacagattatgtttttcaaaaacacgctttaatttctattccaaccttgctagctattactatagttcattatttatggcaaaaatatcaagacaaaaagcatcctgaagagttgtcatattcttcagagctttctcaaaataaagaacaggattcaacagcgtcacctaaggtaagttataaaggattcaaagcttttatttatggattactaccgctcttacctattgtaatattactaatcatctttttcaccaatatatttcttcacactaagctgaatattagtgttcaattagttagcttacttagttttgttattgctgtacttgtagaaatttttaataaaaagcatccccaaattgttttaaaagaaactagtaatttttttgaaggtatgggtagcgtaatgagtatcgtagcattactagtttccgcccaagtattcgtacaaggactaacttcgatagggataattgatttaattcaaaaaactatgcaaactatgaatagctcaggtattgttttaccagtagttatggttgtattcacggcaattattgtcttattaagtggaagtggaactgcgttactttatgcaatgattcctctgttattaccattatctaaagctgcaggtatttcccctatcgccctatcagtacctatgcaattagcagggaacttattgcgagcaatctctcctgtagcggcagttattttaatagttgctggaaccacaaagttatctccagtaaaaattgttaaacgcacttccgttccaatggtttttggagtaatcatgatgcttgttatgtccctactaatcttttag

SEQ ID NO: 36857 - protein, 448 aa, Pediococcus pentosaceus ATCC 25745
MLLKKNDIKMILLSLGLILMYIAILLGNELKVTQPTGTNLLNPFQAIVDQFSSTLVGPGFVILILGGYSAYMNHIGANQVTVHALTKPITKIKSIYLLAPIVFLIGNLLSLVIPSASNLAIILLATLYPVLRSAGMSRLTSAAIIGTSATIVPTPLGADNVAIASQFHMSVTDYVFQKHALISIPTLLAITIVHYLWQKYQDKKHPEELSYSSELSQNKEQDSTASPKVSYKGFKAFIYGLLPLLPIVILLIIFFTNIFLHTKLNISVQLVSLLSFVIAVLVEIFNKKHPQIVLKETSNFFEGMGSVMSIVALLVSAQVFVQGLTSIGIIDLIQKTMQTMNSSGIVLPVVMVVFTAIIVLLSGSGTALLYAMIPLLLPLSKAAGISPIALSVPMQLAGNLLRAISPVAAVILIVAGTTKLSPVKIVKRTSVPMVFGVIMMLVMSLLIF

SEQ ID NO: 36858 - DNA, 1272 bp, Haemophilus somnus 129PT
  CDS (1)..(1272)
atgttaggattatttttaggtagtttattcctatttttatttcttggtgtgccagtagcgttatcaatgttactgagtgccagttttatgttatggcatatggatatgtttgatactcaattaattgctgaaaactttgtaatgggtactaataactttcccttaatggcaattccattttttatgctgactggtgaaattatgaaatacggcggtatttctgagcggattatcaattttgctatgagtatggtaggacatattaaaggaggattaggttatgtagtgattatttcaggtttaatctttgctgggttatctggttctgctgtagcagacaccgcagcgttaggggcaattttaattccaatgatggtagctaaaaaatatgatgttgctcgttctacaggtttagtctgtgcggcaggaattatttcggtggtcattcctccaagtattccaatgattgtatatggaattaccgcaggtgcatccattaccaaattatttatgggtggcacggttcctggattattaatggttacaggattgtggttaatgtggaaatttttatatcgtaatcacgaagaaaatataaaaccgaaacaatctggtgcagaacgctggcaagcttttaaaaaagcttttttcccattattgttaccggtcattatcattgttgggttgcgtggcggtatttttactccaacagaagcaggtgtagttgcggcgatttatgcgggattggttagtcttggctatcgcagtttaaataaagaaaatttaatcgaagtctttttaaatacgattaaaactacttcaatggtgatgtttgttgcggctgcggcaatgatttctgcatttgcaattactgttgctcaaattccaacggagttggtgcaatttatcaaaggattaactgacaattcaacggtattaatgttggttattatgattttcttattactcgttggttgtgtaatggatttaattcctgcagtattaatttttgtacccgtattattgccggtattgagagcttacaatatcgatattgcttattttggcattatgatggtgattaacttatcgattggcttaatcacacctccagtgggaacggtactttatgttggttcgggaattgctaaacttggcataagtaaaattagtaagggaatttcgccgtttttgttagtttatgttgctattttaatgttgatggtgttctttcctgatgttgtgattgtgccaatgaattggttatcttag

SEQ ID NO: 36859 - protein, 423 aa, Haemophilus somnus 129PT
MLGLFLGSLFLFLFLGVPVALSMLLSASFMLWHMDMFDTQLIAENFVMGTNNFPLMAIPFFMLTGEIMKYGGISERIINFAMSMVGHIKGGLGYVVIISGLIFAGLSGSAVADTAALGAILIPMMVAKKYDVARSTGLVCAAGIISVVIPPSIPMIVYGITAGASITKLFMGGTVPGLLMVTGLWLMWKFLYRNHEENIKPKQSGAERWQAFKKAFFPLLLPVIIIVGLRGGIFTPTEAGVVAAIYAGLVSLGYRSLNKENLIEVFLNTIKTTSMVMFVAAAAMISAFAITVAQIPTELVQFIKGLTDNSTVLMLVIMIFLLLVGCVMDLIPAVLIFVPVLLPVLRAYNIDIAYFGIMMVINLSIGLITPPVGTVLYVGSGIAKLGISKISKGISPFLLVYVAILMLMVFFPDVVIVPMNWLS

SEQ ID NO: 36860 - DNA, 1293 bp, Haemophilus somnus 129PT
  CDS (1)..(1293)
atgatacagtttaattctattgtggctattcttggcattatcgccacggtttatcttctcattaaaaaatatgaaactcgtacagtattaatcagtgttggtttgttgatggcaatgttgactttcaaaccaatggaggcgttagatgcttttgctaaatccatgaccagtagcggtttaatcatggctatttgctccagtatggggtttgcttatgtgatgaaatacactcaatgcgatacacatttggtgcatttaatgactcgtccgttaagtggtttaaaattctttttaattccgattgcaacagttattacgttctttattaatatcgctattccgtcagcagcaggttgtgcagcggctgttggtgccactttaattccagtattgaaaagtgcgggtgtacgtccggcaacggcaggtgcggcgattttggcagggacttttggttcaatgatgagtcccggatcttctcatagtgcaatgattagcgaaatgtcgaaattgaccattaccgaagtgaatttgtctcacgcaccttacactatgattgcaggtgcaatcggcacagtggttttaactttgttagcgattgtatttaaagattacggtgaggaacatcggaaagcctatttacaagaaaatcaacaaacggaaagtactttcagtaaggtgaatatattccatgctttagcacctcttgttccattgattatattggttctcggcggaacctctttagctgaaaacccaggattagcgtggacaaaaatgggcgtgccacaagcaatgttaattggtgcgatttatgccattttagttacccgaatttctccggttaaaattaccgaagaattttttaatggaatgggtaattcttatgccaatgtattagggatcatcattgccgcaagtgtgtttgttgcaggattaaaagcgacaggagcggtagattccgctattgaatttttgaaacattctaacgaatttgtccgttggggagcgactatcggaccattcttaatgggtttggtaacaggttcaggtgatgctgcggcaatcgcatttaataccgctgtaacaccacatgcagtggaattgggttatacccatgtcaatttaggaatggcggcggctattgccggagcgattggacgtaccgcttctccaattgcaggagtaaccattgtttgtgccggtttggcaatggtaagtcctgtagaaatagtgaaacgtactgcactgggtatgattttggcaaccttatttttaacgttatttatgttataa

SEQ ID NO: 36861 - protein, 430 aa, Haemophilus somnus 129PT
MIQFNSIVAILGIIATVYLLIKKYETRTVLISVGLLMAMLTFKPMEALDAFAKSMTSSGLIMAICSSMGFAYVMKYTQCDTHLVHLMTRPLSGLKFFLIPIATVITFFINIAIPSAAGCAAAVGATLIPVLKSAGVRPATAGAAILAGTFGSMMSPGSSHSAMISEMSKLTITEVNLSHAPYTMIAGAIGTVVLTLLAIVFKDYGEEHRKAYLQENQQTESTFSKVNIFHALAPLVPLIILVLGGTSLAENPGLAWTKMGVPQAMLIGAIYAILVTRISPVKITEEFFNGMGNSYANVLGIIIAASVFVAGLKATGAVDSAIEFLKHSNEFVRWGATIGPFLMGLVTGSGDAAAIAFNTAVTPHAVELGYTHVNLGMAAAIAGAIGRTASPIAGVTIVCAGLAMVSPVEIVKRTALGMILATLFLTLFML

SEQ ID NO: 36862 - DNA, 996 bp, Campylobacter coli RM2228
  CDS (1)..(996): transl_table=11
atgctaggtattgttttttctttatttagtatttttttacttgtttttatgctttataaaaaaatcaatgctcatatggctttgcttttaagtggtttacttttactttccttagctgctatttttggactttctccacacattgtcgctaaaggttctttaaatttaggtttttttgatatttttcaagttttcaatcaaaccatgtcaaatacattagcagggcttggacttacacttatgactatagcaggtttttctgcttatatggatcatgtaggggcttcttatgcactttttaaagtttttgaaaaacctttaaaagccgtaaaatctccttatgttttactcatagttgcttattttatcgtgcaatttttagttcttttcatcccttctcacgcaggcttagcacttttacttatggttactatgtatcctatacttgtacgctctggtgtttcaaaactttctgccttaagtgtgattgcgatttgtcaatatatcgatcatggacctggaagtggaaatgtgatcatggcgtcaaaagtagctgaagttgatcctgcaatttattttgttcattatcaactccctacaaccttgcctatcattatagctgtaggtattgcgatatatctttgcaataaattttttgacaaaaaagataattttgtcttcaatgcacaagaaattgaaaaagaactaaatgaaaatgaaggtaaagaaaaagaacttaaaaagcctcctagaatttatgcgattttacctataattcctttggttttaatcctaggatttagttccgtgcttgatagcatcttggttttaatgggaataagtagcgctgaagaagttaaagcagctgctagcactgccattgaaatgaatgttccagtagcaatggtgatttcaacttttgtggctattatttttgaaatgatacgctataaaagtatagtagaaactcttaattctattatgattttcttttaa

SEQ ID NO: 36863 - protein, 331 aa, Campylobacter coli RM2228
MLGIVFSLFSIFLLVFMLYKKINAHMALLLSGLLLLSLAAIFGLSPHIVAKGSLNLGFFDIFQVFNQTMSNTLAGLGLTLMTIAGFSAYMDHVGASYALFKVFEKPLKAVKSPYVLLIVAYFIVQFLVLFIPSHAGLALLLMVTMYPILVRSGVSKLSALSVIAICQYIDHGPGSGNVIMASKVAEVDPAIYFVHYQLPTTLPIIIAVGIAIYLCNKFFDKKDNFVFNAQEIEKELNENEGKEKELKKPPRIYAILPIIPLVLILGFSSVLDSILVLMGISSAEEVKAAASTAIEMNVPVAMVISTFVAIIFEMIRYKSIVETLNSIMIFF

SEQ ID NO: 36864 - DNA, 1440 bp, Campylobacter lari RM2100
  CDS (1)..(1440): transl_table=11
atgttgggtttattttttgcaggatgttctgtatttttacttgtatttatgctctataaaaaaatcaacgcccatatggcgttgcttttaagtggtttattcttgctagctttggcaggaatttttggactttctcctatcattagtgaaaagcaatctttacatttaggtctttttgatattttccaagtagtaaataccaaaatgtcaagtactctagcaggacttggacttactttaatgtgtatagcagggttctctgcttatatggatcatgtgggcgcaagctatgctttatttaaagtatttgaaagacctttaaaggctgtaaaatcaccttatattttattgctagtttcatattttgtaatccagtttttagtgctttttataccttcacatgcaggtttagcgcttttgcttatggttacaatgtatcctattttagtacgctcaggtgtttctaagctttctgcgctttcgattattgctatttgtcaatacattgaccatggtccaggtagtggtaatgtgattttggctgcaaaaacagcagagattgatcctgcggtgtattttgtacattatcaacttcctacaacttgccctattattatagcagtaggtattgcggtttatttttgttcaaaatactttgataaaaaagaaaattttgtatttaatcgtgatgaggttgaaagagaattagcagagcatgatggtaataatgaagagttgaaaaaaccacctagaatttatgcaattttacctattttacctttggtgttgattttaggttttagtagtgttgtagatagcattatgattttaatgggaattaccaccatagaagaagtgaaagcagcttcatctactgctattaaaatgaatgtaccagttgcgatgatgatttcaacctttattgcaattatttttgaaatcattcgttatagaagtttgattgatactttaaattctattatggtattttttaaaggtatggggcatttgtttgtgattacggtgtctttgattatatgtggtcaagtttttgcaagtggacttttatcggttggttttgtagataccttgatagattttgcaaaaaatgcaggttttagtgtgtttgctattattatagcagtatctattttgcttgctgtgtgtgcatttttaatgggatctggaaatgcagcatttttttcttttgctccactcattcctaatatagcaaaatcttttggagtagatactatatccatgatcgcacctattcaaatcatgacaggctttggtagatgtatttcgccgattgcacctgctatattagctatttcagctatggcaaaagtaaatccactgcaagtggtaaaaagaacacttgtccctatgctagtagctgctattgtgaatatgatcatgacttatatttatttgtaa

SEQ ID NO: 36865 - protein, 479 aa, Campylobacter lari RM2100
MLGLFFAGCSVFLLVFMLYKKINAHMALLLSGLFLLALAGIFGLSPIISEKQSLHLGLFDIFQVVNTKMSSTLAGLGLTLMCIAGFSAYMDHVGASYALFKVFERPLKAVKSPYILLLVSYFVIQFLVLFIPSHAGLALLLMVTMYPILVRSGVSKLSALSIIAICQYIDHGPGSGNVILAAKTAEIDPAVYFVHYQLPTTCPIIIAVGIAVYFCSKYFDKKENFVFNRDEVERELAEHDGNNEELKKPPRIYAILPILPLVLILGFSSVVDSIMILMGITTIEEVKAASSTAIKMNVPVAMMISTFIAIIFEIIRYRSLIDTLNSIMVFFKGMGHLFVITVSLIICGQVFASGLLSVGFVDTLIDFAKNAGFSVFAIIIAVSILLAVCAFLMGSGNAAFFSFAPLIPNIAKSFGVDTISMIAPIQIMTGFGRCISPIAPAILAISAMAKVNPLQVVKRTLVPMLVAAIVNMIMTYIYL

SEQ ID NO: 36866 - DNA, 1293 bp, Campylobacter lari RM2100
  CDS (1)..(1293): transl_table=11
atgcaagctttatatcttttaattgctattttaggtgttattgctgtggtgtatttactaataaaaaaaatagaaaccaaaacagcattaatcggggtagggtttatcttgtgtttgctctctttaaaacctacagaggctttgagtgcttttactcacgctatggttcaacctgctttgattaaagcaatttgtgcgagtatgggttttgcttttgtgatgaaagttacaaaatgtgataagcatttggtaaaacttttaacagcacctttgaaaaatgtaggatttttcttaattccacttgcttttatggtaacttttttcatagctattgctataccttcagctgctgggtgttcggctgcagtaggagctactttaataccacttttaatggcttcgggtataaaacctgctatggcagcagctactgttctttgtggaactataggcggtattttaagtcctggggtttcacatacagctttaatctctgaaatttctggtaaaaatatacaagaaataatcttggtacaaactccaaatgctctaacagcaggagtgatagttatgatttctttgatgattatggctttgatttttaaagattatcaaaaaggtaaagcatttgaagtagcaaatcaaaatgtaaaagaagaaagtatagaaaaagtcaatattttatacgctttaatgcctttggtgcctttagcgattttgataataggtgcaagtcctttgcatgcgtatgaatttttgtcttggacttctaaaataggcgtggctgaagctatgcttttaggagctattatagctatagttgtaacttggagtaagcctgatacaatttcaaaagaatttttcaatggtatgggaaaatcttatgctgaaatcattggtattattatagcagcgagtgtttttgtggctggtcttaaagcatgtggggtaatagatataatcatagaatggcttaaaaatgagcaacattatgtgcgttttggtgggacttttataccatttttaatggctatgatcacaggaagcggagatgctgctgctatggcgtttaataaagcagtaacaatccatgctcaagatcttgggtttgatcaagttaaacttggtacagctgtagcaatgtctgctgtgcttggaagatatctttctcctattttgggagcttgtattatcgtttcagctattgctggggttagtcctttagagattgtcaaaagaacagctttaggatgcgtgatttcagtagtagtgattgcttttgtgttattataa

SEQ ID NO: 36867 - protein, 430 aa, Campylobacter lari RM2100
MQALYLLIAILGVIAVVYLLIKKIETKTALIGVGFILCLLSLKPTEALSAFTHAMVQPALIKAICASMGFAFVMKVTKCDKHLVKLLTAPLKNVGFFLIPLAFMVTFFIAIAIPSAAGCSAAVGATLIPLLMASGIKPAMAAATVLCGTIGGILSPGVSHTALISEISGKNIQEIILVQTPNALTAGVIVMISLMIMALIFKDYQKGKAFEVANQNVKEESIEKVNILYALMPLVPLAILIIGASPLHAYEFLSWTSKIGVAEAMLLGAIIAIVVTWSKPDTISKEFFNGMGKSYAEIIGIIIAASVFVAGLKACGVIDIIIEWLKNEQHYVRFGGTFIPFLMAMITGSGDAAAMAFNKAVTIHAQDLGFDQVKLGTAVAMSAVLGRYLSPILGACIIVSAIAGVSPLEIVKRTALGCVISVVVIAFVLL

SEQ ID NO: 36868 - DNA, 1374 bp, Campylobacter lari RM2100
  CDS (1)..(1374): transl_table=11
atggaggtttttctttctgttgtggctactttattttgtgtatttttagtagcctattttattcttaaaaaatacaatcctatctttactttttttctctcaggtattattatcttaatcatcatttctttagcaactggtgagtctgtgttaaaacaaagcttaggaaatcctgtttttgatgtctttggctttgtaactcaaacttttaaaactaacttagctggtgtggggcttattataatgtctgttgcaggttttgcagcttatatgaaacacattaatgcttcagcaaaattagcttttgtagcaaataaaccactaggcaagattaaaaataaatatctagttttaagtggaacttttgtggtgggtatggctttaaaaatagttatttcaagttacactggattgttgcttttattgcttgcttcgatttatcctgttttaattgccataggaattcgtcctattactgctgtgtcggttttatcattaatcgcacttgattatggtcctaaagatggaaattctataaatttagcagatatggtaggcattgaaaatgttgttgctatgttttttgaataccaaatttatcctgttatagcttatgttgttgtgatagctttgcttattccgttttattatagttatatggacaaaaaagacttagcaaaaggtgttgtagataatatcgaacacatggaaataaaaaacccaaattgccctttattttatattttcttgccttggcttcctatagtgtttttatttggtgcttattttgcaagtttatatgggtataaagtgaagttagatgtggtgagtgctaattttttaagtataagtttggtttttattttagagtatgttagacataaagatgcaaaaaaacttgcagatgatttaatggtgatactaaaagctatggcagaaatttttgtaagtgttgtttgtattatcattgcagcttctatttttgcagaaggcattaaagcgttaaaaggtatagaacatttagccttagcagtatcttctatgggggcttctgctgtgttgcttactattatagttttaagctttattgtgtattttgcaagtgtgattatgggtagtgggattgctgcttttaatgcttttggaagacttgctccagatattgctcaaaaactagggattaatcctatctcgctagctttgccacttgagattgcttcttgtttagggcgtgctgcctcgccgatatcgggtggagttttagccttagcaggttttgcaaaattagatcctatagccattgttaaaagatctactcctatgttgcttgtaggaatggctttaaatatcctaatagcttggtattttgcataa

SEQ ID NO: 36869 - protein, 457 aa, Campylobacter lari RM2100
MEVFLSVVATLFCVFLVAYFILKKYNPIFTFFLSGIIILIIISLATGESVLKQSLGNPVFDVFGFVTQTFKTNLAGVGLIIMSVAGFAAYMKHINASAKLAFVANKPLGKIKNKYLVLSGTFVVGMALKIVISSYTGLLLLLLASIYPVLIAIGIRPITAVSVLSLIALDYGPKDGNSINLADMVGIENVVAMFFEYQIYPVIAYVVVIALLIPFYYSYMDKKDLAKGVVDNIEHMEIKNPNCPLFYIFLPWLPIVFLFGAYFASLYGYKVKLDVVSANFLSISLVFILEYVRHKDAKKLADDLMVILKAMAEIFVSVVCIIIAASIFAEGIKALKGIEHLALAVSSMGASAVLLTIIVLSFIVYFASVIMGSGIAAFNAFGRLAPDIAQKLGINPISLALPLEIASCLGRAASPISGGVLALAGFAKLDPIAIVKRSTPMLLVGMALNILIAWYFA

SEQ ID NO: 36870 - DNA, 1524 bp, Campylobacter coli RM2228
  CDS (1)..(1524): transl_table=11
atgccaatttttatgatatgttctacacttttagcggtaattgtcgttgcttattatatacttaaaaaatacaatcctatttttgtattttttctttcaggtattatcttgcttatttttgctttttacatcacaggagcacctataccaaaagccccgagcagagaacatgcaagctttttgaatgttttacttgatagctatgcttttatcacagcgacttttaaaagtcagctttctggagtaggacttattatcatgagtgtggcaggttttgctgcttatatgaaacatatcaatgcttcggctaaactcgcttttttagcaaacaaacctttaggaaaaatcaaaaataaatatttgattttaagcggaacttttatcgttggaatggccttaaaaattgttatttctagctatgctggacttcttttgcttttattagcatgtatttatcctgttttaatctcacttaaaatccgtcctattacagctgtatgtgtgctttctttgattgcgcttgattatggtccaaaagatggaaattcaatcaatatggcagatatggtaggacaaagcgataatgtcgtggggctttttttaaattatcaaatttatagcgtgattgcttatgtgatggttattgctatcttaatacctttttactttgcttgggttgataaaagagataaagaaaaaggtgttttaaatgatgaagttgaaattccaccaatcattgatcctaaatgtcctactttttatatactctttccttggctgcctgtcgtatttttatttatagcatatttttttactatcaagcttgatgttgtaacagcaaattttttaagcatttctttagtttttcttgttgaatttgcaagacacagaaatgctagaaaattaggcgaagatatgatggtgattttaaaagctatggctgaaatttttatctcagtcgtaagcataatcatcgccgctggagtatttgctgaaggcattaaagcacttggtggagttaatatccttgctaacgcggtttcaaatcttggaacaggaaattttgcatggtttggaattcttttgagtatagctattttaagctttttagtttattttgctacagtgattatgggaagtgggattgctgcttttaatgcttttgggaaattagctcctgatatagctacaaaattaggcgttgcccctatcacttttgttttacctatagaaattgcatcttgtttaggtcgtgcagcttcaccaatagcaggcggaatcatagctttagctggatttgcaaaagtagctccaatggatattataaaacgaaccactcctcttttacttatcgctatgcttgtaaatgtgcttgtagccttttatctagcacaaaccaatcctttgccaaaagaacaaaacactacaaaaatagcagtatctttaaataataaatatttattattttataaaaactataaattttctaaattattttctgcttttttagtaaaaatttcataa

SEQ ID NO: 36871 - protein, 507 aa, Campylobacter coli RM2228
MPIFMICSTLLAVIVVAYYILKKYNPIFVFFLSGIILLIFAFYITGAPIPKAPSREHASFLNVLLDSYAFITATFKSQLSGVGLIIMSVAGFAAYMKHINASAKLAFLANKPLGKIKNKYLILSGTFIVGMALKIVISSYAGLLLLLLACIYPVLISLKIRPITAVCVLSLIALDYGPKDGNSINMADMVGQSDNVVGLFLNYQIYSVIAYVMVIAILIPFYFAWVDKRDKEKGVLNDEVEIPPIIDPKCPTFYILFPWLPVVFLFIAYFFTIKLDVVTANFLSISLVFLVEFARHRNARKLGEDMMVILKAMAEIFISVVSIIIAAGVFAEGIKALGGVNILANAVSNLGTGNFAWFGILLSIAILSFLVYFATVIMGSGIAAFNAFGKLAPDIATKLGVAPITFVLPIEIASCLGRAASPIAGGIIALAGFAKVAPMDIIKRTTPLLLIAMLVNVLVAFYLAQTNPLPKEQNTTKIAVSLNNKYLLFYKNYKFSKLFSAFLVKIS

SEQ ID NO: 36872 - DNA, 1455 bp, Campylobacter upsaliensis RM3195
  CDS (1)..(1455): transl_table=11
atggctatcgtttcgaccctctttgccgtggtagttgtggcgtattgtatcctcaaaaagtataatcccattttcacctttttattttcaggtatgattattttaatctttgcattttattattttggtgtgcctatcccaaatgctcaaattagagaaaattcaaattttttagacataatgcttgatggatttacctttattacaacaacttttcaaagcaaactcgcaggagttggatttatcattatgagtgtggcagggtttgcagcctatatgaaacacattaacgcttctgtaaaacttgcctttttggctaataagccgcttggaaagattaaaaataaatatctcattttaagcggaacttttattgtaggtatggctttaaagcttgtgattacaagtggcgtgggtctttttcttttgcttttagcttgtatttatcctgttttaatcactcttaaaattcgtcctattacggctgtttgtgtgctttctttgattgctcttgattatggtcctcaagatgcaaattttatcaatatggcggatatggtaggcgaaaaagacaatgtcgtggggctttttttaaattatcaactttgggttgcccttgtttatattgtgctaattgctgtgttaatccccttttattttgcttggattgataagaaagataaagccaaaggcgtgctttgtgatgaggtgcaaacgcctaaaattataaatccaaaatgccccactttttatatgttttttcctttacttcccgtgatatttttgttcgcggcttattttttggatataaaacttgatgtgataacggcaaatttcattagcatagcccttgtgtttattgctgaatttattcgccataaagatgctaaaaagcttggcgaggatataatggtgattttgcgtgcaatggctgaaatttttgtcagcgttgtaagcattattgttgcagctagtgtttttgctgagggcataaaggcacttggaggcataggcattttaactgatgctgtgagcgttttaggtaaagatggtgaatttgctaatcttgctgtgttagtaagcattgcagttttgagctttttggtttatggctttgctgttattatgggaagtggaattgccgtttttaacgcttttggtcgtttagcacctgagattgctacaaggctagggattgctcctattgcgttggttttgcccattgaagttgcttcttgtttggggcgtgcggcttcgcctattgcgcctggtattatcgttttggctggttttgctaaggtttcgcccatagacattgttaagcgcactgcaccgcttttactcatcgctatgcttgtaaatatcctcgtgtcattttatttggctaaggctgaaccgcaaatcaagcctgaaatttccgcaaaaatagagaggcaaatagcccctctatcttaa

SEQ ID NO: 36873 - protein, 484 aa, Campylobacter upsaliensis RM3195
MAIVSTLFAVVVVAYCILKKYNPIFTFLFSGMIILIFAFYYFGVPIPNAQIRENSNFLDIMLDGFTFITTTFQSKLAGVGFIIMSVAGFAAYMKHINASVKLAFLANKPLGKIKNKYLILSGTFIVGMALKLVITSGVGLFLLLLACIYPVLITLKIRPITAVCVLSLIALDYGPQDANFINMADMVGEKDNVVGLFLNYQLWVALVYIVLIAVLIPFYFAWIDKKDKAKGVLCDEVQTPKIINPKCPTFYMFFPLLPVIFLFAAYFLDIKLDVITANFISIALVFIAEFIRHKDAKKLGEDIMVILRAMAEIFVSVVSIIVAASVFAEGIKALGGIGILTDAVSVLGKDGEFANLAVLVSIAVLSFLVYGFAVIMGSGIAVFNAFGRLAPEIATRLGIAPIALVLPIEVASCLGRAASPIAPGIIVLAGFAKVSPIDIVKRTAPLLLIAMLVNILVSFYLAKAEPQIKPEISAKIERQIAPLS

SEQ ID NO: 36874 - DNA, 1293 bp, Chromohalobacter salexigens DSM 3043
  CDS (1)..(1293): transl_table=11
atggaagtattcaccatcatgttcattgggttgatcgtcctgctaatgctgggcgtccccgttgcgtttgccatgatcgcgtcttctgccctcgtattgggctatacgcgaggcttcgatgccatccccatagaaatgatctctcagcgcactctctacggagtcaacagttttaccttgttggctattcctgcttttctcttcattggccgcttgatgaactcggcaggcatatcggaccgcgttttcgacgtggcacgtaccatggttggccatttcaaagggggattgggccacgtcaatgtggtagccagcatgctgtttgcaggtatgtcggggtcggcagtcgctgatgccggtggccttggagcgttggaaataaaagccatggaagatgatggatatccaacggggttcagtgctgctgtcaccgccagttcagccactatcggtccgatcattccacccagtattcccgccgttatttacggggctttggcgaatgcttcaatcgcttccatcttcctcgcgtcgatcattcccggtttgttcatggggctgggactgatgctcatggtggctatcatttcacatcgccgtggattccctacacgaactcgggcacgcctcaacgatgtcttgcgggcgctttcgcgtgggctgttacctatgttgaccccgttgatcatcatcgtggggattctctcaggcgtgtttacgcctacagaagcctcggtgattgccctgttgtattgcatgatcatctcgttcctggtttatcgctcgatcacctttagggagtttctggggattctccgagccactgccatcgatactgccgcactgcttttcatcattgctggaagcgctctttatagctgggtgctggcgcgttaccaagtcacggcgttagtagcggattttttgttggctactgtgaccgatccgctcggcctgatgttgttgttggtcgtgttcatcctgctgatcgggttgtttatcgattcggtaccggctttgtttctcttgacccccctgttggtgccggtagtgactcaatatggcatcgaccccgttcactttggtgtggtcatgatctttaccttgatgatcggtttgatcacgccaccggtgggtacggtcctattcaccatacaaaaaataaccgggatgtcattcgtagggttggtacgggagaccatacctttctatatccctttgttcgtggtgcttctgatcattacgtgttttccatctatcgtcatgtttttgcccagtttgattcttggttga

SEQ ID NO: 36875 - protein, 430 aa, Chromohalobacter salexigens DSM 3043
MEVFTIMFIGLIVLLMLGVPVAFAMIASSALVLGYTRGFDAIPIEMISQRTLYGVNSFTLLAIPAFLFIGRLMNSAGISDRVFDVARTMVGHFKGGLGHVNVVASMLFAGMSGSAVADAGGLGALEIKAMEDDGYPTGFSAAVTASSATIGPIIPPSIPAVIYGALANASIASIFLASIIPGLFMGLGLMLMVAIISHRRGFPTRTRARLNDVLRALSRGLLPMLTPLIIIVGILSGVFTPTEASVIALLYCMIISFLVYRSITFREFLGILRATAIDTAALLFIIAGSALYSWVLARYQVTALVADFLLATVTDPLGLMLLLVVFILLIGLFIDSVPALFLLTPLLVPVVTQYGIDPVHFGVVMIFTLMIGLITPPVGTVLFTIQKITGMSFVGLVRETIPFYIPLFVVLLIITCFPSIVMFLPSLILG

SEQ ID NO: 36876 - DNA, 1281 bp, Chromohalobacter salexigens DSM 3043
  CDS (1)..(1281): transl_table=11
atgatggtcgtcgtcttcctcgccgtgctgttctcgttgatgttgatcggcatgccgatcgccttcgccatgctcagctccgccgtggtgatgatgtggacccaggacatgttcaatgtcaccacactggccgagcacttcatcaccggggccaacagctttgccttgatggccattccctttttcatcctgaccggcgagatcatgaatgccgggggcgtttccaagcgcatcgtcgactttgcctcgtcactggtgggccatgtgaaaggcggcctgggctatgtcgccatcgtggccggggtgatctttgccgggttatccggctccgccgttgccgataccgcggcactgggctcgatcctcatccccatgatggtggcgcaaggctacgagaagaagcgctcgaccgcgctggtggcatccgtcggcatcgtgggcaccgtgattcccccgagcattcccttgattctttacggggtcgtgggcggcgtctcgattaccgggttgttcatgggcggcatcgtgcccggggtcatcatggcgatcggcatgacgttcacctggtggctggtcgcgcgcaaagccgataccaagcggctcgagcgtgccaactggcaggcgcggcttcacagcttcaagcgtgccttctgggccttgctgctgccgctgatcatcatcgtcgggctgcgtggcggcgtgttcacgccgacagaagcgggcgtcgtcgctgcggtatacgcgctgttgatcagcctctgctatcgagaaattcgtctgacgcagctgttcgatgtgctcaccaacaccgccaagaccacggccatcgtgatgctgatcgcctcggcggccattgtcacggcgtatgcgatcacggtagcgcaggttcccgcccagatcgcggcagggctcacgagcattaccgacagcccgaccctgatgctcttgatcatcatggtcatactgctgctgttcggctgcgtgatggacatgacacccgcggtgctgattttcgcgcccgtgctgatcccggtggtcgagcagctcggtatcgatcccatctacttcggtgtggtgatgatcatcaacctctccatcggcttgatcacaccgccggtgggcacggtgctctatgtagggtgcagcatcagccgaatcagcatcatcgacatttcgcgcggcatatggccgatgctgttgatgtacgtggcgatcctgtttgcactgattctcttccccgagatcgtgacctatcccttaagtattctgcacaacggttga

SEQ ID NO: 36877 - protein, 426 aa, Chromohalobacter salexigens DSM 3043
MMVVVFLAVLFSLMLIGMPIAFAMLSSAVVMMWTQDMFNVTTLAEHFITGANSFALMAIPFFILTGEIMNAGGVSKRIVDFASSLVGHVKGGLGYVAIVAGVIFAGLSGSAVADTAALGSILIPMMVAQGYEKKRSTALVASVGIVGTVIPPSIPLILYGVVGGVSITGLFMGGIVPGVIMAIGMTFTWWLVARKADTKRLERANWQARLHSFKRAFWALLLPLIIIVGLRGGVFTPTEAGVVAAVYALLISLCYREIRLTQLFDVLTNTAKTTAIVMLIASAAIVTAYAITVAQVPAQIAAGLTSITDSPTLMLLIIMVILLLFGCVMDMTPAVLIFAPVLIPVVEQLGIDPIYFGVVMIINLSIGLITPPVGTVLYVGCSISRISIIDISRGIWPMLLMYVAILFALILFPEIVTYPLSILHNG

SEQ ID NO: 36878 - DNA, 1278 bp, Polaromonas sp. JS666
  CDS (1)..(1278): transl_table=11
atgaccattgcaatctttttgacatccctgatgggagccatgacgctgggcgttcccattgccttttccctgctggtgtgcggcgtcgccctgatggtgcacctgaacagttttgacacacaaatcctggcgcaaaacctgctcgaaggcgccaacaactacccgttgatggctgtgccgttcttcatgctcgccggcgagctgatgaacgctggtggcctgtcccggcgaatcgttgatgtagccaacgcgctggtcggccatgttcggggcgggctgggttacaccgccatcattgcggcggtcgtgatggccagtatctctggctctgcggtcgctgatacggccgctttggccgcgctgctgatacccatgatgcgcaaggcgggctacaacgtgccgcgtgctgcaggcctcattgcctctggcggcatcattgcgcccatcattccgccctcgattggctttgtggtctttggagtagccgcgcaggtgtccatcaccaaacttttcatggcgggcattgttccaggtgtgatgatgggcgtggccctcgggatcacgtggtggtttttggccaagaaggagccgctggtcaacggcggcgagttcagcctggccaaagtggccagcgccatcgtaagtggcacctgggcgctggcattgcccatcgtcatcatcggcggcatgaaatttggtgtgttcacgccaaccgaagcggccgtggttgcggtggtgtattccctcggggttggcctgtttgtctatggcgagctcaaactggcagagctgcccgaactaatgctagccgccgccaagacctccagcaccatcatgtttttggtggctaccgcactggtctctgcctggctcatcaccatcgccgacattccagcacaggccgttgcgttgctgcagccgttcatggacagccccaggctgctcatgctggtgatgatgctgctggtcattgtggtgggcaccgcgctggacttcatgcccaccgtcttgatcttgacgcccattttgatgccggtggtcaggcaagcgggtattgaccctgtctatttcggcgtgatgttcatcatcaacaacgcgattggtttgctgacaccccccgtgggaacggtactcaatgtggtggcaggcgtcgccagggtcaacctcgacaaagtcatcaagagcgtctggcccttcctgctggcgcaaacggttttgctgtttctgttcgtgttgttcccgcaactcatcacggggccggcggcctggttccgctga

SEQ ID NO: 36879 - protein, 425 aa, Polaromonas sp. JS666
MTIAIFLTSLMGAMTLGVPIAFSLLVCGVALMVHLNSFDTQILAQNLLEGANNYPLMAVPFFMLAGELMNAGGLSRRIVDVANALVGHVRGGLGYTAIIAAVVMASISGSAVADTAALAALLIPMMRKAGYNVPRAAGLIASGGIIAPIIPPSIGFVVFGVAAQVSITKLFMAGIVPGVMMGVALGITWWFLAKKEPLVNGGEFSLAKVASAIVSGTWALALPIVIIGGMKFGVFTPTEAAVVAVVYSLGVGLFVYGELKLAELPELMLAAAKTSSTIMFLVATALVSAWLITIADIPAQAVALLQPFMDSPRLLMLVMMLLVIVVGTALDFMPTVLILTPILMPVVRQAGIDPVYFGVMFIINNAIGLLTPPVGTVLNVVAGVARVNLDKVIKSVWPFLLAQTVLLFLFVLFPQLITGPAAWFR

SEQ ID NO: 36880 - DNA, 1365 bp, Polaromonas sp. JS666
  CDS (1)..(1365): transl_table=11
atgagctggtcggcgttcaggagtccgaggatctcccgcaccaggcgcacaaacctccccgttaaaccctccggaccgactatcatgaccatcgcagttttcctgggctccctgctcgccgccatggcgctgggcattcccatttcattttccctgttgctgtgcggtgccgcattgatgtggcacctggatatgttcgatgcgcaaattctggcgcagaacgtgatcaacggtgctgacagcttcccgctgctggcggtaccgtttttcatgctggctggggaaatcatgaacgccggcggcctgtcgcgccgtatcgtcaactttgccatgacgctggtggggcacatcaagggcgggctgggctatgtggccattgtggcggccgtgctgatggccgccctgtccggctccgccgtggcagatgccgccgccctgtcggccctgttgctgcccatgatggtggccgccggccacgacaaggcgcgctccgccggcctgctggcatcggccagcatcatcgctcccgttattccgcccagcatcggcttcgtgatcttcggcgtggcggccaatgtctcgatttccaagctattcatggccggcattgcgcccggcgtcatgctcggggtcgccttgtggttcacgtggtggtatgtcgcacgcaaggaaaccgtcgcggtgcccccccgcaagtcacgtgcggacgtgatcgccgccttcaaggacaccacctttgcgatggtcttgccggtgatcgtggtggtgggtctgaagtttggcgtgttcacgcccaccgaggcggcggtggtggctgcggtttacgcgctgttgatctcgacgctggtctacagggagctcaagctcaaccagttgtacggcctgtttctggcggcggccaagacgacggcggtgatcatgttcctcgttgccgcggcgatggtctcggcctggctaatcacggtggcgcaattgccggcgcaggtggtcacgctgctgcaaccgctgctggacagcccgaagctgctgatgctggccatcatggtgctggtgatggtggtgggtgcggcgatggacatgacccccactatcctgattctcaccccggtgctgatgccgatcgtgaaagcggcagggattgacccggtgtactttggcgtgctgttcatcatcaacaacgcgatcggcctgatcacgccaccggtcggaaccgtgctcaacaccgtcgcaggcgtgggcaaggttagcatggacgaggtgaccaagggcgtctggccgttcatgatcgcgcagttcgccatcatgttcctgatggtgctgttcccgcagctggtcatggtgcccgcacgctggttctatggctag

SEQ ID NO: 36881 - protein, 454 aa, Polaromonas sp. JS666
MSWSAFRSPRISRTRRTNLPVKPSGPTIMTIAVFLGSLLAAMALGIPISFSLLLCGAALMWHLDMFDAQILAQNVINGADSFPLLAVPFFMLAGEIMNAGGLSRRIVNFAMTLVGHIKGGLGYVAIVAAVLMAALSGSAVADAAALSALLLPMMVAAGHDKARSAGLLASASIIAPVIPPSIGFVIFGVAANVSISKLFMAGIAPGVMLGVALWFTWWYVARKETVAVPPRKSRADVIAAFKDTTFAMVLPVIVVVGLKFGVFTPTEAAVVAAVYALLISTLVYRELKLNQLYGLFLAAAKTTAVIMFLVAAAMVSAWLITVAQLPAQVVTLLQPLLDSPKLLMLAIMVLVMVVGAAMDMTPTILILTPVLMPIVKAAGIDPVYFGVLFIINNAIGLITPPVGTVLNTVAGVGKVSMDEVTKGVWPFMIAQFAIMFLMVLFPQLVMVPARWFYG

SEQ ID NO: 36882 - DNA, 1875 bp, Desulfitobacterium hafniense DCB-2
  CDS (1)..(1875): transl_table=11
atgatcaaagaagaagcacaacaaagaaaaaccttttcgggacttttaagggtacttgatcaaaggtttgaagaagttgcaatagtggccggttttctattctttacaattttaataaccttacaggtcatcaaccgttatgtattgacatttgccgatattgccaacattaatgtatggtcggaagagttagctagatatgtttttatttgggtttcatatattggggcggctctggttataaaaaaacgagccaatatcaatgtggacgccgttaccaggattttacctgtttcttttagtaaagtcttgaatttggtcagttcattattaaccttcgttttgttttacattctgattaaaggcggaatagccactataactatgcaggttaccaatcatcaggttactccggcaatgggaatccctatgtacataccatatttagccgttcctttgggaatcagtctgatgttcttcagaacactgcaaaacattattgcagacatcaaagaaatgagctttcaatcgattgtgctgggcatagcaattaccattatactgtttttacccattttgctggttgataatattaacgctactcttttgttatttgcttattttatattattgataataatgggcgtacccattgcctttagtttgggaattgctactttggttacaacaataaactctcaagctatacctttggattatttttctcaggcagcgtttaacggcattgatagctttcccattatggccataccattttttgtagctgcgggagtcatcatgggaagcggaggcttattaagaaggctgttaaatctgggcaatgaattagtaggcttcttcccgggcggattagctttagtgacggttattacctgcatgttctttgccgcaataagcggttccgggccggcgacggttgctgcagtgggaactatgatgatacctgaaatgaaaaggcagggatatagcgttgctttcagtgcggcaatagtagcagctgccggctcaattggtgtcattattccacctagtaatccttttgttatttatggagttgttggccaagaatcggttggaaaactgtttattgcaggtattattcctggagtcctaattggtataattttaatgattctggcttatagtacctcaaagaaaaatggttggaaaggcaataaagatcgaatagatataattgcagtacttcgagccgcatgggatgccaaattggctttagtcgtacctgttattattttgggcggtatttatggcggatatatgactcctacggaagcagcagccatttctgtaacttacggtttgctcattggactgtttgtttaccgtgatttaaaattcaaggatatgtacaattgtctggtcgagtcaggttccaccaccgcggtgatcattattcttatggctatggcgacaatctttggcagattcattactatagagcgagtcgctgagacagtggcagcttttgtattgggtatcagtacgaataaagttattgtattgttgttgatcaatatatttcttctttttgtaggaatggttatggaggcacttgcggcaatcatcattttaacccctattttactgccaatggtctcacagctgggtgtggatcctatacaatttggcgttatcatggtcgtcaatttagcgattggtttcataacaccaccagtcggagttaatttgttcgttgcttccggaatatcaaaagtaagaatagaagaaatcacccgcccagctatcccgcttatcctgggtatgatatttatccttttactggttacctatataccagagatttccttatggcttccttcattaatgcgttaa

SEQ ID NO: 36883 - protein, 624 aa, Desulfitobacterium hafniense DCB-2
MIKEEAQQRKTFSGLLRVLDQRFEEVAIVAGFLFFTILITLQVINRYVLTFADIANINVWSEELARYVFIWVSYIGAALVIKKRANINVDAVTRILPVSFSKVLNLVSSLLTFVLFYILIKGGIATITMQVTNHQVTPAMGIPMYIPYLAVPLGISLMFFRTLQNIIADIKEMSFQSIVLGIAITIILFLPILLVDNINATLLLFAYFILLIIMGVPIAFSLGIATLVTTINSQAIPLDYFSQAAFNGIDSFPIMAIPFFVAAGVIMGSGGLLRRLLNLGNELVGFFPGGLALVTVITCMFFAAISGSGPATVAAVGTMMIPEMKRQGYSVAFSAAIVAAAGSIGVIIPPSNPFVIYGVVGQESVGKLFIAGIIPGVLIGIILMILAYSTSKKNGWKGNKDRIDIIAVLRAAWDAKLALVVPVIILGGIYGGYMTPTEAAAISVTYGLLIGLFVYRDLKFKDMYNCLVESGSTTAVIIILMAMATIFGRFITIERVAETVAAFVLGISTNKVIVLLLINIFLLFVGMVMEALAAIIILTPILLPMVSQLGVDPIQFGVIMVVNLAIGFITPPVGVNLFVASGISKVRIEEITRPAIPLILGMIFILLLVTYIPEISLWLPSLMR

SEQ ID NO: 36884 - DNA, 1875 bp, Desulfitobacterium hafniense DCB-2
  CDS (1)..(1875): transl_table=11
atgctggacattgcaaagaatccagaaaattcctggaaaaaatggctgagatggatcgatgggaattttgaaaaaccatttcttgtaatcggcatgctggcgattattatgctgattacctatcaaactctttatcgttatatcgtttccaatatcaccggcggtacggccattgtgggcttagaagaattagcgcgctttattttcatatggatcacctatttggcgatcccgctggccattaaagggcgcaataatatcagggtcgatattctctatgaccggatttccgaccggtggcagaaaatcagctggatcatggtcgacagctgcatcctcgtcttaacgggtgtgatattctttatggggatcgatcatctgcagatgatgctaaactatcctcagacttccccggcgctcaatatccccttcttttttccctacttaatcctacccattggttttggcttaatgtccatccggtgtatccaggacttggtcaagcaggcgttggaaattggccttaaggataccttgatcggggttttggttacggcggcaattttttctcccctcttcttaaagcccgatgttccggccatggcttggctttttggctattttgtgctttttatctttattggggtgcccattgccatggccttaggcctttccgctttagggacgattctctgtgccaatacgatgcccatcgagtatatatcacaaatttcctttacctccattgatagttttccgattatggccattcccttttttgtggcggcaggtgtcttcatgggggaagggggattatccaagcggctcttaggcctggctgatgaactcctggggtcctttaccgggggcctggccttggctacggttgtcacctgtatgttttttgcggcgatcagcggctcggggccggctacggtagctgccatcggctccctgaccattccggccatggtggaaagagggtattcccgggcctttgcggcggcacttgtggcagcggccggctccatcggggtgatgattcctcccagcaacccctttgtcgtttatggtgtttccgctcaggtctccattggcaaactctttatgggcgggattgttcccggcttgatcattggtttggttttaatgggcatcagttactactattccaaaaagaacggctggaaaggcgaagcccgcaaacgtacctttcgtacagtgggcaaggctttttgggaggccaagtgggccttgatggttccggtgataattttaggcgggatttattccgggtacatgacccctaccgaatcggcggctgtggcagccttttatggactgatcgtcggtgttttcatccacaaagggattaaccgcaagaatattgtctattgcttcacggaatcctgcagtacctccgccgtcattattgccttgatggccatggccacgatcttcggtaatattttgacgattgaacagattcccaccaaaatcgccacctggatgctggcgataaccgacagcaaatacgttattctcctgatcattaccctattgctgctcttcgtgggaaccttcatggaagctttggcggcgattgttattcttaccccgattttactgccgattgtccttcaggtgggtatcgatccgattcacttcggaatcattatggtggtcaacctggcgatcggcttcattacaccaccggttggtgtgaacctgtttgtggcaagcggtttggcgaagctgaagatcgaagagatatccaaagcggtggtccccttcctcttaggcatgatcgccgtactgttgctgatttcttatgtgccttccatttccatgttcctgactcaatttgtgaagtaa

SEQ ID NO: 36885 - protein, 624 aa, Desulfitobacterium hafniense DCB-2
MLDIAKNPENSWKKWLRWIDGNFEKPFLVIGMLAIIMLITYQTLYRYIVSNITGGTAIVGLEELARFIFIWITYLAIPLAIKGRNNIRVDILYDRISDRWQKISWIMVDSCILVLTGVIFFMGIDHLQMMLNYPQTSPALNIPFFFPYLILPIGFGLMSIRCIQDLVKQALEIGLKDTLIGVLVTAAIFSPLFLKPDVPAMAWLFGYFVLFIFIGVPIAMALGLSALGTILCANTMPIEYISQISFTSIDSFPIMAIPFFVAAGVFMGEGGLSKRLLGLADELLGSFTGGLALATVVTCMFFAAISGSGPATVAAIGSLTIPAMVERGYSRAFAAALVAAAGSIGVMIPPSNPFVVYGVSAQVSIGKLFMGGIVPGLIIGLVLMGISYYYSKKNGWKGEARKRTFRTVGKAFWEAKWALMVPVIILGGIYSGYMTPTESAAVAAFYGLIVGVFIHKGINRKNIVYCFTESCSTSAVIIALMAMATIFGNILTIEQIPTKIATWMLAITDSKYVILLIITLLLLFVGTFMEALAAIVILTPILLPIVLQVGIDPIHFGIIMVVNLAIGFITPPVGVNLFVASGLAKLKIEEISKAVVPFLLGMIAVLLLISYVPSISMFLTQFVK

SEQ ID NO: 36886 - DNA, 1305 bp, Ralstonia metallidurans CH34
  CDS (1)..(1305): transl_table=11
atgacgctgatcgccatcattctgttcgtggttttcattggcctgatgctgctgggcgcgccaattggcgtgtcgctggggctgggcggtctggtcgccatcggcctgtcgaacctcgatacgcaaatgttcggcctgctggccgtgccccagaacttctatgccggtcttgccaagtacccgctgctggccattcccatgttcgtgctggtcggttcgatcttcgatcgttccggcgtagcgcaacgactggtcacgttcgccatcgcgatcgtgggccgtggtccgggcatgttgccgctggtggccatcctcgtggcgatgttcctgggcggcatctccggctctggtcccgcgaacgcggccgcggtagggggcgtgatgatcgcggcgatgtcgcgtgcgggctatccgggctcctacagcgccgcggtggttggcgcggcggcggctacggacattctgatcccgccgtcggtggcgttcattatctacagcgtgctggtgccaggcgcatcggtgcccgcgctgttcgccgccggcatgatcccgggcatcctggccggtgtggcgttgatcgttccggccgtctggctggcgcgcaagcacaacatggggcatatcgaagccggcttgccgcgcccgccgttctggaagagcctgcgcgaggccgcatggggcctggtggcgccgttcctgattctgggtggcatgcgcgcgggctggttcacgccgaccgaggccgccgtcgtggccgtggtctacgggttgttcgtcggcatggtgatctatcgcagcattggcgtgcgcgacctgttcacgattttccaggaggcggccgagacatcggcggtgatcctgctggtggtggcgctggccggcatcttcgcctatgcgctgtccacgctcggcgtaatcgacccgctggccaatgccattgcgcattcggggctgggcgagtacggcgtgctggcgctgatcgtgctgttgctgatgaccgtcggcatgttcctggacggcatctcgatcttcctgatcttcgtgccgctgctgctcccgatcgccaccgcgttccactggaatccggtatggtttggcgtggtgctcacgctcaaggtggcgctgggtcagttcaccccgccactggccgtgaacctgatggtgtcgtgccgcatcgcgcgcgtgcgcatggaagagaccgtgccatgggtgatctggatgctgctggcgatgttcgtcgccatgctgatggtgctggcctatccgccgctggccacctggctgcccgactacctgggctattga

SEQ ID NO: 36887 - protein, 434 aa, Ralstonia metallidurans CH34
MTLIAIILFVVFIGLMLLGAPIGVSLGLGGLVAIGLSNLDTQMFGLLAVPQNFYAGLAKYPLLAIPMFVLVGSIFDRSGVAQRLVTFAIAIVGRGPGMLPLVAILVAMFLGGISGSGPANAAAVGGVMIAAMSRAGYPGSYSAAVVGAAAATDILIPPSVAFIIYSVLVPGASVPALFAAGMIPGILAGVALIVPAVWLARKHNMGHIEAGLPRPPFWKSLREAAWGLVAPFLILGGMRAGWFTPTEAAVVAVVYGLFVGMVIYRSIGVRDLFTIFQEAAETSAVILLVVALAGIFAYALSTLGVIDPLANAIAHSGLGEYGVLALIVLLLMTVGMFLDGISIFLIFVPLLLPIATAFHWNPVWFGVVLTLKVALGQFTPPLAVNLMVSCRIARVRMEETVPWVIWMLLAMFVAMLMVLAYPPLATWLPDYLGY

SEQ ID NO: 36888 - DNA, 1278 bp, Paracoccus denitrificans PD1222
  CDS (1)..(1278): transl_table=11
atgatcctcctcgtcttcatcctgtcgcttcttgcagcgatcctgatcggtatcccgatcgccttcggcctgatcctgtccggcatcgtcatgatgtggtggcttggtgcgctggactggcagctgatcgcgctgcagatgaccaatggcgccgacagcttccccctgctggcgatccccttcttcatgctggccggtgaggcgatgaatgccggcggcatttccaagcgccttgtcaacttcggcatgacgcttgtcggccacaagcgcggaggtctgggctatgtgaccatcgtcgcggcgctgctgctggccagcctttccggatccgccgtggctgataccgcagttctggcaggcatgctgctgccgatcatgcggcaggcgggctacgacatcaatcattccggcggtctgatcgcttcgggcggcatcatcgcgccgatcctgcctccttcgatcggctacatcgtcttcggtgtggcgggtggcgtgtcgatcaccaagctgttcatggcgggcattgcccccggcatcatgatggcgctgacccttgccgtcacctggtggttcctttcccggaactccgaggtcagcgtgccgcagcgtgcgccgctgcgcgaggtgctgaaagcagccggtcaggcaagccttgccttcatccttccggtgatcatcatcgtcggtctgaaagccggaatattcaccccgaccgaggccggtgtcgtggcctgtgtctatgcgatcttcatcggtatgttcgtctaccgcgaactgcacccgaagatgctgtatcacgtcatgatcgccgcggttcgcaccacggcctcggtgatgcttctggtcgcggcggcctcgatcaccgcctatctggtggccatcgccaacattcccggcgtgattggcgacatgctcagcggtgtgcgcgaacatccggtgctgctgatgctggtcatcatgacgatcattctggtcgtcggaactgcgctggacttcatcccgaccatcctgatcctgacgcctgtgctgctgccgatcgccaaaagcgcggggatcgatccggtctatttcggtgtcatgttcatcatggcaggcgccatcggcctgctgacgccaccagtgggcgcggtgctgaacgtggtctgcgccgtgggcaacatgcgctacacggatgccgtgcggggtgtcgtgcccttcctgatcgtgcaggccttcctgatcttgctgctggccctgttcccacagctggtgatcgtgcccgcgaactggttctactga

SEQ ID NO: 36889 - protein, 425 aa, Paracoccus denitrificans PD1222
MILLVFILSLLAAILIGIPIAFGLILSGIVMMWWLGALDWQLIALQMTNGADSFPLLAIPFFMLAGEAMNAGGISKRLVNFGMTLVGHKRGGLGYVTIVAALLLASLSGSAVADTAVLAGMLLPIMRQAGYDINHSGGLIASGGIIAPILPPSIGYIVFGVAGGVSITKLFMAGIAPGIMMALTLAVTWWFLSRNSEVSVPQRAPLREVLKAAGQASLAFILPVIIIVGLKAGIFTPTEAGVVACVYAIFIGMFVYRELHPKMLYHVMIAAVRTTASVMLLVAAASITAYLVAIANIPGVIGDMLSGVREHPVLLMLVIMTIILVVGTALDFIPTILILTPVLLPIAKSAGIDPVYFGVMFIMAGAIGLLTPPVGAVLNVVCAVGNMRYTDAVRGVVPFLIVQAFLILLLALFPQLVIVPANWFY

SEQ ID NO: 36890 - DNA, 1281 bp, Actinobacillus succinogenes 130Z
  CDS (1)..(1281)
atgaccattcttatttttttagccagccttgtaggcggtattgtaatcggtgtaccgattgcattctcgctgctgttttcaggcatgatgctgatgttttatctgggcggcttcaattcacagattctttcgcaaaatctgtttaacggtgcggacagcttttctatgatggccattccgttctttgtggttgccggcgatttgatgaaccggggcggattaaccaacaaaatcgttgatgcggcgaccgcacttgtggggcatatccggggcggtttagggtatgtggcgattatcgctattctattgttcgccagtttggtgggaagcgcggtggcgtctactgccgctttaggggcaattttaattccgatgatggcgactatcggttacaaccgtgatcgcgctaccgcgttgattgcggcgggtaatattttatcgccgattatgccgccgtccgtgccgatgattattttcggcgttaccgcgggcgtatccgtaacggatttatttatgggcggtattgcaccggccgtttatattacactgactctttgtgtgatttgggctatcgtttcccgtcgcgattccgccgtaccgttgccgaaaagatcattccgcgaagtggtacgcgctacgcgtgaagcgctttgggcgattttgatgccggtcggtcttttattaggcttgcgtagcggtatgtttacgccgacggaagccggggtggttgcggttgtttatgcgttaatcatcggtttgtttgtgtaccgagaattaactttccaagccattaaagaatgtttcatttcttccgcgaaagccagtgcggcaattatgtttctggccgccgccgcgatggtgtcttcctggctgatgaccatcggtaatattccacgtattgtcacggatttacttcatccgtttatcggttcgccgattctgttaatgcttgtgattgccggtttagtgttgctggtgggaacttcgatggacgtggtaccgactattttgattttaacaccggtattaatgccggcagtgaaacaggcgggaattaatccggtctatttcggggtggtatttattattacctgcgtcttcggtttgttaacgccgccggtaggtacggtattaaacgttgccgccagtacgggtaaaatcaacatggaacgtatcgtgcgcaaagtatggcctttcctgcttgcgattgttgtggtgctgctcgtgttaatcgtattcccgagtacgttcatgataccacttgaattttttactaaataa

SEQ ID NO: 36891 - protein, 426 aa, Actinobacillus succinogenes 130Z
MTILIFLASLVGGIVIGVPIAFSLLFSGMMLMFYLGGFNSQILSQNLFNGADSFSMMAIPFFVVAGDLMNRGGLTNKIVDAATALVGHIRGGLGYVAIIAILLFASLVGSAVASTAALGAILIPMMATIGYNRDRATALIAAGNILSPIMPPSVPMIIFGVTAGVSVTDLFMGGIAPAVYITLTLCVIWAIVSRRDSAVPLPKRSFREVVRATREALWAILMPVGLLLGLRSGMFTPTEAGVVAVVYALIIGLFVYRELTFQAIKECFISSAKASAAIMFLAAAAMVSSWLMTIGNIPRIVTDLLHPFIGSPILLMLVIAGLVLLVGTSMDVVPTILILTPVLMPAVKQAGINPVYFGVVFIITCVFGLLTPPVGTVLNVAASTGKINMERIVRKVWPFLLAIVVVLLVLIVFPSTFMIPLEFFTK

SEQ ID NO: 36892 - DNA, 1293 bp, Actinobacillus succinogenes 130Z
  CDS (1)..(1293)
atggacgttattattcctatttctattctattgtttctctttgttattggaacaccggtcgctttctgtattttttgttcaacattaatctattttttaatgagtaatttacctatggtaatgttgattcaacgactagctggcggtttggaaagcgttactttacttgcgattcctttcttcattatggctggagtatttatgaatcacacagggattagtgaacgattactcaagttttgtgaagtattaacggggcatatgagtggcggtttggctcaggttaatgtcgcattgagcacattaatgggcggtttatccggttcgaatattgcggatgccgcaatgaactcgaaattacttgtacctcaaatggttgcgcgtggttatagtgcttcattttctgcagccgtaacagctgccggatcgctcattacccctattattccgcccggtatagcgatgattatttatggttatgtcaataatgtttctattgggcgtttatttttagcgggtattgtccccggaaccctgctttgtatcatgatgatggttttggtttccattatttctaaaaagcgaggttatttgcctattcgagaaaagcgtgcaagctgtaaagaaatcattgtttcggctaaagatgcggtattggctcttttactgccaattatcattattggcggtattcgaatggggatttttacacctactgaggctggggctgttgcggtgatttatgcattaatactaggcatgtttatttatcgcaatatggatttgaaaaaactttggctggcaacccgagaatcggcattaggcgcggcgaacgtattgttaataatctgtgtcgccgtagcattctcaaaattcttgacttgggagcgtgtgccgcaaactcttgcgagctggatgacaacagtggttgatagtccgattacgttcttaatgctggttaatgttgctttattgattttaggtatgtttttagaaggtaatgcgatcatgatcgtattggcgccgttacttgcgccaattgcacattcatttggcattgatcctattcatttcggtattgtttttattttcaacggggcaattgggacgattacgcctccattaggaaccgtaatgtttacaacgtgttctattaccgaagttcctattgagaaatttatcaaagatgtcttaccgttttggggactccttatattggaactcattctattaacttatattccgacaatcaccacttggctgcctaatttagtttatggcgtagcacaataa

SEQ ID NO: 36893 - protein, 430 aa, Actinobacillus succinogenes 130Z
MDVIIPISILLFLFVIGTPVAFCIFCSTLIYFLMSNLPMVMLIQRLAGGLESVTLLAIPFFIMAGVFMNHTGISERLLKFCEVLTGHMSGGLAQVNVALSTLMGGLSGSNIADAAMNSKLLVPQMVARGYSASFSAAVTAAGSLITPIIPPGIAMIIYGYVNNVSIGRLFLAGIVPGTLLCIMMMVLVSIISKKRGYLPIREKRASCKEIIVSAKDAVLALLLPIIIIGGIRMGIFTPTEAGAVAVIYALILGMFIYRNMDLKKLWLATRESALGAANVLLIICVAVAFSKFLTWERVPQTLASWMTTVVDSPITFLMLVNVALLILGMFLEGNAIMIVLAPLLAPIAHSFGIDPIHFGIVFIFNGAIGTITPPLGTVMFTTCSITEVPIEKFIKDVLPFWGLLILELILLTYIPTITTWLPNLVYGVAQ

SEQ ID NO: 36894 - DNA, 1362 bp, Enterobacter sakazakii
  CDS (1)..(1362): transl_table=11
atgggaacaattctggaactcctcacgggagccgtggttattgtgggggtcgcacgttatatcattaaaggttattccgccacgggcgtactctttgttggcggtattaccctgttaataattagcgcgctaatgggtcacgccatattgcccgccaaagaaacgagtaccggttacgctatcagcgatatttttgaatatattaaaattctgctgatgagccgcggcggcgatctcggcatgatgattatgatgctgtgtggtttcgcggcgtatatgacgcataccggtgccaacgatatggtggtcaagctcgcctcccgcccgctgcgttatatcaattcaccttatttactgatgattgccgcctatttcgtcgcctgcctgatgtcgcttgccgtctcgtccgcgaccggccttggcgtgttgctgatggcgacgctgttcccggtcatggtcaatgtcggtatcagccgcggcgcggcggcggctatctgcgcctctccggcggcgattattctctccccaacctctggtgatgtggtgctggccgcacaggcctctgaaatgccgcttatcgattttgcgtttaaaaccacactgccgatttccatcgcggccattatctgcatggctgtcgcccacttcttctggcagcgctttctggataaaaaagagcacatctatcacgaaacgctggaggtaaaagaaatcaccaccagcgcgcccgctttttacgcgattctgccgttcagcccgatcattggcgtgctgattttcgacggcaaatgggggccgcaactgcatatcatcaccattctggtgatctgcatggtgctgaccgccgtgattgaatttatccgcagctttaacagtaaaacggtgtttgccgggctggaagtggcgtaccgcggcatggcggacgcgtttgcaggcgtggtgatcctgctggtcgccgccggcgttttcgcccaggggctcagcgcgataggctttatccagagccttatctctatcgccacctcgtttggctcggccagcattatcctgatgctggtgctggtcacgctcaccatgcttgcggcgatgacgaccggctccggcaacgcgccgttttacgccttcgttgagatgatcccaaaactcgcgcacagcgccggggtgaatccggcctatctgacgatcccgatgctgcaggcgtccaacctgggacgcaccatttcaccggtttccggtgtggtggtggcggtcgcggggatggcgaaaatctcaccgtttgaagtcgttaaacgcacctcggtgcctgtgctggttggattaatcgtcgtgatcctggcgacgcaactgctggttgcggcataa

SEQ ID NO: 36895 - protein, 453 aa, Enterobacter sakazakii
MGTILELLTGAVVIVGVARYIIKGYSATGVLFVGGITLLIISALMGHAILPAKETSTGYAISDIFEYIKILLMSRGGDLGMMIMMLCGFAAYMTHTGANDMVVKLASRPLRYINSPYLLMIAAYFVACLMSLAVSSATGLGVLLMATLFPVMVNVGISRGAAAAICASPAAIILSPTSGDVVLAAQASEMPLIDFAFKTTLPISIAAIICMAVAHFFWQRFLDKKEHIYHETLEVKEITTSAPAFYAILPFSPIIGVLIFDGKWGPQLHIITILVICMVLTAVIEFIRSFNSKTVFAGLEVAYRGMADAFAGVVILLVAAGVFAQGLSAIGFIQSLISIATSFGSASIILMLVLVTLTMLAAMTTGSGNAPFYAFVEMIPKLAHSAGVNPAYLTIPMLQASNLGRTISPVSGVVVAVAGMAKISPFEVVKRTSVPVLVGLIVVILATQLLVAA

SEQ ID NO: 36896 - DNA, 1203 bp, Shigella flexneri
  CDS (1)..(1203): transl_table=11
atggatatcgttgaatacgttaaaatattactaatgagccgcggcggcgacctcggcatgatgattatgatgctgtgtggctttgccgcttacatgacccatatcggcgcgaatgatatggtggtcaagctggcgtcaaaaccattgcagtatattaactccccttacctgctgatgattgccgcctattttgttgcttgtctgatgtcactggccgtctcttccgcaaccggtctgggggttttgctgatggcaaccctgtttccggtgatggtaaacgttggtatcagtcgtggcgcagcagctgccatttgtgcctccccggcggcgattattctcgcaccgacttcaggggatgtggtgctggcggcgcaggcttccgaaatgtcgctgattgacttcgccttcaaaacgacgctgcctatctcaattgctgcaattatcggcatggcgatcgcccacttcttctggcaacgttatctggataaaaaagagcacatctctcatgaaatgttagatgtcagtgaaatcaccaccactgcccccgcgttttatgccattttgccgttcacgccgatcatcggtgtactgatttttgacggtaaatggggtccgcaattacacatcatcactattctggtgatttgtatgctgattgcctccattctggagttcctccgcagctttaatacccagaaagttttctctggtctggaagtggcttatcgcgggatggcagatgcgtttgctaacgtggtgatgctgctggttgccgctggggtattcgctcaggggcttagcaccatcggctttattcaaagtctgatttctatcgctacctcgtttggttcggcgagtatcatcctgatgctggtattggtgattctgaccatgctggcggcagtcacgaccggttcaggcaatgcgccgttttatgcgtttgttgagatgatcccgaaactggcgcactcttccggcattaacccggcgtatttgactatcccgatgctgcaggcgtcaaacctgggtcgtaccctatcacccgtttctggcgtagtcgttgcggttgccgggatggcgaaaatctcaccatttgaagtcgtaaaacgcacctcggtgccggtgcttgttgggctagtgattgttatcgttgctacagagctgatggtgccaggaacggcagcagcggtcacaggcaagtaa

SEQ ID NO: 36897 - protein, 400 aa, Shigella flexneri
MDIVEYVKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILAPTSGDVVLAAQASEMSLIDFAFKTTLPISIAAIIGMAIAHFFWQRYLDKKEHISHEMLDVSEITTTAPAFYAILPFTPIIGVLIFDGKWGPQLHIITILVICMLIASILEFLRSFNTQKVFSGLEVAYRGMADAFANVVMLLVAAGVFAQGLSTIGFIQSLISIATSFGSASIILMLVLVILTMLAAVTTGSGNAPFYAFVEMIPKLAHSSGINPAYLTIPMLQASNLGRTLSPVSGVVVAVAGMAKISPFEVVKRTSVPVLVGLVIVIVATELMVPGTAAAVTGK

SEQ ID NO: 36898 - DNA, 1206 bp, Edwardsiella ictaluri
  CDS (1)..(1206): transl_table=11
atgtcgaccggctggcgcgcgaccgatatcgttgagtatgtaaaagttctgctgatgagtcgcggcggcgacctcggcatgatgatcatgatgctgtgcggttttgccgcctatatgacccatatcggtgccaacgatatggtggtcaagctggcctcccgcccgctgcgctatattaactcgccctatattttaatgattgcggcctactttgtcgcctgcctgatgtcgctggccgtttcgtcggccaccgggctgggagtattgctgatggcaaccctgttcccggtgatggtcaacgtggggatcagccggggggcggcggcggcgatctgtgcctcgcctgcggcgatcatcctggctccgacctccggcgatgtggtgctggcagccaaggcgtccgaaatgccgctgatcgactttgcctttaaaacaaccctgcccatctccatcatcgctatcgtctgtatggcgattgcccactacttctggcagcgctacctggacaacaaggagcaggcgcagcacgagatactggacgtcaacgagatcaccaccacggcaccctcgttttatgccattctgccctttacgccgatcatcggcgtgctggtgttcgacggtaagtgggggccacatctgcacatcatcagcgtcctggttatctgtatgctgctggcctcggtgactgagtttttgcgcagcttcgacgctaaaaaggtctatagcgggctggaggtggcctaccgcgggatggcggacgcctttgccagcgtggtgatgctgttggtggccgccggggtctttgcccaggggctgagcaccgtcggctttatcagcagcctgatcgagctggcccagtcctttggcaccggtggcatcatcatgatgctggtgctggtggtgatcaccatgctggcggcgatgaccaccggctccggcaacgcgccgttctacgcctttgtcgagttgatccccaagctgtccggccagatgggcatcaacccggcctacctgaccattccgatgctgcaggcctccaatctgggccgcaccctatcgccggtttccggtgtggtggtggctgtctccgggatggccaagatctccccctttgaggtggttaaacgcacctcggtgccggtgctggtcggcctggtggtggtgatcgtcgccaccgagtttatggtaccgctgcaccgctga

SEQ ID NO: 36899 - protein, 401 aa, Edwardsiella ictaluri
MSTGWRATDIVEYVKVLLMSRGGDLGMMIMMLCGFAAYMTHIGANDMVVKLASRPLRYINSPYILMIAAYFVACLMSLAVSSATGLGVLLMATLFPVMVNVGISRGAAAAICASPAAIILAPTSGDVVLAAKASEMPLIDFAFKTTLPISIIAIVCMAIAHYFWQRYLDNKEQAQHEILDVNEITTTAPSFYAILPFTPIIGVLVFDGKWGPHLHIISVLVICMLLASVTEFLRSFDAKKVYSGLEVAYRGMADAFASVVMLLVAAGVFAQGLSTVGFISSLIELAQSFGTGGIIMMLVLVVITMLAAMTTGSGNAPFYAFVELIPKLSGQMGINPAYLTIPMLQASNLGRTLSPVSGVVVAVSGMAKISPFEVVKRTSVPVLVGLVVVIVATEFMVPLHR

SEQ ID NO: 36900 - DNA, 1380 bp, Vibrio cholerae
  CDS (1)..(1380): transl_table=11
ttggagattgctatgcttgagcttctgattggcttagtcgtgacctttgcggtcggctatttcatcgttaaaggctataagcctgcgggtatcctactcaccgcagggattttgctactcattttaaccggtatcttgggacacaaagtcctacctggacagatggaatcaaccggtaacctactcaccgatgcaatggagtatgtgaaatacatgctgcaaaaccgtggcggcggcttaggtatgcaaattatgttgctgtgtggttttgcgtcatacatgacgcacatcggtgccaacaacgtagtggtaaaacagttttctaaaccactctcttttattaaatcaccctacatcttgttggtcgcggcctatcttgttgcctgtttgatgtctctggccgtgagttcagccaccggccttggcgtgttattaatggcgaccttattcccaatgatgaccgcgatgggcatttctcgccctgcggcagtagcggtgtgtgcctctccggctgcgatcattctctctcctacctctggtgacgtggtcattgcggcagaaaaatccggtttgccattgcacgtattcgccgtagaaaccgtattgcctgtttcgatctgcgcgatcattgtgatggcggccgccgcgtatttctggaaccaataccttgataaaaaagataatacaccaatggagaaagtggatttgtcggaaatggaggttaaatcaccagcctattatgcagtcctgccattcttacccatcatcggtgtgtttgtgttcaatggtgaaacgctgcctggcattacgctggatatctataccatcgttgtactgtcaattttcattggcgtgctggtcgactacatcactaaacgtttcaacggtaagcaaacattggaagatcttgaagcctgttacgaaggcatggcggatgcctttaaaggcgtagtcatgttgttggttgcagcaggcgtatttgcacaaggtttgatgtcgattggtgcgattgacaacctactgcacttagcagaagtagcgggggctggcggtattgctctgatgttgattctgactggtttaaccgtcgccgctgcgattgccaccggctcaggcaacgcgcctttctatgcgtttgtggaattggctccgtcactggctgcgaaaatgggactcaaccccgcattcctgattattcctatgctgcaagcctccaaccttggccgtaccatttctccggtttctggtgtggtagtagctaccgcgggtatgggtaaaatcagcccattcgaagtggtaaagcgtacttctgtgcctgtgttactgggccttgttacggtgatcatcggtactatggtgctggtacctatgcacgcttaa

SEQ ID NO: 36901 - protein, 459 aa, Vibrio cholerae
MEIAMLELLIGLVVTFAVGYFIVKGYKPAGILLTAGILLLILTGILGHKVLPGQMESTGNLLTDAMEYVKYMLQNRGGGLGMQIMLLCGFASYMTHIGANNVVVKQFSKPLSFIKSPYILLVAAYLVACLMSLAVSSATGLGVLLMATLFPMMTAMGISRPAAVAVCASPAAIILSPTSGDVVIAAEKSGLPLHVFAVETVLPVSICAIIVMAAAAYFWNQYLDKKDNTPMEKVDLSEMEVKSPAYYAVLPFLPIIGVFVFNGETLPGITLDIYTIVVLSIFIGVLVDYITKRFNGKQTLEDLEACYEGMADAFKGVVMLLVAAGVFAQGLMSIGAIDNLLHLAEVAGAGGIALMLILTGLTVAAAIATGSGNAPFYAFVELAPSLAAKMGLNPAFLIIPMLQASNLGRTISPVSGVVVATAGMGKISPFEVVKRTSVPVLLGLVTVIIGTMVLVPMHA

SEQ ID NO: 36902 - DNA, 1368 bp, Escherichia coli
  CDS (1)..(1368): transl_table=11
atgttcggcataattatatctgtcatcgtattaattacgatgggctatttgatcctgaaaaactacaaacctcaggtggtgctggctgccgcaggtatcttcctgatgatgtgcggtgtctggttagggttcggtggtgtactcgatcccaccaaaagcagcggctacttgatcgtcgatatttataatgaaatcctgcgcatgctgtccaaccgcattgccggattggggctgtcgattatggcggtgggcggttatgcccgctacatggagcgcataggggccagtcgcgcgatggtgagcttgttaagccgcccgttaaaactcattcgctcgccgtatattattctgtcggcaacttacgtcatcggccaaatcatggcgcagtttattaccagcgcctccggtctgggtatgttgctgatggtcaccttatttccgacgctggtgagtctgggagtaagtcgtctctctgcggtggcagttatcgcaaccacgatgtccattgagtgggggattctggaaacgaactccatttttgctgcccaggtagcgggaatgaaaattgccacatacttcttccactaccagcttccggtcgcctcttgcgtcattatctcggtggcgatctcccactttttcgtgcaacgcgcttttgacaaaaaagataaaaatatcaatcacgaacaggcagagcaaaaagctctcgataatgtcccgccgctctattacgccattttacctgtgatgccgttaatcctgatgctcggctcgctgttcctcgcccacgtcgggctgatgcagtcagaactgcatctggtggtggtgatgttactgagtttgactgtgacgatgtttgttgagttcttccgcaagcataacttgcgcgaaacaatggacgatgtgcaggcgttttttgacggcatgggtacgcagtttgccaacgtggtaacgctggtggtcgcgggtgaaatatttgcgaaaggcttaacgacgattggcactgtcgatgcggttatcaggggggcggagcattctggtctgggcggtattggcgtgatgattattatggcgctggtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcgcggtttcgccgattactgcggtggtggtcgttacgtcaggaattgcaggcgtttcgccttttgcggtggtgaagcggacagcgatccccatggcagtcggtttcgtggtgaatatgattgccacaatcacgctattttattaa

SEQ ID NO: 36903 - protein, 455 aa, Escherichia coli
MFGIIISVIVLITMGYLILKNYKPQVVLAAAGIFLMMCGVWLGFGGVLDPTKSSGYLIVDIYNEILRMLSNRIAGLGLSIMAVGGYARYMERIGASRAMVSLLSRPLKLIRSPYIILSATYVIGQIMAQFITSASGLGMLLMVTLFPTLVSLGVSRLSAVAVIATTMSIEWGILETNSIFAAQVAGMKIATYFFHYQLPVASCVIISVAISHFFVQRAFDKKDKNINHEQAEQKALDNVPPLYYAILPVMPLILMLGSLFLAHVGLMQSELHLVVVMLLSLTVTMFVEFFRKHNLRETMDDVQAFFDGMGTQFANVVTLVVAGEIFAKGLTTIGTVDAVIRGAEHSGLGGIGVMIIMALVIAICAIVMGSGNAPFMSFASLIPNIAAGLHVPAVVMIMPMHFATTLARAVSPITAVVVVTSGIAGVSPFAVVKRTAIPMAVGFVVNMIATITLFY

SEQ ID NO: 36904 - DNA, 24 bp, Artificial sequence
  (1)..(24): primer
atgctgacattcattgagctcctt

SEQ ID NO: 36905 - DNA, 22 bp, Artificial sequence
  (1)..(22): primer
ttacttgcctgtgaccgctgct

SEQ ID NO: 36906 - protein, 498 aa, Artificial sequence
  Variant (2)..(10): xaa in position 2 to 10 is any amino acid
  Variant (13)..(24): xaa in position 13 to 24 is any amino acid
  Variant (25)..(25): xaa in position 25 is any or no amino acid
  Variant (27)..(27): xaa in position 27 is any amino acid
  Variant (29)..(44): xaa in position 29 to 44 is any amino acid
  Variant (45)..(74): xaa in position 45 to 74 is any or no amino acid
  Variant (76)..(76): xaa in position 76 is any amino acid
  Variant (78)..(83): xaa in position 78 to 83 is any amino acid
  Variant (85)..(86): xaa in position 85 to 86 is any amino acid
  Variant (88)..(90): xaa in position 88 to 90 is any amino acid
  Variant (92)..(95): xaa in position 92 to 95 is any amino acid
  Variant (98)..(103): xaa in position 98 to 103 is any amino acid
  Variant (105)..(109): xaa in position 105 to 109 is any amino acid
  Variant (110)..(112): xaa in position 110 to 112 is any or no amino acid
  Variant (114)..(129): xaa in position 114 to 129 is any amino acid
  Variant (132)..(132): xaa in position 132 is any or no amino acid
  Variant (134)..(136): xaa in position 134 to 136 is any amino acid
  Variant (137)..(139): xaa in position 137 to 139 is any or no amino acid
  Variant (141)..(143): xaa in position 141 to 143 is any amino acid
  Variant (145)..(145): xaa in position 145 is any amino acid
  Variant (147)..(147): xaa in position 147 is any amino acid
  Variant (149)..(151): xaa in position 149 to 151 is any amino acid
  Variant (153)..(157): xaa in position 153 to 157 is any amino acid
  Variant (159)..(162): xaa in position 159 to 162 is any amino acid
  Variant (163)..(164): xaa in position 163 to 164 is any or no amino acid
  Variant (166)..(172): xaa in position 166 to 172 is any amino acid
  Variant (173)..(173): xaa in position 173 is any or no amino acid
  Variant (175)..(179): xaa in position 175 to 179 is any amino acid
  Variant (181)..(187): xaa in position 181 to 187 is any amino acid
  Variant (188)..(196): xaa in position 188 to 196 is any or no amino acid
  Variant (198)..(211): xaa in position 198 to 211 is any amino acid
  Variant (212)..(212): xaa in position 212 is any or no amino acid
  Variant (214)..(238): xaa in position 214 to 238 is any amino acid
  Variant (239)..(267): xaa in position 239 to 267 is any or no amino acid
  Variant (269)..(269): xaa in position 269 is any amino acid
  Variant (271)..(271): xaa in position 271 is any amino acid
  Variant (273)..(273): xaa in position 273 is any amino acid
  Variant (275)..(276): xaa in position 275 to 276 is any amino acid
  Variant (278)..(281): xaa in position 278 to 281 is any amino acid
  Variant (282)..(308): xaa in position 282 to 308 is any or no amino acid
  Variant (310)..(314): xaa in position 310 to 314 is any or no amino acid
  Variant (318)..(318): xaa in position 318 is any amino acid
  Variant (319)..(320): xaa in position 319 to 320 is any or no amino acid
  Variant (322)..(324): xaa in position 322 to 324 is any amino acid
  Variant (326)..(343): xaa in position 326 to 343 is any amino acid
  Variant (344)..(354): xaa in position 344 to 354 is any or no amino acid
  Variant (357)..(357): xaa in position 357 is any amino acid
  Variant (360)..(361): xaa in position 360 to 361 is any amino acid
  Variant (363)..(363): xaa in position 363 is any amino acid
  Variant (365)..(368): xaa in position 365 to 368 is any amino acid
  Variant (370)..(377): xaa in position 370 to 377 is any amino acid
  Variant (379)..(398): xaa in position 379 to 398 is any amino acid
  Variant (399)..(408): xaa in position 399 to 408 is any or no amino acid
  Variant (410)..(426): xaa in position 410 to 426 is any amino acid
  Variant (428)..(435): xaa in position 428 to 435 is any amino acid
  Variant (437)..(443): xaa in position 437 to 443 is any amino acid
  Variant (445)..(451): xaa in position 445 to 451 is any amino acid
  Variant (454)..(457): xaa in position 454 to 457 is any amino acid
  Variant (458)..(459): xaa in position 458 to 459 is any or no amino acid
  Variant (462)..(462): xaa in position 462 is any amino acid
  Variant (463)..(472): xaa in position 463 to 472 is any or no amino acid
  Variant (474)..(475): xaa in position 474 to 475 is any or no amino acid
  Variant (477)..(477): xaa in position 477 is any amino acid
  Variant (478)..(480): xaa in position 478 to 480 is any or no amino acid
  Variant (482)..(482): xaa in position 482 is any amino acid
  Variant (484)..(488): xaa in position 484 to 488 is any amino acid
  Variant (490)..(497): xaa in position 490 to 497 is any amino acid
LXXXXXXXXXIIXXXXXXXXXXXXXLXLXXXXXXXXXXXXXXXXXXXXXXXXXXXXXXXXXXXXXXXXXXXXXXMXIXXXXXXAXXMXXXGXXXXLVXXXXXXLXXXXXXXXLXXXXXXXXXXXXXXXXSAXGXXXXXXLXXXLXPXMXXXGXXXXXAXXXXXXAXXXXXXXXPXXXXXIXXXXXXXXXXXXXXXXIXXXXXXXXXXXXXXXIXXXXXXXXXXXXXXXXXXXXXXXXXXXXXXXXXXXXXXXXXXXXXXXXXXXXXXLXPXLXIXXLXXXXXXXXXXXXXXXXXXXXXXXXXXXXXXXLXXXXXLLIXXXIXXXLXXXXXXXXXXXXXXXXXXXXXXXXXXXXXVVXLIXXAXVXXXXLXXXXXXXXLXXXXXXXXXXXXXXXXXXXXXXXXXXXXXXLXXXXXXXXXXXXXXXXXLXXXXXXXXGXXXXXXXIXXXXXXXIGXXXXXXPVXXXXXXXXXXXIXXVXXXXVXKXXXXXMXXXXXXXXL

SEQ ID NO: 36907 - protein, 22 aa, Artificial sequence
  Variant (2)..(17): xaa in position 2 to 17 is any amino acid
  Variant (18)..(18): xaa in position 18 is any or no amino acid
  Variant (20)..(21): xaa in position 20 to 21 is any or no amino acid
LXXXXXXXXXXXXXXXXXSXXA

SEQ ID NO: 36908 - protein, 6 aa, Artificial sequence
  Variant (2)..(3): xaa in position 2 to 3 is any amino acid
  Variant (4)..(5): xaa in position 4 to 5 is any or no amino acid
PXXXXI

SEQ ID NO: 36909 - protein, 32 aa, Artificial sequence
  Variant (2)..(23): xaa in position 2 to 23 is any amino acid
  Variant (24)..(26): xaa in position 24 to 26 is any or no amino acid
  Variant (28)..(28): xaa in position 28 is any amino acid
  Variant (29)..(29): xaa in position 29 is any or no amino acid
  Variant (31)..(31): xaa in position 31 is Phe, Ile, Leu, Met or Val
  Variant (32)..(32): xaa in position 32 is Ala, Gly, Ile, Leu or Val
PXXXXXXXXXXXXXXXXXXXXXXXXXTXXPXX

SEQ ID NO: 36910 - DNA, 1284 bp, Escherichia coli K12
  CDS (1)..(1284): transl_table=11
atggctgatacaaaagcaaaactcaccctcaacggggatacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcggcgttctatcacgactcgctggatgttaacaatcctcgtcaccgtgaaattgccgcgttccgcctgctgtcgaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctctacctccaccgtgcgtaccgctggctcttcgggtgcgaacccgtttgcctgtatcgcagcaggtattgcttcactgtggggacctgcgcacggcggtgctaacgaagcggcgctgaaaatgctggaagaaatcagctccgttaaacacattccggaatttgttcgtcgtgcgaaagacaaaaatgattctttccgcctgatgggcttcggtcaccgcgtgtacaaaaattacgacccgcgcgccaccgtaatgcgtgaaacctgccatgaagtgctgaaagagctgggcacgaaggatgacctgctggaagtggctatggagctggaaaacatcgcgctgaacgacccgtactttatcgagaagaaactgtacccgaacgtcgatttctactctggtatcatcctgaaagcgatgggtattccgtcttccatgttcaccgtcattttcgcaatggcacgtaccgttggctggatcgcccactggagcgaaatgcacagtgacggtatgaagattgcccgtccgcgtcagctgtatacaggatatgaaaaacgcgactttaaaagcgatatcaagcgttaa

SEQ ID NO: 36911 - protein, 427 aa, Escherichia coli K12
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 36912 - DNA, 1302 bp, Mesorhizobium loti MAFF303099
  CDS (1)..(1302): transl_table=11
gtgggcggcgcgaaccaagaggctacggcaacgcttcaattcgctggcaagacccatgaattcaaggtgcgaagcggctccgtcggacccgacgtcatcgacatcgcctcgctctacagcacgaccggcgccttcacctacgaccccggcttcacttcgacggcaagctgcgagtccgaaatcaccttcatcgacggcgacgccggtattctcctccaccgcggctatccgatcgaccagttggccgaacacggcgacttcctcgaagtctgctacctcctgctctacggcgaattgccgaccaaggcgcagaaggacgatttcgattaccgcgtgacgcgccacaccatggtgcacgagcagatgtcgcgcttcttcaccggtttccgccgcgacgcgcacccgatggcggtgatgtgcggcgtggtgggcgcgctgtcggccttctatcacgactccaccgacatctcggacccctaccagcgcatggtcgcctcgatgcgtctgatcgccaagatgccgacgatcgcggccatggcctacaagtaccacatcggccagcccttcatttacccaaagaacgatctcggcttcgcggcaaacttcctgcatatgtgctttgccgtgccgtgcgaagagtacaagatcaacccggtgctggcgcgcgccatggagcgcatcttcatcctgcacgcagatcacgagcagaacgcctcgacctcgacggttcgcctcgccggctcgtcgggcgccaacccgttcgcctgcatcgccgccggcatcgcttgcttgtggggcccggcccatggcggtgccaatgaagcggcgctcaacatgctgggcgagatcggccatgtcgatcacatcccggagttcatcgcccgcgccaaggacaagaacgacccgttccggctgatgggctttggccaccgcgtctacaagaactacgatcctcgtgcgaaaatcatgcagaagacggcgcacgaggttctgggcgaactcggcatcaaggacgatccgctgctcgacatcgccatggaactggaaaagatcgcgctgaccgatccctatttcatcgagaagaagctgtatccgaatgtcgacttctattccggcatcacgctgaaggcgctgggcttccccaccaccatgttcaccgttctgttcgcggtcgcccgcaccgtcggctggatcgcgcagtggaaagagatgatcgaggacccgcgccagaagattggccgcccgcgccagctctacacgggtgcgccggagcgcgactacgtgccgatcgccaagcgctga

SEQ ID NO: 36913 - protein, 433 aa, Mesorhizobium loti MAFF303099
MGGANQEATATLQFAGKTHEFKVRSGSVGPDVIDIASLYSTTGAFTYDPGFTSTASCESEITFIDGDAGILLHRGYPIDQLAEHGDFLEVCYLLLYGELPTKAQKDDFDYRVTRHTMVHEQMSRFFTGFRRDAHPMAVMCGVVGALSAFYHDSTDISDPYQRMVASMRLIAKMPTIAAMAYKYHIGQPFIYPKNDLGFAANFLHMCFAVPCEEYKINPVLARAMERIFILHADHEQNASTSTVRLAGSSGANPFACIAAGIACLWGPAHGGANEAALNMLGEIGHVDHIPEFIARAKDKNDPFRLMGFGHRVYKNYDPRAKIMQKTAHEVLGELGIKDDPLLDIAMELEKIALTDPYFIEKKLYPNVDFYSGITLKALGFPTTMFTVLFAVARTVGWIAQWKEMIEDPRQKIGRPRQLYTGAPERDYVPIAKR

SEQ ID NO: 36914 - DNA, 1104 bp, Thermotoga maritima MSB8
  CDS (1)..(1104): transl_table=11
ttgatacaaaagggactggaaggcgtcaaaatatgtgaaagttcgatatgctatctggatggcatcaacggaaggctctactaccgaggaataccggttgaggaactcgcggaaaaatcgaccttcgaagaaacggcctactttctctggtacggaaagcttcccacaaagagtgagcttgaagaattcaaaaggaaaatggcagattacagagagcttcctgcagaagcccttggaattctttaccatcttccgaaaaaccttcattacattgatgttttgaagatattcctttctattcacggttccatggatgggaacgatgaggatctcagagaaaaagccatcagggttgccagcgtctttcccacaatactggcgtattactacagatactctaaaggaaaagaactgataaggccaagaaaagacttatcacacgttgagaacttctactacatgatgttcggagagagaaacgaaaagatccgtcttctggaatctgcgttcattcttctcatggagcaggatataaacgcttccacctttgccgcgctcgtgatagcctccacactctccgatctttattcctgtattgtaggggctctcggtgcactcaagggtcctctccacggtggtgcaagtgaaaaggttccacccatgctggaagagatcggaagcgaagacagggtggaagagttcgttcaaaagtgtctgaaagagaaaagaaagatcatgggattcgggcatcgagtttacaaaacttacgatccgagagcggtgtttttgaagagagtccttcaggaacactttccagatagcaaactgttcagaatcgccagcaagctggaagaatacatcgtttccaacaagatcaaaaacatatacccgaatgtggatctgtattcgagcgttctcttcgaagaactcggttttccaaggaacatgttcactgccctgtttgcaactgcgcgtgttgtcggatggaccgctcatgtgatcgaatacgtgagtgacaacaagctgatcagaccaaccagtgagtacgtgggtcctatggatgtcgaatacattcctatcgagcggagggatgagaatgggtaa

SEQ ID NO: 36915 - protein, 367 aa, Thermotoga maritima MSB8
MIQKGLEGVKICESSICYLDGINGRLYYRGIPVEELAEKSTFEETAYFLWYGKLPTKSELEEFKRKMADYRELPAEALGILYHLPKNLHYIDVLKIFLSIHGSMDGNDEDLREKAIRVASVFPTILAYYYRYSKGKELIRPRKDLSHVENFYYMMFGERNEKIRLLESAFILLMEQDINASTFAALVIASTLSDLYSCIVGALGALKGPLHGGASEKVPPMLEEIGSEDRVEEFVQKCLKEKRKIMGFGHRVYKTYDPRAVFLKRVLQEHFPDSKLFRIASKLEEYIVSNKIKNIYPNVDLYSSVLFEELGFPRNMFTALFATARVVGWTAHVIEYVSDNKLIRPTSEYVGPMDVEYIPIERRDENG

SEQ ID NO: 36916 - DNA, 1296 bp, Vibrio cholerae O1 biovar eltor str. N16961
  CDS (1)..(1296): transl_table=11
atggttatggcggataagaaagcgacccttcacatcgaaggtaaagcgccaatcgaattgccaattatggatggatcgcttggtccacaagtgattgacgttcgtactttaggctcaaacggttactttacttttgacccgggttttcttgccactgcatcctgtgaatctcaaattacttatatcgatggcgctaagggcattctgttgcaccgcggctaccctatcgatcagttagccaataacgctgattacttggaagtgtgttacatccttctttacggtgaagcccctaatcgtaagcaatatgaagagttcaagaaaatcgttactcgtcacactatggttcatgaacagatcgcgagctttttccacggtttccgccgtgatgctcacccgatggctgtgatgtgtggtgtggtgggtgcgttagctgctttctatcatgattcactcgatatcaataacgacacccaccgagaaattgcggcttatcgtctgctttccaaaatgccgaccttggctgcgatgtgttacaaatactcagttggtcaaccgtttatctacccacgtaacgatttgagctatgcagaaaacttcctgcacatgatgtttgccacaccttgtgaggagtatgaagtgaatcctatcgtggctcgtgccatggacaagattttcactctacatgcggatcatgaacaaaacgcatcgacatcgactgtacgtctggcaggttcatcgggtgctaacccatttgcgtgtatcgcagcaggtatcgcttctctttggggccctgcacatggtggcgcaaacgaagcttgtctacgtatgcttgaagagatcggctctgttgataagattcctgaatacgtaagacgtgcaaaagacaaagatgacccattccgtctaatgggctttggtcaccgagtgtacaaaaactacgatccacgtgccactgtaatgcgtgaagcgtgtcatgaagtgctgaaagagctaagcattcaagatccactgctcgacgtcgcgatggaacttgagcgtattgcgctgtctgatgagtactttattgagaagaaactctatcctaacgtcgatttctactcaggcatcattctcaaagccattggtattcctgtgtctatgttcacggtgatctttgcgatgtctcgtactatcggttggattgctcactggaatgaaatgcacagcgatccggacaaccgtatcggtcgtccacgtcagttgtacacaggtcaaaaactgcgcgatttcacacccttgcatgaacgcagttaa

SEQ ID NO: 36917 - protein, 431 aa, Vibrio cholerae O1 biovar eltor str. N16961
MVMADKKATLHIEGKAPIELPIMDGSLGPQVIDVRTLGSNGYFTFDPGFLATASCESQITYIDGAKGILLHRGYPIDQLANNADYLEVCYILLYGEAPNRKQYEEFKKIVTRHTMVHEQIASFFHGFRRDAHPMAVMCGVVGALAAFYHDSLDINNDTHREIAAYRLLSKMPTLAAMCYKYSVGQPFIYPRNDLSYAENFLHMMFATPCEEYEVNPIVARAMDKIFTLHADHEQNASTSTVRLAGSSGANPFACIAAGIASLWGPAHGGANEACLRMLEEIGSVDKIPEYVRRAKDKDDPFRLMGFGHRVYKNYDPRATVMREACHEVLKELSIQDPLLDVAMELERIALSDEYFIEKKLYPNVDFYSGIILKAIGIPVSMFTVIFAMSRTIGWIAHWNEMHSDPDNRIGRPRQLYTGQKLRDFTPLHERS

SEQ ID NO: 36918 - DNA, 1119 bp, Bacillus halodurans C-125
  CDS (1)..(1119): transl_table=11
atgagtgtcactcgtggtcttgaaggcgtcgttgcgacgacatctagcgtaagttcgattattgaaagtgtattaacgtatcaaggatacgatattgatgaacttgctgaacatgcaagttttgaagaagtaatataccttctttggaatggaaagctcccaaataaagtagagcttaaagaacttgcagatgaacttgcaaataacgctgaaatcccgcaagaagtcattgagcaaatgaaagcttatccgttagatcgcgtacacccaatgggcgctcttcgcacagcgatttcaagcttaggcttgtatgatgaggaagcggatcttatggatgaagcagcaaacaagcgaaaggcattgaagcttcaagcgcaagtttcaacggttgtgacagcgttttctcgcattcgcgaaggaaaagagcctgttgcgcctcgtacagatttaagttttgcggcgaatttcttgtacatgctaacaggagaagagcctgatgaaatagcggttgatgcatttaataaagcacttgttctgcatgctgatcacgagctaaacgcctctacattcacagcacgagtctgtgttgcgactctttctgacgtttactctggtattacagcagcgattggggcattaaagggacctcttcacggtggtgccaacgaacaggtaatggccatgctcacggaaatcggcgatgttgaaaacgttgaaccttacatccgcaaagctttggacaacaaacaaaaaattatgggcttcggtcaccgagtgtataaaaatggcgatccacgtgctaaacacctacgggaaatgtctaagaaattaacgagcattacgggggaaagcaagtggtacgagatgtctgtgaaaattgaagaaatcgtaacaaatgaaaaaggactattgccaaacgttgatttctattccgctagcgtttaccatagtcttggaatcaaacacgacttatttacaccgatttttgctgttagccgtatgagcggatggttggctcatattttagagcaatacagcaacaaccgcttgattcgccctcgggcagaatatgttggaccgaacaagcgacaatatgtacgtttggaagagcgcaactaa

SEQ ID NO: 36919 - protein, 372 aa, Bacillus halodurans C-125
MSVTRGLEGVVATTSSVSSIIESVLTYQGYDIDELAEHASFEEVIYLLWNGKLPNKVELKELADELANNAEIPQEVIEQMKAYPLDRVHPMGALRTAISSLGLYDEEADLMDEAANKRKALKLQAQVSTVVTAFSRIREGKEPVAPRTDLSFAANFLYMLTGEEPDEIAVDAFNKALVLHADHELNASTFTARVCVATLSDVYSGITAAIGALKGPLHGGANEQVMAMLTEIGDVENVEPYIRKALDNKQKIMGFGHRVYKNGDPRAKHLREMSKKLTSITGESKWYEMSVKIEEIVTNEKGLLPNVDFYSASVYHSLGIKHDLFTPIFAVSRMSGWLAHILEQYSNNRLIRPRAEYVGPNKRQYVRLEERN

SEQ ID NO: 36920 - DNA, 1284 bp, Neisseria meningitidis MC58
  CDS (1)..(1284): transl_table=11
atgtccaaatcaatcaaactcaacgtaccgggtcaggcaggtttggagctgccggtattggaagccagcatcgggcacgatgtggttgacattcgggggctgacaaaaaatacaggtttgttttccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaataccgtccgccgccacacgatggtgcatgaacagctgacttggttcttccgggggttccgccgcgacgcgcatccgatggcgatgatggtcggcgtggtcggcgcactgtctgcgttctaccaagacagcttggacattagcaatcccgaacaccgcaaaatcgcgatttaccgcctgatttctaaaatcccgaccattgcggcaatgtgctaccgctattcaaacggtctgccgttcaattatccgaagaataatctttcttattccgaaaacttccttcatatgatgttcgccacgccgtgtgaagactacaaacccaatcccgttttggcacgcgcgctcgaccgcatctttattttgcatgccgaccacgagcaaaacgcctcaacttcaaccgtccgtctggcagggtcttcgggtgcgaacccgtttgcctgtattgctgccggtatcgcctgcctgtggggtgcttcgcacggcggtgcgaacgaagccgtgttgaaaatgttggacgaaatcggcgatgtgtctaatgttgccgcatacatggaaggtgtgaaacaacgcaaataccgtctgatgggcttcggtcaccgcgtgtaccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatccaaacgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccgccaggcgagaggtaa

SEQ ID NO: 36921 - protein, 427 aa, Neisseria meningitidis MC58
MSKSIKLNVPGQAGLELPVLEASIGHDVVDIRGLTKNTGLFSFDPGFVSTASCESKITYIDGDQGLLYYRGYPIEQLAEKSDYLEVCYLLIYGELPTPEQKAEFDNTVRRHTMVHEQLTWFFRGFRRDAHPMAMMVGVVGALSAFYQDSLDISNPEHRKIAIYRLISKIPTIAAMCYRYSNGLPFNYPKNNLSYSENFLHMMFATPCEDYKPNPVLARALDRIFILHADHEQNASTSTVRLAGSSGANPFACIAAGIACLWGASHGGANEAVLKMLDEIGDVSNVAAYMEGVKQRKYRLMGFGHRVYRNMDPRASIMRETCYEVLKELGLEDSPKFKLAMELEQIALKDPFFIERKLYPNVDFYSGIVLSALGIPTEMFTVIFALSRSVGWISHWHEMISDPSLKIGRPRQLYTGSERRDYVPPGER

SEQ ID NO: 36922 - DNA, 1269 bp, Campylobacter jejuni subsp. jejuni NCTC 11168
  CDS (1)..(1269): transl_table=11
atgtcaaattccgttactataaccgataatagaaatggaaaaagctatgaatttcctatatatgacggtacaactgggccaagcgttgtagatatgtcaagtttttataaacaaacaggaatgttttcttatgatgagggcttgacttctacagctacttgtaaatcaaaaatcacttatattgatggagaaaatggaattttaatgcaccgtggctatcctatagagtggcttgctgaaaacaaactttatttagatgtggttcatcttttactttataaagaattacctgatgctacgcgtcttgaagcgtttcgttatgaaatgaaaaaacgttcttttatccatgaaggtatgcaccgtctttttgattctttccctgataatgctcatcctatggcagttttacaaggtgctgtttcatcgcttagtgctttttatcctgatcatttaaacatgaatgtaaaagaagaatatatggaaatggcagctagaatagtagctaaaatccctactatagtggccaccgcttatagatataaacacggctttcctatggcttatccaaatttagatcgtggttttacagaaaatttcttatatatgttaagaacctatccttacgatcatgtagagcttaaacctatagaagtaaaagcacttgatacagtttttatgcttcatgcagatcatgagcaaaatgcttcaacttcaacagttcgtgctgtgggttcaactcatgctcatccttatgcctgtatagcagcaggtattggtgcgctttggggtcatgcacatggtggagctaatgaaggtgttattagaatgcttgagcaaataggtagtgttgatagggtagatgaattcatcaaaagagctaaggataaaaacgatcctttccgcttgatgggctttgggcatagggtttataaaaattttgatcctagagcaaaagtactgaaaaagcttcgtgatcaacttattgatgagttgggtattgataccaatcttattaaagtagcaacgcgtatagaagagattgctttaagcgatgattattttgttcaaagagggttatatccgaatgttgattttcatagtggacttattttaaaagccttaggtattccaaatgaaatgtttgctactttatttgttatagggcgcaccccaggatggatagctcagtggatagaacaaaaagagcaagaaagtcttaaaatagtccgtccaagacaactttatttgggtgaaactagtaaaatttaa

SEQ ID NO: 36923 - protein, 422 aa, Campylobacter jejuni subsp. jejuni NCTC 11168
MSNSVTITDNRNGKSYEFPIYDGTTGPSVVDMSSFYKQTGMFSYDEGLTSTATCKSKITYIDGENGILMHRGYPIEWLAENKLYLDVVHLLLYKELPDATRLEAFRYEMKKRSFIHEGMHRLFDSFPDNAHPMAVLQGAVSSLSAFYPDHLNMNVKEEYMEMAARIVAKIPTIVATAYRYKHGFPMAYPNLDRGFTENFLYMLRTYPYDHVELKPIEVKALDTVFMLHADHEQNASTSTVRAVGSTHAHPYACIAAGIGALWGHAHGGANEGVIRMLEQIGSVDRVDEFIKRAKDKNDPFRLMGFGHRVYKNFDPRAKVLKKLRDQLIDELGIDTNLIKVATRIEEIALSDDYFVQRGLYPNVDFHSGLILKALGIPNEMFATLFVIGRTPGWIAQWIEQKEQESLKIVRPRQLYLGETSKI

SEQ ID NO: 36924 - DNA, 1236 bp, Deinococcus radiodurans R1
  CDS (1)..(1236): transl_table=11
gtgtgccctgcccgctctcatctctttgtcaccccggcagggacgtttgaccgcccctttttcgccccctggaagaagggcaggtgttatcctctgctcactatgtcgaacattgccaaagggcttgaaggtgttctctttaccgagagcaagctgacgtttatcaacggctcggagggcattctgacccacctgggcattccgattcaggaatgggccgaaaagagcaccttcgaggaactcagcctcgcgctgctcgacgccaaactgcccaccgccgaggaactcgccaagttcgacgccgaactcaaggccaaccgcgccatccccgatcagctcgtgggcatcatccgcgacatgcccaagggcgtacaccccatgcaggcgctgcgcacggcggtcagctacctgggcctgctcgaccctcaggccgaggacatcacccctgaggcccggcgcgccatcagcacccgcatgatcgcgcagttctcgaccatcatcgcggcgatcaaccgcgcccaagaaggccaggacatcgtggccccccgcgccgacctgacccacgcgggcaacttcctgtacatgctgaccggcaacgagcccacccccgagcaggcccgtctgttcgacatcgcgctcgtgctgcacgccgaccacggcatgaacgcctcgaccttcacggcgattgcgaccagctcgaccctcagcgacatgtactcctgcatggtgagcgccatcggcgcgctcaaaggcccgctgcacggcggcgccaacgaagccgtgatgaccatgctcgacgaaatcggcaccgtggacaaggccgaggcgtacatcacggggaagctcgacaacaaagagaagatcatgggcgtgggccaccgcgtctacaagtacttcgacccccgctcgcgcgtgctgcgcgactacgccgagcacgtcgccaacaaagaaggcaagagcaactactaccagatcctcgaagccatcgagaagatcatcgtggaccgcatgggcgccaagggcatctaccccaacgtggacttctactccggcaccgtgtacagcgacctgggcatcaagaaggaatacttcacccccatctttgccctggcccgcatcagcggctggtgcgccagcgtcatcgagtacagccaggacaaccgcctgctgcgccccgacgccgagtacaccggcgcccgcgaccagcactacgtggacatcaaagaccgccagtaa

SEQ ID NO: 36925 - protein, 411 aa, Deinococcus radiodurans R1
MCPARSHLFVTPAGTFDRPFFAPWKKGRCYPLLTMSNIAKGLEGVLFTESKLTFINGSEGILTHLGIPIQEWAEKSTFEELSLALLDAKLPTAEELAKFDAELKANRAIPDQLVGIIRDMPKGVHPMQALRTAVSYLGLLDPQAEDITPEARRAISTRMIAQFSTIIAAINRAQEGQDIVAPRADLTHAGNFLYMLTGNEPTPEQARLFDIALVLHADHGMNASTFTAIATSSTLSDMYSCMVSAIGALKGPLHGGANEAVMTMLDEIGTVDKAEAYITGKLDNKEKIMGVGHRVYKYFDPRSRVLRDYAEHVANKEGKSNYYQILEAIEKIIVDRMGAKGIYPNVDFYSGTVYSDLGIKKEYFTPIFALARISGWCASVIEYSQDNRLLRPDAEYTGARDQHYVDIKDRQ

SEQ ID NO: 36926 - DNA, 1296 bp, Mycobacterium leprae TN
  CDS (1)..(1296): transl_table=11
gtggccgacaccgacgacaccgtcactctgaagtatccgggaggcgagatcgatctacagattgtccgtgccaccgaaggtaatgacggcattgcgatcgtcccggtattggccaagaccggttacactacgtttgatgtcggctacggtaacaccgcatccaccaagagttccatcacctacattgatggtgacgccgggattctgcgttaccgcggctatccgattgagcagctcgccgagaagtcgaccttcatagaggtttgctatctgctgatctatggggagttaccagccaccgatcagctggccgaattcacccatcggatccagcgccacaccatgttgcacgaggaccttaagcgattctatgatggcttcccgcgcaacgcgcacccgatgccggtgttgtccagcgtggtcaacgcattgagtgcttactatcaggatgcactggacccgatggacaacggccaagtagagctgtcgacgatccgactcttggccaagctgcccactatcgctgcctatgcatacaagaagtcggtaggccagccgttcctttacccggacaacgcgttttctctagtagagaacttccttcgaatgacttttggtttgccggctgagccctatgagcccgaccctgaggtggtccgggctctggacatgctgtttatcctgcatgctgaccacgagcaaaactgttcgacgtcaaccgtgcgtttggtgggctcgtcgcgagccaacctgttcacctcgatttcgggcggcattaacgcgctgtggggaccgctgcacggcggtgccaaccaggcggtgcttgagatgctcgaaggtatccgcgagagtggcgacgacgttggtggatttgtccaaaaagtaaagaattgccaggccggtgtgaaattgatgggctttggtcaccgcgtctacaagaactacgatccgcgggcccgcatcgtcaaggaacaggctgacaagatcctggtcaaacttggtggcgatgacgatttgctgaacattgccaagggactcgaggaggcggcgctaaccgatgactatttcatcgagcgcaagctttacccgaacgtcgacttctacaccggtctgatctaccgggccctcggttttccgacccggatgttcaccgtgttgtttgctttgggtcggctgccaggctggattgcgcactggcgtgagatgcacgacgagggtgacagtaagattggccgtccgcgccaaatatacaccggctacacagagcgtgactacaccgcaattgaaacacgatag

SEQ ID NO: 36927 - protein, 431 aa, Mycobacterium leprae TN
MADTDDTVTLKYPGGEIDLQIVRATEGNDGIAIVPVLAKTGYTTFDVGYGNTASTKSSITYIDGDAGILRYRGYPIEQLAEKSTFIEVCYLLIYGELPATDQLAEFTHRIQRHTMLHEDLKRFYDGFPRNAHPMPVLSSVVNALSAYYQDALDPMDNGQVELSTIRLLAKLPTIAAYAYKKSVGQPFLYPDNAFSLVENFLRMTFGLPAEPYEPDPEVVRALDMLFILHADHEQNCSTSTVRLVGSSRANLFTSISGGINALWGPLHGGANQAVLEMLEGIRESGDDVGGFVQKVKNCQAGVKLMGFGHRVYKNYDPRARIVKEQADKILVKLGGDDDLLNIAKGLEEAALTDDYFIERKLYPNVDFYTGLIYRALGFPTRMFTVLFALGRLPGWIAHWREMHDEGDSKIGRPRQIYTGYTERDYTAIETR

SEQ ID NO: 36928 - DNA, 1122 bp, Sulfolobus tokodaii str. 7
  CDS (1)..(1122): transl_table=11
atggagataaagaaaggtcttgaagacgtttatgttaaagaaacagagataacatatattgacggggaactaggtaggttatattatagaggttactccatatatgacttggctgaattctctaattttgaagaagtaagttacctaatattatatggtaaattaccaaatagagaagaattaaactggttccaggaaaagctaagggaagaaagatacttaccagattttataataaaatttctaagagaagtgagaaaagatgcccaaccaatggatatactaagaactgctgtgagcttacttggtattgaagattcaaaaaatgatgaacgaactgatataaagggcataaaattaatttcaaaattccctactattgtagctaattatgcaagattaagaaaagggctagatataattgagccagatcctaaactttcacactcggagaatttcttgtacatgctatatggagatagaccaaatgaaataaaatcaaaggctatggatgtcacattaatcttacatattgatcatgaaatgaacgcatcaacctttgcctcattagttgtagcctctactttttcagatttatattcttctatagtagctgggatatcagcattgaaagggcctttgcacggaggggcaaactatgaggcactaaaaatgtttaaggaaattggatctcccgaaaaagttaacgattatattctaaataggctttctaacaaacaaagaataatgggatttggacatcgtgtttataaaacttatgatccaagggcaagaatattaaaacagtatgctaaactattagctgaaaaagaaggaggagaaatatatactttatatcaaatagctgagaaagttgaagagattggaataaagtatttaggtcctaaaggtatatatcctaatgttgatttcttctccagtattgttttctactctttaggtttcgagccagacttctttccggcagtttttgcttcagccagagtagttggctgggttgctcatatcatggagtatataaaagataataagataattaggcctaaagcatactataaaggggaaataggaaagaaatatattccaattgatagtaggtaa

SEQ ID NO: 36929 - protein, 373 aa, Sulfolobus tokodaii str. 7
MEIKKGLEDVYVKETEITYIDGELGRLYYRGYSIYDLAEFSNFEEVSYLILYGKLPNREELNWFQEKLREERYLPDFIIKFLREVRKDAQPMDILRTAVSLLGIEDSKNDERTDIKGIKLISKFPTIVANYARLRKGLDIIEPDPKLSHSENFLYMLYGDRPNEIKSKAMDVTLILHIDHEMNASTFASLVVASTFSDLYSSIVAGISALKGPLHGGANYEALKMFKEIGSPEKVNDYILNRLSNKQRIMGFGHRVYKTYDPRARILKQYAKLLAEKEGGEIYTLYQIAEKVEEIGIKYLGPKGIYPNVDFFSSIVFYSLGFEPDFFPAVFASARVVGWVAHIMEYIKDNKIIRPKAYYKGEIGKKYIPIDSR

SEQ ID NO: 36930 - DNA, 1137 bp, Sulfolobus tokodaii str. 7
  CDS (1)..(1137): transl_table=11
atgagcgtagaagtaagtagaggattggaaaatgtaattataaaaactactggattaacttacattgatggcattaacggtatattaagatatagagggtacgatattaacgatttagttaattatgcttcatatgaggagctaatccatttaatgctttacggtgaattacctaacagacaacaattaaatcagattaaaggtataataaatgaaagttttgaagttccagaacaagttatatcaacgatattttcgatgcctagaaactgtgatgcaataggaatgatggaaacagcatttggcatattagcttcaatatatgatccaaaatggaacagagctactaataaagaattagctgttcaaattattgcaaaaactgcaacaattaccgcaaatatttatagggctaaagaagggttaaaaccaaagatcccagaaccatcagagagctatgctgaaagcttcttggctgcaacgtttggtaaaaagcctactcaagaagagataaaggctatggatgcttcactaattttatatacagatcacgaagttccagcctcaacaactgcagccttagtagcctcctcaaccctctcggatatgtactcatgtattgttgcagcattagctgcactaaagggtcctttgcatggtggtgcagctgaggaagctttcaaacagtttgtagaaataggttctgtcgaaaatgcagataaatggtttgaggaaaaaataataaaaggcaaaagtaggctcatgggattcgggcatcgtgtatataagacttatgatcctagggcaaaaatatttaagacattggctaaatcctttgctgaaaaaaatgaaaatgttaaaaagtattatgaaattgcagaaagaatagagaaattgggagttgacacattcggtagtaagcatatttatcctaatactgacttttacagtggtatagtattttatgctttaggcttcccaatatatatgttcacttcactgttcgctctatcaagagtattagggtggttagctcacataattgaatatgtagaggaacagcatagactcattagacctagagcactatacattggaccagaaaaaagagagtttaaacctatagagttaagataa

SEQ ID NO: 36931 - protein, 378 aa, Sulfolobus tokodaii str. 7
MSVEVSRGLENVIIKTTGLTYIDGINGILRYRGYDINDLVNYASYEELIHLMLYGELPNRQQLNQIKGIINESFEVPEQVISTIFSMPRNCDAIGMMETAFGILASIYDPKWNRATNKELAVQIIAKTATITANIYRAKEGLKPKIPEPSESYAESFLAATFGKKPTQEEIKAMDASLILYTDHEVPASTTAALVASSTLSDMYSCIVAALAALKGPLHGGAAEEAFKQFVEIGSVENADKWFEEKIIKGKSRLMGFGHRVYKTYDPRAKIFKTLAKSFAEKNENVKKYYEIAERIEKLGVDTFGSKHIYPNTDFYSGIVFYALGFPIYMFTSLFALSRVLGWLAHIIEYVEEQHRLIRPRALYIGPEKREFKPIELR

SEQ ID NO: 36932 - DNA, 1281 bp, Caulobacter crescentus CB15
  CDS (1)..(1281): transl_table=11
atgaccgataaagccacgctgacgatcggcgacaagagctatgagctgccgatcctcaagggcagcacgggtccggacgtcatcgacgttcggaagatctacggtgaaagcgatcacttcacgttcgatccaggcttcacctccaccgcctcgtgcgagagcaagatcacctatatcgacggcgacgcgggcatcctgctgcaccgcggctatccgatcgaccagctggccgagaagtcctcgttcctcgaggtctgctacctgctgctgaacggcgaactgcccaaggccgacgagttcgccaagttcgagcacaacatcacctaccacacgatgttgcacgctcagttcgaccgcttcttcgagggcttccgccgcgacgctcacccgatggcggtcatgaccggcgccgtcggcgctctgtcggccttctattcggacagcatcaatgtcgacgacgcccgtgagcgcgagatcagcgcccatcgcctgatcgcgaagatgccgacgatcgccgcccgcgcctacaagtacacggtcggccagccgttcgtgtcgccgcgcaacgacctgtcgtattcggaaaacttcctgcgcatgtgcttcgccgtgccggccgaggactggaagccgaacccggtgctgacccgcgccatggaccggatcttcatcctgcacgccgatcacgagcagaacgcctcgacctcgaccgtccgtctggccggttcgtcgggcgcgcacccgttcgcctgtatcgccgccggcatcgcctgcctgtggggcccgtcgcacggcggcgccaaccaggaagcgcttgagatgctggagaccatcggttcggtcgacaacatcaaggactacgtccagggcgtgaaggaccggaagtacaagctgatgggcttcggccaccgcgtgtacaagaacttcgacccgcgcgcgaaggtcatgcaaaagaccgcgcacgaggttctggccgagctgggccataacaacgatccgctgctgcaggtcgcccaggagctggaaaaggtcgccctgaacgacccgtacttcgtcgatcgcaagctgtacccgaacatcgatttctattcgggcatcaccctgcgcgcgatgggcttcccgaccaacatgttcaccgtgctgttcgccctggcccgcaccgtgggctggatcagccagtggaaggaaatgttcgaggaccccacccgcaagatcggtcgtccccgtcagctctacacgggcgccacgcatcgcgactacgtcacgctcgacaagcgctaa

SEQ ID NO: 36933 - protein, 426 aa, Caulobacter crescentus CB15
MTDKATLTIGDKSYELPILKGSTGPDVIDVRKIYGESDHFTFDPGFTSTASCESKITYIDGDAGILLHRGYPIDQLAEKSSFLEVCYLLLNGELPKADEFAKFEHNITYHTMLHAQFDRFFEGFRRDAHPMAVMTGAVGALSAFYSDSINVDDAREREISAHRLIAKMPTIAARAYKYTVGQPFVSPRNDLSYSENFLRMCFAVPAEDWKPNPVLTRAMDRIFILHADHEQNASTSTVRLAGSSGAHPFACIAAGIACLWGPSHGGANQEALEMLETIGSVDNIKDYVQGVKDRKYKLMGFGHRVYKNFDPRAKVMQKTAHEVLAELGHNNDPLLQVAQELEKVALNDPYFVDRKLYPNIDFYSGITLRAMGFPTNMFTVLFALARTVGWISQWKEMFEDPTRKIGRPRQLYTGATHRDYVTLDKR

SEQ ID NO: 36934 - DNA, 1137 bp, Nostoc sp. PCC 7120
  CDS (1)..(1137): transl_table=11
atgatggtgtgcgaatacaagcctggtttagaaggcattcccgccgcccaatcgagtatcagttatgtagatgggcaaaagggaatactagaatatcgtggcatccggattgaggatttagcccagcaaagtacttttctggagactgcttatcttttaatctggggtgagttgccaacaaaagaagaattgcaagtatttgaggaggaagtccgtcttcatcggcggattaaataccggattcgggatatgatgaagtgctttcccgaatctggtcatccaatggatgcactccaagcctctgcggcggctttaggcttgttttactcccgtcgagatttgcacaatcctgcctatattcgggatgctgtagtgcggctaatagctactattccgacgatggtagctgcattccagttgatgcggaaaggtaatgaccccgttaagccccgtgatgatttagattattccgccaattttctctacatgctcaacgagaaagaaccggatgctttggcggcaaaaatctttgatatctgcttgattctccatgtcgagcatacgatgaatgcttccacctttagtgctagggtaacagcttccaccttgactgacccgtatgcggtggttgctagcgctgtggggactttaggagggcctttacacggtggagccaatgaagaagtaatccagatgttggaagagattggttccgtggagaatgtgcgttcttatgtcgaggagaggttgcaacgtaaagacaagctcatgggctttggacatcgtgtctacaaagttaaagacccacgggcgacaattttgcaaggcctcgcagaacagttgtttgccaagttcggcgcagataagtattacgacatcgcccaagaaatggaacgggtagtcgaagagaaacttggtcataaagggatttatcccaatgttgacttctactctggtttagtgtatcggaagatgggtattcctacagacttgtttacaccaatctttgcgatcgctcgtgttgctggttggttagcccactggaaagaacaactcgaagagaaccgcattttccgtcctacccaggtttacaacggcaaacacagtgttacctacacccccattgaccaacgttaa

SEQ ID NO: 36935 - protein, 378 aa, Nostoc sp. PCC 7120
MMVCEYKPGLEGIPAAQSSISYVDGQKGILEYRGIRIEDLAQQSTFLETAYLLIWGELPTKEELQVFEEEVRLHRRIKYRIRDMMKCFPESGHPMDALQASAAALGLFYSRRDLHNPAYIRDAVVRLIATIPTMVAAFQLMRKGNDPVKPRDDLDYSANFLYMLNEKEPDALAAKIFDICLILHVEHTMNASTFSARVTASTLTDPYAVVASAVGTLGGPLHGGANEEVIQMLEEIGSVENVRSYVEERLQRKDKLMGFGHRVYKVKDPRATILQGLAEQLFAKFGADKYYDIAQEMERVVEEKLGHKGIYPNVDFYSGLVYRKMGIPTDLFTPIFAIARVAGWLAHWKEQLEENRIFRPTQVYNGKHSVTYTPIDQR

SEQ ID NO: 36936 - DNA, 1302 bp, Ralstonia solanacearum GMI1000
  CDS (1)..(1302): transl_table=11
atgacgccgtccgatgtgaaagccaccctatcgttttccgatggctcgcccagcgtcgagttgccgatctacacgggcacggttggcccggacgtgatcgacatccgcaagctgtacggccagacgggcaagttcacctacgaccccggcttcatgtcgaccgcgtcgtgcaactccaagatcacctatatcgatggcgacaagggcgagctgctctatcgcggctacgccatcgacgatctggcgggcaagtgcgacttcctggaaatctgctacctgctgctcaagggcgagctgcccaacgccaagcagaaggatgagttcaacagcaccgtcatgaaccacaccatggtgcatgagcagatgcagttcttcctgcgcggcttccgtcgcgatgcgcatccgatggccgtgctgaccggcctggtgggcgccatgagcgcgttctatccggatgccgccaacatcaacgattcgcgcgagcgcgagatctcgcagatccgcctgatcgccaagctgccgacactggtggcgatggcctacaagtacaacatcggccagccgctgatctacccgcagaacaacctgtcctacaccggcaacttcatgcgcatgatgttcgccacgccgtgcgaggactacaaggtcaacccggtgcttgagcgcgcgctcgaccgcatcttcatcctgcacgccgaccacgagcagaacgcctcgacctcgacggtgcgcctggctggctcctcgggcaccaacccgatcgccgccattgcagccggcatcgcctgcctgtggggcccggcgcacggcggcgcgaacgaagcggcgctgaacatgctggaagagatcggcagcgtcgacaagatcgatgagttcatcaagcaggtcaaggacaagaacagcggcgtgcgcctgatgggcttcggccaccgcgtgtacaagaactacgatccgcgcgccaagctgatgcgtgagacctgccatgaagtgctgcaggaactcggcctggagaacgatcgcctgttcaagctggccatggcgctcgagaagatcgcgctggaagacgaatacttcgtcagccgcaagctgtatccgaacgtcgatttctactcgggcatcgtgcagcgcgcgctgggcatcccgacctcgatgttcacctgcatcttcgcgctggcccgctcggtgggctggatcgcgcagtgggaagagatgatcaccgatccggaatacaagatcggccgtccgcgccagctgttcaacggcgccgccacccgcgcggtgcccgagctgggcaagcgctga

SEQ ID NO: 36937 - protein, 433 aa, Ralstonia solanacearum GMI1000
MTPSDVKATLSFSDGSPSVELPIYTGTVGPDVIDIRKLYGQTGKFTYDPGFMSTASCNSKITYIDGDKGELLYRGYAIDDLAGKCDFLEICYLLLKGELPNAKQKDEFNSTVMNHTMVHEQMQFFLRGFRRDAHPMAVLTGLVGAMSAFYPDAANINDSREREISQIRLIAKLPTLVAMAYKYNIGQPLIYPQNNLSYTGNFMRMMFATPCEDYKVNPVLERALDRIFILHADHEQNASTSTVRLAGSSGTNPIAAIAAGIACLWGPAHGGANEAALNMLEEIGSVDKIDEFIKQVKDKNSGVRLMGFGHRVYKNYDPRAKLMRETCHEVLQELGLENDRLFKLAMALEKIALEDEYFVSRKLYPNVDFYSGIVQRALGIPTSMFTCIFALARSVGWIAQWEEMITDPEYKIGRPRQLFNGAATRAVPELGKR

SEQ ID NO: 36938 - DNA, 1290 bp, Agrobacterium tumefaciens str. C58
  CDS (1)..(1290): transl_table=11
atgacggaaaaaagcgctacagtgacacttggcgaaaagcaggtggaactcccggtcagggaaggcacgattggaccaagcgtcgtcgatatcgccacgctctacaagcacacgggctccttcacctacgacccgggtttcacgtcgacggcctcctgcgaatccaagatcacctatatcgacggtgacgagggcgttctcctgcatcgtggtttccccatcgagcaactggctgaacagggcgacttcctcgaaacctgctatctgctgctctacggcgaactgccgacggctgcgcagaagaaggatttcgacacccgcgtcacgcgccacaccatggtgcatgagcagatgagccgcttcttcaccggctatcgtcgcgacgcacacccgatggccgtcatgtgcggcacggtcggcgctctctcggccttctatcacgactcgacggacatcaccgatccgcaccagcgcatggtcgcttcgctgcgcatgatcgcgaagatgccgacgatcgccgccatggcctacaagtaccatatcggccagcccttcgtttacccgaagaacgatctggattacgcctccaacttcctgcacatgtgctttgccgtgccgtgcgaggactacaaggtggacccggttctggcccgcgccatggatcgcatcttcatcctgcatgccgatcacgagcagaacgcctccacctccacggtgcgtcttgccggttcgtcgggtgcaaatccgttcgcctgtatcgcggctggcatcgcctgcctctggggtccggctcacggcggcgccaacgaagcggcgctcaacatgctgaacgagatcggctctgtcgaccgcatcccggaatatatcgcccgcgccaaggacaagaacgatccgttccgcctgatgggctttggccaccgcgtctacaaaaactacgacccgcgcgccaagatcatgcagaagacgatgtacgaagtgctggaagccaccggcaattccgacgatccgatcatgcaggtcgcgctcgaactggaaaagatcgccctttccgacccatacttcgtcgaaaagaagctctacccgaatgtcgacttctattcgggcatcacgctgaaggcgctcggcttccccaccaccatgttcaccgttctcttcgctctcgcccgcaccgtcggctggatcgcacagtggaacgaaatgatcgaagatccgcagcagcgcatcggccgtccgcgccagctctatacgggcgccggcaagcgcgattacgttccggtttccaagcgttaa

SEQ ID NO: 36939 - protein, 429 aa, Agrobacterium tumefaciens str. C58
MTEKSATVTLGEKQVELPVREGTIGPSVVDIATLYKHTGSFTYDPGFTSTASCESKITYIDGDEGVLLHRGFPIEQLAEQGDFLETCYLLLYGELPTAAQKKDFDTRVTRHTMVHEQMSRFFTGYRRDAHPMAVMCGTVGALSAFYHDSTDITDPHQRMVASLRMIAKMPTIAAMAYKYHIGQPFVYPKNDLDYASNFLHMCFAVPCEDYKVDPVLARAMDRIFILHADHEQNASTSTVRLAGSSGANPFACIAAGIACLWGPAHGGANEAALNMLNEIGSVDRIPEYIARAKDKNDPFRLMGFGHRVYKNYDPRAKIMQKTMYEVLEATGNSDDPIMQVALELEKIALSDPYFVEKKLYPNVDFYSGITLKALGFPTTMFTVLFALARTVGWIAQWNEMIEDPQQRIGRPRQLYTGAGKRDYVPVSKR

SEQ ID NO: 36940 - DNA, 1314 bp, Brucella melitensis 16M
  CDS (1)..(1314): transl_table=11
gtggacatgaaaggaaaaacgatgtcagataagacagccagctttaccctcgacggcaaaacgttcgatctgcctgtgcgaaaaggcactgtcgggccggatgtcgttgatattggtccactttacaagaattcccacgcattcacctacgaccctggcttcacttccaccgcttcgtgcgaatccaaaatcacctatatcgatggtgacgaaggcgtcctgctttatcgcggctacccgatcgaccagcttgccgagcatggcgacttcctcgaaacctgctatctgcttctttacggcgaactgccgaccgcaacccagaaggccgatttcgactatcgtgtaacccgccacaccatgctgcacgagcagatgacgaagttcttcaccggcttccgtcgtgatgcccacccgatggctgtcatggtgggttgcctgggcgccatgtccgccttctaccacgactcgaccgatatcaccgatccgcatcagcgcatggtcgcttcgatccgcctgatcgccaaggtgccgacgcttgcagccatggcctacaagtaccatatcggccagccgttcgtatatccgaagaacgacctcgatttcgcgtcgaacttcctgcacatgtgcttcaccgtgccttgcgaagagtacaaggtgaacccggttctggcgcgcgccatggaccgcattttcatcctgcatgctgatcacgaacagaatgcctccacctcgaccgtccgcctcgccggctcgtcgggtgcaaacccgtttgcctgcattgccgctggcgtggcctgcctctggggcccggctcatggcggcgccaatgaagctgcgctcaacatgctttcggaaatcggctcggttgaccgtatcccggaatatatcgccagggctaaagacaagaacgatccgttccgtttgatgggcttcggccatcgcgtttacaagaactacgatccgcgcgccaagatcatgcagaagacctgccatgaagtcctcggcgagctgggcatcaaggatgatccgctgcttgacgttgcaatggaactggaaaggattgccctgaccgacgaatatttcatcgaaaagaagctctacccgaacatcgacttctattcgggcatcacgctgaaggcgctgggcttcccgaccgaaatgttcaccgtcctgttcgcccttgcccgcaccgttggctgggtcgcccagtggaaggaaatgatcgaagatccgcagcagaaaatcggccgtccgcgccagctctacaccggcgcaaccgaacgcgattacgtgccgcttgcaaagcgcaagtaa

SEQ ID NO: 36941 - protein, 437 aa, Brucella melitensis 16M
MDMKGKTMSDKTASFTLDGKTFDLPVRKGTVGPDVVDIGPLYKNSHAFTYDPGFTSTASCESKITYIDGDEGVLLYRGYPIDQLAEHGDFLETCYLLLYGELPTATQKADFDYRVTRHTMLHEQMTKFFTGFRRDAHPMAVMVGCLGAMSAFYHDSTDITDPHQRMVASIRLIAKVPTLAAMAYKYHIGQPFVYPKNDLDFASNFLHMCFTVPCEEYKVNPVLARAMDRIFILHADHEQNASTSTVRLAGSSGANPFACIAAGVACLWGPAHGGANEAALNMLSEIGSVDRIPEYIARAKDKNDPFRLMGFGHRVYKNYDPRAKIMQKTCHEVLGELGIKDDPLLDVAMELERIALTDEYFIEKKLYPNIDFYSGITLKALGFPTEMFTVLFALARTVGWVAQWKEMIEDPQQKIGRPRQLYTGATERDYVPLAKRK

SEQ ID NO: 36942 - DNA, 1230 bp, Pyrobaculum aerophilum str. IM2
  CDS (1)..(1230): transl_table=11
atgagtgaacaaactgttcaggtaaaaactacgggtaaaattcttcagtctccctgtggtcccattattcacggtttagaagacgttttgataaaaagcacatcaataagcgatatagacggcgagaagggcattctttggtacagagggtataggatagaagagttggccaggctctctacttatgaagaggtctcgtacctcattctatatgggaggttgccgacgaagagggagcttgaagattacattaatagaatgaaaaaatacagagagctccacccggcgacagttgaggtaattagaaacctcgccaaggcccatcccatgtttgcgctagaggcggctgtggcggcggagggcgcgtacgatgaagacaaccagaaattaatagaggcgttatcagtaggcaggtataaagccgaggagaaggagcttgcgtatagaatagccgagaagcttgtggccaaaatgccgacaatagtggcgtatcactacagattctcgcgtggactagaggtagtaaggcctagagacgatttgggacacgcggcgaactttctctacatgatgttcggcagagagccagatccccttgcctcgagggggatagatctctacttaatactccacgcagatcacgaggtccccgccagcactttcgctgcccacgtcgttgcgtctacgctgagcgacctctactcctcagtagccgctgcaatagccgcacttaaaggcccgttgcacggcggggctaatgaaatggccgttaggaactacctcgaaataggcactccggctaaggccaaggagatagtagaggcggcgactaagccaggcgggccaaagttaatgggcgtcggccaccgcgtatataaggcatatgatccaagggccaagatatttaaagagttttcaagagattatgtagccaaattcggcgatccccaaaacttgtttgcaatcgccagcgccatagagcaagaagtactgagccacccctatttccaacagcggaagctatacccaaacgtcgacttctggtccggaatagcgttttattacatggggataccgtatgagtacttcaccccaatattcgccatgtctagagtagtgggctgggttgcgcacgtcttggagtactgggagaacaacaggatattcaggcctagggcttgctatattggcccccacgatttacaatacatcccgcttgaacagagataa

SEQ ID NO: 36943 - protein, 409 aa, Pyrobaculum aerophilum str. IM2
MSEQTVQVKTTGKILQSPCGPIIHGLEDVLIKSTSISDIDGEKGILWYRGYRIEELARLSTYEEVSYLILYGRLPTKRELEDYINRMKKYRELHPATVEVIRNLAKAHPMFALEAAVAAEGAYDEDNQKLIEALSVGRYKAEEKELAYRIAEKLVAKMPTIVAYHYRFSRGLEVVRPRDDLGHAANFLYMMFGREPDPLASRGIDLYLILHADHEVPASTFAAHVVASTLSDLYSSVAAAIAALKGPLHGGANEMAVRNYLEIGTPAKAKEIVEAATKPGGPKLMGVGHRVYKAYDPRAKIFKEFSRDYVAKFGDPQNLFAIASAIEQEVLSHPYFQQRKLYPNVDFWSGIAFYYMGIPYEYFTPIFAMSRVVGWVAHVLEYWENNRIFRPRACYIGPHDLQYIPLEQR

SEQ ID NO: 36944 - DNA, 1134 bp, Pyrococcus furiosus DSM 3638
  CDS (1)..(1134): transl_table=11
atgaatacggaaaaataccttgctaaaggtctagaagatgtctacatagatcaaacaaatatatgctatatcgatggaaaagagggaaagctatactacagaggatacagtgtagaagagctagcagagttaagcacgtttgaggaagtggtgtatctcctctggtggggaaaattaccatccctaagtgaactagagaatttcaaaaaagagctagcaaaaagtagaggccttccaaaagaagttatagaaataatggaagcactacctaaaaatactcacccaatgggcgctttaagaaccataatctcatatctaggaaacattgacgatagtggagacattccagtaacccctgaagaagtttacaggataggaattagtgtaactgcaaagataccaacaatagtagctaattggtatagaattaagaatggtctcgaatatgttcctccaaaagaaaaacttagtcatgcagcaaatttcctatacatgctccacggtgaagaaccccccaaagaatgggagaaagccatggatgtggccctaattctatatgctgaacatgaaattaacgcatcgactttagcagtaatgaccgttggctctactcttagcgactactattcagccatcctcgcgggaataggagctttaaagggcccaatccatggaggtgcagtagaggaggccataaaacagtttatggaaataggatctcccgagaaagtagaagaatggttctttaaggctcttcagcagaagagaaaaataatgggtgctggtcatagggtgtataaaacctatgatccaagggctagaatatttaaaaaatatgcctccaaattaggagataaaaagctcttcgagatagctgaaagattagagaggttagtagaagaatacctaagcaaaaaaggaattagtataaatgttgactactggtcaggattagttttctatggaatgaagattccaatagagctttacacaacaatatttgcaatgggtagaattgcgggatggactgctcatttagctgagtatgtttctcacaatagaattattagacccaggttgcagtatgtaggagaaataggaaagaagtacctacccatagaattaaggaggtag

SEQ ID NO: 36945 - protein, 377 aa, Pyrococcus furiosus DSM 3638
MNTEKYLAKGLEDVYIDQTNICYIDGKEGKLYYRGYSVEELAELSTFEEVVYLLWWGKLPSLSELENFKKELAKSRGLPKEVIEIMEALPKNTHPMGALRTIISYLGNIDDSGDIPVTPEEVYRIGISVTAKIPTIVANWYRIKNGLEYVPPKEKLSHAANFLYMLHGEEPPKEWEKAMDVALILYAEHEINASTLAVMTVGSTLSDYYSAILAGIGALKGPIHGGAVEEAIKQFMEIGSPEKVEEWFFKALQQKRKIMGAGHRVYKTYDPRARIFKKYASKLGDKKLFEIAERLERLVEEYLSKKGISINVDYWSGLVFYGMKIPIELYTTIFAMGRIAGWTAHLAEYVSHNRIIRPRLQYVGEIGKKYLPIELRR

SEQ ID NO: 36946 - DNA, 1290 bp, Streptomyces coelicolor A3(2)
  CDS (1)..(1290): transl_table=11
gtgagcgacaactctgtagtactgcggtacggcgacggcgagtacacctacccggtgatcgacagcaccgtcggtgacaagggcttcgacatcgggaagctccgcgcccagaccggtctggtgacgctggacagcggttacggcaacaccgccgcctacaaatccgccattacctatctggacggcgaagccggcatcctccggtaccgcggctacccgatcgagcagctggccgagcgctcctccttcgtggaggtggcctacctgctgatcaacggcgagctgccgacggtcgacgagctgtccgcgttcaagggcgagatcacgcagcacaccctgctgcacgaggacgtcaagaacttctacaagggcttcccgcgcgacgcccacccgatggccatgctgtcgtcggtggtctcggcgctgtccaccttctaccaggacagccacaacccgttcgacgagcggcagcgcaacctctccacgatccggctgctcgcgaagcttccgacgatcgcggcgtacgcgtacaagaagtcgatcggccacccgttcgtctacccggccaacaacctcggctacgtcgagaacttcctgcgcatgaccttctcggttccggcgcaggagtacgagctggacccgacggtcgtcgcggccctcgacaagctgctgatcctgcacgcggaccacgagcagaactgctcgacctccacggtgcgcctggtcggctcctcgcaggcgaacatgttcgcctcgatctccgccggcatcaacgccctgtggggcccgctgcacggcggcgccaaccagtcggtgctggagatgctggaaggcatccgcgacgcgggcggcgacgtcgactccttcatccgcaaggtgaagaacaaggaggacggcgtccgcctgatgggcttcggccaccgggtctacaagaacttcgacccgcgcgccaagatcatcaaggccgccgcgcacgacgtgctctccgcgctcggcaagtccgacgagctgctggacatcgcgctgaagctggaggagcacgcgctctccgacgactacttcgtctcgcgcagcctctacccgaacgtcgacttctacaccggtctgatctaccgggccatgggcttcccgaccgagatgttcacggtcctgttcgccctcggccggctgccgggctggatcgcccagtggcacgagatgatcaaggagccgggttcccgcatcggccgcccgcgccagatctacacgggcgtcgtcgagcgcgacttcgtccccgtcgaggagcgctga

SEQ ID NO: 36947 - protein, 429 aa, Streptomyces coelicolor A3(2)
MSDNSVVLRYGDGEYTYPVIDSTVGDKGFDIGKLRAQTGLVTLDSGYGNTAAYKSAITYLDGEAGILRYRGYPIEQLAERSSFVEVAYLLINGELPTVDELSAFKGEITQHTLLHEDVKNFYKGFPRDAHPMAMLSSVVSALSTFYQDSHNPFDERQRNLSTIRLLAKLPTIAAYAYKKSIGHPFVYPANNLGYVENFLRMTFSVPAQEYELDPTVVAALDKLLILHADHEQNCSTSTVRLVGSSQANMFASISAGINALWGPLHGGANQSVLEMLEGIRDAGGDVDSFIRKVKNKEDGVRLMGFGHRVYKNFDPRAKIIKAAAHDVLSALGKSDELLDIALKLEEHALSDDYFVSRSLYPNVDFYTGLIYRAMGFPTEMFTVLFALGRLPGWIAQWHEMIKEPGSRIGRPRQIYTGVVERDFVPVEER

SEQ ID NO: 36948 - DNA, 1290 bp, Xanthomonas axonopodis pv. citri str. 306
  CDS (1)..(1290): transl_table=11
gtgtccgatcttgatcaggtcacgctcaacgccggcgacaagtcggtcgttctgccggttctcaagcccacgcttggcaatgattgcgtcgatatctccaagctgaccaaagaaaccggtctgttcacctacgattcgggcttcaccgccaccgccagctgcaagtcggccatcacctacatcgatggcgacaatggcgtgttgctgtatcgcggctacccgatcgaacagctggccgaaaagtccagcttcctcgaggtctcgtacctgctgatgaacggcgaactgccgacggcggacgaattcaagaagttcgaccacgaagtgacgcatcacaccatgatgcacgagtcgctgaagaacttcctcggtggtttccgtcatgacgcacacccgatggccatgctggccggctcggtcgcctcgctgtctgcgttctaccatgacaccctggacctcaacgatccggagcagcgtcgtcaggccgccatccgtctgatcgccaaggtgccgaccctggcggctgccgcgtaccgttattcgatcggctggccgatccgctacccgcgcaacaacctgaactacgtcgatcgcttcctgcacatgatgttcgaagtgccgagcgagccgctggagatcaatccggtcgttgccaaggccctggatctgctgttcatcctgcacgccgaccacgagcagaacgcctcgacctcgaccgtgcgtctggtcggttcgaccggtgccaacccgtacgcctcggtcgcagcgggcatcaccgcgctgtggggcccggcacatggtggcgccaacgaagccgtgctgaagatgttggaagagatcggcaccgccgacaacgtcgaatccgccgtggccaaggccaaggacaagaattcctcgttccgtctgatgggcttcggtcaccgcgtctacaagaacttcgacccgcgcgccaagatcatccgtgagatgacccacaaggtgctgggcgagctgggcgtcaacgacccgctgctggaagtggcgctgaagctggaagaggccgcgctgaaggacgactacttcgtgcagcgcaagctgtacccgaacgtcgacttctactcgggcatcatctacaaggcgctcaatatcccggtggaaatgttcaccgtgatgttcgccatcgcacgcaccgcaggctgggtgtcgcattggctggaacagcaggtcgacccggaaatgaagatcggccgtccgcgccagatctacaccggctacgacaagcgcgattacaccgacagcgccaagcgctga

SEQ ID NO: 36949 - protein, 429 aa, Xanthomonas axonopodis pv. citri str. 306
MSDLDQVTLNAGDKSVVLPVLKPTLGNDCVDISKLTKETGLFTYDSGFTATASCKSAITYIDGDNGVLLYRGYPIEQLAEKSSFLEVSYLLMNGELPTADEFKKFDHEVTHHTMMHESLKNFLGGFRHDAHPMAMLAGSVASLSAFYHDTLDLNDPEQRRQAAIRLIAKVPTLAAAAYRYSIGWPIRYPRNNLNYVDRFLHMMFEVPSEPLEINPVVAKALDLLFILHADHEQNASTSTVRLVGSTGANPYASVAAGITALWGPAHGGANEAVLKMLEEIGTADNVESAVAKAKDKNSSFRLMGFGHRVYKNFDPRAKIIREMTHKVLGELGVNDPLLEVALKLEEAALKDDYFVQRKLYPNVDFYSGIIYKALNIPVEMFTVMFAIARTAGWVSHWLEQQVDPEMKIGRPRQIYTGYDKRDYTDSAKR

SEQ ID NO: 36950 - DNA, 1149 bp, Thermosynechococcus elongatus BP-1
  CDS (1)..(1149): transl_table=11
atggttgcttgcgaatttagccccggtcttgacggtattcccgttgctcaatcggccattagctatgtggatggccaagcaggcattctggagtatcgcggtgtcccgattcaggaactagcggagaaaagcacgtttttggaaactgccttcctcttgatttggggctactggccaaacagggaggagttagcagcctttgagcacgatattacctaccatcgccgcgttaaatatcgcattcgcgatatgatgaaatgctttcccgaaagtggccaccccatggatgccctgcaggcctcggcgggagccttgggattgttctattcacggcgggcactcgaggatccagagtacattcgggcagcggtgattcgcctcttggcaaaaattccaacgatggtggcggcctttcaactgatccgcaagggaaatgacccagtcatgccctgtgatgaactggactatgcggccaattttctctatatgctcaatgagcggcggccggatccatttgcagcgcgagtatttgatatttgcttgattctccacgcggagcacacgatgaatgcctcaaccttctcggcgcgggtgacggcctcgacgttgacagacccctacgccgtggttgcttcagcggtgggtacgctggcagggccactccacgggggcgccaatgaagatgtgatcaatatgcttgaagaaatcggcagtgtcgagaatgtccgtccctatgtggaaaagtgtatccagaacaagatcaaaattgctgggtttggccatcgtgtgtataaggtcaaggatccgcgcgccacgattttacagaagttggcggagcagttgtttgataagtttggcggcgatcgctactacgacattgccctgaaactggaggaagtggtgggcgaatacctcagttacaaggggatttaccccaatgtagacttttactctggtcttgtctaccggcggttgggaattcccagtgatttgtttacgccggtgtttgcgatcgcccgcgtggccggttggctagcccactggaaggaacaactggaggccaatcgcatttatcgtcccacccaagtctatacgggtgcccacaatcagccctatgtgcccatggaggaacgcaatcatcgcccctaa

SEQ ID NO: 36951 - protein, 382 aa, Thermosynechococcus elongatus BP-1
MVACEFSPGLDGIPVAQSAISYVDGQAGILEYRGVPIQELAEKSTFLETAFLLIWGYWPNREELAAFEHDITYHRRVKYRIRDMMKCFPESGHPMDALQASAGALGLFYSRRALEDPEYIRAAVIRLLAKIPTMVAAFQLIRKGNDPVMPCDELDYAANFLYMLNERRPDPFAARVFDICLILHAEHTMNASTFSARVTASTLTDPYAVVASAVGTLAGPLHGGANEDVINMLEEIGSVENVRPYVEKCIQNKIKIAGFGHRVYKVKDPRATILQKLAEQLFDKFGGDRYYDIALKLEEVVGEYLSYKGIYPNVDFYSGLVYRRLGIPSDLFTPVFAIARVAGWLAHWKEQLEANRIYRPTQVYTGAHNQPYVPMEERNHRP

SEQ ID NO: 36952 - DNA, 1293 bp, Bifidobacterium longum NCC2705
  CDS (1)..(1293): transl_table=11
atggcaacggcacaacttgatgtcgattcgaacaagttcaacctgcccgtggttaaggctagtgcagggccggatggcatcgtcgtttccaaactgcgcaacgatggctgggtaacgcttgatcccggattcctcaccaccgcgcagtgcgaatcgaaaatcacctacatcgacggcaagcattcgattttgcgctactgcggttaccccatcgagcaactgtgcgagaactccgattttctggaggtggcgtggctgctgcgccacggcgagctgccgagcagggctgagtatgagcagttctgtgcggacatcaatcacaagacgatggttggcgaagacttccgtaccttcatgggttcgttcccgcgctccgctcacccgatgagcgtgcttgcctccgccatcaatgcgctggccacgttctacccggacaccaccgatatttctgacaacgaccagcttgatgaggccgccaagatcatcatggccaaggcccgtacgattgtgtcgtacatcttccgccgtcgtcgcgatgagccgatgctgtaccccgattacgcgcgcggctatgtggacgacttcctgcgcatgtgcttcgctgtgccgtacgagccgtttgaatccgacccgctgtatgtgcatgctttgggtcgtttgttgattattcatgccgaccatgagcagaactgctcgacctcggtggtgcgtatcgccggttccgcccacgccaacctgtattcggcggtggccgctggcgtcaatgcgctgtccggtccgttgcatggtggtgcgaatgaggccgtactgcgccaattgaaggcgattcgtgattccggcaagtctgtggccgagttcgtgcgtgatgccaaggagaatggccagaagatttccggccttggccaccgtgtatacaagtcgtatgatccgcgcgcggcgattgccaggaagtatctggaaaagatcatggagcgcgaagatacgcagaagctgccgtctgacgagcgcgcgctgttcgccgtggccaccgagcttgaagatattgcgctgaatgacgaatatttcgtatcgcgcaacctgtatccgaacgtcgacttctacacgggcttgatttatcgggcgatcggcttcgatccggccatgttcaccacgctgttcgcgctgggccgcattcccggttggattgcgcagtaccgtgagatgttggccgacccgaataccaagatcggccgcccacgccaggtctacaccggtccggtcgagcgcgatttcgtgccgatggacgagcggtga

SEQ ID NO: 36953 - protein, 430 aa, Bifidobacterium longum NCC2705
MATAQLDVDSNKFNLPVVKASAGPDGIVVSKLRNDGWVTLDPGFLTTAQCESKITYIDGKHSILRYCGYPIEQLCENSDFLEVAWLLRHGELPSRAEYEQFCADINHKTMVGEDFRTFMGSFPRSAHPMSVLASAINALATFYPDTTDISDNDQLDEAAKIIMAKARTIVSYIFRRRRDEPMLYPDYARGYVDDFLRMCFAVPYEPFESDPLYVHALGRLLIIHADHEQNCSTSVVRIAGSAHANLYSAVAAGVNALSGPLHGGANEAVLRQLKAIRDSGKSVAEFVRDAKENGQKISGLGHRVYKSYDPRAAIARKYLEKIMEREDTQKLPSDERALFAVATELEDIALNDEYFVSRNLYPNVDFYTGLIYRAIGFDPAMFTTLFALGRIPGWIAQYREMLADPNTKIGRPRQVYTGPVERDFVPMDER

SEQ ID NO: 36954 - DNA, 1293 bp, Brucella suis 1330
  CDS (1)..(1293): transl_table=11
atgtcagataagacagccagctttaccctcgacggcaaaacgttcgatctgcctgtgcgaaaaggcactgtcgggccggatgtcgttgatattggtccactttacaagaattcccacgcattcacctacgaccctggcttcacttccaccgcttcgtgcgaatccaaaatcacctatatcgatggtgacgaaggcgtcctgctttatcgcggctacccgatcgaccagcttgccgagcatggcgacttcctcgaaacctgctatctgcttctttacggcgaactgccgaccgcaacccagaaggccgatttcgactatcgtgtaacccgccacaccatgctgcacgagcagatgacgaagttcttcaccggcttccgtcgtgatgcccacccgatggctgtcatggtgggttgcctgggcgccatgtccgccttctaccacgactcgaccgatatcaccgatccgcatcagcgcatggtcgcttcgatccgcctgatcgccaaggtgccgacgcttgcagccatggcctacaagtaccatatcggccagccgttcgtatatccgaagaacgacctcgatttcgcgtcgaacttcctgcacatgtgcttcaccgtgccttgcgaagagtacaaggtgaacccggttctggcgcgcgccatggaccgcattttcatcctgcatgctgatcacgaacagaatgcctccacctcgaccgtccgcctcgccggctcgtcgggtgcaaacccgtttgcctgcattgccgctggcgtggcctgcctctggggcccggctcatggcggcgccaatgaagctgcgctcaacatgctttcggaaatcggctcggttgaccgtatcccggaatatatcgccagggctaaagacaagaacgatccgttccgtttgatgggcttcggccatcgcgtttacaagaactacgatccgcgcgccaagatcatgcagaagacctgccatgaagtcctcggcgagctgggcatcaaggatgatccgctgcttgacgttgcaatggaactggaaaggattgccctgaccgacgaatatttcatcgaaaagaagctctacccgaacatcgacttctattcgggcatcacgctgaaggcgctgggcttcccgaccgaaatgttcaccgtcctgttcgcccttgcccgcaccgttggctgggtcgcccagtggaaggaaatgatcgaagatccgcagcagaaaatcggccgtccgcgccagctctacaccggcgcaaccgaacgcgattacgtgccgcttgcaaagcgcaagtaa

SEQ ID NO: 36955 - protein, 430 aa, Brucella suis 1330
MSDKTASFTLDGKTFDLPVRKGTVGPDVVDIGPLYKNSHAFTYDPGFTSTASCESKITYIDGDEGVLLYRGYPIDQLAEHGDFLETCYLLLYGELPTATQKADFDYRVTRHTMLHEQMTKFFTGFRRDAHPMAVMVGCLGAMSAFYHDSTDITDPHQRMVASIRLIAKVPTLAAMAYKYHIGQPFVYPKNDLDFASNFLHMCFTVPCEEYKVNPVLARAMDRIFILHADHEQNASTSTVRLAGSSGANPFACIAAGVACLWGPAHGGANEAALNMLSEIGSVDRIPEYIARAKDKNDPFRLMGFGHRVYKNYDPRAKIMQKTCHEVLGELGIKDDPLLDVAMELERIALTDEYFIEKKLYPNIDFYSGITLKALGFPTEMFTVLFALARTVGWVAQWKEMIEDPQQKIGRPRQLYTGATERDYVPLAKRK

SEQ ID NO: 36956 - DNA, 1413 bp, Corynebacterium efficiens YS-314
  CDS (1)..(1413): transl_table=11
ttggagacttttgtgtcgcgcaacaacattctggctgcacgtgatgcgtccgacctggttattgaatctggtgacctcccgcaacccgggggaaccgacaaaaagtttgaaagggaaatcgtggcttctgataacaacaaggctgtactgcactaccctggcggcgaattcgagatgggcatcaagcaggccaccgagggtaactccggtgtcatcctgggtaagatgctgtcggaaaccggtctggtcaccttcgaccccggttatgtcagcaccggttccaccgaatccaagatcacctacatcgatggtgatgcaggcatcctgcgctaccgcggctacgacattgcggatctggccgaaaatgccaccttcaatgaggtctcctacctcctgatcaagggtgagctcccgaccccggaagagctccacaagttcaacgacgagattcgtcaccacaccctgctggacgaggacttcaagtcccagttcaatgtcttccctcgcgatgcccacccgatggccaccctggcctcctcggttaacatcctctccacctactaccaggatcagctggatcccctggatgaggctcagctggacaaggcaaccgtccgcctgatggcgaaggttccgatgctggctgcatacgcacaccgtgcccgcaagggtgcgccgtacatgtacccggacaactccctcaatgcccgtgagaacttcctgcgcatgatgttcggttacccgaccgagccgtacgaggttgatccgatcatggtcaaggccctcgacaagctgctcatcctgcacgcagaccacgagcagaactgctccacctccactgtccgcatgatcggctccgcgcaggcgaacatgttcgtctccatcgccggcggcatcaacgcactctccggcccgctgcacggtggcgccaaccaggctgtcctcgagatgctcgaggagatcgcagccaacggcggcgacgcaaccgacttcatgaaccgcgtgaagaacaaggagaagggtgtccgcctcatgggcttcggacaccgcgtctacaagaactacgatccgcgtgcagccatcgtcaaggacaccgcccacgagatcctcgagcacctcggtggcgacccactgctggatctggctctcaagctggaggagatcgccctcaacgacgattacttcatctcccgcaagctgtacccgaacgtggacttctacaccggcctgatctaccgcgccatgggcttcccgacggacttcttcaccgtcctgttcgccatcggccgcctcccgggctggatcgcccactaccgcgagcagctcgccgatccgggcgccaagatcaaccgtcctcgccagatctacaccggtgagaccgcacgcaagatcatcccccgcgaagagcgctag

SEQ ID NO: 36957 - protein, 470 aa, Corynebacterium efficiens YS-314
METFVSRNNILAARDASDLVIESGDLPQPGGTDKKFEREIVASDNNKAVLHYPGGEFEMGIKQATEGNSGVILGKMLSETGLVTFDPGYVSTGSTESKITYIDGDAGILRYRGYDIADLAENATFNEVSYLLIKGELPTPEELHKFNDEIRHHTLLDEDFKSQFNVFPRDAHPMATLASSVNILSTYYQDQLDPLDEAQLDKATVRLMAKVPMLAAYAHRARKGAPYMYPDNSLNARENFLRMMFGYPTEPYEVDPIMVKALDKLLILHADHEQNCSTSTVRMIGSAQANMFVSIAGGINALSGPLHGGANQAVLEMLEEIAANGGDATDFMNRVKNKEKGVRLMGFGHRVYKNYDPRAAIVKDTAHEILEHLGGDPLLDLALKLEEIALNDDYFISRKLYPNVDFYTGLIYRAMGFPTDFFTVLFAIGRLPGWIAHYREQLADPGAKINRPRQIYTGETARKIIPREER

SEQ ID NO: 36958 - DNA, 1290 bp, Xylella fastidiosa Temecula1
  CDS (1)..(1290): transl_table=11
atgtccgatcttgataaggtcacgctcaatgctggtgagacttctctcgttttaccggttttgaaacccacgttaggtaatggttgcgttgatattgccaagttgacaaaggaaaccgggctgtttacttacgactctggttttacggcaactgcaagctgtaagtctgccatcacttacattgatggtgaaaagggtgtgttgttgtaccgcggctatccgattgagcagttagccgagcactccagttttttggaggtcgcttatttgttgatgaacggtgagttaccgagaaaagacgagtttgccaagtttgatgatgaaattacgcatcacacgatgatgcatgagtcgttgaagaactttcttggcggttttcattatgatgcacatccaatggctatgttggctgcttcggtggcttcgctgtcggcgttctaccacgatacccttgatttgaacgatcttgagcaacgtcgcttagctgcaattcgtttgatcgctaaggtgccgacgcttgcagcggcagcgcatcgctactcgattggctggccgatccgttatccacgaaacaatcttggttatgtcgagcgctttttgcatatgatgtttgaagtgcctagtgaaccgctgcagttgaatccagtcgtgatcaaagctctggatttactgtttattttgcatgctgatcatgagcagaacgcttcgacatcaacagtccgtttggtgggttcgactggcgctaatccttatgcatcggttgccgcgggtatcaccgcgttgtggggaccggcacacggcggcgctaatgaggccgtgttaaagatgttggaggagattggtgatgctaagaatgttgacttggttattgcaaaagcgaaaaccaaggacaaaaactctccattccgtttgatgggtttcggccatcgtgtctataaacattttgatccacgtgcgaaaatcatccgtgagatggcacacacagttcttggtgagttaggtgtgaacgatccgctactggaagtagcattaaagttggaagaggcagcgctgaaggatgattactttgtgcagcgtaagttgtaccctaacgttgatttttattcgggcatcatctacaaagccatcaacattcctttggaaatgtttacagtgatgtttgccatcgcgcgtaccgcagggtgggtttctcattggcttgagcagcaagtcgacccggagatgaaaatcagcaggccgcgccaaatttacacaggtcatcgcgagcgtgactacaaagatgctaggtaa

SEQ ID NO: 36959 - protein, 429 aa, Xylella fastidiosa Temecula1
MSDLDKVTLNAGETSLVLPVLKPTLGNGCVDIAKLTKETGLFTYDSGFTATASCKSAITYIDGEKGVLLYRGYPIEQLAEHSSFLEVAYLLMNGELPRKDEFAKFDDEITHHTMMHESLKNFLGGFHYDAHPMAMLAASVASLSAFYHDTLDLNDLEQRRLAAIRLIAKVPTLAAAAHRYSIGWPIRYPRNNLGYVERFLHMMFEVPSEPLQLNPVVIKALDLLFILHADHEQNASTSTVRLVGSTGANPYASVAAGITALWGPAHGGANEAVLKMLEEIGDAKNVDLVIAKAKTKDKNSPFRLMGFGHRVYKHFDPRAKIIREMAHTVLGELGVNDPLLEVALKLEEAALKDDYFVQRKLYPNVDFYSGIIYKAINIPLEMFTVMFAIARTAGWVSHWLEQQVDPEMKISRPRQIYTGHRERDYKDAR

SEQ ID NO: 36960 - DNA, 1290 bp, Pseudomonas syringae pv. tomato str. DC3000
  CDS (1)..(1290): transl_table=11
atggctgacaaaaaagcgcagttgatcatcgagggcgctgcccccgtcgagctgccaatactgaccggtacagtgggtccggacgtgatcgacgtacgcggtctgaccgccaccggccgcttcacatttgaccctggcttcatgtccacggcctcttgcgagtcgaagatcacctacattgatggtgacaacggaattctgctgcaccgcggctacccgatcgaacaactggccgagcagtccgattacctcgagacctgctacctgttgctcaacggcgagctgccaaccgccgaacagaaagcccagttcgtggccgtggtcaagaaccacacgatggttcacgaacaactcaagaccttcttcaacggctttcgccgtgacgcccacccgatggccgtcatgtgcggtgtagtcggcgccctgtcggcgttctaccacgattcgctggacatcaataacccgcagcaccgcgaaatttcggctgtacgcctggtcgccaagatgccgaccctggcagcgatggtctacaagtactccatgggccaacccatgatgtacccgcgcaacgacctcagctacgccgaaaacttcctgcacatgatgttcaacacgccgtgcgagatcaaaccgatcagcccggtgctggccaaggcgatggacaagatcttcatccttcacgccgatcacgagcagaacgcgtcgacctctaccgtgcgcatggcgggctcctcgggtgccaacccgttcgcctgtatcgcagccggtatcgcggcactctggggcccggctcacggcggcgccaacgaagccgtgctgaccatgctcgatgaaatcggcgacgtgtcgaacatcgacacattcatagccaaagccaaggacaagaacgatccgttcaagctcatgggcttcggtcaccgggtctacaagaaccgtgaccctcgcgcgaccgtgatgaagcagacctgcgacgaagtactcaaggaactgggcatcaaaaacgatcctcagctcgagctggccatgcgtcttgaagagatcgccctgaccgacccgtacttcatcgagcgctcgctgtacccgaacgttgacttctactcgggcatcatcctcaaggctatcggcatcccgaccagcatgttcaccgtgatcttcgccctggcgcggaccgttggctggatctcgcactggaaagaaatgctctccagcccttacaagatcggtcgcccgcgccagctctacaccggcaacgtgcaacgcgacattattgcactgaaagaccgcaagtaa

SEQ ID NO: 36961 - protein, 429 aa, Pseudomonas syringae pv. tomato str. DC3000
MADKKAQLIIEGAAPVELPILTGTVGPDVIDVRGLTATGRFTFDPGFMSTASCESKITYIDGDNGILLHRGYPIEQLAEQSDYLETCYLLLNGELPTAEQKAQFVAVVKNHTMVHEQLKTFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDKIFILHADHEQNASTSTVRMAGSSGANPFACIAAGIAALWGPAHGGANEAVLTMLDEIGDVSNIDTFIAKAKDKNDPFKLMGFGHRVYKNRDPRATVMKQTCDEVLKELGIKNDPQLELAMRLEEIALTDPYFIERSLYPNVDFYSGIILKAIGIPTSMFTVIFALARTVGWISHWKEMLSSPYKIGRPRQLYTGNVQRDIIALKDRK

SEQ ID NO: 36962 - DNA, 1290 bp, Vibrio parahaemolyticus RIMD 2210633
  CDS (1)..(1290): transl_table=11
atggcggataagaaagcgacccttcatgttgaaggtcaagcgccaatcgaactgccaattatggacggtacgctaggtacacctgtaattgacgttcgtaaactgggagccaatggttactttacttttgacccaggttttcttgccactgcatcttgtgaatcatcaatcacttacatcgatggcggcaaaggtattcttttgcaccgcggttacccgattgatcaattagccaataacgcagattacctagaagtatgttacatccttctttacggtgaagcccctacccgagaacaatacgagcaattcaaaacgacagttactcgtcacacaatggtacacgagcaaatcgcaagcttcttccatggcttccgtcgtgatgctcacccaatggcagtaatgtgtggtgtggttggtgctcttgcagccttctaccacgattcacttgatatcaataacgacgagcaccgcgaaattgcggcttatcgtctgctatctaaaatgccaactctggctgcaatgtgtttcaaatactctgttggtcagccatttatctacccacgcaacgatttgagctacgcggaaaacttcctacacatgatgtttgctaacccatgtgaagagtatgaagtgaaccctgttgttgctcgtgcgatggataaaatcttcacacttcacgcagatcacgagcaaaacgcgtcgacatcaacagtccgtttagcaggttcttctggtgcaaacccattcgcatgtattgccgctggtatcgcatcactttggggcccagctcacggtggcgcaaacgaagcatgtctgaagatgctagaagaaatcggcagcgtggataacattccagaatacgtggaacgtgcgaaagacaaagatgacccattccgtttgatgggcttcggtcaccgtgtttacaagaactacgatcctcgtgcgaccgtaatgcgcgaaacatgtcacgaagttctaaaagagctcaacattaaagatcctctgctggacgtagcaatggaacttgagcgtatcgctctttctgacgagtactttgtttctaagaagctatacccgaacgtagatttctattcaggtatcattctgaaagcgatcggtattcctgtatcaatgtttacggttatcttcgcgatttctcgtactattggttggattgcccactggaacgagatgcacagcgacccactaaaccgtatcggtcgtccacgtcagctttacaaaggcgaaacgcaacgtgaattttcgccgcttcatgagcgcgaataa

SEQ ID NO: 36963 - protein, 429 aa, Vibrio parahaemolyticus RIMD 2210633
MADKKATLHVEGQAPIELPIMDGTLGTPVIDVRKLGANGYFTFDPGFLATASCESSITYIDGGKGILLHRGYPIDQLANNADYLEVCYILLYGEAPTREQYEQFKTTVTRHTMVHEQIASFFHGFRRDAHPMAVMCGVVGALAAFYHDSLDINNDEHREIAAYRLLSKMPTLAAMCFKYSVGQPFIYPRNDLSYAENFLHMMFANPCEEYEVNPVVARAMDKIFTLHADHEQNASTSTVRLAGSSGANPFACIAAGIASLWGPAHGGANEACLKMLEEIGSVDNIPEYVERAKDKDDPFRLMGFGHRVYKNYDPRATVMRETCHEVLKELNIKDPLLDVAMELERIALSDEYFVSKKLYPNVDFYSGIILKAIGIPVSMFTVIFAISRTIGWIAHWNEMHSDPLNRIGRPRQLYKGETQREFSPLHERE

SEQ ID NO: 36964 - DNA, 1290 bp, Streptomyces avermitilis MA-4680
  CDS (1)..(1290): transl_table=11
gtgagcgacaactctgtagtactgcggtacggcgatggcgagtacacctacccggtgatcgacagcaccgtcggcgacaagggcttcgacatcgggaagctccgcgctcagaccggtctggtgactctggacagtgggtacggcaacactgccgcctataaatccgcgatcacctatctcgacggtgagcagggcatcctccggtaccgcggctacccgatcgagcagctggccgagcgctccaccttcctggaggtggcgtacctgctgatcaacggcgagctgccgaccgtcgacgagctctccacgttcaagggcgagatcacgcagcacaccctgctgcacgaggacgtcaagaacttctaccgcggcttcccgcgtgacgcccacccgatggcgatgctgtcctcggtggtctccgcgctgtcgacgttctaccaggacagccacaacccgttcgacgagaagcagcgcaatctctccacgatccgccttctcgccaagcttccgacgatcgcggcgtacgcctacaagaagtcgatcggtcaccccttcgtctacccgcgcaacgacctcgggtacgtcgagaacttcctgcgcatgaccttctcggtcccggcgcaggactacgacctggacccggtcgtcgtctccgcgctcgacaagctgctgattctgcacgcggaccacgagcagaactgttcgacctccaccgtgcgtctggtcggctcgtcgcaggcgaacatgttcgcgtcgatctccgccggcatctccgccctctggggcccgctgcacggtggcgccaaccagtccgtcctggagatgctcgagggcatccagacgagcggtggcgacgtcgacaccttcatccgcaaggtgaagaacaaggaagacggcgtgaagctcatgggcttcgggcaccgcgtctacaagaacttcgacccccgcgcgaagatcatcaaggcggcggcgcacgacgtcctctcggcgctcggcaagtccgacgagctgctggacatcgcgctgaagctggaggagcacgcgctggccgacgactacttcgtcgagcgcaagctctacccgaacgtggacttctacaccggtctgatctaccgcgccatgggcttcccgaccgagatgttcacggtcctgttcgccctcggccgccttccgggctggatcgcccagtggcacgagatgatcaaggagccgggctcccgcatcggccgcccgcgccagatctacacgggcgaggtcctgcgcgacttcgtcccggtcgagggccggtaa

SEQ ID NO: 36965 - protein, 429 aa, Streptomyces avermitilis MA-4680
MSDNSVVLRYGDGEYTYPVIDSTVGDKGFDIGKLRAQTGLVTLDSGYGNTAAYKSAITYLDGEQGILRYRGYPIEQLAERSTFLEVAYLLINGELPTVDELSTFKGEITQHTLLHEDVKNFYRGFPRDAHPMAMLSSVVSALSTFYQDSHNPFDEKQRNLSTIRLLAKLPTIAAYAYKKSIGHPFVYPRNDLGYVENFLRMTFSVPAQDYDLDPVVVSALDKLLILHADHEQNCSTSTVRLVGSSQANMFASISAGISALWGPLHGGANQSVLEMLEGIQTSGGDVDTFIRKVKNKEDGVKLMGFGHRVYKNFDPRAKIIKAAAHDVLSALGKSDELLDIALKLEEHALADDYFVERKLYPNVDFYTGLIYRAMGFPTEMFTVLFALGRLPGWIAQWHEMIKEPGSRIGRPRQIYTGEVLRDFVPVEGR

SEQ ID NO: 36966 - DNA, 1284 bp, Nitrosomonas europaea ATCC 19718
  CDS (1)..(1284): transl_table=11
atgcccccacaaaacgtagccactttgtcaccgggtaaaggcaaacaagagattgaactgcccattgtgtccggtaatgaaggcccggatgtcgtcgatattcgttcgctgtatgcccagagcggcatgtttacctacgaccccggttttgtgtcgacggccagctgcaaatcggccattacgttcatcgacggtgacaaaggtgttctgttgtaccgtggctatccgatcgagcaactggccacccgctgtgatttcatggaagtcagttatcttctgctgaatggcgagctgccgacacccgaccagaaagcgaaatttgtcgacaacatcaaaaaccacacgatgctgcacgagcagctgatcaagtttctcagcggattccgccgtgatgcgcaccccatggcagtcatggtcggcgtagtcggcgcattgtctgccttttatcatgacgccatggatgtctctgacgcacaacatcgcgaacagtctgcattccgcctgattgccaagctgccgacgatcacggccattgcctataaatacaatattggccagccgttcatctatccgcacaacgatctgggattcacggaaaatttcctgcacatgatgtttgccacaccggccgagcaatatactcccaatccggtcatcgtcagggcactggatcgcatcctgattctgcatgcagaccatgaacagaatgcctccacttcgactgtccgcctggccggttcgagcggagccaacccgtttgcctgtatctcagccggaattacctgcttatggggtccggcacatgggggcgcgaatgaagcctgcctcaacatgcttgaacaaatcggagatgtttcacgtatcaacgaatacattgcgcgagccaaagacaagaacgatcctttccggctgatgggctttggccaccgggtctacaaaaattttgatccgcgcgccacattgatgcgtgaaacctgccatgaggtcctggatgaactggggttacataacgaccggttgttcaagctggcgctagagctggaaaaaatcgcgttggaggatgactacttcattaccaagaagctttaccccaatgtcgatttctattcgggcatcgtacaacgcgcactgggtattccgacgtcgatgttcaccgccatttttgccacagcccgcaccgttggctgggttgctcagtggaacgaaatgatttccgatccggaacaaaaaataggccggccacgtcaactgtacgtgggcgcacctcgcagagatgtgccatga

SEQ ID NO: 36967 - protein, 427 aa, Nitrosomonas europaea ATCC 19718
MPPQNVATLSPGKGKQEIELPIVSGNEGPDVVDIRSLYAQSGMFTYDPGFVSTASCKSAITFIDGDKGVLLYRGYPIEQLATRCDFMEVSYLLLNGELPTPDQKAKFVDNIKNHTMLHEQLIKFLSGFRRDAHPMAVMVGVVGALSAFYHDAMDVSDAQHREQSAFRLIAKLPTITAIAYKYNIGQPFIYPHNDLGFTENFLHMMFATPAEQYTPNPVIVRALDRILILHADHEQNASTSTVRLAGSSGANPFACISAGITCLWGPAHGGANEACLNMLEQIGDVSRINEYIARAKDKNDPFRLMGFGHRVYKNFDPRATLMRETCHEVLDELGLHNDRLFKLALELEKIALEDDYFITKKLYPNVDFYSGIVQRALGIPTSMFTAIFATARTVGWVAQWNEMISDPEQKIGRPRQLYVGAPRRDVP

SEQ ID NO: 36968 - DNA, 1296 bp, Mycobacterium bovis AF2122/97
  CDS (1)..(1296): transl_table=11
gtggccgacaccgacgacaccgcaaccctccgttacccgggaggcgagatcgacctgcagatcgtgcacgccaccgaaggcgccgacggcattgcgctcgggccgctgctggcaaaaaccgggcacaccacgttcgacgtcggcttcgccaacacggccgccgctaaaagctccatcacctacatcgacggagatgccggcattctgcgttatcgcggctacccgatcgaccaactggcggagaagtcaaccttcatcgaggtctgctacctgttgatttacggcgagctgcccgataccgaccagcttgcccagttcaccggccggatccagcgccacaccatgctgcacgaggatctcaagcggttcttcgacggctttccgcgcaatgcccacccgatgccggtgttgtccagcgtggtcaatgcgctgtcggcgtactaccaggatgctctggaccccatggacaacggtcaagtcgagctgtcgaccattcggctgctggccaagctgcccaccatcgccgcgtacgcctacaagaaatcggtcggccagcccttcctctacccagataactcactgacgctggtggagaacttcctacggttgacgttcggatttcccgccgagccctaccaggccgaccccgaggtggtgcgggcgctggacatgttgttcatcttgcacgccgaccacgagcagaactgctcgacgtcgacggttcggctggttggctcgtcgcgagccaacctgttcacctcgatctcgggtggcatcaacgcactatggggtccgcttcatggcggcgccaatcaggctgtcctggagatgctcgagggcattcgcgacagcggcgacgacgtcagcgagtttgtacgcaaggtcaagaaccgcgaggccggggtcaaattgatgggtttcggtcatcgtgtctacaagaactacgatccgcgggcccgcatcgtcaaggaacaggccgacaagatcctggccaagctcggcggcgatgactccttgctgggcatcgccaaggagctcgaagaggcggcgctgaccgacgactacttcatcgaacgcaagctttaccccaacgtcgacttctacaccggcctgatctaccgggccctcggcttcccgaccaggatgttcaccgtgttgtttgccctgggcaggcttcccggctggatcgcgcactggcgtgagatgcacgacgagggcgacagcaagatcggccggccccgccagatctacaccggctacgcggagcgcgactacgtcaccatagacgcgcggtag

SEQ ID NO: 36969 - protein, 431 aa, Mycobacterium bovis AF2122/97
MADTDDTATLRYPGGEIDLQIVHATEGADGIALGPLLAKTGHTTFDVGFANTAAAKSSITYIDGDAGILRYRGYPIDQLAEKSTFIEVCYLLIYGELPDTDQLAQFTGRIQRHTMLHEDLKRFFDGFPRNAHPMPVLSSVVNALSAYYQDALDPMDNGQVELSTIRLLAKLPTIAAYAYKKSVGQPFLYPDNSLTLVENFLRLTFGFPAEPYQADPEVVRALDMLFILHADHEQNCSTSTVRLVGSSRANLFTSISGGINALWGPLHGGANQAVLEMLEGIRDSGDDVSEFVRKVKNREAGVKLMGFGHRVYKNYDPRARIVKEQADKILAKLGGDDSLLGIAKELEEAALTDDYFIERKLYPNVDFYTGLIYRALGFPTRMFTVLFALGRLPGWIAHWREMHDEGDSKIGRPRQIYTGYAERDYVTIDAR

SEQ ID NO: 36970 - DNA, 1284 bp, Helicobacter hepaticus ATCC 51449
  CDS (1)..(1284): transl_table=11
atggctagcattactttaacaaacaatgagacaaaagagagttttgagtttgagcttattgaatgcacaagaggaccaaaggctgtagatttttctaagctttttgaacgcaccaatattttttcttatgacccaggttatggttcaaccgcaggatgtaaatcaaccattagctatattaatggcaaaaatggagaattactttataaagggcttccaatagaaaaaattgtagaaaaataccaatttactgatgtgtgcaagctactcattacaggtgaagttcctaaaaatgagacagaaaccaaggaatttgaaattgagcttgtgcatcgtagttttttgaatgagggactcattaatatttttaacgcatttcctgatagcgcacaccctatggcaaatctctctgcttcgctttctgcactttctactttccatttccgccatttggatatgggtaatgaggaagagcgtcaagtaatggcacggcgagcaattgctaaaatccctacacttgcagcattttcttatagacattctttagggattccatatatttatcctgatgttgcgcgtggatatgttgaaaatttcctttatatgttgcgtgcatatcctggtggtaaaatgaaacatacaattaagggtgaagttgaaatcactcctttagaaatagaggctcttgataagatttttacgcttcacgctgatcacggacaaaatgcttctactactactgtgcgcaatgttgcttctacgggagcacacccttatgcagcattaagtgctggtgttaatgcattgtggggtgcagcacacggaggagctaatgaaaaagtgttagatatgctcaatgagattggcgatgctaaaaatgttgataagtttatcaataaggcaaaagataaaaatgatccatttaggcttatgggctttggacatcgtgtgtataaaaactatgacccgcgtgcaaagattctgaaaaaactcaaagatgaccttgatgctaaaggtattaaaatgaatacacgattaagtgatttggcacataaggttgaagaagtagcattaagtgatagctactttgtagagcgaaatctttatccaaatgttgatttttactccggtatcattctttctgcacttaaaattcctgtttctcttttcacgccaatttttgttattgggcgtatgccgggttggtgtgcgcagcttttagagcacgttaaagatccaactacaagaatcacacgaccacgacaagtgtatataggtgagtaa

SEQ ID NO: 36971 - protein, 427 aa, Helicobacter hepaticus ATCC 51449
MASITLTNNETKESFEFELIECTRGPKAVDFSKLFERTNIFSYDPGYGSTAGCKSTISYINGKNGELLYKGLPIEKIVEKYQFTDVCKLLITGEVPKNETETKEFEIELVHRSFLNEGLINIFNAFPDSAHPMANLSASLSALSTFHFRHLDMGNEEERQVMARRAIAKIPTLAAFSYRHSLGIPYIYPDVARGYVENFLYMLRAYPGGKMKHTIKGEVEITPLEIEALDKIFTLHADHGQNASTTTVRNVASTGAHPYAALSAGVNALWGAAHGGANEKVLDMLNEIGDAKNVDKFINKAKDKNDPFRLMGFGHRVYKNYDPRAKILKKLKDDLDAKGIKMNTRLSDLAHKVEEVALSDSYFVERNLYPNVDFYSGIILSALKIPVSLFTPIFVIGRMPGWCAQLLEHVKDPTTRITRPRQVYIGE

SEQ ID NO: 36972 - DNA, 1488 bp, Rhodopirellula baltica SH 1
  CDS (1)..(1488): transl_table=11
atgttaggaatgggtgaacccggacgggtgagagcgtcaaagtccaaaatcgtcctctctgaccgtcggatgtgggtcccgctgattgtcgcttgcatgacgcagggctacactacgtctgtcacccccaagacgtcccgccaactcgtacattgcatctacagatcgcccatgagctcctcctccagtttggaaattcaacgagccgacaccgtccgagtccaattcggggataccaaccttgagttgcctttggtcgaaggttccgaaggtgaaaaagcgatcgatatcagtcgtttacgtgctgacactggcgtgatcaccttggacgatggcttcgtcaacacgggcagcactcgcagtgcgatcacgttcttggatggcgaaaaagggattctgcgttatcgcgggtacccgatcgaggaactggccaaaagctgtgacttcgtcgaggtcgcctaccttttgatctttggcgatctgccaaatgctgaagagattgaaacgtttcgttcagggatccgcgatcacacgatgatccacgaggacatgcggtcgttctacaacggcttccctcgtgacgctcacccgatggcgatcctcagcagcgttgtcggtgcactgtcaacgttctatcaagattccatggatctgaatgatccgcgacaggtcgagatttctctgtatcgcttgattgcgaaattgcccacgatcgcggcatacagctacaagaaatcgatgggccaaccgttcatgtatccgaagaacgagttggactactgcgagaacttcttgcacatgatgttcgcgacgccgacctccgattacttggtcgaccccgatttcgcggaagcactgaacttgctgtttatcgtgcacgcggaccacgagcaaaactgcagcacgtcgaccgttcggatggttggcagcagcaacgccaacttgttcgcgtcgatctcggccggcatcggtgcattgtggggaccgcttcacggcggtgccaacgaagcttgcgtgaacatgctcgaacaaatcgcggccgacggcggcgacgtgaagaagtacgtcgacatggcgaaggacaaatccaacgacttccgcatcatgggctttggtcaccgcgtttacaaaaactcggatccacgagcgacaatcatccgagcgagctgcgataagttgctggccaaattgaacctggatgatccattgttcgaagttgctcaaaagctagaagaagtcgcgctcaaggacgaatacttcatcgagcggaagttgtatcccaacgtcgatttctattccggcgtgatctaccgagcgctcggcattccggtccagatgttcacggttctattcgccattggtcgtttgcccggttggttggctcactggcgtgagatgcatgccaacccagcctcgcgaatcaatcgtccgcgtcagatctacaccggcgcgacgcagcgtgatgtggttccagtcgatcaacgctag

SEQ ID NO: 36973 - protein, 495 aa, Rhodopirellula baltica SH 1
MLGMGEPGRVRASKSKIVLSDRRMWVPLIVACMTQGYTTSVTPKTSRQLVHCIYRSPMSSSSSLEIQRADTVRVQFGDTNLELPLVEGSEGEKAIDISRLRADTGVITLDDGFVNTGSTRSAITFLDGEKGILRYRGYPIEELAKSCDFVEVAYLLIFGDLPNAEEIETFRSGIRDHTMIHEDMRSFYNGFPRDAHPMAILSSVVGALSTFYQDSMDLNDPRQVEISLYRLIAKLPTIAAYSYKKSMGQPFMYPKNELDYCENFLHMMFATPTSDYLVDPDFAEALNLLFIVHADHEQNCSTSTVRMVGSSNANLFASISAGIGALWGPLHGGANEACVNMLEQIAADGGDVKKYVDMAKDKSNDFRIMGFGHRVYKNSDPRATIIRASCDKLLAKLNLDDPLFEVAQKLEEVALKDEYFIERKLYPNVDFYSGVIYRALGIPVQMFTVLFAIGRLPGWLAHWREMHANPASRINRPRQIYTGATQRDVVPVDQR

SEQ ID NO: 36974 - DNA, 1179 bp, Prochlorococcus marinus subsp. marinus str. CCMP1375
  CDS (1)..(1179): transl_table=11
ttggagcaaaaggctatagacaatcaaaatgatccctgcaacatggttttaaagcctggtctcgaaggtgtacccgttacacaatcagctatctgtgacattaatggccttaaaggagagctgaaatataggggttattcaattgcggagttagcggctaaaagcagctttttagaaaccacttatcttctcatctggggagatctcccaagctcaaagcaactaagggaattcgaagatgcaatacaaatgcatcgcagactgagcttcagagttcgagacatgatgaagtgcttccctgcgactggccatcctatggatgccctgcaatcaagcgctgcatcgctaggcctattttattcaagaagagccattgacaaccctcaatatatttacgatgcagtagtaaggctaattgcaaaaatcccaacaatggttgcagcttttcagctgatcagaaaaggacaagatcccatacaacctcgagacgatttaccttattcagcgaactttctttatatgttgactgaaagggaacctgaccccctcgcagccagagtattcgatagatgcttaatacttcatgcagaacacagtttaaatgcaagtacatttagtgcccgagttacagcaagcactttgactgacccctatgcagttgttgcttcagctgttggcacccttgctgggcctttgcatggtggtgcaaatgaggatgtaattgcaatgcttgaagagattggcgcacctgaaaatgctaggaattatttaaaacaagcaattgatcagaaaagcaaaataatgggttttgggcatagggaatataaagtcaaagatcctagagcgacacttttgcaaggatttgcagaagacctatttgcaagatttgggaaagatgaaatgtatgacgtagctagatcagtggaagaagaagcctctccattactagggccaagaggtatatatccaaatgttgacttttactcaggtctggtatatcgaaagttaggaatcccaagagatttatttactccaatttttgccatttcgcgcgtggctggctggctagcccattggcgtgaacaactaagtgctaatcgtattttcagaccaacacaaatttacactggcaagaaaaccagagcttggtgcgcattagaagaacggaataaaaactaa

SEQ ID NO: 36975 - protein, 392 aa, Prochlorococcus marinus subsp. marinus str. CCMP1375
MEQKAIDNQNDPCNMVLKPGLEGVPVTQSAICDINGLKGELKYRGYSIAELAAKSSFLETTYLLIWGDLPSSKQLREFEDAIQMHRRLSFRVRDMMKCFPATGHPMDALQSSAASLGLFYSRRAIDNPQYIYDAVVRLIAKIPTMVAAFQLIRKGQDPIQPRDDLPYSANFLYMLTEREPDPLAARVFDRCLILHAEHSLNASTFSARVTASTLTDPYAVVASAVGTLAGPLHGGANEDVIAMLEEIGAPENARNYLKQAIDQKSKIMGFGHREYKVKDPRATLLQGFAEDLFARFGKDEMYDVARSVEEEASPLLGPRGIYPNVDFYSGLVYRKLGIPRDLFTPIFAISRVAGWLAHWREQLSANRIFRPTQIYTGKKTRAWCALEERNKN

SEQ ID NO: 36976 - DNA, 1311 bp, Bordetella pertussis Tohama I
  CDS (1)..(1311): transl_table=11
atgaacctgtctgacaaaaaagccacgctatccttttcggacggcagcgctcctatcgaattcccagtctacaagggtacggtcggcccggacgtgatcgacatccgcaagctgtatggccagacgggtatgttcacgttcgaccccggcttcatgtccaccgccgcctgcgcctcgggcattacctacatcgacggcgacaagggcgaactgctgtaccgcggctatcccatcgagcagctggccgtcaattgcgacttcctcgacatctgctacctgatcctcaacggcgagctgcccaacggcggccagaagcaggatttcgactcgcaggtgacccatcacacgatggtcaacgagcagctgcatttcttcctgcgcggcttccgccgcgacgcgcacccgatggcggtgctgacgggcctggtgggcgcgctgtcggccttctaccacgactcgaccgacatcaccaacccgcaccatcgccacgtctcggccatccgcctgatcgccaagatgccgacgctggtcgccatggcgtacaagtattcgcaaggccagccgttcatctatccgcagaatgacctgtcgtacaccggcaacttcctgcgcatgatgtgcgcgaccccgtgtgaagagtacaaggtcaatgacgtcgtcgagcgcgcgctcgatcgcatcttcatcctgcatgcggaccacgagcagaacgcttcgacctcgacggtgcgcctgtgcggttcgtcgggcaccaatccgttcgccgccatcgccgccggcgtggcgtgcctgtggggcccggctcacggcggcgccaacgaagcctgcctgcagatgctcgaagaactgcaggccaacggcggtgtggccaaggtcggcgagttcatggaaaaggtcaaggacaagaactcgggcgtgcgcctgatgggctttggccaccgcgtctacaagaactacgatccgcgcgccaagctgatgcaggaaacgtgcaaggaagtcctggtggcgctgggcctggagaacgacccgctgttcaagctggccatggaactggagcgcatcgccctggaagacgactacttcgtgcagcgcaagctgtacccgaacgtcgacttctactcgggtatcgtgcaacgcgccatcggcatcccgacctcgctgttcacggccatcttcgcgctggcccgcacggtgggctggatcgcccagtggaacgaaatgctgtccgaccccgactacaagatcggccgtccgcgccagctgttcaccggttcggtcacgcgcgacgtgcccggcatggacaagcgctga

SEQ ID NO: 36977 - protein, 436 aa, Bordetella pertussis Tohama I
MNLSDKKATLSFSDGSAPIEFPVYKGTVGPDVIDIRKLYGQTGMFTFDPGFMSTAACASGITYIDGDKGELLYRGYPIEQLAVNCDFLDICYLILNGELPNGGQKQDFDSQVTHHTMVNEQLHFFLRGFRRDAHPMAVLTGLVGALSAFYHDSTDITNPHHRHVSAIRLIAKMPTLVAMAYKYSQGQPFIYPQNDLSYTGNFLRMMCATPCEEYKVNDVVERALDRIFILHADHEQNASTSTVRLCGSSGTNPFAAIAAGVACLWGPAHGGANEACLQMLEELQANGGVAKVGEFMEKVKDKNSGVRLMGFGHRVYKNYDPRAKLMQETCKEVLVALGLENDPLFKLAMELERIALEDDYFVQRKLYPNVDFYSGIVQRAIGIPTSLFTAIFALARTVGWIAQWNEMLSDPDYKIGRPRQLFTGSVTRDVPGMDKR

SEQ ID NO: 36978 - DNA, 1311 bp, Bordetella bronchiseptica RB50
  CDS (1)..(1311): transl_table=11
atgaacctgtctgacaaaaaagccacgctatccttttcggacggcagcgctcctatcgaattcccagtctacaagggtacggtcggcccggacgtgatcgacatccgcaagctgtatggccagacgggtatgttcacgttcgaccccggcttcatgtccaccgccgcctgcgcctcgggcattacctacatcgacggcgacaagggcgaactgctgtaccgcggctatcccatcgagcagctggccgtcaattgcgacttcctcgacatctgctacctgatcctcaacggcgagctgcccaacggcggccagaagcaggatttcgactcgcaggtgacccatcacacgatggtcaacgagcagctgcatttcttcctgcgcggcttccgccgcgacgcgcacccgatggcggtgctgacgggcctggtgggcgcgctgtcggccttctaccacgactcgaccgacatcaccaacccgcaccatcgccacgtctcggccatccgcctgatcgccaagatgccgacgctggtcgccatggcgtacaagtattcgcaaggccagccgttcatctatccgcagaatgacctgtcgtacaccggcaacttcctgcgcatgatgttcgcgaccccgtgtgaagagtacaaggtcaatgacgtcgtcgagcgcgcgctcgatcgcatcttcatcctgcatgcggaccacgagcagaacgcttcgacctcgacggtgcgcctgtgcggttcgtcgggcaccaatccgttcgccgccatcgccgccggcgtggcgtgcctgtggggcccggctcacggcggcgccaacgaagcctgcctgcagatgctcgaagaactgcaggccaacggcggtgtggccaaggtcggcgagttcatggaaaaggtcaaggacaagaactcgggcgtgcgcctgatgggctttggccaccgcgtctacaagaactacgatccgcgcgccaagctgatgcaggaaacgtgcaaggaagtcctggtggcgctgggcctggagaacgacccgctgttcaagctggccatggaactggagcgcatcgccctggaagacgactacttcgtgcagcgcaagctgtacccgaacgtcgacttctactcgggtatcgtgcaacgcgccatcggcatcccgacctcgctgttcacggccatcttcgcgctggcccgcacggtgggctggatcgcccagtggaacgaaatgctgtccgatcccgactacaagatcggccgtccgcgccagctgttcaccggttcggtcacgcgcgacgtgcccggcatggacaagcgctga

SEQ ID NO: 36979 - protein, 436 aa, Bordetella bronchiseptica RB50
MNLSDKKATLSFSDGSAPIEFPVYKGTVGPDVIDIRKLYGQTGMFTFDPGFMSTAACASGITYIDGDKGELLYRGYPIEQLAVNCDFLDICYLILNGELPNGGQKQDFDSQVTHHTMVNEQLHFFLRGFRRDAHPMAVLTGLVGALSAFYHDSTDITNPHHRHVSAIRLIAKMPTLVAMAYKYSQGQPFIYPQNDLSYTGNFLRMMFATPCEEYKVNDVVERALDRIFILHADHEQNASTSTVRLCGSSGTNPFAAIAAGVACLWGPAHGGANEACLQMLEELQANGGVAKVGEFMEKVKDKNSGVRLMGFGHRVYKNYDPRAKLMQETCKEVLVALGLENDPLFKLAMELERIALEDDYFVQRKLYPNVDFYSGIVQRAIGIPTSLFTAIFALARTVGWIAQWNEMLSDPDYKIGRPRQLFTGSVTRDVPGMDKR

SEQ ID NO: 36980 - DNA, 1146 bp, Prochlorococcus marinus subsp. pastoris str. CCMP1986
  CDS (1)..(1146): transl_table=11
ttggatactcataaactaattttaaaaccaggattagagggagttccagtaactaattcatcaatatgtgatattgacggtcaaaaagggaaattattatatagaggctattcaattgaagaattagcacagaaaagtagtttcttagagactgcttttttattaatttggggagaattaccttcagcaacagaactaagagattttgaacaagaagtacagatgcatcggagattaagcttcagagtaagagatatgatgaaatgctttcctgccacagggcatcccatggatgctctgcagtccagtgccgcctctcttggtcttttctactcaagaagagcgatagatgatcccaagtatatctacaacgcagtgataagactaattgcaaaaattccaacaatgattgctgcatttcaacttataagaaaaggacaagatcccattcaacctagggatgatttatcctactcatcgaattttctttacatgttgactgaaaaagaacaagatcccatagctgcaaaagtttttgatagatgcctaattcttcatgcagaacatagtttaaatgcgagtacatttagcgcacgagttacggctagcactcttacagacccatacgcagtaattgcctctgcagtaggaacattagctggtcctcttcatggtggagctaatgaagatgtaattgccatgttagaagatattaaaactccagaaaaagctgcttcatttttagaagatgctattcaaaacaaaagtaaaataatgggtttcggacatcgagagtacaaagttaaagatcctcgagcaattattcttcagaaattagcagaggagctttttgttaggtttggaaaagatgaaatgtatgaagttgctaaaaaattagagttagaggctatcccaaggctaggaggaaaaggtattttcccaaacgttgatttttattctggccttgtttacagaaaacttggtattccccgtgacttatttactcctatttttgcaatatcaagagtcgcaggttggttagctcattggagggaacaattaggcgcaaacagaatttttagaccgtctcaaatttataccggttcggctccaagagattggattactttagaaaatcgaaaataa

SEQ ID NO: 36981 - protein, 381 aa, Prochlorococcus marinus subsp. pastoris str. CCMP1986
MDTHKLILKPGLEGVPVTNSSICDIDGQKGKLLYRGYSIEELAQKSSFLETAFLLIWGELPSATELRDFEQEVQMHRRLSFRVRDMMKCFPATGHPMDALQSSAASLGLFYSRRAIDDPKYIYNAVIRLIAKIPTMIAAFQLIRKGQDPIQPRDDLSYSSNFLYMLTEKEQDPIAAKVFDRCLILHAEHSLNASTFSARVTASTLTDPYAVIASAVGTLAGPLHGGANEDVIAMLEDIKTPEKAASFLEDAIQNKSKIMGFGHREYKVKDPRAIILQKLAEELFVRFGKDEMYEVAKKLELEAIPRLGGKGIFPNVDFYSGLVYRKLGIPRDLFTPIFAISRVAGWLAHWREQLGANRIFRPSQIYTGSAPRDWITLENRK

SEQ ID NO: 36982 - DNA, 1215 bp, Prochlorococcus marinus str. MIT 9313
  CDS (1)..(1215): transl_table=11
ttgccaaggagttgtcgagatgcggtggggcaggagcaggttggggagattcgccacgatcgcagtggcatcagctttcgtccggggctggagggagtgccagtaacccaatccgccatctgtgatatcgatggactgcaggggcggcttgcttatcggggttatccaattgcggagctctcagcgcatagcagctttttggaaaccacctatctgttgatctggggcgatctgccaagcccacagcaacttcgtgatttcgaagctgaggttcagatgcaccgtcgcgtgagtttccgggtacgcgacatgatgaagtgcttcccagcttcggggcacccgatggatgcacttcagtcgagtgcggcatccctggggctgttctattcccgtcgagccatcgatgacccgaagtacgtctataacgccgtggtgaggctgatcgccaagattcccacgatggtggcggccttcaagttgattcgcaaagggcaagatcccattcagcctcgtgacgacctggcctactcagccaatttcctctacatgctcaccgagcgtgaaccggaccctttggcggcaagggttcttgatcgctgcttgatcctgcatgcggaacacagtcttaatgccagtacttttagtgctcgagtgaccgccagtacgctcacagatccttatgcagtggtggcttccgcagtgggcacccttgcaggacccctacatggtggtgccaatgaggatgttttggcgatgcttgaagagatcggcagcccagagcatgctggtgattacttggatgaagcgattgcttctaagcgcaaggtgatgggctttggtcatagggaatatcgggtcaaggatcctcgcgctgtgatccttcagggtcttgcagaggagttgtttgcccgattcggtaccgatgagatgtacgacgtggccaaggcgttggagcaggcggctgccacccgtttaggccctaaagggatctatccgaatgtggacttctattccggtcttgtgtatcgcaagcttggaattccacgtgatctttttactcctgtgtttgctatctcaagggtggctggttggctagctcattggcgagagcaacttggcgcgaatcggattttcagaccttcgcagatttacaccggtccccagaacagaacttggatccctagtgatgagcgtttctcttctacgggcgcttaa

SEQ ID NO: 36983 - protein, 404 aa, Prochlorococcus marinus str. MIT 9313
MPRSCRDAVGQEQVGEIRHDRSGISFRPGLEGVPVTQSAICDIDGLQGRLAYRGYPIAELSAHSSFLETTYLLIWGDLPSPQQLRDFEAEVQMHRRVSFRVRDMMKCFPASGHPMDALQSSAASLGLFYSRRAIDDPKYVYNAVVRLIAKIPTMVAAFKLIRKGQDPIQPRDDLAYSANFLYMLTEREPDPLAARVLDRCLILHAEHSLNASTFSARVTASTLTDPYAVVASAVGTLAGPLHGGANEDVLAMLEEIGSPEHAGDYLDEAIASKRKVMGFGHREYRVKDPRAVILQGLAEELFARFGTDEMYDVAKALEQAAATRLGPKGIYPNVDFYSGLVYRKLGIPRDLFTPVFAISRVAGWLAHWREQLGANRIFRPSQIYTGPQNRTWIPSDERFSSTGA

SEQ ID NO: 36984 - DNA, 1191 bp, Synechococcus sp. WH 8102
  CDS (1)..(1191): transl_table=11
gtggctcagaagcagtcaggggacctgcgccatgcgcggacaggcatcgaacttcgacccggtctggatggtgtaccggccacccagtccgccatctgtgacatcgatggcgagcaggggctgttgacctaccgcggctatccaatgcaggacctggcggccaacagcagcttcctggagacagcctttttgctgatctggggggagctacccagccgcgatcagctggcggagttcgagcacgccgtacagatgcaccggcgggtgagcttccgggtgcgagacatgatgaagtgtttccccgcaagtgggcatccgatggatgcgctgcaatccagcgcagcatccctggggctgttctattcccgtcgggccatcgacgatccgcagtacgtgtatgacgcggtggtgcggctgatcgccaagatccccacgatggttgcggccttccagctgattcggaagggccaggatccgattcagccccgcgacgacctggcctactccgccaatttcctctacatgctcaccgagcgtgagccggatcctctggcggcacgcatcttcgaccgttgcctgatgcttcacgccgagcacagcctcaacgccagcaccttcagcgcccgcgtcaccgccagcacactcaccgatccctacgccgtggtggcctcggcggtgggcacccttgccggacctctgcatgggggagctaatgaagatgtgctggcgatgctggaagaggtgggaacagccgagaacgccggcgcctatctcgatgaagccatggccgccaagcgcaagatcatgggtttcggccaccgtgaatacaaggtgaaggatccccgtgcggtgattcttcaggccttggtggaggagatgttcgcccgctttggccacgatgagctctacgacgtagcggtggccatcgagcgggaggcggagtcccgcctcgggcccaaaggcatctaccccaacgtcgatttctattcaggcctggtgtaccggaagctcggcatcccgagggatttgttcacgccggtgttcgccatcgcacgcgtggctggctggctggcccattggcgggagcagctcggggccaatcgcattttccggccctctcagatttattcgggctcccagctacgcgcgtggatgcccatagatgagcgtgtcaccgctccggccgcttaa

SEQ ID NO: 36985 - protein, 396 aa, Synechococcus sp. WH 8102
MAQKQSGDLRHARTGIELRPGLDGVPATQSAICDIDGEQGLLTYRGYPMQDLAANSSFLETAFLLIWGELPSRDQLAEFEHAVQMHRRVSFRVRDMMKCFPASGHPMDALQSSAASLGLFYSRRAIDDPQYVYDAVVRLIAKIPTMVAAFQLIRKGQDPIQPRDDLAYSANFLYMLTEREPDPLAARIFDRCLMLHAEHSLNASTFSARVTASTLTDPYAVVASAVGTLAGPLHGGANEDVLAMLEEVGTAENAGAYLDEAMAAKRKIMGFGHREYKVKDPRAVILQALVEEMFARFGHDELYDVAVAIEREAESRLGPKGIYPNVDFYSGLVYRKLGIPRDLFTPVFAIARVAGWLAHWREQLGANRIFRPSQIYSGSQLRAWMPIDERVTAPAA

SEQ ID NO: 36986 - DNA, 1308 bp, Chromobacterium violaceum ATCC 12472
  CDS (1)..(1308): transl_table=11
atgactgggagtattgctgtggaaactaatcgcaaagtcacgctcagctacaacgagggcaaggaaaccctggacctgccggtcctggggggcacgctgggtccggatgtcgtcgacatccgcggcttcggcaaaacaggcatgttcaccttcgacccgggcttcctggccaccgccagctgcgagtccaagatcaccttcatcgacggcgacctgggccatctgtactaccgcggctacccgatcgagcagctggccgagaagagcgactacctggaagtctgctacctgctgctgaacggcgagctgccgaccgcggcgcagcgcaaggaattcgaacgcggcgtgatgcgccacaacatgctgcacgaccagctgatgagcctgttcaagggcttccgccgcgacgcgcacccgatggcggtgatggtgggcgtggtgggcgcgctgtccgccttctaccatgactcgctggacatctccaatccggagcaccgccgcatctcggcccaccgcctgatcgccaagctgccgaccatcgccgcccaggcttaccgctacaacaagggcctgccgttctcctatccgaagaacggcctgacctatgcggaaaacttcctgcacatgatgttctccaccccgtgcgaggagtacaaggtgaacccggtgctggcgcgcgcgctggaccgcatcttcaccctgcacgccgaccacgagcagaacgcctccacctccaccgtccgtctggccggctcctccggcgccaacccgttcgcgtgcatcgccgcctgcatcgcctgcctgtggggcccgtcccacggcggcgccaacgaggccgtgctgaagatgctggacgagatcggttccgtggacaatgtggccgacttcatgcagggcgtgaaggacaagcgctacaagctgatgggcttcggccaccgcgtgtacaagaacatggacccgcgcgccgccatcatgaagcagacctgcgacgaagtgctgaacgagctgggcctgcataacgatccgaaattcaagctggccatggagctggaaaagatcgcgctgtccgacccgtacttcatcgagcgcaagctgtacccgaacgtggacttctactccggcatcgtgctgtccgcgatcggcatcccggtttccatgttcaccccgatcttcgcgctggcccgcaccgtgggctggatcgcgcactggaacgagatgatcggcgatccgggcatgaagatcggccgtccgcgccagctgtacaccggcgccgcgcgccgcgacttcgtggaagtcgccaagcgctga

SEQ ID NO: 36987 - protein, 435 aa, Chromobacterium violaceum ATCC 12472
MTGSIAVETNRKVTLSYNEGKETLDLPVLGGTLGPDVVDIRGFGKTGMFTFDPGFLATASCESKITFIDGDLGHLYYRGYPIEQLAEKSDYLEVCYLLLNGELPTAAQRKEFERGVMRHNMLHDQLMSLFKGFRRDAHPMAVMVGVVGALSAFYHDSLDISNPEHRRISAHRLIAKLPTIAAQAYRYNKGLPFSYPKNGLTYAENFLHMMFSTPCEEYKVNPVLARALDRIFTLHADHEQNASTSTVRLAGSSGANPFACIAACIACLWGPSHGGANEAVLKMLDEIGSVDNVADFMQGVKDKRYKLMGFGHRVYKNMDPRAAIMKQTCDEVLNELGLHNDPKFKLAMELEKIALSDPYFIERKLYPNVDFYSGIVLSAIGIPVSMFTPIFALARTVGWIAHWNEMIGDPGMKIGRPRQLYTGAARRDFVEVAKR

SEQ ID NO: 36988 - DNA, 1269 bp, Wolinella succinogenes DSM 1740
  CDS (1)..(1269): transl_table=11
atgggcacagtcactttcacgaataacgaaacgggcgaaaaatttgaatttgaaattctcaaccccacgcgaggtccgcagttggtcgatttttcgaagttttatgagacaacaggaatgttcacctttgaccctggctatggttcgaccgccaactgtaaatcagagatcagttttgtggatggaaaaaagggtgagctggtctactatggacaccctatcgaagagctggtggagaagtataagtttgttgatgtcattaaactgctcattggaaatggctatatctttcccaccaaagaggaatcggatcaatttgagcgtgagctagtgcgccgctcctacatccacgaggggctccgaaagattatcgatgcttttcctgatggcgctcatccgatggcgaatctctcctcatccgtttccgcgctctcgactttctactacgatcatatcgacatggagtatgaggcagagtatcagacgatggcacgaagaatcatcgccaaaacccccacgctagcagcctttgcctatcgaagctctgtgggatcaccttttgtctatcctgatgcagaccgcggctatgtggaaaacttcctttatatgcttagagcctatcctcatggaaagcttaaagaggagatttcacccattgaagtgagtgcgcttgatacgatctttatgcttcatgctgaccatggtcaaaacgcctctacggccacagtgcgcaatgttgctagtacgggagtccacccctatgcggctctatcagcgggcttgagcgcactttggggcaaggctcatggaggggcgaacgaatcggttatggatcagcttgagatgattggcgatgttaaaaatgttgatcgctacattgccaaagccaaagacaaaaacgactcctttagattgatgggctttggccatcgagtctataagagctatgatccaagggctagaattctcagaaaactcaaagacgatctagaccaaaaaggggtcaagatgaatcagcgcctcgtggagattgccgagaagatcgaagaggtggcgacgcaagatgaatattttctctccaggagtctctaccccaatgttgatttctactcaggaatcatcctcacagcgcttaagattccaaagagcatgttcacgcccattttcgccatcggaaggatgcctgggtggtgtgggcaagttttagagctgcttcaagagcccaatgtcaaaatcacgcgtccccgacagatgtatgtcggaaaataa

SEQ ID NO: 36989 - protein, 422 aa, Wolinella succinogenes DSM 1740
MGTVTFTNNETGEKFEFEILNPTRGPQLVDFSKFYETTGMFTFDPGYGSTANCKSEISFVDGKKGELVYYGHPIEELVEKYKFVDVIKLLIGNGYIFPTKEESDQFERELVRRSYIHEGLRKIIDAFPDGAHPMANLSSSVSALSTFYYDHIDMEYEAEYQTMARRIIAKTPTLAAFAYRSSVGSPFVYPDADRGYVENFLYMLRAYPHGKLKEEISPIEVSALDTIFMLHADHGQNASTATVRNVASTGVHPYAALSAGLSALWGKAHGGANESVMDQLEMIGDVKNVDRYIAKAKDKNDSFRLMGFGHRVYKSYDPRARILRKLKDDLDQKGVKMNQRLVEIAEKIEEVATQDEYFLSRSLYPNVDFYSGIILTALKIPKSMFTPIFAIGRMPGWCGQVLELLQEPNVKITRPRQMYVGK

SEQ ID NO: 36990 - DNA, 1143 bp, Gloeobacter violaceus PCC 7421
  CDS (1)..(1143): transl_table=11
atgagcggcgagtatgttcctggtctggaaggcgtccctgcaacccgttcgaatatcagtttcgtggacggcaaagccggcgtcctggagtaccgcggcatcccaatcgaccagcttgccgagtcgagcacgtttttagagaccgcctttttattgatttttgaccacctgcccaccaaggacgaactgctctccttcgaagtcgagatcctgggccaccggcgggtcaaataccgcatccgcgacatgatcaaaagcttccccgagagcggccggccgatggtggccctccagtcgtgcatcgcggcgctggggcttttttatccgctgcaaaacgagagcaaagaaaaatacgcctacgattcgactatccgcctactcgcgaagatgccgacgatggtggcgacgtttcatcagatgcgcctgggcaacgatcccatcccgccgcgcgacgacttgggccacgccgccaattttctctacatgctcacgggcaaggaacccgacccacgggcggcgcgcatcttcgatgtctgtctgatgctgcacgccgagcacaccgtcaacgcctcgactttttcggccctggtcaccgcctccaccctggccgacccctataccgtgatcacctcggcggcgggcaccctctcaggcccgctccacggcggcgccaacgaagaggtgatccgcatgctcaaggaaatcggcaccatcgagcgcgtccgcccctacctcgagaatcgcctcgcccgcaaggaaaaaatcatgggcgtcggccaccgggtctacaaagtcaaagacccgcgcgccacgatcttgcagaatctggcccaggagttgttcgaccgcttcggccacagccgcctctacgacatcgccgtcgaagtcgagcgcgtttgcgacgagttgctcggccaaaagggcatctaccccaacgtcgacttctactcgggtctggtctacgaaaagatgggcattcccgccgacatgttcaccccggtattcgccatctcgcgggtggcggggtggctcgcccactggcacgagcagttggccgacaaccgcatcttccgtcccacccaggtctacaccggctcccacaacgtcgaattcacgcctctgtcgctgcgctcctacgcctag

SEQ ID NO: 36991 - protein, 380 aa, Gloeobacter violaceus PCC 7421
MSGEYVPGLEGVPATRSNISFVDGKAGVLEYRGIPIDQLAESSTFLETAFLLIFDHLPTKDELLSFEVEILGHRRVKYRIRDMIKSFPESGRPMVALQSCIAALGLFYPLQNESKEKYAYDSTIRLLAKMPTMVATFHQMRLGNDPIPPRDDLGHAANFLYMLTGKEPDPRAARIFDVCLMLHAEHTVNASTFSALVTASTLADPYTVITSAAGTLSGPLHGGANEEVIRMLKEIGTIERVRPYLENRLARKEKIMGVGHRVYKVKDPRATILQNLAQELFDRFGHSRLYDIAVEVERVCDELLGQKGIYPNVDFYSGLVYEKMGIPADMFTPVFAISRVAGWLAHWHEQLADNRIFRPTQVYTGSHNVEFTPLSLRSYA

SEQ ID NO: 36992 - DNA, 1284 bp, Photorhabdus luminescens subsp. laumondii TTO1
  CDS (1)..(1284): transl_table=11
atggcagataacaaagcaactctagccccagacggttcagttgctattgaattggacgtgctcacaccgacccttgggtccaaagtcatcgacgttcgtactctcggctcccaaggtttctatacctacgatcctggttttacttccacagcatcttgcgaatccaagatcacttacattgatggtaacgaaggtgtattgctgcaccgtggtttccctatcgaccagctagcgacaaaatccacttatctggaagtctgctatatcctgctgtatggtgaaacaccaacacaagaacagtttgataaattcaaaaaaaccattacccgccacaccatgattcacgaacagatccatcgcctgttcaacggtttccgccgtgattcgcatcctatggccgtactgtgtggtgttactggcgctctggctgctttctatcatgatgctctggacgtgaacaatccacgtcaccgtgacattaccgcctaccgcctgctgtcaaaaatgccgacagtggccgccatgtgctacaaatactctatcggtcagccattcgtttatccacgcaatgatctctcctatgcaggcaacttcctaaacatgatgttcgctacgccgtgtgaagagtataaagtgaacccagtactggaacgcgctatggatcgcatctttatcctacatgcggaccatgaacaaaatgcatctacctcaacagtacgtaccgcaggttcttctggcgctaacccatttgcctgtattgccgcaggtatcgcttctctttggggccccgctcatggcggcgcaaacgaagcttgtctgcgtatgttggaagaaattcagtcagttgaacatattccggaattcattaaacgcgccaaagataaaaatgatgctttccgtctgatgggatttggtcatcgcgtttacaaaaactatgatcctcgtgcaaccgtcatgcgtgaaacctgccatgaagtgctagatgaactcggcctgaatgacagcctgctggaagttgctatggaacttgaacgtatcgctctgcacgatccttattttattgagaaaaaactgtatccgaacgtggatttctactccggcattatcctgaaagcaatgggtattccatccactatgttcactgttattttcgccattgcccgtactatcggctggatcgctcactggaatgaaatgcatgatggtggcgtgaaaatcgctcgcccacgtcaactctataccggctacacaaaacgtgatttcgatagccagcttgaaaaataa

SEQ ID NO: 36993 - protein, 427 aa, Photorhabdus luminescens subsp. laumondii TTO1
MADNKATLAPDGSVAIELDVLTPTLGSKVIDVRTLGSQGFYTYDPGFTSTASCESKITYIDGNEGVLLHRGFPIDQLATKSTYLEVCYILLYGETPTQEQFDKFKKTITRHTMIHEQIHRLFNGFRRDSHPMAVLCGVTGALAAFYHDALDVNNPRHRDITAYRLLSKMPTVAAMCYKYSIGQPFVYPRNDLSYAGNFLNMMFATPCEEYKVNPVLERAMDRIFILHADHEQNASTSTVRTAGSSGANPFACIAAGIASLWGPAHGGANEACLRMLEEIQSVEHIPEFIKRAKDKNDAFRLMGFGHRVYKNYDPRATVMRETCHEVLDELGLNDSLLEVAMELERIALHDPYFIEKKLYPNVDFYSGIILKAMGIPSTMFTVIFAIARTIGWIAHWNEMHDGGVKIARPRQLYTGYTKRDFDSQLEK

SEQ ID NO: 36994 - DNA, 1290 bp, Vibrio vulnificus YJ016
  CDS (1)..(1290): transl_table=11
atggcggataagaaagcgacccttcatgttgaaggtaaagcgccgatcgaattgccaattatggaaggttctttgggaacgcctgtaattgatgttcgtaagctaggagcgaacggctacttcactttcgacccgggttttcttgccactgcatcttgtgaatcgcaaataacatacatcgacggcggaaaaggcatcctgcttcaccgtggataccctattgatcagcttgcaaacaacgctgattacctagaggtttgttatattctactttacggtgaagcccctactcgtgagcaatacgagaaattcaaaacaactgttactcgccacactatggtgcacgaacaaattgccagcttcttccatggcttccgtcgtgatgcacaccctatggcagtaatgtgtggtgttgttggcgcacttgctgcgttctaccacgattctctagacatcaataatgacctgcaccgtgagatcacagcgtatcgtctgttgtctaagatgccgactttggctgcgatgtgttacaagtactctacaggccagccgttcatctaccctcgcaatgatttgagctacgcagaaaacttcctacacatgatgtttgctacaccatgtgaagaatatgaagtaaaccctgtcgttgcacgtgcgatggacaaaatcttcactctgcacgcagaccacgaacaaaatgcgtcaacgtcaacggtacgtttggcgggttcttctggtgcaaacccgtttgcttgtattgcggcaggtattgcatcgctttggggtccagctcatggcggcgcaaatgaagcgtgtttgaagatgttggaagagattggttcagtcgacaacattcctgagtacgtggatcgagcgaaagacaaagatgacccattccgtttgatgggctttggtcaccgtgtttacaagaactacgatccacgcgcaaccgtcatgcgtgaaacctgtcatgaagtgcttaaagagctcaacattcaagatccactgcttgatgttgcaatggaacttgagcgtattgctctttcagacgagtactttgtatcgaagaaactgtacccgaacgttgatttctactcaggcatcattctgaaagcgattggcattccagtttcaatgtttaccgttatcttcgcaatttcacgcaccatcggttggattgcacactggaacgaaatgcacagtgacccactgaaccgtatcggtcgccctcgccagttgtacacaggggaagtccaacgcgatttccaacctatgcacgaacgcgagtaa

SEQ ID NO: 36995 - protein, 429 aa, Vibrio vulnificus YJ016
MADKKATLHVEGKAPIELPIMEGSLGTPVIDVRKLGANGYFTFDPGFLATASCESQITYIDGGKGILLHRGYPIDQLANNADYLEVCYILLYGEAPTREQYEKFKTTVTRHTMVHEQIASFFHGFRRDAHPMAVMCGVVGALAAFYHDSLDINNDLHREITAYRLLSKMPTLAAMCYKYSTGQPFIYPRNDLSYAENFLHMMFATPCEEYEVNPVVARAMDKIFTLHADHEQNASTSTVRLAGSSGANPFACIAAGIASLWGPAHGGANEACLKMLEEIGSVDNIPEYVDRAKDKDDPFRLMGFGHRVYKNYDPRATVMRETCHEVLKELNIQDPLLDVAMELERIALSDEYFVSKKLYPNVDFYSGIILKAIGIPVSMFTVIFAISRTIGWIAHWNEMHSDPLNRIGRPRQLYTGEVQRDFQPMHERE

SEQ ID NO: 36996 - DNA, 1308 bp, Corynebacterium diphtheriae NCTC 13129
  CDS (1)..(1308): transl_table=11
ttgaaagggatgcttgtggctactgaaaacaaggataaggcggttcttcactaccctggtggcgagtatgagatggatatcatccatgcaaccgagggcaacgatggtgttgtactggataaattgctgtcccaaaccggcatggtcacttttgaccccggctatgtaagcaccggttccactgaatcgaagatcacctacattgacggcgacaacggcatcctgcgccaccgcggctatgacatcgcggatctagcggaaaacgcaaccttcaacgaagtctcctaccttctgatcaaaggccacctgccaaccgttgatgaactccacaagttcaacaacgaaatccgtcaccacaccctgctggacgaggactttaagagccagttcaacatcttcccacgtgacgcacacccaatgtccgtgctggcttcctccgtgaacatcttgtccacctactaccaagatcagctcaacccactcgatgaggagcagctagacaaggcaaccgttcgcctgctggctaaggtcccaatgctcgcggcttacgcataccgcgcatccaagggcgcaccatacatgtacccagacaactccttgaatgctcgtgagaacttcctgcgcatgatgttcggttacccaaccgagccatacgaggttgacccagtagtagcaaaggcactggataagctgctcattctgcacgcagaccacgagcaaaactgctcaacctccaccgtccgcatgatcggttccgcgcaggctaacatgtttgttgctgttgctggtggcatcaacgccctttccggcccactgcacggtggcgcaaaccaggccgttttggaaatgctcgaagagatcaaggccaacggcggcgacgctaccgactttatgaaccgcgtgaagaacaaggaaaaaggcgttcgcctgatgggcttcggccaccgcgtgtacaagaactacgacccacgtgcagccatcgtgaaggaaaccgcacacgagatcctcgaacacctcggtggtgacgaacttttggatcttgccatgaagctcgaagagatcgcactgagcgacgactacttcgtatcgcgcaagctatacccgaacgtcgacttctacaccggcttgatctaccgcgcaatgggattccccacggacttcttcaccgtcctctttgccatcggtcgtctgccaggctggatcgctcagtaccgcgagcagttggcaaccaccaccaagatcaaccgcccacgtcagatttacaccggagaaaccttgcgaaaggtcactccacgcgagcagcgctaa

SEQ ID NO: 36997 - protein, 435 aa, Corynebacterium diphtheriae NCTC 13129
MKGMLVATENKDKAVLHYPGGEYEMDIIHATEGNDGVVLDKLLSQTGMVTFDPGYVSTGSTESKITYIDGDNGILRHRGYDIADLAENATFNEVSYLLIKGHLPTVDELHKFNNEIRHHTLLDEDFKSQFNIFPRDAHPMSVLASSVNILSTYYQDQLNPLDEEQLDKATVRLLAKVPMLAAYAYRASKGAPYMYPDNSLNARENFLRMMFGYPTEPYEVDPVVAKALDKLLILHADHEQNCSTSTVRMIGSAQANMFVAVAGGINALSGPLHGGANQAVLEMLEEIKANGGDATDFMNRVKNKEKGVRLMGFGHRVYKNYDPRAAIVKETAHEILEHLGGDELLDLAMKLEEIALSDDYFVSRKLYPNVDFYTGLIYRAMGFPTDFFTVLFAIGRLPGWIAQYREQLATTTKINRPRQIYTGETLRKVTPREQR

SEQ ID NO: 36998 - DNA, 1305 bp, Rhodopseudomonas palustris CGA009
  CDS (1)..(1305): transl_table=11
atggacgcaacgaccaacaacaaaacggcaacgctgacggttggaaacaagaacttcgatcttccggtgctcaccgggacagtcggtcccgacgtcatcgacatcggcaagctctacgcgcagaccggaatgttcacctacgatccgggcttcacgtcgacggcgagctgccagtccaaaatcacttacatcgacggcgacgcaggcgttctcgagtatcgcggttacccgattgaacagctcgccgaaaaaggcgacttcctagaaacttgctatctcttgctgtacggcgaactgccgaccaaggcgcagaaggaagatttcgactaccgcgtcacccgccacaacatggttcacgagcagatggcccggttcttccagggcttccgtcgtgacgcgcatccgatggcggtgatggtggcttcggtcggcgcgctcgccgcattctaccacgactccaccgacattaacgatccgacccagcggatggtcgcttcgatccggatgatcgcgaaggtcccgacgctggccgcgatggcctacaagtactcggtcggccagcccttcatctatccgaagaacacgctcagctacgcagcgaacttcctgcggatgtgcttcgcgactccgtgcgaggaatacgtcgtcaatccggtgctggcgaacgcgctcgacaagatcttcacgctgcacgcggaccacgagcagaacgcctcgacctcgaccgtgcgcatcgccggctcgtcgggtgccaatccgttcgcctgtatcgcggcgggtatcgcctgcctgtggggcccggcgcatggcggtgccaacgaagcggcgctggcgatgctgaaggagatcggcaccgtcgagaacatcccggacttcatcgccaaggtgaaggacaagagctcttcggtgcggctgatgggcttcggccaccgcgtctataagaactacgatccgcgcgccaagatcatgcagcaggtctgccacgaagtgctggccgaaaccggccatcacggcgacccgctgctcaaggtggcgatggagctcgagaagatcgcgctcagcgatcagtacttcattgaccgcaagttgtacccgaacgtcgacttctattcgggcatcacgctgaaggcgatgggcttcccgaccgacatgttcaccgtgctgttcgcggtcgcccgcactgtcggctggatcagccagtggagcgagatgatcgaggacccgcagcagaagatcggccgtccgcgccagctcttcaccggtgcgaccacccgcaactacgtcgagatcggcaagcgcggctga

SEQ ID NO: 36999 - protein, 434 aa, Rhodopseudomonas palustris CGA009
MDATTNNKTATLTVGNKNFDLPVLTGTVGPDVIDIGKLYAQTGMFTYDPGFTSTASCQSKITYIDGDAGVLEYRGYPIEQLAEKGDFLETCYLLLYGELPTKAQKEDFDYRVTRHNMVHEQMARFFQGFRRDAHPMAVMVASVGALAAFYHDSTDINDPTQRMVASIRMIAKVPTLAAMAYKYSVGQPFIYPKNTLSYAANFLRMCFATPCEEYVVNPVLANALDKIFTLHADHEQNASTSTVRIAGSSGANPFACIAAGIACLWGPAHGGANEAALAMLKEIGTVENIPDFIAKVKDKSSSVRLMGFGHRVYKNYDPRAKIMQQVCHEVLAETGHHGDPLLKVAMELEKIALSDQYFIDRKLYPNVDFYSGITLKAMGFPTDMFTVLFAVARTVGWISQWSEMIEDPQQKIGRPRQLFTGATTRNYVEIGKRG

SEQ ID NO: 37000 - DNA, 1296 bp, Mycobacterium avium subsp. paratuberculosis K-10
  CDS (1)..(1296): transl_table=11
gtggccgacaccgacgacatcgccactttgaagtacccgggcggggaaaccgacctggagatcgtcagcgccaccgagggcgccgacggcatcgcgctgggttcgctgttgtccaagaccggctacaccaccttcgacaacggctttgtcaacaccgcctcgtgcaagagcgcgatcacctacatcgacggcgacgccggcatcctgcgttaccgcggctacccgatcgagcaactggccgagaagtcgaccttcctcgaggtgagctacctgttgatctacggcgagctgccggacaaggaccagctggccgagttcaccaagcggatccagctgcacaccatgctgcacgaggacctgaagcggttcttcgacggcttccctcgcaacgcccacccgatgccggtgctgtccagtgccgtcaacgcgctgtccgcctactaccccgattcgctggacccgatggacaccgaggacgtcgagctgtccacgatccggttgctggccaagctgccgaccatcgccgcgtacgcctacaagaagtcggtcggccagcccttcctctacccggacaacaagctgagcctggtggagaacttcctgcgcatgacgttcggcctgcccgccgagccgtaccaggccgaccccgaggtggtccgcgcgctggacatgctgctgatcctgcacgccgaccacgaacagaactgctcgacgtcgacggtccggctggtggggtcctcccaggccaacctgttcacctccatctccggcggcatcaacgcgctgtgggggccgctgcacggtggggccaaccaggcggtgctcgagatgctggagaagatccgccaaagcgacgacgacgtcagcgaattcgtgcgcaaggtgaagaaccgcgaggccggggtgaagctgatgggcttcggtcaccgggtgtacaagaactacgacccgcgggcgcgcatcgtcaaggaacaggccgacaagatcctggccaagctcggcggcgacgacgacctgctcgacatcgccaagcaactcgaagaggccgcgctgaccgacgagtacttcatcgagcgcaagctgtaccccaacgtcgacttctacaccggcctgatctaccgggcgctgggcttcccgacccggatgttcaccgtgctgttcgcgctggggcgcctgcccggctggatcgcgcactggcgcgagatgcacgacgagggcgacagcaagatcggccgcccgcgccagatctacaccggctacaccgagcgcgactacgtcaccatcgacgcccgctag

SEQ ID NO: 37001 - protein, 431 aa, Mycobacterium avium subsp. paratuberculosis K-10
MADTDDIATLKYPGGETDLEIVSATEGADGIALGSLLSKTGYTTFDNGFVNTASCKSAITYIDGDAGILRYRGYPIEQLAEKSTFLEVSYLLIYGELPDKDQLAEFTKRIQLHTMLHEDLKRFFDGFPRNAHPMPVLSSAVNALSAYYPDSLDPMDTEDVELSTIRLLAKLPTIAAYAYKKSVGQPFLYPDNKLSLVENFLRMTFGLPAEPYQADPEVVRALDMLLILHADHEQNCSTSTVRLVGSSQANLFTSISGGINALWGPLHGGANQAVLEMLEKIRQSDDDVSEFVRKVKNREAGVKLMGFGHRVYKNYDPRARIVKEQADKILAKLGGDDDLLDIAKQLEEAALTDEYFIERKLYPNVDFYTGLIYRALGFPTRMFTVLFALGRLPGWIAHWREMHDEGDSKIGRPRQIYTGYTERDYVTIDAR

SEQ ID NO: 37002 - DNA, 1251 bp, Wolbachia endosymbiont of Drosophila melanogaster
  CDS (1)..(1251): transl_table=11
atggataaaaaagtgctattagaactaagtaatggattaaaaatcgagctacctgtattaagcggaacaacaggtcctgatgtgttaaatatcaaggatttatataagatgacaggattattcacttacgatccagggtttgtttctacagcttcatgctcttctacaattacattcattgatggagatgaaggagttcttaaatataggggacataatatagctgatttggcagagaataataattttactgctgtgatttatttattgctctatggtgaattacccagttcagagcaacacaaaaaatttcttctcaaaatacaagaatcatccaaagtatcagagcaagttacaaatgtaattaaagcatttccaaaaactgctcaccctatgtcaatcttagttgcatgttttgcaagtttgtcagcatcttatcatgaaaagcatggcaacaatgtcaatggtgaagacctagattttggaatttctgcaatagcgcaagtttccacaattattgcaatgatttataggcatatcaacaatcaggaattcataaatgctaacaatgaattaagttacagtgaaaatttcttaaagatgatatttggcgatgctgttgataatgataaaagcgccctttttgcaaaagctctggataaaatatttactctccatgctgatcatgaacagaatgcttctacggcggctgtcagattggtgggatcggctggttctaatctgtttgcaagcctctctgcaggagttgctacactttggggaccagcacatggtggagctaatgaggcagttataaatatgctaaaagagatagagcaaagtggagatatagataaattcatcgaaaaagctaaagatgataaagatccatttaaattgatgggatttggacatcgtgtttataaaaattatgatccgcgcgcgcgtatattggaaggcgcttgccatgaggttctaagtaaactagaacaaaataatgaactgcttaaaattgcaaaaaaacttgaagaaatagctttaaaggatgaatattttatcgtgcgtaagttatatccaaatgttgatttttactcaggtataataatgaatgctattgatatcccctcaaatatgttcacgcctatttttgcactcgcaagaaccactggttgggttactcagtggtatgaaatgataaatgataaagaaactaagatctgtagaccaaggcaactctattttggtaaataa

SEQ ID NO: 37003 - protein, 416 aa, Wolbachia endosymbiont of Drosophila melanogaster
MDKKVLLELSNGLKIELPVLSGTTGPDVLNIKDLYKMTGLFTYDPGFVSTASCSSTITFIDGDEGVLKYRGHNIADLAENNNFTAVIYLLLYGELPSSEQHKKFLLKIQESSKVSEQVTNVIKAFPKTAHPMSILVACFASLSASYHEKHGNNVNGEDLDFGISAIAQVSTIIAMIYRHINNQEFINANNELSYSENFLKMIFGDAVDNDKSALFAKALDKIFTLHADHEQNASTAAVRLVGSAGSNLFASLSAGVATLWGPAHGGANEAVINMLKEIEQSGDIDKFIEKAKDDKDPFKLMGFGHRVYKNYDPRARILEGACHEVLSKLEQNNELLKIAKKLEEIALKDEYFIVRKLYPNVDFYSGIIMNAIDIPSNMFTPIFALARTTGWVTQWYEMINDKETKICRPRQLYFGK

SEQ ID NO: 37004 - DNA, 1290 bp, Leptospira interrogans serovar Copenhageni str. Fiocruz L1-130
  CDS (1)..(1290): transl_table=11
atggcagaggtagcaattctgaaaatcgatgggaaagaatacgaactcccgatcgtaataggcaccgaaaaagaaaaagcaatcgatatttctaaactccgtcaacagaccggatatgtaaccttggacaacggatatttaaatactggagcctgcacaagcgcggtgacttttttagacggagaactaggtattttaagatacagaggaattccgatcgaacaactcgccgaaaattccacatttactgaagtcgcctatttactgatatacggaaaaattccttcagactcagaattgaaaaaatggaacgacgaacttacgatgcacacgttgatccacgaggatcttaaacgtctttataatggatttccaaaagacggtcacccaatggcgatcatgtcttctatgatcggatctctttccacttattatcaagattcttacgatccggaaaatgcagaacacagacatatttctatgattcgtcttctcgctaagtttcctacaatcgccgcattcgcttataagaaatccattggacaacctacaattcatcctttgaacagtttggattattgcgcaaactttatgaacatgatgttctccgttccaagcgaggattataaaattgatccagaaatcgtaaaagcgttgaacttattattgattcttcatgcggaccacgaacaaaactgttctacgtctacggtgcgtttggtgggatcttctctcgcaaacttatacggcgcgatctctgctggaatttgtgctctttggggacctagacacggaggagccaatcaagaagtattagaaatgttgcaagagattcaggcaagcggtttgcccgtaaaaaaaatcgtagaaaaagcaaaagataaaaatgactctttccgtctttccggattcggtcacagggtctataaaaattttgatccacgtgcaaagatcatcaaaaaggcgtgcgactccgtattaaaaagattaggcgttcaagattctttattagatattgctaaagaactagaagaaacagctcttcatgatccttactttgtggaaagaaaactctatccaaacgtagacttttattccggaattatctaccgagccctcggaattccagtaaatatgtttacggtaatgtttgctatgggacgtcttccaggttggatcgctcagtggaaagaaatgatagaatctccggatatgaaaattggtcgtccaagacaaatctacaccggttctacagaaacttcctacaaagaagccaagaaaaaagcctga

SEQ ID NO: 37005 - protein, 429 aa, Leptospira interrogans serovar Copenhageni str. Fiocruz L1-130
MAEVAILKIDGKEYELPIVIGTEKEKAIDISKLRQQTGYVTLDNGYLNTGACTSAVTFLDGELGILRYRGIPIEQLAENSTFTEVAYLLIYGKIPSDSELKKWNDELTMHTLIHEDLKRLYNGFPKDGHPMAIMSSMIGSLSTYYQDSYDPENAEHRHISMIRLLAKFPTIAAFAYKKSIGQPTIHPLNSLDYCANFMNMMFSVPSEDYKIDPEIVKALNLLLILHADHEQNCSTSTVRLVGSSLANLYGAISAGICALWGPRHGGANQEVLEMLQEIQASGLPVKKIVEKAKDKNDSFRLSGFGHRVYKNFDPRAKIIKKACDSVLKRLGVQDSLLDIAKELEETALHDPYFVERKLYPNVDFYSGIIYRALGIPVNMFTVMFAMGRLPGWIAQWKEMIESPDMKIGRPRQIYTGSTETSYKEAKKKA

SEQ ID NO: 37006 - DNA, 1281 bp, Leptospira interrogans serovar Copenhageni str. Fiocruz L1-130
  CDS (1)..(1281): transl_table=11
atgagtgaattcattgaaatcaaagttggggaaaaatcctatcagtttccattgatctccggaacggacggtaaaaaaggaatcgatattagagaacttcatcaaaaaaccggactaatttcttacgatccgggtttttttaacaccgcctacgctgttagtcgaatctcccgaagagacccgaattcaggtgaactcaactatcgtggttacgacatcgcagatttagtacaacattctacatttgtggaaactagttacttattgatttatggcaaacttccaacggagcagcagcttaaagatttttctctgaaattatctaaacactcattgattcacgaagatatgatcaatctatttgatggatttccgggtaaaggtcatcctctagcggttctgtccgtgatggtaacttctctttccagttattatccagaagaatacgaagaatccttggacaaaggaatcgatcattccgcaagactgctcgcaaagattagaactatcgccgccttttcttacaaaaaaatcgtaggccaacccttcgtatatcctttggacaaacatccttattgtacaaattttctttatatgttattttcaattccttccaaggattatattcccaccgaagacatagatcgaattttaaatcaattatggatactttacgcggatcatgaacaaaacgtatccaatacaaccgttcaagtaattggctctacacaagccaacttattcgcttctatatcttctgcgatcaatgcgctttggggctctagagaaggtggtcgtcaggtcgcggcggtaggattgatagaagacattctcaaatccagaaaatcggtgccggaatattttgaaaaattcaaaggagactcggaaaagttatttggaaacggttttgggcataaggcatacgaggcaaaaagtagaagagcaatcattgcaagtaaactgtttcacgatttttacaaaaaaaatcctattggacctatcgcagaagtagctcttaaaatcgaagaatatatgcaaaatgatgaatattatatcaatcaaaatttgtatccgaatttagagttctacagcgcggtaatttttaattcacttggaataccaaaagaactttttacggctatgcaggtaatcggaaaacttccaggctggttagcgcactggagagaacaaagagtttccggaaattacagtaaggctcgtccaaaacaaatttattctggagaaatgggtagaaaatacattccactttcggaaagataa

SEQ ID NO: 37007 - protein, 426 aa, Leptospira interrogans serovar Copenhageni str. Fiocruz L1-130
MSEFIEIKVGEKSYQFPLISGTDGKKGIDIRELHQKTGLISYDPGFFNTAYAVSRISRRDPNSGELNYRGYDIADLVQHSTFVETSYLLIYGKLPTEQQLKDFSLKLSKHSLIHEDMINLFDGFPGKGHPLAVLSVMVTSLSSYYPEEYEESLDKGIDHSARLLAKIRTIAAFSYKKIVGQPFVYPLDKHPYCTNFLYMLFSIPSKDYIPTEDIDRILNQLWILYADHEQNVSNTTVQVIGSTQANLFASISSAINALWGSREGGRQVAAVGLIEDILKSRKSVPEYFEKFKGDSEKLFGNGFGHKAYEAKSRRAIIASKLFHDFYKKNPIGPIAEVALKIEEYMQNDEYYINQNLYPNLEFYSAVIFNSLGIPKELFTAMQVIGKLPGWLAHWREQRVSGNYSKARPKQIYSGEMGRKYIPLSER

SEQ ID NO: 37008 - DNA, 1134 bp, Thermus thermophilus HB27
  CDS (1)..(1134): transl_table=11
atggaagtggcacgcggtctggaaggcgttctcttcacggaaagccggatgtgctacattgacggccagcaggggaagctctactactacggcatccccatccaggagctggcggagaagagcagctttgaggaaaccaccttcctcctcctccacgggagactgccgcgaaggcaggagctggaggagttctcggccgccctcgcccggcgccgcgccctgcccgcccaccttctggagtccttcaagcgctaccccgtctccgcccaccccatgagcttcctgcgcacggcggtctccgagctcgggatgctggaccccaccgagggggacatctcccgggaggccctctacgagaaggggcttgacctcatcgccaagttcgccaccatcgtggccgccaacaagcgcctcaaggagggcaaggagcccatccctccccgggaggacctctcccacgccgccaacttcctctacatggcgaacggggtggagccctcccccgagcaggcccgcctcatggacgcggccctcatcctccacgccgagcacggcttcaacgccagcaccttcaccgccatcgccgccttctccacggagaccgacctctactcggccatcaccgccgccgtggcctccctgaaggggccgcgccacggcggggccaacgaggccgtgatgcgcatgatccaggagatcggcacccccgagcgggcccgggagtgggtgcgggagaagctggccaagaaggagcgcatcatgggcatgggccaccgggtctacaaggcctttgaccccagggccggggtcctggaaaagctcgcccggttggtggcggagaagcacggccactccaaggagtaccagatcctgaagatcgtggaggaggaggcggggaaggtcctgaaccccaggggcatctaccccaacgtggacttctactccggggtggtctactccgacctgggcttcagcctggagttcttcacccccatcttcgccgtggcccggatctcgggctgggtggggcacatcctggagtaccaggagctggacaaccgcctcctccgccccggggccaagtacatcggggagctggacgtgccctacgtccccctcgaggcccgggagtag

SEQ ID NO: 37009 - protein, 377 aa, Thermus thermophilus HB27
MEVARGLEGVLFTESRMCYIDGQQGKLYYYGIPIQELAEKSSFEETTFLLLHGRLPRRQELEEFSAALARRRALPAHLLESFKRYPVSAHPMSFLRTAVSELGMLDPTEGDISREALYEKGLDLIAKFATIVAANKRLKEGKEPIPPREDLSHAANFLYMANGVEPSPEQARLMDAALILHAEHGFNASTFTAIAAFSTETDLYSAITAAVASLKGPRHGGANEAVMRMIQEIGTPERAREWVREKLAKKERIMGMGHRVYKAFDPRAGVLEKLARLVAEKHGHSKEYQILKIVEEEAGKVLNPRGIYPNVDFYSGVVYSDLGFSLEFFTPIFAVARISGWVGHILEYQELDNRLLRPGAKYIGELDVPYVPLEARE

SEQ ID NO: 37010 - DNA, 1122 bp, Picrophilus torridus DSM 9790
  CDS (1)..(1122): transl_table=11
atgagtataagtcttggtcttgaggacgttttcataaagtacacatcattaacatcgatagatggtgaaaagggggagctcaggtacaggggttatgatataaaagatctcgttgaacactgctcctttgaggaggttgcctatctaatgttttacggcgagcttccaaaaagagacgagctagaacactttaaaagcaatgtaatgaagaattataaaattcctgaaaatgtaaaaaacatcataaaaaacatgccaagggatggcgatgcccttgcaatcatggaggcagccttcgccgcattgagcaccgaggaatacacatgggaaaaggaaagggatcgtgaaaaggccgcagagattatgggccgcgcccttggaattgtctcggctgtctttaggtacagggacggaagggaaataaaggatcctgagaataagggttatgccgaggcatttcttaatgcatgctttgattcaggcatagatgaggataaaataaaggcaatgaacgcggcattgatactttacatagatcatgaggtaccggcatcaaccacggcagcacttgttgcatcatcaacgttatctgatatgtactcatgtgttacagcagcaatagctgcactgaagggaccgcttcacggaggggcggcagaggctgcctataagcagttccttgcaataaaatctcctgaaaacgttgattcatggttcaatgaaaatatattaaacaataaaaagagattaatgggctttggccacagggtttataaaacatacgatccaaggatgttaatcttcaaggagcttgcaaggaaaaatgcaaaaaccgatgaacagaaaaaaatacttgagcttgcagagaggcttgaggctctgggcgttaagaactttggccagaaaaagatctttccaaacactgattactattcaggcatagtctttaatgagataggctttccattatacatgttcacaacgctcttcgcactttcaagggttgttggctgggttgcacacatatcagagtacgttgagagcgaggagagattaataaggccaagggcaatatatataggacctgagaagagagatgttgtaccaatagataaaagataa

SEQ ID NO: 37011 - protein, 373 aa, Picrophilus torridus DSM 9790
MSISLGLEDVFIKYTSLTSIDGEKGELRYRGYDIKDLVEHCSFEEVAYLMFYGELPKRDELEHFKSNVMKNYKIPENVKNIIKNMPRDGDALAIMEAAFAALSTEEYTWEKERDREKAAEIMGRALGIVSAVFRYRDGREIKDPENKGYAEAFLNACFDSGIDEDKIKAMNAALILYIDHEVPASTTAALVASSTLSDMYSCVTAAIAALKGPLHGGAAEAAYKQFLAIKSPENVDSWFNENILNNKKRLMGFGHRVYKTYDPRMLIFKELARKNAKTDEQKKILELAERLEALGVKNFGQKKIFPNTDYYSGIVFNEIGFPLYMFTTLFALSRVVGWVAHISEYVESEERLIRPRAIYIGPEKRDVVPIDKR

SEQ ID NO: 37012 - DNA, 1275 bp, Acinetobacter sp. ADP1
  CDS (1)..(1275): transl_table=11
atgtctgaagcaactggcaagaaagccgtattaaagcttgatggcaaagaaattgaattaccaatttacagcggcacattgggcccagatgtaattgacgttaaggatgtattggctgcaggtcattttacttttgatcctggtttcatggcgaccgcttcatgtgaatcgaagattacattcattgacggaaacgaaggtgtgttattacaccgcggttacccaattgatcagcttgcaactcaagcagattatttggaaacttgctatttgttattaaatggtgaacttcctacgccagagcaaaaacaagaatttgatgctaaagttcgtaaccacaccatggttcacgatcaagttagccgtttcttcaatggtttccgtcgtgatgcgcaccctatggcaatcatggtgggtgtagtcggtgctttatctgcgttttatcacaaccagttaaacattgaagatgtcaatcatcgtgaaattactgcaattcgtttgattgcaaaaattccaacgcttgctgcttggagttataaatacactgtcggccaaccgttcatttaccctcgtaatgatcttggttatgcagaaaacttcctgcacatgatgtttgcaaccccagcagaccgtgattacaaagttaatccaattcttgctaaggcaatggatcgtattttcacgcttcatgcagatcatgaacaaaatgcttcaacatctacagtccgtttggctggttcaaccggtgcgaatccgtatgcgtgtatcgcagcaggtatttctgcactttggggccctgctcatggtggtgcaaacgaagctgttctgaaaatgcttgatgaaattggcactgttgagaacgttgctggtttcatggaaaaagtgaaaaccaaagaagttaaactcatgggctttggtcaccgtgtgtataaaaacttcgatccacgcgcgaaagtcatgaaagaaacatgtgatgaagttcttgccgcactcggcattaacgatccacaacttgaacttgcgatggaacttgagcgcattgcgttgtctgatgaatacttcatcaagcgtaatttgtatccaaacgtagacttctattcaggtatcattcttaaagcgattggtattccaacagaaatgtttacagtgatctttgcacttgcacgtactgtgggctggatcagccactggttagaaatgcacagtgctccgtacaaaattggtcgtcctcgtcagctttacactggcgaaaccaaacgcgacattaaacgttaa

SEQ ID NO: 37013 - protein, 424 aa, Acinetobacter sp. ADP1
MSEATGKKAVLKLDGKEIELPIYSGTLGPDVIDVKDVLAAGHFTFDPGFMATASCESKITFIDGNEGVLLHRGYPIDQLATQADYLETCYLLLNGELPTPEQKQEFDAKVRNHTMVHDQVSRFFNGFRRDAHPMAIMVGVVGALSAFYHNQLNIEDVNHREITAIRLIAKIPTLAAWSYKYTVGQPFIYPRNDLGYAENFLHMMFATPADRDYKVNPILAKAMDRIFTLHADHEQNASTSTVRLAGSTGANPYACIAAGISALWGPAHGGANEAVLKMLDEIGTVENVAGFMEKVKTKEVKLMGFGHRVYKNFDPRAKVMKETCDEVLAALGINDPQLELAMELERIALSDEYFIKRNLYPNVDFYSGIILKAIGIPTEMFTVIFALARTVGWISHWLEMHSAPYKIGRPRQLYTGETKRDIKR

SEQ ID NO: 37014 - DNA, 1287 bp, Erwinia carotovora subsp. atroseptica SCRI1043
  CDS (1)..(1287): transl_table=11
atggctgataaaaaagcaacacttactctagagggtaaagatccaattgagctaaatgtcctatctggcacattggggtatgatgagattgatattcgtcccctcggttctaaaggttacttcacatttgaccccggctttacctcaaccgcatcttgcgaatccaagattacctatatcgacggcgacgaaggcatcctactgcaccgtggcttcccaattgcccaactggctgaaaaatctaattatcttgaagtttgttacatcctgctgttcggcgagcccccgacggcagaacaatatgaaacctttaagacaaccgttactcgccacacgatgatccatgagcagattacccgtctgttccacggtttccgtcgtgattcacatccaatggccgtcttatgtggcgtcaccggtgcactggcagcgttctaccacgattcattggacattagcattgagcgccaccgcgaaattgcggcctaccgcctgctgtccaaaatgccaaccgttgcggcgatgtgctacaaatattcactgggccagccgtttgtttatccgaaaaacaacctgtcctacgcgggtaatttcctgcatatgatgttctccactccttgtgaagaatatgttgtgaatccggtgctagaacgggcgatggaccgtattctgatcctgcatgccgatcacgaacaaaacgcctcgacttctaccgtgcgtaccgcgggttcgtctggtgcaaacccgtttgcctgtatcgccgcggggatcgcctcgctgtggggaccggcacacggcggcgcgaacgaagcctgtctacgtatgctggaagaaatcagcagcgtggaacacatcccggcgtttatcgagcgtgcaaaagacaagaacgactccttccgcctgatgggcttcggtcaccgtgtgtacaaaaaccacgatccgcgcgccacagtcatgcgtgaaacctgccatgaagtgctgaaagagctgggcagaaaagatgatctgctggaagtggcgatggagctagaacatatcgcgctgaacgacccgtacttcattgagaagaaactgtacccgaacgtggacttctactcaggtatcatcctgaaagcaatggggattccgtcttccatgtttaccgtcatcttcgcgatggcgcgtaccgtgggctggattgcgcactggagcgaaatgcacgccgacggcattaaaattgcccgtccacgtcagctgtacaccggctacgacaaacgtgactttgcgtccaatctgaaacacgattaa

SEQ ID NO: 37015 - protein, 428 aa, Erwinia carotovora subsp. atroseptica SCRI1043
MADKKATLTLEGKDPIELNVLSGTLGYDEIDIRPLGSKGYFTFDPGFTSTASCESKITYIDGDEGILLHRGFPIAQLAEKSNYLEVCYILLFGEPPTAEQYETFKTTVTRHTMIHEQITRLFHGFRRDSHPMAVLCGVTGALAAFYHDSLDISIERHREIAAYRLLSKMPTVAAMCYKYSLGQPFVYPKNNLSYAGNFLHMMFSTPCEEYVVNPVLERAMDRILILHADHEQNASTSTVRTAGSSGANPFACIAAGIASLWGPAHGGANEACLRMLEEISSVEHIPAFIERAKDKNDSFRLMGFGHRVYKNHDPRATVMRETCHEVLKELGRKDDLLEVAMELEHIALNDPYFIEKKLYPNVDFYSGIILKAMGIPSSMFTVIFAMARTVGWIAHWSEMHADGIKIARPRQLYTGYDKRDFASNLKHD

SEQ ID NO: 37016 - DNA, 1284 bp, Erwinia carotovora subsp. atroseptica SCRI1043
  CDS (1)..(1284): transl_table=11
atgacagtcagaacatccacgttgacggcagaagggcaggcgagtattgcgctggaaatgcgttccggcgtactggggaaaacggctgtggatattcgcccactcggcgagcatgggctatgcagctatgaccccggttttgctaacacggcagggtgtgagtcggcgattacctacattgatgcagcgaatagcgtgttgctgcatcggggcttccctgtcgaacagcttgccgagcagtgcgactttactgaggtttgttacattctgctgcacggcgacgccccttcaccggaggcgtatgcgaaatttgctgacaacattacccgacatacgctggttcatgagcagattacccggatgttcagcggttttcgtcgcgattcccacccaatggcgctgatgtgcgcggtggtcggtgcgctggccgcgttctatcacgatgtcttggatatcaataacgcggaacaccgcgagctggcggcggtacggctgctgtcgaaaatgccgacgctggcggcgatgtgctacaaatactccgtcgaacagccgtctgtgtatccccgaaattctctctcctataccggcaacttcctacacatgctgttttcgattccggcagagaagtatgaagttaatccggtgttggaacgggcgatgaaccgcatcctgattctgcatgccgatcatggtcaatgcccatcaaccatggcggtcagagcgtctggttcttccggcgcgaacccgtttgcctgtattgcggctgggctggcgtcgatgtgggggccgttgcacggtggggcgaatgaagcctgcatgcgcatgctggaagagattaaaacggtcgaccgcgttcctgaatttgtacggcgtgcgaaagaccgctgtgattcattccgcctgatggggtttggtaactctgtctaccagcatttcgatccacgtgcggcgattctgcgtaaaacctgttacgaggtgctcaacgaattaggcatggaggacagcctgttgcaggtggcgatggagctggaacatatcgctatgaccgatgcctattttctggagaataaactctaccctagtgtcgatttctatacctccgtcattctgaaagcgatggggctgccgtcatcaatgtttaccgtcatctctaccgtcggcaggacgattggctggattgcgcattgggatgaaatgcacaaacagcaggaaatcagcatctatcgcccacggcaaatttataccgggcagccgcagcgggactatgtttctctgaagggataa

SEQ ID NO: 37017 - protein, 427 aa, Erwinia carotovora subsp. atroseptica SCRI1043
MTVRTSTLTAEGQASIALEMRSGVLGKTAVDIRPLGEHGLCSYDPGFANTAGCESAITYIDAANSVLLHRGFPVEQLAEQCDFTEVCYILLHGDAPSPEAYAKFADNITRHTLVHEQITRMFSGFRRDSHPMALMCAVVGALAAFYHDVLDINNAEHRELAAVRLLSKMPTLAAMCYKYSVEQPSVYPRNSLSYTGNFLHMLFSIPAEKYEVNPVLERAMNRILILHADHGQCPSTMAVRASGSSGANPFACIAAGLASMWGPLHGGANEACMRMLEEIKTVDRVPEFVRRAKDRCDSFRLMGFGNSVYQHFDPRAAILRKTCYEVLNELGMEDSLLQVAMELEHIAMTDAYFLENKLYPSVDFYTSVILKAMGLPSSMFTVISTVGRTIGWIAHWDEMHKQQEISIYRPRQIYTGQPQRDYVSLKG

SEQ ID NO: 37018 - DNA, 1287 bp, Propionibacterium acnes KPA171202
  CDS (1)..(1287): transl_table=11
atgggttcgagtgcaaggttcgtcgacgaagacactcacctcgatttcagcaaggttgtcgctactgacggccaggtgggttacgacgtcgcgggtctgctcaacaagaccggcaacgtcatgatcgacccgggattcgtcaacacggcatcctgcgagtcacagatcacctacattgacggtgagcagggagttttgcgttaccgcggctacccgattgagcagctcgctgaacagtcgaccttccttgagaccgcctaccttgtcctctatggggaactgccaagcaaggcccaattggacggcttcgaggagcgtattcgtcgcactaccctcatcgacgagcggatgcgtgacctcttccgatgcttcccccgtcggtcccacccgatgcctgtgttggctgcgggcatcatggccctgtcgaccttctcacagaaatcctccggcactgatcccgaccaaatcgaggcggccaccactcgcctcatcgccaaggtccccaccctggccgccttcggctacaagaactcgatgggccagccgaccctctaccccgataactccctgagctacgtccagaacttcatccggatgagcttcggcttcccgactgaaccctacgagttcaatgacgaaatcacccgcgctctggaaaccctgctcatcctgcacgttgatcacgagcagaactgttcaacctcgacggtccgtatggtcgcgtcgtcgggtgccaacatgtacgcggcggttgccgcaggcgtcaacgccctgtccggcccgaagcacggtggcgcaaaccaggccgtcctcgaaatgctgcaatttattcgcgactccggcatgaccactaaggagttcgtccgtaaggtcaaggacaaagaatccgacatcaagctgatgggctttggccaccggatctacaagaactacgatccacgcgccgccatcatcaagaaacatgccgaccgcattatggaactccataccggtcgtgaggaccttctcgagatcgccaaggaacttgaagagaccgcgctaaacgatgactacttcaaggagcgcaagctctacccgaacgttgatttctataccggcctcatctacgaggccatgggcttcccgatgaatatgttcaccgtgctgttcgcactgggacgtctgcccgggtggatcgcccagtaccgagagcaagttgccagcggaggcaacaagatttggcgtccgcgtcagatcttcaccgggtctgacaagcgagattacgtaccactcaacaagcgtgcctga

SEQ ID NO: 37019 - protein, 428 aa, Propionibacterium acnes KPA171202
MGSSARFVDEDTHLDFSKVVATDGQVGYDVAGLLNKTGNVMIDPGFVNTASCESQITYIDGEQGVLRYRGYPIEQLAEQSTFLETAYLVLYGELPSKAQLDGFEERIRRTTLIDERMRDLFRCFPRRSHPMPVLAAGIMALSTFSQKSSGTDPDQIEAATTRLIAKVPTLAAFGYKNSMGQPTLYPDNSLSYVQNFIRMSFGFPTEPYEFNDEITRALETLLILHVDHEQNCSTSTVRMVASSGANMYAAVAAGVNALSGPKHGGANQAVLEMLQFIRDSGMTTKEFVRKVKDKESDIKLMGFGHRIYKNYDPRAAIIKKHADRIMELHTGREDLLEIAKELEETALNDDYFKERKLYPNVDFYTGLIYEAMGFPMNMFTVLFALGRLPGWIAQYREQVASGGNKIWRPRQIFTGSDKRDYVPLNKRA

SEQ ID NO: 37020 - DNA, 1278 bp, Leifsonia xyli subsp. xyli str. CTCB07
  CDS (1)..(1278): transl_table=11
atgccgaccgcgtccctgacctacccgggcggtgtggccgagttcccgatgctgccgagcagtcagggacccggcagcatcgacctctccagcttcacccgccagaccgggctgaccagtctggactacggctttgtcaacaccgccgccactcgctcctcgatcacttacatcgacggcgacgccgggattctgcgctaccgcggttacccgatcgagcagctggccgggaactccaccttcctcgaggtggcttggttgctcatccacggtgagctgcccagtgcctcggagctcgcggacttcgacgcgcgcatccgtcgtcacacgctcctccacgaggatctgcgccgcttcttcagcgcgctcccgcacgacgcgcacccgatgtcggtgctctccagcgcggtctccgcgctgtcgaccttctaccaggactcgctgagcgtccacgacccggagcaggtggagctctccaccgtccgcctcctggcgaaattgccggtcatcgcggcctacgcccacaagaagagcattggtcaggcgttcctctacccggacaattcgctgagcttcgtggacaacttcctccgcctcaacttcggtacgctggccgagccgtacgaggtggacccggtgctctcccgtgcgctggagcgtctgctcatcctgcacgaggaccacgagcagaacgcctccacgtcgacggtccgcctcgtcggctcgacccaggccaatctgttcgcctcggtctccgccggcatcaacgccctctacggtccgcttcacggcggcgccaatgaggctgtgctgcagatgctcgccggcatccgcgactcgggcgagggcgttcagaagttcgtcgagcgtgtcaagaacaaggagtccggcgtcaagctcatgggcttcggccaccgcgtctacaagaacttcgacccccgggccaggctcgtcaagcagtccgcggacgaggttctctccgctctgggcgtccacgacccgcttctcgacatcgccaaggagctcgaggaagtcgctctcgccgaccagtatttcatagaccgcaagctctacccgaatgtggacttctacaccggcgtcatctacaaggcgatgggcttcccgactcggatgttcacggtgctcttcgccatcggccgcctccccggctggatcgcccactggcgtgagatgatgctcgacccgggcaccaagatcggccgcccccagcagctttacgtgggttcccccgaacgcagctggccgtcctcccgctga

SEQ ID NO: 37021 - protein, 425 aa, Leifsonia xyli subsp. xyli str. CTCB07
MPTASLTYPGGVAEFPMLPSSQGPGSIDLSSFTRQTGLTSLDYGFVNTAATRSSITYIDGDAGILRYRGYPIEQLAGNSTFLEVAWLLIHGELPSASELADFDARIRRHTLLHEDLRRFFSALPHDAHPMSVLSSAVSALSTFYQDSLSVHDPEQVELSTVRLLAKLPVIAAYAHKKSIGQAFLYPDNSLSFVDNFLRLNFGTLAEPYEVDPVLSRALERLLILHEDHEQNASTSTVRLVGSTQANLFASVSAGINALYGPLHGGANEAVLQMLAGIRDSGEGVQKFVERVKNKESGVKLMGFGHRVYKNFDPRARLVKQSADEVLSALGVHDPLLDIAKELEEVALADQYFIDRKLYPNVDFYTGVIYKAMGFPTRMFTVLFAIGRLPGWIAHWREMMLDPGTKIGRPQQLYVGSPERSWPSSR

SEQ ID NO: 37022 - DNA, 1287 bp, Desulfotalea psychrophila LSv54
  CDS (1)..(1287): transl_table=11
atgagtgaaaaagcaaccctgactgttggcggtgcaagttatgaacttgatgttaccagtggaacggaggatgagaggtgtattgatattcaatcgttacgtgctaaatcgggctatatcaccatggatccaggctttggcagtactggtgcctgcttctctgatatcacatatgttgatggtgagagaggaatcctgcgttatcgtggctaccctattgagcagatagcggagagggcaagttttgtggagacatgctcgctgattatctatggtgaacttcccgatgcagaaaccctgaacaggtttcgcagggccctggcagaacatgcgccactgcacacaagcctctatcactacttttccggatttcccgaatcgtcgcctcccatggcgattctctcggcaatgcttaacctggtctcctgtttccaccccggtgttctggaggtacactcagaggggcatggctttgatcgaactgccgccctcctcctgtccaaggttcgaaccatagcagcctggtcctatcggatgtctgtcggcaaaccctttaatcagccaaacccccatctcacttactgtgcaaattttctgcatatgatgttttccgagccctttcaagaatatatccccagtccagctgtcgaaagggctttggcacttttcctgatactccatgccgatcatgagcagaactgctcgacctcaacggtgagaacagtggccagttccagggcgaacctgtttagttccgtcgcctcaggggtatgtgccctttggggacccctgcatggtggtgccaatgcagccgtgatagagatgctggaagagattatggcctcgggccggaagattgactattatatcaacagggcaaaggataaaagtaacgattacaaactgatgggctttggccatcgggtctataaaaattttgatccccgggccagcatcctcaagaagagggtttatgaggtacttgcagagctgcacaaatccgatcctctgcttgatattgccctggagcttgaggagaaaaccctgaaagatgagtactttatcagtcgtaaactctaccctaatgtcgatttctatagcggcattcttctcagggcaataggaattcctccggagatgtacacggtgatgtttgccattggtagaatgcccggctggatagcaaattggcgggaactgcatgaccagaacctccgtattacccggccacgtcaggtctatacggggaggcaggagagatcctttgtcccccttgaagagaggtaa

SEQ ID NO: 37023 - protein, 428 aa, Desulfotalea psychrophila LSv54
MSEKATLTVGGASYELDVTSGTEDERCIDIQSLRAKSGYITMDPGFGSTGACFSDITYVDGERGILRYRGYPIEQIAERASFVETCSLIIYGELPDAETLNRFRRALAEHAPLHTSLYHYFSGFPESSPPMAILSAMLNLVSCFHPGVLEVHSEGHGFDRTAALLLSKVRTIAAWSYRMSVGKPFNQPNPHLTYCANFLHMMFSEPFQEYIPSPAVERALALFLILHADHEQNCSTSTVRTVASSRANLFSSVASGVCALWGPLHGGANAAVIEMLEEIMASGRKIDYYINRAKDKSNDYKLMGFGHRVYKNFDPRASILKKRVYEVLAELHKSDPLLDIALELEEKTLKDEYFISRKLYPNVDFYSGILLRAIGIPPEMYTVMFAIGRMPGWIANWRELHDQNLRITRPRQVYTGRQERSFVPLEER

SEQ ID NO: 37024 - DNA, 1293 bp, Desulfotalea psychrophila LSv54
  CDS (1)..(1293): transl_table=11
atgtccgaaaaatttgcaacactcagcctcgacggcaaacaatactcactccccatcatcgaatcaaccaccggcgagaaagccattgatatccgatcgctgctcaaggatacggggcatataacccttgataggggctttatgaacaccgcatcctgcttcagcagcattacctaccttgatggagacaagggcattctcaactaccgaggatactccattgaagacctcgccgccaactgcagctttgtcgaggtctcctatctcattctccacggtgagttgccaaattaccaggagcttgaacactttcgccacgacatgaaccgttttgccctgctccacgaagatatgatccacttctttgatcactttccgccaaacgcctcccccatgtccatcctctccaccaccatcaactccctgcataatttttaccctgagatgaccgccaaaactgatccctacgggggcatcagcgtcaccaccgcccgactcctggccaaggttcgaaccatcgccgccttctcctataagaagagtaatggctacccccttgtctaccccagtcacaagttaaattactgtgaaaatttcctcaatatgatgtttgatcgtcccaatataccctacgagatcaaaccagaggtaaccgctgccctcaacaaactactcatcctccatgcggaccatgagcagaactgctcaaccagcaccgttcgactggtgggaagcgctcaggtaaatctctatgcatcaatttcggcaggagtaagtgccctttggggacctcttcatggaggagccaaccaggcagtcattgaaatgctcgaagagattcatgagagtggcgatgactataactactatatagaaaaggcaaaggacaagaacgaccccttccgactagcaggctttggtcaccgcgtctacaagacctttgaccctcgcgcccggataataaaggaggcctgccacgagatgctggcaagcatgaatgtccatgaccctctgttggatatagcctttgaattggaagagagggtgctcagagacgactactttatcagccgcaacctctatcccaatgtcgatttttatagcggcattatctaccgggcaatgggaattcccaccgatatgtttaccgtcatgttcgcactcggacgactaccgggatggattgcccaatggacagagatgcacgcagacccgaataccaagataggtcgacctcgccaaatatacacaggatacaagcaacgtgcttttgtacccatgtacgaaagataa

SEQ ID NO: 37025 - protein, 430 aa, Desulfotalea psychrophila LSv54
MSEKFATLSLDGKQYSLPIIESTTGEKAIDIRSLLKDTGHITLDRGFMNTASCFSSITYLDGDKGILNYRGYSIEDLAANCSFVEVSYLILHGELPNYQELEHFRHDMNRFALLHEDMIHFFDHFPPNASPMSILSTTINSLHNFYPEMTAKTDPYGGISVTTARLLAKVRTIAAFSYKKSNGYPLVYPSHKLNYCENFLNMMFDRPNIPYEIKPEVTAALNKLLILHADHEQNCSTSTVRLVGSAQVNLYASISAGVSALWGPLHGGANQAVIEMLEEIHESGDDYNYYIEKAKDKNDPFRLAGFGHRVYKTFDPRARIIKEACHEMLASMNVHDPLLDIAFELEERVLRDDYFISRNLYPNVDFYSGIIYRAMGIPTDMFTVMFALGRLPGWIAQWTEMHADPNTKIGRPRQIYTGYKQRAFVPMYER

SEQ ID NO: 37026 - DNA, 1281 bp, Yersinia pseudotuberculosis IP 32953
  CDS (1)..(1281): transl_table=11
atggctgacaaaaaagcgacgctgaatttaggcgaagctgcgatcgaactgggtgtcctatccccaaccctcggcactgacgtgatcgacgtccgcaccttaggttctaaaggttattttacctttgaccccggttttacctctaccgcatcctgcgaatcaaaaatcacctatattgatggtgatcagggtattttgctgcaccgtggcttcccgattgcccagttggcaaaagattctacttatctggaagtttgttacattctgctgtacggcgaaacacctacgccagaagagtacaaaacgttcaaaaccacagtgacccgacataccatgatccacgagcagatcacccgtctgttccatggtttccgccgcgattcacatccgatggccgtgctatgtggggttactggtgcgctagccgccttctaccatgatgctctggatgttaataacgagcgccatcgtgaaattaccgccttccgtctgttgtctaaaatgccgactgtcgcagcgatgtgttataaatattcactgggtcaaccgtttgtttatccacgtaacgatctgtcctacgcgggtaacttcctacacatgatgttctctacgccatgtgagaaatatgaagttaacccagtactggaacgcgctatggatcgtattctcatcctgcacgcagatcacgaacagaacgcgtcaacatcgaccgtccgtactgccggctcttctggcgctaacccgtttgcctgtatcgccgcggggatcgcatccctgtggggccctgcgcacggtggtgccaatgaagcctgcctgaagatgttggaagagattaaaactgttgagcatatccctgaatttatccgccgcgcgaaagataagaatgactcattccgtctgatgggttttggtcaccgtgtctataaaaactatgaccctcgtgccaccgtcatgcgtgaaacctgtcatgaagtgttagaagagctgaagctgaataacagcttgttagaagtggcgatggagttggaaaacatcgcactgaacgatccttacttcattgagaaaaaactgtatccaaacgtggacttctattcaggtattatcctgaaagccatggggattccatcgtcaatgtttacggtgatattcgccattgcccgaaccatcggttggattgctcactggaacgaaatgcataatgacggcatcaagattgcccgtccgcgccagctttatactggctatacagaacgtgatttccagagccaattgaaaaaataa

SEQ ID NO: 37027 - protein, 426 aa, Yersinia pseudotuberculosis IP 32953
MADKKATLNLGEAAIELGVLSPTLGTDVIDVRTLGSKGYFTFDPGFTSTASCESKITYIDGDQGILLHRGFPIAQLAKDSTYLEVCYILLYGETPTPEEYKTFKTTVTRHTMIHEQITRLFHGFRRDSHPMAVLCGVTGALAAFYHDALDVNNERHREITAFRLLSKMPTVAAMCYKYSLGQPFVYPRNDLSYAGNFLHMMFSTPCEKYEVNPVLERAMDRILILHADHEQNASTSTVRTAGSSGANPFACIAAGIASLWGPAHGGANEACLKMLEEIKTVEHIPEFIRRAKDKNDSFRLMGFGHRVYKNYDPRATVMRETCHEVLEELKLNNSLLEVAMELENIALNDPYFIEKKLYPNVDFYSGIILKAMGIPSSMFTVIFAIARTIGWIAHWNEMHNDGIKIARPRQLYTGYTERDFQSQLKK

SEQ ID NO: 37028 - DNA, 1284 bp, Mannheimia succiniciproducens MBEL55E
  CDS (1)..(1284): transl_table=11
atggccgacaaaaaagcaacactgacggtggatggaaaaaattatgaatttgatattgttaaaggttcattaggatatgaatccattgatattcacggtttaagccaaaacaaactttttatgtacgacccgggacttgtttcgactgccgtatgtgaatccgctatcacttatgtggacggcgatgaggggatgctgctttatcgtggttatcctatcgatcagctagcctctaacgccgattatcttgaagtcagttatttattactgtttggtgaacgacctaccaagcagcaatatcaggatttttccaaattggttaaacgtcacactctggtgcacgaacaattgaccaaattcttccaaggattccgtcgagattcacatccgatggcggtaatgtgcggggtaagcggcgcattggcggcattctatcacgattctattgatgttaaaaaagaagaacaccgggaattgacggcaattcgtttattggcaaaaattccgaccctggcggcgatgtgttataaatattcaatcggtcagccgtttatgttcccgcaaaataacctgtcttatgcgggaaactttctgtatatgatgtttgccaccccttgcgagccttatgtggtgaatccggtattggaacgcgcattggataaaatctttattttgcacgcggatcacgagcaaaacgcctcaacttcaacggtgcggattgccgcatcttcaggcgctaacccgtttgcctgtatcgccgccggtatcgcttcgctttgggggccgtctcatggcggcgctaacgaagcctgtattaatatgctggaagaaataggtacggtggatagaattccggaatttattgcccgggcaaaagataaaaacgacccgttccgcttaatgggctttggtcaccgcgtatataaaaactacgatccgcgagcgaaagtcatgcgtgaaacctgccatgaagtattgaaagaactgaatattaaaaatccgttgttcgatgttgccagcgagttggaacgcattgctttaagcgatccgtattttatcgatcataaattgtatcctaatgtggatttttattccggtatcgtcttaaaagccatcggtattccgacttccatgtttaccgtgatgttcgccttggcgagaactgtgggttggattgctcactggaaagaaatgtataaacaaggaaactttaaaattgcccgccctcgtcaaatttacacgggttacacggaacgcgattttcctgcgattgataaggattaa

SEQ ID NO: 37029 - protein, 427 aa, Mannheimia succiniciproducens MBEL55E
MADKKATLTVDGKNYEFDIVKGSLGYESIDIHGLSQNKLFMYDPGLVSTAVCESAITYVDGDEGMLLYRGYPIDQLASNADYLEVSYLLLFGERPTKQQYQDFSKLVKRHTLVHEQLTKFFQGFRRDSHPMAVMCGVSGALAAFYHDSIDVKKEEHRELTAIRLLAKIPTLAAMCYKYSIGQPFMFPQNNLSYAGNFLYMMFATPCEPYVVNPVLERALDKIFILHADHEQNASTSTVRIAASSGANPFACIAAGIASLWGPSHGGANEACINMLEEIGTVDRIPEFIARAKDKNDPFRLMGFGHRVYKNYDPRAKVMRETCHEVLKELNIKNPLFDVASELERIALSDPYFIDHKLYPNVDFYSGIVLKAIGIPTSMFTVMFALARTVGWIAHWKEMYKQGNFKIARPRQIYTGYTERDFPAIDKD

SEQ ID NO: 37030 - DNA, 1272 bp, Legionella pneumophila subsp. pneumophila str. Philadelphia 1
  CDS (1)..(1272): transl_table=11
atgactcaaaagacagcgaaactcagcatcgatgggcaagagacgattgatttaccaatctatactcccaccctaggtaatgatgtgattgatattacccagcttggttcacatggcgtctttacctttgatcaaggttttttatcaactgcctcctgtgaatcaaaaatcacctatattgatggggataaaggcattttgttgtataggggttatcctatagaacaattggcagaaaaaaaggacttccttgatgtaagttatttattactcaatggagaactacctaacaaagaagaaaagaaagctttcgttagtctgatcaacaatcatactatggttcatcagcaaatgtaccagtttttgaatgggttcagacgtgacgctcacccaatggctataatggttggaattgtgggggctttgtctgctttttatcatgaatccatggatttgaataacgcacaagaccgttttatttccgcaatcagactggttgctaaaatgcctactttagctgcgatgagctataaatactccattggcatgccttatatgtatcctaaaaataaaatgtcttatgcagagaactttctccatatgatgtttggtgttccatctgaagatactacgccagatcctgtactggtaagggctatggatactatttttattctccatgccgatcatgagcaaaatgcctctacatcgacggtacgtctggccggttctaccggagctaatccctttgcttgcatttcagccggtataggggctttatggggaccagctcatggtggagcgaatgaagcctgcttaaatatgctaaaagaaataggcgatgtgagtcgcatcgatcattacattaaacgagctaaagataaaaatgatccattccgcttgatggggtttgggcacagggtctataaaagctatgatccaagagctaaagtaatgcgtaagacctgttatgatgtactagaagcggtaggagccaaagacgcacctttattcaaattggcaatggagcttgaacgtatagctcttgaagatgaatatttcattgagaaaaaactctaccccaatgtagacttttactcaggactgactttaagtgctattggaataccaaccaatatgttcacagtgatatttgctctggcccgcactgttggatggatgagtcattggatggaaatggtagccaccaagtcacgcattggcagacctcgccaattgtatactggtgaaaaaattcgtgacgtaaaataa

SEQ ID NO: 37031 - protein, 423 aa, Legionella pneumophila subsp. pneumophila str. Philadelphia 1
MTQKTAKLSIDGQETIDLPIYTPTLGNDVIDITQLGSHGVFTFDQGFLSTASCESKITYIDGDKGILLYRGYPIEQLAEKKDFLDVSYLLLNGELPNKEEKKAFVSLINNHTMVHQQMYQFLNGFRRDAHPMAIMVGIVGALSAFYHESMDLNNAQDRFISAIRLVAKMPTLAAMSYKYSIGMPYMYPKNKMSYAENFLHMMFGVPSEDTTPDPVLVRAMDTIFILHADHEQNASTSTVRLAGSTGANPFACISAGIGALWGPAHGGANEACLNMLKEIGDVSRIDHYIKRAKDKNDPFRLMGFGHRVYKSYDPRAKVMRKTCYDVLEAVGAKDAPLFKLAMELERIALEDEYFIEKKLYPNVDFYSGLTLSAIGIPTNMFTVIFALARTVGWMSHWMEMVATKSRIGRPRQLYTGEKIRDVK

SEQ ID NO: 37032 - DNA, 1302 bp, Burkholderia mallei ATCC 23344
  CDS (1)..(1302): transl_table=11
atgaccccgtctgatgttaaagccacgctatcgttcagcgataattcgccgagcgtcgaactgccgatctacaagggtacgatgggccccgacgtgatcgatatccgcaagctgtacggccagaccggcaagttcacgtacgacccgggcttcatgtcgacggcgtcgtgcaactcggcgatcacgtacatcgacggcgacaagggcgaactgctgtaccgcggctacccgatcgacaatctcgcgcaaaacgcggacttcctcgaatcctgctatctgctgctcaagggcgaactgccgaacgcggcgcagaagaaggagttcgtggccaccgtcacgaagcacacgatggtgcacgagcagatgcagttcttcttccggggtttccgccgcgacgcgcacccgatggcgattctcgtcgccgcggtcggcgcgctgtccgcgttctaccacgattcgctcgacatcaatgatccgcgtcaccgcgaagtgtcggcgatccgcatgatcgcgaagctgccgacgctcgtcgcgatggcgtacaagtacagcatcggccagccgttcgtgtatccgcgcaacgatctgtcgtacagcgcgaacttcatgcgcatgatgttcgcgaacccgtgcgaggaatatcaggtcaacgacgtgctcgtccgcgcgctcgaccgtatcctgatcctgcatgccgaccacgagcagaacgcgtcgacgtcgacggtccgcctcgccggctcgtcgggcgcgaacccgttcgcgtgtatcgcggccggcatcgcgtgcttgtggggcccggcgcacggcggcgcgaacgaagccgcgctgaacatgctcgagcagatcggcacgccggagaacattcccgagttcatcaagcaggtgaaggacaagaactcgggcgtgaagctgatgggcttcggccaccgcgtgtacaagaactacgatccgcgcgcgaagctgatgcgcgaaacgtgctacgaagtgctcaacgagctgggcctgcacgacgatccgctgttcaagctcgcgatgcagcttgagaagatcgcgctcgaagacgaatacttcgtgtcgcgcaagctgtacccgaacgtcgacttctactcgggcatcgtccagcgcgcgctcggcatcccgacgtcgatgttcacctgcatcttcgcgatggcgcgcacggtcggctggatcgcgcagtggaacgagatgatcgccgatccggagcagaagatcggccgtccgcggcagctcttcatcggcgaaacgccgcgcacggcgaagccgatcgagcagcgctga

SEQ ID NO: 37033 - protein, 433 aa, Burkholderia mallei ATCC 23344
MTPSDVKATLSFSDNSPSVELPIYKGTMGPDVIDIRKLYGQTGKFTYDPGFMSTASCNSAITYIDGDKGELLYRGYPIDNLAQNADFLESCYLLLKGELPNAAQKKEFVATVTKHTMVHEQMQFFFRGFRRDAHPMAILVAAVGALSAFYHDSLDINDPRHREVSAIRMIAKLPTLVAMAYKYSIGQPFVYPRNDLSYSANFMRMMFANPCEEYQVNDVLVRALDRILILHADHEQNASTSTVRLAGSSGANPFACIAAGIACLWGPAHGGANEAALNMLEQIGTPENIPEFIKQVKDKNSGVKLMGFGHRVYKNYDPRAKLMRETCYEVLNELGLHDDPLFKLAMQLEKIALEDEYFVSRKLYPNVDFYSGIVQRALGIPTSMFTCIFAMARTVGWIAQWNEMIADPEQKIGRPRQLFIGETPRTAKPIEQR

SEQ ID NO: 37034 - DNA, 1302 bp, Nocardia farcinica IFM 10152
  CDS (1)..(1302): transl_table=11
gtgcccgagaaccacatcgacgacgccaagccggtactgagttacccgggcggcgaatacgccatgacgatcaccgaggccaccgagggcaaccacggtatcgatctgggcaaaatgctggccagcaccggatacgtcacctacgacccgggcttcatgaacaccgcccccaccaagtcggcgatcacctacatcgacggcgaggcgggcatcctgcgctaccgcggctacccgatcgagcagctggccgactcctcgaccttcatcgaggtcagctacctgctgatctacggcgagctacccacccaggcccagctcgacgacttcaccgaccggatccgccgccacaccctgctgcacgaggacctcaagcggttcttcgacggcttcccgcgcaacgcgcaccccatgccggtgctctcctcggcggtcaacgcgctgtcggcctactaccaggactcgctggacccgcgcgaccccgagcaggtcgagctgtccaccatccgcctgctggccaagctgcccaccatcgcggcctactcctacaagaagtcggtcggccagccgttcctctacccggacaactcgctgaccctggtggagaacttcctgcggatgaccttcggtttcccggccgagccgtacgaggtcgaccccgaggtcgcggccgcgctggacatgctgctgatcctgcacgccgatcacgagcagaactgttccacctccaccgtgcgcctggtcggctcctcggacgccaacctgttcacctcggtctccggcggcatcaacgcgctgtggggcccgctgcacggcggcgcgaaccaggccgtgctggagatgctcgacgacatcaaggcccagggcggtgacgtcaaggagttcatccgcaaggtcaagaacaaggaagacggcgtgaagctgatgggcttcgggcaccgcgtctaccgcaactacgacccgcgcgccgccatcgccaagaagcacgccgacaacatcctgcgcaagctgggcggcgacgacgagctgttcgagatcgcccaggcgctggaggaggccgcgctgaccgacgactacttcgtcgagcgccgcctgtacccgaacgtcgacttctacaccggcgtcatctacaaggcgatgggcttccccacccggatgttcaccgtgctgttcgcgatgggccggctgccgggctggatcgcgcactggcgcgagatgcacagcgagccgctgaagatcggccgcccgcgacagatctacaccgggtatggtgcgcgcgactacagccggatcaccgaacgctga

SEQ ID NO: 37035 - protein, 433 aa, Nocardia farcinica IFM 10152
MPENHIDDAKPVLSYPGGEYAMTITEATEGNHGIDLGKMLASTGYVTYDPGFMNTAPTKSAITYIDGEAGILRYRGYPIEQLADSSTFIEVSYLLIYGELPTQAQLDDFTDRIRRHTLLHEDLKRFFDGFPRNAHPMPVLSSAVNALSAYYQDSLDPRDPEQVELSTIRLLAKLPTIAAYSYKKSVGQPFLYPDNSLTLVENFLRMTFGFPAEPYEVDPEVAAALDMLLILHADHEQNCSTSTVRLVGSSDANLFTSVSGGINALWGPLHGGANQAVLEMLDDIKAQGGDVKEFIRKVKNKEDGVKLMGFGHRVYRNYDPRAAIAKKHADNILRKLGGDDELFEIAQALEEAALTDDYFVERRLYPNVDFYTGVIYKAMGFPTRMFTVLFAMGRLPGWIAHWREMHSEPLKIGRPRQIYTGYGARDYSRITER

SEQ ID NO: 37036 - DNA, 1371 bp, Photobacterium profundum SS9
  CDS (1)..(1371): transl_table=11
ttgacatttgggctaacgaaaggtacaacaaaaggaggtccgtattggattaggattataataatagcaaaggagattgttatggcggataagaaagcgactcttcatattgaagggaaagccccaatcgaactaccaattcttgggggctctcaggggccagatgtaattgatgtgcgtaaacttggcgctagcggttactttacatttgatcctggttttctagccacagcatcatgtgaatctcaaattacttacattgatggcgacaaaggtatcctgttacaccgtggctaccctatcgaccaattagccaataacgctgactacttagaagtatgttacgtattgttatatggtgaagtgccaacccgagctcagtacgaatttttccgtactacagtgactcgtcacacaatggttcatgaacaaattgctagcttcttccacggtttccgtcgagatgctcaccctatggcagttatgtgtggtgtggttggagcacttgcagcgttttaccatgattcgttagatatcaacaatgatagccaccgtgaaatcacggcattccgtttgctatcaaaaatgccgacacttgcttcaatgtgttacaaatactcaattggacaaccattcatcttccctcgcaacgatctagattatgcagaaaacttcctgcatatgatgtttgcgactccgtgtgaagagtatgatgttagcccagttattgcgcgtgcaatggataagatcttcaccttgcatgccgatcacgaacaaaatgcttcaacatcgactgtacgtttagctggctcttcaggcgctaacccgtttgcatgtattgcagctggtattgcgtcactttggggacctgcacatggcggggcaaatgaagcctgcttgaaaatgctagaagaaattggcagcgttgataaaattgcagaatatatagaacgtgcaaaagacaaagatgacccgttccgtcttatgggctttggtcaccgcgtttacaaaaactatgacccacgtgcgacagtaatgcgtgaagcatgtcatgaagtattagaagagcttaatatccaagacccactgcttgatatagcaatggaactggaacgtatcgcactttctgacccgtactttattgacaagaaactgtacccgaatgtcgatttctactcaggtctaatcttgaaagctattggtattccaatttcaatgtttacggttattttcgccatgtctcggactgttggttggattgcacactggagcgaaatgcacggtgaccctgataatcgcatcggtcgtcctcgtcagctttacactggtaaactacaacgcgaatttaaacctcttcatgaaagagagtaa

SEQ ID NO: 37037 - protein, 456 aa, Photobacterium profundum SS9
MTFGLTKGTTKGGPYWIRIIIIAKEIVMADKKATLHIEGKAPIELPILGGSQGPDVIDVRKLGASGYFTFDPGFLATASCESQITYIDGDKGILLHRGYPIDQLANNADYLEVCYVLLYGEVPTRAQYEFFRTTVTRHTMVHEQIASFFHGFRRDAHPMAVMCGVVGALAAFYHDSLDINNDSHREITAFRLLSKMPTLASMCYKYSIGQPFIFPRNDLDYAENFLHMMFATPCEEYDVSPVIARAMDKIFTLHADHEQNASTSTVRLAGSSGANPFACIAAGIASLWGPAHGGANEACLKMLEEIGSVDKIAEYIERAKDKDDPFRLMGFGHRVYKNYDPRATVMREACHEVLEELNIQDPLLDIAMELERIALSDPYFIDKKLYPNVDFYSGLILKAIGIPISMFTVIFAMSRTVGWIAHWSEMHGDPDNRIGRPRQLYTGKLQREFKPLHERE

SEQ ID NO: 37038 - DNA, 1119 bp, Geobacillus kaustophilus HTA426
  CDS (1)..(1119): transl_table=11
atgacagtaacccgtgggttagagggagttgtggccacaacttcaagcatcagttcgatcatcgatgacacgttgacgtatgtcggttatgacattgacgatttagccgaaaacgcttccttcgaagaagtcgtttatttgctttggcatcgcgaactgccgacgaaagagcagcttgaggaattaaagaaacagttggcggaaaacgctgaaattccaaatgaaatcattgaacacttcaagctgtatccgattgacaaggtgcatccgatggcggctttgcgcaccgcggtatcgcttctcggcttgtatgacgaagaggcggatgtgatgacgaaagaggcgaattatcggaaagccattcgcctgcaggcgaaaatcccgacgattgtcaccgccttcgcccgcgtgcgcaaagggttggaaccggttgcgccgcgcaaagatttgagctttgctgccaatttcttgtacatgctgaccggcaaagaaccagacgacatcgccacggaagcgttcaacaaggcgctcgtgctgcatgccgaccacgagttgaacgcgtcgacgttcacggcgcgcgtctgcgtagccacgctgtccgatatttattccggcatcacggcggcgatcggagccttgaaagggccgcttcacggcggggcgaacgaagcggtgatgaaaatgttgacggaaatcggcacggtcgacaacgtcgagccatacatccgcagaaagctcgccaacaaagaaaaaattatgggctttggccatcgcgtttaccgaaaaggcgacccgcgcgccaaacatttgaaaaaaatgtcggaaaaactaacgaagctcgtcggcgagccgcattggtatgaaatgtcgacgaagattgaagaaatcgtcacatcggaaaaagcgctgccgccgaacgttgacttttattccgcctcggtttaccattgtttaggaatcgatcatgatttgtttacgccgatttttgccgtcagccgcacctcgggatggttggctcacatcttggaacaatacgacaacaaccgtctcatccgtccgcgcgctgagtacaccggcccaggcaagcgggcgtacgtgccgatcgacgagcgcggctaa

SEQ ID NO: 37039 - protein, 372 aa, Geobacillus kaustophilus HTA426
MTVTRGLEGVVATTSSISSIIDDTLTYVGYDIDDLAENASFEEVVYLLWHRELPTKEQLEELKKQLAENAEIPNEIIEHFKLYPIDKVHPMAALRTAVSLLGLYDEEADVMTKEANYRKAIRLQAKIPTIVTAFARVRKGLEPVAPRKDLSFAANFLYMLTGKEPDDIATEAFNKALVLHADHELNASTFTARVCVATLSDIYSGITAAIGALKGPLHGGANEAVMKMLTEIGTVDNVEPYIRRKLANKEKIMGFGHRVYRKGDPRAKHLKKMSEKLTKLVGEPHWYEMSTKIEEIVTSEKALPPNVDFYSASVYHCLGIDHDLFTPIFAVSRTSGWLAHILEQYDNNRLIRPRAEYTGPGKRAYVPIDERG

SEQ ID NO: 37040 - DNA, 1254 bp, Anaplasma marginale str. St. Maries
  CDS (1)..(1254): transl_table=11
atggtagaaaaagcgattttagagtgcggagattgcaaaataagcttgcccgttatgcatggcagcgatggtacactagctgttgacacgactagcctctacaaagattccaaaatccttacttatgatcctggattcatgtccactgctgcgtgtaaatccgaaataacgttcatagacggcgatgaaggcattctgcgttacagggggtatgatatagctgaccttaccatggcagacggcggattttgtagcattgcctacctactgttgtatgggactatgccgcaagggcgcgagctcgctgactttgtcgctactgtaagcagggagtgcaatgtacgcacacaagttttagacgtaattcgagcattgccacgtgatgcccacccaatggccatattaattgcaagctttgcagctcttgctgcccactatcacggtgccaattctttagatccactgcgcagcgcgattgtggctatatcgcaagtgccgggcattgttgcaagcatttacaggcacacttctggcgcgccgcttatagaggcagatccgagcctagggtacgtacaaaacttcgtgcacatgatgtttggtgacttgcatgagacgcgcaaaagcattatctgcaaggcgctggaggcgatcttcataatgcatgcagaccacgaacagaatgcttctactgctacggtaagggcaaccggctctgccggggctaacctgtttgcgtgcctgagcgcaggcgcagcaaccttgtggggcccagctcatggtggtgcgaacgaagcagttgtaaaaatgcttgaggaaattggtcgccctgagcgagttggtgagttcattgagaaggtaaaagagaaagaaagcggagtgaggctcatgggttttggccacagggtctacaagaactacgatccaagagcccgcatcatccgggatatatgcaaagaaacgctgagtggattgggcgcggatgacccactacttgatgtggcgactgcgctggaaaaagcggctctggaagacgaatattttgtcaaacgctcactgtaccccaatgttgacttttactccggtattgtactaaaggcagccggggtgccagtgaacatgtttaccgcgttttttgctctggcgaggactaccggatggtctgcccaatggtatgaaatgttggataaacagcacgagggtagcaagatatgccgcccacgccaactttataccggcaagatgaacgcagagtag

SEQ ID NO: 37041 - protein, 417 aa, Anaplasma marginale str. St. Maries
MVEKAILECGDCKISLPVMHGSDGTLAVDTTSLYKDSKILTYDPGFMSTAACKSEITFIDGDEGILRYRGYDIADLTMADGGFCSIAYLLLYGTMPQGRELADFVATVSRECNVRTQVLDVIRALPRDAHPMAILIASFAALAAHYHGANSLDPLRSAIVAISQVPGIVASIYRHTSGAPLIEADPSLGYVQNFVHMMFGDLHETRKSIICKALEAIFIMHADHEQNASTATVRATGSAGANLFACLSAGAATLWGPAHGGANEAVVKMLEEIGRPERVGEFIEKVKEKESGVRLMGFGHRVYKNYDPRARIIRDICKETLSGLGADDPLLDVATALEKAALEDEYFVKRSLYPNVDFYSGIVLKAAGVPVNMFTAFFALARTTGWSAQWYEMLDKQHEGSKICRPRQLYTGKMNAE

SEQ ID NO: 37042 - DNA, 1281 bp, Idiomarina loihiensis L2TR
  CDS (1)..(1281): transl_table=11
atggctgatcgtaaagccactttacagattgacggccaatccattgaattgccggtactatcaccaacggcaggaaaggatgtagttgacgtccgaactctgggaaaacatggttattttacttttgacccagggtttctggctacaggctcttgcgagtcggctatcacctatatagatggtgaaaacggcgttttactgcaccgcggttaccctattggtgagttagcaactaaagcagattacttagaagtttgctacatgttgttgcacggcgaagctcctaccgaaaagcaataccatgaattcaaaaacaccattactaaacacactatggtgcatcagggaattcacaatttctttaatggtttccgtcgcgatgctcaccctatggcaatgttatgtgccgtaacgggagctttatcatcgttctatcatgatgatctggagattcacgatgaaaaccaacgtttacgtagtgcttaccgtctgattgcaaaaattccaacaattgcagcaatggcttataaattcagcattggtcaacctttcgtttacccacgtaacgacttaggttatgcagaaaacttcctgaacatgatgttctcggttcctgcggaagactacaaaataagccctgcggtagctcgcgctatggatcgcatctttactttgcatgctgaccacgagcaaaacgcatcaacgtcaacagtacgccttgccggttcttctggtgctaacccttacgcatgtatcgctgcgggtgttgcgtctttatggggaccagcccatggtggtgcaaacgaagcttgcttgcgtatgctggctgaaattggctctgttgaaaacattccaaaatatattgagaaagcaaaagacaaagacgatcctttccgtctaatgggctttggtcaccgtgtatacaaaaacaccgaccctcgtgcaacggtaatgcgtgaatcttgccacgaagtactgaaagaattggatcgtgatgatccattacttgacgtcgcaatggaactggagcgtatcgctctggaagacgactacttcattgaaaagaaactcttccctaacgttgacttctactcaggtatcgtactgaaagctattggtattcctaccaatatgttcaccgttatctttgcgctgtcacgtactgtcggctgggtttctcactggcacgaaatgatgggcgaagaaaaccagaaaattggtcgtcctcgtcagttatatactggttatacaaaacgcgagttttcaccaattaaaaaataa

SEQ ID NO: 37043 - protein, 426 aa, Idiomarina loihiensis L2TR
MADRKATLQIDGQSIELPVLSPTAGKDVVDVRTLGKHGYFTFDPGFLATGSCESAITYIDGENGVLLHRGYPIGELATKADYLEVCYMLLHGEAPTEKQYHEFKNTITKHTMVHQGIHNFFNGFRRDAHPMAMLCAVTGALSSFYHDDLEIHDENQRLRSAYRLIAKIPTIAAMAYKFSIGQPFVYPRNDLGYAENFLNMMFSVPAEDYKISPAVARAMDRIFTLHADHEQNASTSTVRLAGSSGANPYACIAAGVASLWGPAHGGANEACLRMLAEIGSVENIPKYIEKAKDKDDPFRLMGFGHRVYKNTDPRATVMRESCHEVLKELDRDDPLLDVAMELERIALEDDYFIEKKLFPNVDFYSGIVLKAIGIPTNMFTVIFALSRTVGWVSHWHEMMGEENQKIGRPRQLYTGYTKREFSPIKK

SEQ ID NO: 37044 - DNA, 1296 bp, Azoarcus sp. EbN1
  CDS (1)..(1296): transl_table=11
atgagcactgaacgcactgcaacgctaaccgtcgatggcaagaccgtcgaattcccggtaatgaccggcacccatggcaatgacgtcatcgatattcgcacgctgggggccaagaccggtttcttcacttacgactcgggcttcctgtcgaccgcgagctgcaagtccacgattacgttcatcgacggtgacaagggtgaactgctctatcgcggttatcccatcgagcaactggccgacaagtgcagcttcctcgaagtcgcctatctgctgaagaacggcgagctcccgaacgggacgcagaaagtggagttcgagaacaccatcaagaaccacacgatgctgcacgaccagatgacgaagttcttcacgggcttccgtcgtgatgcgcatccgatggccgtgatggtcggcgtcgtcggcgcgctgtcggccttctatcatgaagcgatggatttctccgactccgagcaccgcaacatctcgatcaaccgcctgatcgcgaagctgccgacgatcgtcgcgatggcctacaagtacaacatgggccagccgttcatgtatccgcgcaacgagctcgactacacggcgaacttcatgcacatgatgttcggcacgccgtgcgaagagtacaagcccaatccggtgctggtgcgtgcgctcgacacgatcttcacgctgcacgccgatcacgagcagaacgcttcgacgtccaccgtgcggctcgcggggtcgtcgggtgcgaacccgttcgcgtgcatctcggccggcatcgcctgcctgtggggcccggcgcacggcggcgcgaacgaagcatgcctcaacatgctcgaggaaatcggcgacgtgtcgcgcgtcggcgaatacatcgcgcgtgcgaaggacaagaacgacagcttcaagctgatgggcttcggtcaccgcgtctacaagaacttcgacccgcgcgcgaagctgatgcgccaggtctgctacgacgtcctgggcgagctgggcctcgagaacgaccgcctcttcaagctggcgatggaactcgagaagatcgcactggaagaccagtacttcgtcgagaagaagctctatccgaacgtcgacttctactccggcatcgtgcagaaggcgctggggatcccgacgtcgatgttcacctgcatcttcgcgctggcacggaccgtcggctggatcacgcagtgggaagaaatgatcaccgatccggaatacaagatcggtcgtccgcgccagttgtacatcggtgcagcgcggcgcgacgtaccgacgctcgcacaacgtccgtaa

SEQ ID NO: 37045 - protein, 431 aa, Azoarcus sp. EbN1
MSTERTATLTVDGKTVEFPVMTGTHGNDVIDIRTLGAKTGFFTYDSGFLSTASCKSTITFIDGDKGELLYRGYPIEQLADKCSFLEVAYLLKNGELPNGTQKVEFENTIKNHTMLHDQMTKFFTGFRRDAHPMAVMVGVVGALSAFYHEAMDFSDSEHRNISINRLIAKLPTIVAMAYKYNMGQPFMYPRNELDYTANFMHMMFGTPCEEYKPNPVLVRALDTIFTLHADHEQNASTSTVRLAGSSGANPFACISAGIACLWGPAHGGANEACLNMLEEIGDVSRVGEYIARAKDKNDSFKLMGFGHRVYKNFDPRAKLMRQVCYDVLGELGLENDRLFKLAMELEKIALEDQYFVEKKLYPNVDFYSGIVQKALGIPTSMFTCIFALARTVGWITQWEEMITDPEYKIGRPRQLYIGAARRDVPTLAQRP

SEQ ID NO: 37046 - DNA, 1290 bp, Zymomonas mobilis subsp. mobilis ZM4
  CDS (1)..(1290): transl_table=11
atgagctctcctaatgaagcgattattggcctaaataacgaagagtatcgtttccccgtgcgacaaagcacggcaggcacattaggaattgatatccgtcagcttcatagccagagcggcgctctgacctatgatcccggttttctgtcgacggcaagctgccagtcaaagattacttatgtcgatggcgaaaaaggcattttgctttatcgaggatatcctattgagcaattagcagaaaaatcgagctttcccgaagtcgcctatctccttttacatggcgagctccccaaagccgatgatttttctactttttcagatgtaattacccatcatacgatggttaatgagcagctttccgctttttatcggggcttccggcgagatgctcatcctatggctgttctttgtggggttgtgggtgccttatcggccttttatccagaggcaatccatattcatgatcccgcgcaaagaatggcatcttgtcatcgtttactggctaaattgccgactattgcggcaatggcgtataaatattcagtaggccaacccttcgtctatccagataatagcctaagctatgtaggtaatttccttcggatgactttcagtgttcctgcggaaccgtatcatgtcgatccgttaattgaatcagctttgaataaaatctttattctacatgctgatcacgaacaaaatgcttcgacatcgacggttcgcttggctggttcttcaggcgctaacccttatgcttgtattgcggctggcattgcctgtttatgggggccctcgcatggcggcgctaatgaggcaacattggctatgctgaaagaaatcggcacacctgaaaatattcctcatttcattgatcgtgccaaagaccgcaatgatcccttccgtcttatgggctttggccatcgcctctataaaaattatgatcctcgggcgcgtgttctggctaaaacagctgccgcaattttggataaaacaggcgccaataatccaatatttgatacggctcgcgccttggaagaaatcgctcgaaaagattcctattttatcgagaggaaactttatcccaatgttgatttctattcaggcttgatcttgtcagctatcggtttcccgacttctatgtttaccgctttatttgccttggccagaactgcgggatggatggctcaatggaatgaaatgattaccgatcctgaacaaaaaatcggtcgtccgagacaaatctacacaggtgtctctactcgggattacgttaatatcgaaaaccgttga

SEQ ID NO: 37047 - protein, 429 aa, Zymomonas mobilis subsp. mobilis ZM4
MSSPNEAIIGLNNEEYRFPVRQSTAGTLGIDIRQLHSQSGALTYDPGFLSTASCQSKITYVDGEKGILLYRGYPIEQLAEKSSFPEVAYLLLHGELPKADDFSTFSDVITHHTMVNEQLSAFYRGFRRDAHPMAVLCGVVGALSAFYPEAIHIHDPAQRMASCHRLLAKLPTIAAMAYKYSVGQPFVYPDNSLSYVGNFLRMTFSVPAEPYHVDPLIESALNKIFILHADHEQNASTSTVRLAGSSGANPYACIAAGIACLWGPSHGGANEATLAMLKEIGTPENIPHFIDRAKDRNDPFRLMGFGHRLYKNYDPRARVLAKTAAAILDKTGANNPIFDTARALEEIARKDSYFIERKLYPNVDFYSGLILSAIGFPTSMFTALFALARTAGWMAQWNEMITDPEQKIGRPRQIYTGVSTRDYVNIENR

SEQ ID NO: 37048 - DNA, 1296 bp, Silicibacter pomeroyi DSS-3
  CDS (1)..(1296): transl_table=11
atgactgaagaaaagaaaaccgccacgcttagcctgaacggtcaatcctacgatttgccggtgtattcgccctcggcgggcccggacgtgatcgacatccgcaaactctatggtcaggccggcgtgttcacctatgacccgggcttcacctcgacggcgagctgcgacagcaccatcacctatatcgatggcgaactgggcgagctgctgcatcggggctatccgatcgaccagctggcggccaagtcgcattacctcgaggtctgctatctgctgctgtacggtgaactgccgaccgcggccgctctcgagaagttcgagaccacgatcacccgccacaccatgatccacgagcagatgcactatttcttccgcggcttccgccgcgatgcgcatccgatggcgaccatggtgggtgtggtcggcgcgatgtcggccttctatcacgactcgaccgatatcgccgacccgcatcagcgcgagatcgccagccaccgcctgatcgccaagatgccgaccatcgcggcgatggcgtataaatactcgatcggccagccgttcatgtatccgcgcaacgatctggattacgcggccaacttcctgcagatgtgttttgccgtcccggccgagcattatcatgtcgacccgatcctggcccgcgccatggaccggattttcacgctgcatgccgatcacgagcagaacgcctcgacctcgaccgtgcgtctggcgtcgtcctcgggcgcgaacccgtttgcctgtatcgccgccggtatcgcctgtctctggggtcccgcccatggcggcgccaaccaggcctgcctggagatgctgaaagagatcggctcgcccgaccgcatccccgagttcatcgcccgcgccaaggacaagaacgatccgttccgcctgatgggctttggtcaccgcgtctacaagaacttcgatccgcgcgcgacggtgatgaaacagtccgccgacgaggtgctggacctgctgggtgtggaaaacaacccgatcctggccaccgccaaggaactggaacgcgccgccctggccgatgactatttcgccgagaagaagctgttcccgaatgtcgacttctattcgggtatcatcctcgaggcgatgggcttcccgacctcgatgttcacgcccatcttcgcggtatcgcggaccgtgggttgggtcagccagtggaaagagcagctggccgatccgcagcacaagatcggccgcccgcgtcagctgtacctcggctctaccgcgcgcgactatgtggatatcgaagaccgctga

SEQ ID NO: 37049 - protein, 431 aa, Silicibacter pomeroyi DSS-3
MTEEKKTATLSLNGQSYDLPVYSPSAGPDVIDIRKLYGQAGVFTYDPGFTSTASCDSTITYIDGELGELLHRGYPIDQLAAKSHYLEVCYLLLYGELPTAAALEKFETTITRHTMIHEQMHYFFRGFRRDAHPMATMVGVVGAMSAFYHDSTDIADPHQREIASHRLIAKMPTIAAMAYKYSIGQPFMYPRNDLDYAANFLQMCFAVPAEHYHVDPILARAMDRIFTLHADHEQNASTSTVRLASSSGANPFACIAAGIACLWGPAHGGANQACLEMLKEIGSPDRIPEFIARAKDKNDPFRLMGFGHRVYKNFDPRATVMKQSADEVLDLLGVENNPILATAKELERAALADDYFAEKKLFPNVDFYSGIILEAMGFPTSMFTPIFAVSRTVGWVSQWKEQLADPQHKIGRPRQLYLGSTARDYVDIEDR

SEQ ID NO: 37050 - DNA, 1275 bp, Francisella tularensis subsp. tularensis SCHU S4
  CDS (1)..(1275): transl_table=11
ttggaggtcatgttaatgagtaaatacgcaactcttaagtatgcagataaaaatattgaaatagaattaccagtatattctcctagcttgggtaatgactgcatagatgtttcatcattagtaaaacacggaatttttacttatgatcctggattcatgtctacagctgcatgcgaatctaaaattacatatatcgatggtggtaaaggtgtactcttacatagaggctacccaatcgaagaatggactcaaaaatcaaactacagaactctttgctatgcattgatttatggcgaactcccaacagatgaacaggttaaaagctttagacaagaaattatcaataaaatgccagtatgcgagcatgtcaaagctgcaatagctgcaatgcctcaacatacacatcctatgtcaagcttaatagctggtgttaatgtcttagctgctgaacatatccacaatggacaaaaagaatctcaagatgaagtcgcaaaaaatatcgtagcaaaaattgcaactatagcagccatggcttacagacataatcacggcaagaaattcttagaacctaaaatggaatatggctatgctgagaatttcttgtatatgatgtttgctgatgatgagagctacaaaccagatgagctacatatcaaagcaatggatacaatatttatgcttcatgctgatcacgagcaaaatgcttcaacatcaactgtaaggttatcaggatcaactggtaactctccttatgcggcaattatcgcaggtattaccgcattatggggacctgctcatggaggcgctaatgaagctgtgcttaaaatgttatctgaaattggtagcactgagaatatcgataagtatattgctaaagcgaaagataaagatgatccatttagattaatgggctttggacatagagtctacaaaaatactgatccgagagctactgcaatgaaaaagaactgtgaagaaatacttgctaaacttggtcatagtgataaccctcttctcacagtagctaaaaaactagaagaaattgctttacaagatgagttctttatcgagagaaagcttttctctaatgttgatttttactcaggtataatcttaaaagccatgggcattccagaagatatgtttacagccatatttgctctagcaagaacatcagggtggatatctcaatggatagagatggttaatgatcctgctcaaaagattggtcgtccaagacaattatatactggtgcaacaaatagaaatttctaa

SEQ ID NO: 37051 - protein, 424 aa, Francisella tularensis subsp. tularensis SCHU S4
MEVMLMSKYATLKYADKNIEIELPVYSPSLGNDCIDVSSLVKHGIFTYDPGFMSTAACESKITYIDGGKGVLLHRGYPIEEWTQKSNYRTLCYALIYGELPTDEQVKSFRQEIINKMPVCEHVKAAIAAMPQHTHPMSSLIAGVNVLAAEHIHNGQKESQDEVAKNIVAKIATIAAMAYRHNHGKKFLEPKMEYGYAENFLYMMFADDESYKPDELHIKAMDTIFMLHADHEQNASTSTVRLSGSTGNSPYAAIIAGITALWGPAHGGANEAVLKMLSEIGSTENIDKYIAKAKDKDDPFRLMGFGHRVYKNTDPRATAMKKNCEEILAKLGHSDNPLLTVAKKLEEIALQDEFFIERKLFSNVDFYSGIILKAMGIPEDMFTAIFALARTSGWISQWIEMVNDPAQKIGRPRQLYTGATNRNF

SEQ ID NO: 37052 - DNA, 1182 bp, Synechococcus elongatus PCC 6301
  CDS (1)..(1182): transl_table=11
atggggaagcccaggattgctatgactgccgtcagcgagtttcggcctggcctagaaggcgtgcccgccacactctcgagcattagctttgtcgatggccagcgcggcgtcctagagtatcgcggcatcagcatcgagcaactggcgcaacagagcagttttctggaaaccgcctacctgttgatttggggccatctaccaactcagcaggaattgaccgagttcgagcacgaaattcgctaccaccgccgcatcaagttccgcatccgggacatgatgaaatgcttccccgatagcggccatcctatggatgccctgcaggcgagcgccgcagccctcgggttgttctattcgcggcgcgccttggatgatcccgaatacattcgggcggccgttgtgcgtttgctagccaaaattccgacgatggtggctgccttccagctgatccgcaagggtaacgacccaattcagccccgcgatgaactggactacgccgccaactttctctacatgctgacggagcgcgagcccgatccagtcgcagctcggatttttgatatttgcctcaccctgcacgccgaacatacgatcaacgcctcgaccttctcggcgatggtcacagcttcgaccctgaccgatccctacgctgtcgttgcttctgccgttggcaccttggctggccccctccatggcggcgccaatgaagaagtgctggacatgctggaggcgatcggttccgtcgagaatgttgagccctacctcgaccactgcattgccaccaaaacgcgcattatgggctttgggcaccgtgtctacaaagtcaaggatccgcgggcagtcattctgcaaaatctggccgagcaactgttcgatatcttcggccatgatccctactacgaaatcgcggtcgcagtcgaaaaggcagcagccgagcgactcagccacaagggcatttaccccaacgtcgatttctactccggcttggtctatcgcaagctcggtattcctagcgatctattcacaccggtgtttgcgatcgcgcgggttgcgggctggctcgcccactggaaagagcagctgaacgaaaatcggatcttccgccccactcagatctacacgggcagccacaacctcgactacaccccgatcgccgatcgggatttggcgatcgaatctgattga

SEQ ID NO: 37053 - protein, 393 aa, Synechococcus elongatus PCC 6301
MGKPRIAMTAVSEFRPGLEGVPATLSSISFVDGQRGVLEYRGISIEQLAQQSSFLETAYLLIWGHLPTQQELTEFEHEIRYHRRIKFRIRDMMKCFPDSGHPMDALQASAAALGLFYSRRALDDPEYIRAAVVRLLAKIPTMVAAFQLIRKGNDPIQPRDELDYAANFLYMLTEREPDPVAARIFDICLTLHAEHTINASTFSAMVTASTLTDPYAVVASAVGTLAGPLHGGANEEVLDMLEAIGSVENVEPYLDHCIATKTRIMGFGHRVYKVKDPRAVILQNLAEQLFDIFGHDPYYEIAVAVEKAAAERLSHKGIYPNVDFYSGLVYRKLGIPSDLFTPVFAIARVAGWLAHWKEQLNENRIFRPTQIYTGSHNLDYTPIADRDLAIESD

SEQ ID NO: 37054 - DNA, 1116 bp, Bacillus clausii KSM-K16
  CDS (1)..(1116): transl_table=11
gtgactacaactcgtggtttagaaggtattgtggcaacacaatcgagcgttagctccattattgatgatgaattaacgtaccatggttatggcattgacgacctggccgaaaatgctagttttgaagaggtcgtttatttgctgtggaatggtgaattgcctacgaaagaagaattggaatcgttttcaagagcgcttgctgaacaagcgggcgtccccgatgaaattttcgaacaaatgaaagcctatccaatcgatagcgtccatccaatggctgccctgcgcacatctgtttcaatgcttggtttgtttgatgatgaagcagaatcagtcgaggaagaaaaaaattaccgcaaagcgattaaacttcaagcaaaaattcctacaattgttgccggctttgagcggatccgttctggcaaagaaccgattgctccaaacaaggagttatcgtttgcagcaaatttcctatacatgttaacgggcgaaaacccagatgcgatttcagtaaaagcttttaataaagcgcttgtgctccatgcggatcatgaactgaacgcctcaacatttacggcgcgcgtttgtgtagcgacgctgtctgatatgtattcaggcattacagcggcaattggcgcattgaaagggcctcttcatggcggcgcaaatgagggcgtcatgaaaatgcttcttgaaatcgaagaatttgagcgagtggaaccgtatatccagaaagcgcttgataataaagagaaaatcatgggctttggccatcgtgtatacaaaaatggcgatcctcgggctaagcatttgcgggaaatgtccaaacaactaacagacgttattaaagaatcaaaatggtacgacatgtctttgcggattgaagaattggtcaccactcaaaaaggcttgctgccaaacgttgatttttattcagcgactgtataccatagtcttgggattaaacatgatttgttcacgccgatttttgcgatcagccgcacatctggctggattgcccatatcctcgaacagtatgcaaacaaccgcctgattcgtccgcgtgctgagtatgtcggtccgaacaaacgcagctacaaaccagtagaatcacgatag

SEQ ID NO: 37055 - protein, 371 aa, Bacillus clausii KSM-K16
MTTTRGLEGIVATQSSVSSIIDDELTYHGYGIDDLAENASFEEVVYLLWNGELPTKEELESFSRALAEQAGVPDEIFEQMKAYPIDSVHPMAALRTSVSMLGLFDDEAESVEEEKNYRKAIKLQAKIPTIVAGFERIRSGKEPIAPNKELSFAANFLYMLTGENPDAISVKAFNKALVLHADHELNASTFTARVCVATLSDMYSGITAAIGALKGPLHGGANEGVMKMLLEIEEFERVEPYIQKALDNKEKIMGFGHRVYKNGDPRAKHLREMSKQLTDVIKESKWYDMSLRIEELVTTQKGLLPNVDFYSATVYHSLGIKHDLFTPIFAISRTSGWIAHILEQYANNRLIRPRAEYVGPNKRSYKPVESR

SEQ ID NO: 37056 - DNA, 1248 bp, Ehrlichia ruminantium str. Welgevonden
  CDS (1)..(1248): transl_table=11
atgatcaaaaaggcagcagtagagttagatgatcaaaaaataactttgccaattttgtatgatactgaagggaatgaagtattagatattacttctttatataaaaatacaggggtattaacttatgatccaggatttatgtctactgctgcttgtgagtctaaaattacgtttattgatggaaataaaggtatattgcgttatagaggatatgatatagcagatttggtttataataataaaagcttcattgaagtagtgtatttattattttatggggttttccctaatgctgagcaacttcaggaatttatattacatatttctcaagaatatgtattgccacagatggttagagatgtgataacgtcgtttccacaaaattctcaccctatggctatattaattgctagtttttcttcgttagctgcatattattgtgatcagaaaactgatggtgagttagagtgtaaacttgctgttgctaaggtggcaagtatagttgctctaatttataggcatattactaatcaagacttcattcaagctgatgtaggcttatcttatagtaaaaattttatccatatgatgtttgacatttcttcttataaatttactgaaattgtagataaagctttagatgttatttttgtattacatgctgatcatgaacaaaatgcttctactgcaactgtacgaatgacaggttcttctggtcctaatttgtttgcttgtttagcagcgggtgccgcgactttatggggaccagctcatggtggggccaatgaagcagtgatcaatatgctgatgaatattggaaaaccagagaatgtaaaacaatttattcagaaagtaaaggatagtaataaaagcacaaaattaatgggttttggtcatagggtatataagaactatgatccacgagcgcgaataatgtgtacaatttgtaaagaaatattaaaggattttggtctaaatgatccactacttgaagtagctgtggaattagaaaatattgctttacaggatgactattttatagcacgtaatttatatcctaatgttgatttttattctggcattgtgttaaagactatagggattccagttaaaatgtttacgacattatttgcgttagcaagaacatctgggtggtctgctcagtggtatgagatggtatctagtaaaaattataagatatcacgtcctcgtcaattatatactggtaatccagttcaaaaagtttag

SEQ ID NO: 37057 - protein, 415 aa, Ehrlichia ruminantium str. Welgevonden
MIKKAAVELDDQKITLPILYDTEGNEVLDITSLYKNTGVLTYDPGFMSTAACESKITFIDGNKGILRYRGYDIADLVYNNKSFIEVVYLLFYGVFPNAEQLQEFILHISQEYVLPQMVRDVITSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMTGSSGPNLFACLAAGAATLWGPAHGGANEAVINMLMNIGKPENVKQFIQKVKDSNKSTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYTGNPVQKV

SEQ ID NO: 37058 - DNA, 1296 bp, Gluconobacter oxydans 621H
  CDS (1)..(1296): transl_table=11
atgtccgaaaaccgttccgcaacctttggtctcgatggcctcagccgtcagtttccagttctggaagggacgattggtccggacgtcgtggacatgcgcgccctgtcccagaaaacgggtgtcttttcctttgatcccgggctgggcagcacagcaacctgcaccagcgccatcagctatattgacggcgacaagggcgtcctgctgcatcgtggctatccgatcgaagacctggccctcaacgccagcttcaccgagacggcctatctgctgctttatggcgaactgccaaccgccgcgcagtatcaggcgttccgcacggacatgaacactcaccggctgctgaacgagcagatccggaacttcttcaacggcttccgccgcgatgcgcatcccatggcgatcctatgcggaacggttggcgcgctttcggccttctatcatgacgggctggacatttcggagccaaaagcccgcgatctctcggcccgccggctgatcgccaaggtcccgaccatcgcagcctgggcctataaatattccatcggcgagcccttcatctatcccgatgaagagatgtcgttctccgagaacttcctgcacatgctgttcgcccggccgggcaaccattaccgggtcaatcccgtgctggcccgcgcgatggaccgcatcctgctgctgcatgccgatcacgagcagaacgcctccacgacgactgtccgtctcgtggggtcgaccggcgcgaacccctatgcctgcatcgcggctggcattgccgccctgtgggggcctgcgcatggtggcgccaacgaggccgcgctcggcatgctggaaaccatcggtacccgcgatggcattccggccttcctcaatgaggtcaagaaccgtaattccggcgtgcgcctgatgggctttggccatcgcgtctacaagaacttcgatccgcgcgcgaagatccttcaggcgacctgtcacgaagtcatcgaggaactcgggctcaagcgcgacccgctgctggatctggcgatggaactggagcgcgtggcgaccgaggacgattatttcgtcagccgccgcctctatccgaatgtggatttctattccggactgatcctcaaggctctcgggattcccaagagcatgttcacggtgctgttcgcagtcgcgcggacagtcggatgggtcagtcagtggaaggaaatgatcgaggaaccgtccgttcgcatcagccgcccgaggcagctctatatcggtgcggcagaacggaattttgtccccatgagcgagaggcgctga

SEQ ID NO: 37059 - protein, 431 aa, Gluconobacter oxydans 621H
MSENRSATFGLDGLSRQFPVLEGTIGPDVVDMRALSQKTGVFSFDPGLGSTATCTSAISYIDGDKGVLLHRGYPIEDLALNASFTETAYLLLYGELPTAAQYQAFRTDMNTHRLLNEQIRNFFNGFRRDAHPMAILCGTVGALSAFYHDGLDISEPKARDLSARRLIAKVPTIAAWAYKYSIGEPFIYPDEEMSFSENFLHMLFARPGNHYRVNPVLARAMDRILLLHADHEQNASTTTVRLVGSTGANPYACIAAGIAALWGPAHGGANEAALGMLETIGTRDGIPAFLNEVKNRNSGVRLMGFGHRVYKNFDPRAKILQATCHEVIEELGLKRDPLLDLAMELERVATEDDYFVSRRLYPNVDFYSGLILKALGIPKSMFTVLFAVARTVGWVSQWKEMIEEPSVRISRPRQLYIGAAERNFVPMSERR

SEQ ID NO: 37060 - DNA, 1251 bp, Wolbachia endosymbiont strain TRS of Brugia malayi
  CDS (1)..(1251): transl_table=11
atgaataaaaaagcgttattggaactaagcaatggattaaaaattgagttacccgtattaagcggaacaatgggttatgatgtattaaatattaaagatttatataaggtcacagggttactcacctacgacccagggtttgtttccacggcttcatgttcttccgcaattacattcattgatggagatgaaggagttcttagatatagaggacatgatatagctgatttagcacaaagcaatgattttactgctgtaatttatttactactctatggtaaattacctaatctagagcaacacaaaaaatttttcctaaaaatacaagaattatctaaagtaccagagcaggttgtaaatgtaataaaagcatttccaaaaactgctcaccctatgtcaattttgattgcgtgttttgcaactttgtcagcactttaccatgagagatatggtaacaatgtcagtaatgaaaacctagattttggaatctctgcaatagcgcaggttcctgcaattattgcaatggtttatagacataccaatgaccaggaattcatagatactgacaatgaattgaactatagtaaaagcttcttaaggatgatgtttggtaatgctcttgataacgataaaagcaccctttttgcaaaagccttggacaaaatatttactcttcatgctgaccatgagcagaatgcgtcaacagcagctgtcagggtggtaggatcggctggttctaatttatttgcatgcctttctgcaggagttgctacactctggggacctgtgcatggcggagctaacgagtcagttataaatatgttaaaggagatagaacaaagcggaaatgtagacaaatttattgaaaaagctaaagatgataaagacccgtttaaactgatgggatttggacatcgtgtctataaaaattacgatccacgcgcacgcatattaaaagatgcttgtgatgagattttaaacaaactagaacaagatagtaaactgctcaagattgcaaaagaacttgaaaaaatagctttaaaagacgagtattttgttgtgcgtaagttatacccaaatgttgatttctattcaggtataataatgaatgctatcaatattcctccaagtatgtttacacctatttttgcgcttgcaagaactactggttgggttactcagtggtatgaaatgataaatgataaagaaactaagatttgcagaccaaggcagctttatgttggtaaatag

SEQ ID NO: 37061 - protein, 416 aa, Wolbachia endosymbiont strain TRS of Brugia malayi
MNKKALLELSNGLKIELPVLSGTMGYDVLNIKDLYKVTGLLTYDPGFVSTASCSSAITFIDGDEGVLRYRGHDIADLAQSNDFTAVIYLLLYGKLPNLEQHKKFFLKIQELSKVPEQVVNVIKAFPKTAHPMSILIACFATLSALYHERYGNNVSNENLDFGISAIAQVPAIIAMVYRHTNDQEFIDTDNELNYSKSFLRMMFGNALDNDKSTLFAKALDKIFTLHADHEQNASTAAVRVVGSAGSNLFACLSAGVATLWGPVHGGANESVINMLKEIEQSGNVDKFIEKAKDDKDPFKLMGFGHRVYKNYDPRARILKDACDEILNKLEQDSKLLKIAKELEKIALKDEYFVVRKLYPNVDFYSGIIMNAINIPPSMFTPIFALARTTGWVTQWYEMINDKETKICRPRQLYVGK

SEQ ID NO: 37062 - DNA, 1329 bp, Xanthomonas oryzae pv. oryzae KACC10331
  CDS (1)..(1329): transl_table=11
atgtgggatcaggcgccttccactgaaggagcgtacacagtgtccgatcttgatcaggtcacgctcaacgccggcgacacgtcggtcgttctgccggttctcaagcccacgcttggcaatgattgcgtcgatatctcaaagctgaccaaagaaaccggtctgttcacctacgactcgggctttaccgccaccgccagctgcaagtcggccatcacctacatcgatggcgacaatggcgtgttgctgtatcgcggctacccgatcgagcagctggccgaaaagtccaccttcctggaagtgtcgtacctgctgatgaacggcgaactgccgacggcggacgaattcaagaagttcgatcacgaagtgacgcatcacacgatgatgcacgagtcgctgaagaacttcctcggtggtttccgtcatgacgcgcacccgatggccatgctggccggctcggtcgcctcgctgtcggcgttctaccacgacaccctggacctcaacgatccggagcagcgccgtcaggccgccatccgtctgatcgccaaggtgccgaccctggctgctgccgcgtaccgctattcgatcggctggccgattcgctacccgcgcaacaacctgaactacgtcgatcgcttcctgcacatgatgttcgaagtgccgagcgagccgttggcgaccaacccggtcgtggccaaggcgctggatcttctgttcatcctgcacgccgaccacgagcagaacgcctcgacctcgaccgtgcgtctggtcggttcgaccggtgtcaacccgtatgcgtcggtcgctgccggtatcaccgcgctgtggggcccggcacatggcggcgccaacgaagccgtgctgaagatgctggaagagatcggcaccgccgacaacgtcgagtccgccgtggccaaggccaaggacaagaactcgagcttccgcctgatgggcttcggtcaccgtgtctacaagaacttcgacccgcgcgccaagatcatccgcgagatgacccacaaggtgctgggcgaactgggcgtcaacgacccgctgctggaagtggcgctgaagctggaagaggctgcgctgaaggatgactacttcgtgcagcgcaagctgtacccgaacgtcgacttctactcgggcattatctacaaggcgctcaatatcccggtggaaatgttcaccgtgatgttcgccatcgcccgcaccgccggctgggtgtcgcattggctggagcagcaggtcgacccggaaatgaagatcggccgtccgcgccagatctacaccggctacgacaagcgcaattacaaagacgccgaacagcgctaa

SEQ ID NO: 37063 - protein, 442 aa, Xanthomonas oryzae pv. oryzae KACC10331
MWDQAPSTEGAYTVSDLDQVTLNAGDTSVVLPVLKPTLGNDCVDISKLTKETGLFTYDSGFTATASCKSAITYIDGDNGVLLYRGYPIEQLAEKSTFLEVSYLLMNGELPTADEFKKFDHEVTHHTMMHESLKNFLGGFRHDAHPMAMLAGSVASLSAFYHDTLDLNDPEQRRQAAIRLIAKVPTLAAAAYRYSIGWPIRYPRNNLNYVDRFLHMMFEVPSEPLATNPVVAKALDLLFILHADHEQNASTSTVRLVGSTGVNPYASVAAGITALWGPAHGGANEAVLKMLEEIGTADNVESAVAKAKDKNSSFRLMGFGHRVYKNFDPRAKIIREMTHKVLGELGVNDPLLEVALKLEEAALKDDYFVQRKLYPNVDFYSGIIYKALNIPVEMFTVMFAIARTAGWVSHWLEQQVDPEMKIGRPRQIYTGYDKRNYKDAEQR

SEQ ID NO: 37064 - DNA, 1290 bp, Vibrio fischeri ES114
  CDS (1)..(1290): transl_table=11
atggcagataaaaaggcaacacttcatattgaaggtcaatcgcctatagacatgccaatcatggatggaacgattggtccagaagtgatcgatgtgcgtaaattaggagcgaatggttactttactttcgaccctggttttcttgccactgcatcttgtgagtctcaaattacctatatcgatggtgataaaggtgttctattgcaccgtggtttccctattgatcagttagctaacaatgcagattaccttgaagtctgttatatccttctaaatggcgaagcgccaaacagagaagaatatgaaacgttcaaggacatcgtaactcgccacacaatggtacatgagcaaatttcaagcttcttccatggcttccgccgtgatgctcaccctatggccgtaatgtgtggtgttgtaggagcactggctgctttctatcacgattctttagatatcaataacgatgaacaccgcgaaattgctgcatttagattactatcaaaaatgccaactctttcagcaatgtcttacaaatactcaattggacaaccgttcatctatcctcgtaatgatctgacttacgcagaaaacttcttacacatgatgttcgctaatccgtgtgaagaatatgaagtaaaccctgttgttgcacgagcaatggataaaatctttacgctacatgccgatcacgaacaaaatgcatcaacatcaaccgttcgtttagctggttcatcaggtgcgaatccatttgcttgtatcgctgctggtattgcttctctatggggacctgctcatggtggtgctaacgaagcatgtttacgtatgcttgaagaaatcggctctgtagacaacattgatgaatacgttgcaaaagcaaaagataaggatgacccattccgcctaatgggcttcggtcaccgtgtttataagaactatgaccctcgtgcaaccgtaatgcgtgaagcatgtcacgatgttctaaaagaactaaacattaaagatccactacttgatgtcgcaatggaacttgaacgtattgcactttctgatgaatattttgtatctaagaaattgtatccaaacgtagatttctactcaggtattatcttaaaagcaattggtattcctgtatctatgtttacggttatctttgcaatgtctcgtactgttggctggattgcacactggagcgaaatgcacagtgatccaacaaatcgtatcggtcgtcctcgccaactttatacaggtgaagaactacgcgagtttaaaccgcttcatgagcgtgaataa

SEQ ID NO: 37065 - protein, 429 aa, Vibrio fischeri ES114
MADKKATLHIEGQSPIDMPIMDGTIGPEVIDVRKLGANGYFTFDPGFLATASCESQITYIDGDKGVLLHRGFPIDQLANNADYLEVCYILLNGEAPNREEYETFKDIVTRHTMVHEQISSFFHGFRRDAHPMAVMCGVVGALAAFYHDSLDINNDEHREIAAFRLLSKMPTLSAMSYKYSIGQPFIYPRNDLTYAENFLHMMFANPCEEYEVNPVVARAMDKIFTLHADHEQNASTSTVRLAGSSGANPFACIAAGIASLWGPAHGGANEACLRMLEEIGSVDNIDEYVAKAKDKDDPFRLMGFGHRVYKNYDPRATVMREACHDVLKELNIKDPLLDVAMELERIALSDEYFVSKKLYPNVDFYSGIILKAIGIPVSMFTVIFAMSRTVGWIAHWSEMHSDPTNRIGRPRQLYTGEELREFKPLHERE

SEQ ID NO: 37066 - DNA, 1284 bp, Neisseria gonorrhoeae FA 1090
  CDS (1)..(1284): transl_table=11
atgtccaaatcaatcaaactcaacgtaccgggtcgggcaggtttggagctgccggtattggaagccagcatcgggcatgatgtggttgacattcgggggctgacaaaaaatacaggtttgtttgccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaatacagtccgccgccacacgatggtgcatgaacagctgacttggttcttccggggtttccgccgcgacgcgcatccgatggcgatgatggtcggcgtggtcggcgcgctgtctgcgttctaccaagacagcttggacattactaatcccgaacaccgcaaaatcgcgatttaccgccttatttccaaaatcccgaccattgcggcaatgtgttaccgctattcaaacggtctgccgttcaattatccgaagaataatctttcttattcagaaaacttccttcatatgatgtttgccacaccgtgtgaagactacaaacctaatcccgttttggcacgcgcgctcgaccgcatctttattttgcatgccgaccacgagcaaaacgcctcaacttcaaccgtccgtctggcaggctcttcgggtgcgaacccgtttgcctgtattgctgccggtatcgcctgcctgtggggtgcttcgcacggcggtgcgaacgaagccgtgttgaaaatgctggatgaaatcggcgatgtgtccaatgttgccgcatacatggaaggcgtgaaacagcgcaaataccgcctgatgggcttcggacaccgggtataccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatcccaatgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccggcaggcgagaggtaa

SEQ ID NO: 37067 - protein, 427 aa, Neisseria gonorrhoeae FA 1090
MSKSIKLNVPGRAGLELPVLEASIGHDVVDIRGLTKNTGLFAFDPGFVSTASCESKITYIDGDQGLLYYRGYPIEQLAEKSDYLEVCYLLIYGELPTPEQKAEFDNTVRRHTMVHEQLTWFFRGFRRDAHPMAMMVGVVGALSAFYQDSLDITNPEHRKIAIYRLISKIPTIAAMCYRYSNGLPFNYPKNNLSYSENFLHMMFATPCEDYKPNPVLARALDRIFILHADHEQNASTSTVRLAGSSGANPFACIAAGIACLWGASHGGANEAVLKMLDEIGDVSNVAAYMEGVKQRKYRLMGFGHRVYRNMDPRASIMRETCYEVLKELGLEDSPKFKLAMELEQIALKDPFFIERKLYPNVDFYSGIVLSALGIPTEMFTVIFALSRSVGWISHWHEMISDPSLKIGRPRQLYTGSERRDYVPAGER

SEQ ID NO: 37068 - DNA, 1290 bp, Pseudomonas syringae pv. syringae B728a
  CDS (1)..(1290): transl_table=11
atggctgacaaaaaagcgcagttgatcatcgagggcgctgcccccgtcgagctgccaattctgaccggtacagtgggtccggacgtgatcgacgtacgcggcctgaccgccaccggccgcttcacatttgaccctggtttcatgtccacggcgtcttgcgattcgaagatcacctacatcgatggtgacaatggcattctgctgcaccgcggctacccgatcgaacaactggccgagcagtccgactacctcgaaacctgctacctgctgctcaacggcgaactgcccaccgccgagcagaaagcccagttcgtggccgtggtcaagaaccacacgatggttcacgagcaactcaagacctttttcaacggtttccgtcgcgacgcccacccgatggccgtcatgtgtggcgtagtcggtgccctgtcagcgttctaccacgactcgctggacatcaataacccgcagcaccgcgagatttccgcggtacgcctggtcgccaagatgccgaccctggcagcgatggtctacaagtactccatgggtcagcccatgatgtacccgcgcaacgacctcagctacgcggaaaacttcctgcacatgatgttcaacaccccgtgcgagatcaaaccgatcagcccggtgctggccaaggcgatggacaagatcttcatcctccacgccgatcacgagcagaacgcttcgacctccaccgtgcgcatggcaggctcttcgggcgccaacccgttcgcctgtatcgcagccggcatcgcagcgctctggggccctgcccacggcggcgccaacgaagcggtactgaccatgctcgatgaaatcggcgatgtgtcgaacatcgacacgttcattgccaaggccaaggacaagaacgatccgttcaagctcatgggcttcggtcaccgcgtctacaagaaccgtgacccgcgcgccactgtaatgaagcagacctgcgacgaagtactgaaagagctgggcatcaccaacgatcctcaactcgaactggccatgcgcctcgaagagatcgccctgaccgatccgtacttcatcgagcgctcgctgtacccgaacgtcgacttctattcgggcatcatcctcaaggccatcggcattccgaccagcatgttcaccgtgatcttcgccctggcgcggactgtcggctggatctcgcactggaaagaaatgctctccagcccttacaagatcggtcgccctcgccagctgtacaccggcaacgtgcaacgcgacatcgtcgccctgcaagaccgcaagtaa

SEQ ID NO: 37069 - protein, 429 aa, Pseudomonas syringae pv. syringae B728a
MADKKAQLIIEGAAPVELPILTGTVGPDVIDVRGLTATGRFTFDPGFMSTASCDSKITYIDGDNGILLHRGYPIEQLAEQSDYLETCYLLLNGELPTAEQKAQFVAVVKNHTMVHEQLKTFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDKIFILHADHEQNASTSTVRMAGSSGANPFACIAAGIAALWGPAHGGANEAVLTMLDEIGDVSNIDTFIAKAKDKNDPFKLMGFGHRVYKNRDPRATVMKQTCDEVLKELGITNDPQLELAMRLEEIALTDPYFIERSLYPNVDFYSGIILKAIGIPTSMFTVIFALARTVGWISHWKEMLSSPYKIGRPRQLYTGNVQRDIVALQDRK

SEQ ID NO: 37070 - DNA, 1290 bp, Xanthomonas campestris pv. campestris str. 8004
  CDS (1)..(1290): transl_table=11
gtgtccgatcttgatcaggtcacgctcaacgccggcgacacgtcggtcgttctgccggttctcaagcccacgttgggcaatgattgcgtcgatatttccaagctgaccaaagaaaccggtctgttcacctacgactcgggcttcaccgccaccgccagttgcaagtcggccatcacctacatcgatggcgacaatggcgtgctgctgtaccgcggctacccgatcgaacagttggccgagaagtccagcttcctggaagtttcgtatctgctgatgaacggcgaattgccgacggcggacgaattcaagaagttcgaccacgaagtgacgcatcacacgatgatgcacgagtcgctgaagaacttcctcggcggtttccgccacgatgcgcacccgatggccatgctggccggttcggtggcctcgctgtcggcgttctaccacgacaccctggacctcaacgatccggagcagcgccgtcaggccgccatccgtctgatcgccaaggtgccgaccctggctgctgcggcgtaccgttactcgatcggctggccgatccgctatccgcgcaacaacctgaactacgtcgaccgcttcctgcacatgatgttcgaagtgccgagcgagccgctggagatcaacccggtcgttgccaaggcactggatctgctgttcatcctgcacgccgatcacgagcagaacgcctccacctcgaccgtgcgtctggtcggttcgaccggtgccaacccgtacgcgtccgtggcagccggtatcaccgcgctgtggggcccggcacacggtggcgccaacgaagccgtgctgaagatgctggaagagatcggtaccgctgacaacgtcgagtccgccgtggccaaggccaaggacaagaactcctcgttccgtctgatgggcttcggtcaccgcgtctacaagaacttcgacccgcgcgccaagatcatccgcgagatgacccacaaggtgctgggcgagctgggtgtcaacgacccgctgctggaagttgccctgaagctggaagaagccgcgttgaaggacgactacttcgtgcagcgcaagctgtacccgaacgtggacttctactcgggcctcatctacaaggcgctcaatatcccggtggaaatgttcaccgtgatgttcgccattgcccgcaccgccggctgggtgtcgcattggctggagcagcaggtcgacccggaaatgaagatcggccgtccgcgccagatctacaccggctacgacaagcgcgactacaccgacgccggcaagcgctaa

SEQ ID NO: 37071 - protein, 429 aa, Xanthomonas campestris pv. campestris str. 8004
MSDLDQVTLNAGDTSVVLPVLKPTLGNDCVDISKLTKETGLFTYDSGFTATASCKSAITYIDGDNGVLLYRGYPIEQLAEKSSFLEVSYLLMNGELPTADEFKKFDHEVTHHTMMHESLKNFLGGFRHDAHPMAMLAGSVASLSAFYHDTLDLNDPEQRRQAAIRLIAKVPTLAAAAYRYSIGWPIRYPRNNLNYVDRFLHMMFEVPSEPLEINPVVAKALDLLFILHADHEQNASTSTVRLVGSTGANPYASVAAGITALWGPAHGGANEAVLKMLEEIGTADNVESAVAKAKDKNSSFRLMGFGHRVYKNFDPRAKIIREMTHKVLGELGVNDPLLEVALKLEEAALKDDYFVQRKLYPNVDFYSGLIYKALNIPVEMFTVMFAIARTAGWVSHWLEQQVDPEMKIGRPRQIYTGYDKRDYTDAGKR

SEQ ID NO: 37072 - DNA, 1278 bp, Corynebacterium jeikeium K411
  CDS (1)..(1278): transl_table=11
atggctactgataatcaggacaaggccgttctccactacccaggtggagagtacgaaatggacattgtccgcgccaccgaaggaaacgacggtgtcgcactgggcaagatgctggcagaaaccggcttgaccaccctggatcccggctacgtgaacaccggttccaccaagtccgccatcacctacatcgacggtgcaaacggcatcctgcgttaccgtggctacgacattgccgacctggccaacaacgcaaccttcaacgaggtttcctacctgctgatcaacggcgagctgccgaacaaggagcaggctgaggagttcaacaccaacatccgcaaccacaccctgctggatgaagacttcaaggcacagttccgcgtgttcccgcgcgacgctcacccgatgagcgttctggcttcctccctgaacattctgtccacctactaccaggactccctggatccgctgaacccggatcaccagaagctgaacacctaccgcctgatggcgaaggtgccgatgctggctgcttacgcttaccgcgcttccaagggtaagccgtacatgtacccggataactccatgaacgcgcgccagaacttcctgcgccagatgttcggctacccgaccgagcctttcgaggatgacccggtggttaccaaggctctggacaagctgctgatcctgcacgctgaccacgagcagaactgctccacctccaccgtccgcatggttggttcttcccaggccaacatgttcgtctccatcgccgcaggcatcaacgccctgtccggcccgctgcacggcggtgctaaccaggctgttctggagatgctggaggagatccacgctaacggtggcgacgctaccgagttcatgaaccgcgtgaagaacaaggagccgggcgtgaagctgatgggcttcggtcaccgcgtgtacaagaactacgatccgcgtgcggccatcgtcaaggagtccgctcacgagattctggatcacctgggtggcgaccacctgctggatctggctatgaagctggaagagattgcgctggctgatgattacttcatctcccgcaagctctacccgaacgtggacttctacaccggcctgatctaccgcgctatgggcttcccgacggacttcttcaccgtcctgttcgccatgggtcgcctgccgggctggatcgctcactacctggagcaggtcaacgatccgaccgcgaagatcaaccgtccgcgccagatctacaccggcgagggtgcgcgcaagctctaa

SEQ ID NO: 37073 - protein, 425 aa, Corynebacterium jeikeium K411
MATDNQDKAVLHYPGGEYEMDIVRATEGNDGVALGKMLAETGLTTLDPGYVNTGSTKSAITYIDGANGILRYRGYDIADLANNATFNEVSYLLINGELPNKEQAEEFNTNIRNHTLLDEDFKAQFRVFPRDAHPMSVLASSLNILSTYYQDSLDPLNPDHQKLNTYRLMAKVPMLAAYAYRASKGKPYMYPDNSMNARQNFLRQMFGYPTEPFEDDPVVTKALDKLLILHADHEQNCSTSTVRMVGSSQANMFVSIAAGINALSGPLHGGANQAVLEMLEEIHANGGDATEFMNRVKNKEPGVKLMGFGHRVYKNYDPRAAIVKESAHEILDHLGGDHLLDLAMKLEEIALADDYFISRKLYPNVDFYTGLIYRAMGFPTDFFTVLFAMGRLPGWIAHYLEQVNDPTAKINRPRQIYTGEGARKL

SEQ ID NO: 37074 - DNA, 1290 bp, Pseudomonas fluorescens Pf-5
  CDS (1)..(1290): transl_table=11
atggctgacaaaaaagcgcagttgatcatcgagggcgcagcccccgtcgagctgcccattttaaccggcaccgttggtcccgatgtaatcgatgttcggggtctgacggccacgggccgcttcacttttgacccgggtttcatgtcgaccgcctcctgcgagtcgaaaatcacctacatcgacggcgacaacggcattctgctgcatcgcggctacccgatcgaacagctggccgagaaatccgactacctggaaacctgctacctgctgctcaacggtgaattgcccaccgccgaacagaaggcccagttcgtcagcaccgtgaaaaaccacaccatggttcacgagcagttgaagagcttcttcaacggtttccgccgcgacgcccacccaatggcggtgatgtgcggcgtagtgggtgcactctcggcgttctaccacgactccctggacatcaataacccacagcatcgcgaaatctccgctgtgcgcctggtggccaagatgccgaccctggcagcgatggtttacaagtactccatgggtcagccgatgatgtatccgcgcaacgacctgtcgtacgcggaaaacttcctgcacatgatgttcaacaccccgtgcgagatcaaaccgatcagcccggtactggccaaggcaatggaccggatcttcatcctccatgccgaccacgaacagaacgcctcgacgtccaccgtgcgcctggcgggctcttcgggtgccaacccgttcgcctgtatcgctgccggtatcgccgcgctctggggccctgcccacggcggcgccaacgaagcagtgctgaccatgctcgacgaaattggcgatgtctcgaacatcgacaagttcatcgccaaggccaaggacaagaacgatccgttcaaactcatgggcttcggtcaccgcgtgtacaagaaccgcgacccgcgcgccaccgtgatgaaacagacctgcgacgaagtactcaaggaactgggcatcaacaacgatccgcaactcgaactggccatgcgcctggaagagatcgccctgaccgacccatacttcatcgagcgctcgctgtacccgaacgtcgacttctactcgggcatcatcctcaaggcgatcggcattccaaccagcatgttcaccgtgatcttcgccctggcgcggaccgtcggctggatctcgcactggaaggaaatgctctccagcccgtacaagatcggccgtccacgccagctgtacaccggctacgagtcgcgtgacatcaccaaactggaagaccgcaaataa

SEQ ID NO: 37075 - protein, 429 aa, Pseudomonas fluorescens Pf-5
MADKKAQLIIEGAAPVELPILTGTVGPDVIDVRGLTATGRFTFDPGFMSTASCESKITYIDGDNGILLHRGYPIEQLAEKSDYLETCYLLLNGELPTAEQKAQFVSTVKNHTMVHEQLKSFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDRIFILHADHEQNASTSTVRLAGSSGANPFACIAAGIAALWGPAHGGANEAVLTMLDEIGDVSNIDKFIAKAKDKNDPFKLMGFGHRVYKNRDPRATVMKQTCDEVLKELGINNDPQLELAMRLEEIALTDPYFIERSLYPNVDFYSGIILKAIGIPTSMFTVIFALARTVGWISHWKEMLSSPYKIGRPRQLYTGYESRDITKLEDRK

SEQ ID NO: 37076 - DNA, 1281 bp, Psychrobacter arcticum 273-4
  CDS (1)..(1281): transl_table=11
atggctgataatcaagccacattgaccgtagatggtaaggattaccaacttcctattactgaaggcactttaggaccgtcagttattgatgttgctgctttccaaaaagctggctactggacctatgatccaggctttatggcaaccgctcctgtcgaatcaaaaatcaccttcattgatggtggtaaaggcgaactattgcatcgcggctaccctatcgaccagttagcaaacaatgcagaatatctagaagtggcttatgcactgattcatggtgacctgcctaacgctgagcagaaagcagatttctatgaaaaaatccgtaagcatatgggtgttcatgatcaattgcgtaagttctttgaaggcttccgccgtgacgcgcatccaatggcgattatggttggtgtcgttggtgctttatcagcgttttatcatgaaaatttagatattagcaacgaagaacatcgtgagattacagcgattcgtcttatcgctaaaatgccaacgcttgccgctatgagttataagtactcaaaaggcgaaccgttcatgtacccacgtaatgatttcaattatgctgaaaacttcttatacatgatgtttgcaacgcctgctgatgttaattataaaaccaatgacgttatcactcgcgccatggacaaaatctttaccctgcatgctgaccatgagcaaaacgcatcaacgtctaccgtacgtctagctggctctactggcgcaaacccttacgcttgtatcgctgctggtatcgcagcattgtggggtccatcacatggtggcgccaacgaagcggtacttgagatgctcgatgaaatcggttctgtagaaaacgtgcctgagttcatggaaaaagtgaagagccgtgaagtgaaactgatgggctttggtcatcgtgtttataaaaactttgacccacgtgcacaagtcatgaaagaaacgtgtgatgaagtattaggcgcattgggtatcaatgatcctaagcttgagcttgcaatggcgcttgagaaaattgctttagaagacccgttcttcgttgagcgtaacctgtatccaaacgttgacttttactctggcattatcttaaaagccatcggaatcccaacgtcaatgtttactgtcatcttctcattggctcgtacctctggttggatcagccattggcttgagatgcacagcacaccgttcaaaatcggtcgtccacgtcagttatatactggtgaaacgcatcgcgattttgttaaagttgaagatcgtaaatag

SEQ ID NO: 37077 - protein, 426 aa, Psychrobacter arcticum 273-4
MADNQATLTVDGKDYQLPITEGTLGPSVIDVAAFQKAGYWTYDPGFMATAPVESKITFIDGGKGELLHRGYPIDQLANNAEYLEVAYALIHGDLPNAEQKADFYEKIRKHMGVHDQLRKFFEGFRRDAHPMAIMVGVVGALSAFYHENLDISNEEHREITAIRLIAKMPTLAAMSYKYSKGEPFMYPRNDFNYAENFLYMMFATPADVNYKTNDVITRAMDKIFTLHADHEQNASTSTVRLAGSTGANPYACIAAGIAALWGPSHGGANEAVLEMLDEIGSVENVPEFMEKVKSREVKLMGFGHRVYKNFDPRAQVMKETCDEVLGALGINDPKLELAMALEKIALEDPFFVERNLYPNVDFYSGIILKAIGIPTSMFTVIFSLARTSGWISHWLEMHSTPFKIGRPRQLYTGETHRDFVKVEDRK

SEQ ID NO: 37078 - DNA, 1290 bp, Pseudomonas syringae pv. phaseolicola 1448A
  CDS (1)..(1290): transl_table=11
atggctgacaaaaaagcgcagttgatcatcgagggcgcagcccccgtcgagctgccaattctgaccggtacagtgggtccggacgtgatcgacgtacgcggcctgaccgccaccggccgcttcacatttgaccctggcttcatgtccacggcctcttgcgattcgaagatcacctacattgatggtgacaatggcattctgctgcaccgcggctacccgatcgaacaactggccgagcagtccgattacctcgaaacctgctacctgctgctcaacggcgaactgccgaccgccgaacagaaagcccagttcgtggccgtggtcaagaaccacacgatggttcacgagcaactcaagaccttcttcaacggctttcgtcgcgacgcccacccgatggccgtcatgtgcggcgtagtcggtgccctgtcagcgttctaccacgactcgctggacatcaataacccgcagcaccgcgagatttccgctgtacgcctggtggccaagatgccgaccctggcagcgatggtctacaagtactccatgggccagcccatgatgtacccgcgcaacgacctcagctacgccgaaaacttcctgcacatgatgttcaacaccccgtgcgagatcaaaccgatcagcccggtgctggccaaggcgatggacaagatcttcatccttcacgccgatcacgagcagaacgcctcgacatccaccgtccgcatggcaggctcttcgggcgccaacccgtttgcctgtatcgctgccggcatcgccgcgctctggggcccggcccacggcggcgccaacgaagcggtactgaccatgctggatgaaatcggtgacgtgtcgaacatcgacaagttcatcgccaaggccaaggacaagaacgacccgttcaagctcatgggcttcggccaccgcgtgtacaagaaccgtgacccgcgcgccaccgtaatgaagcagacctgcgacgaagtgctgaaagaactgggcatcaccaacgatcctcaactcgaactggccatgcgcctcgaagagatcgccctgaccgacccgtacttcatcgagcgctcgctgtacccgaacgtcgacttctactcgggcattatcctcaaggccatcggcattccgaccagcatgttcaccgtgatcttcgccctggcgcggactgtcggctggatctcgcactggaaggaaatgctctccagcccctacaagatcggtcgccctcgccagctgtacaccggcaacgtgcaacgcgacatcgtcgccctgcaagaccgcaagtaa

SEQ ID NO: 37079 - protein, 429 aa, Pseudomonas syringae pv. phaseolicola 1448A
MADKKAQLIIEGAAPVELPILTGTVGPDVIDVRGLTATGRFTFDPGFMSTASCDSKITYIDGDNGILLHRGYPIEQLAEQSDYLETCYLLLNGELPTAEQKAQFVAVVKNHTMVHEQLKTFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDKIFILHADHEQNASTSTVRMAGSSGANPFACIAAGIAALWGPAHGGANEAVLTMLDEIGDVSNIDKFIAKAKDKNDPFKLMGFGHRVYKNRDPRATVMKQTCDEVLKELGITNDPQLELAMRLEEIALTDPYFIERSLYPNVDFYSGIILKAIGIPTSMFTVIFALARTVGWISHWKEMLSSPYKIGRPRQLYTGNVQRDIVALQDRK

SEQ ID NO: 37080 - DNA, 1299 bp, Dechloromonas aromatica RCB
  CDS (1)..(1299): transl_table=11
atgacgaccgaacgcaaggcaactttatcaatcgatggacaggctcccgtcgatttttcgatcatgtcaccgacgcatggcaacgattgcatcgatattcgcacactgggtggcaagaccggtctgtttacctacgactccggttttctttccaccgccagttgcaagtccaagattacttttattgatggcgacgtgggccaactgctgtatcgcggttacccgatcgagcaactggctgaaaactgtaacttcctcgaagttacctacttgctgaagaacggcgagttgccgaatgccaagcagaaggctgatttcgaaagcaccatcaagaatcacaccatggtgcatgagcagttgtccaagttcttctctggtttccgccgtgatgcccacccgatggctgtgatgaccggtgtggttggcgcgctgtccgctttctaccacgatgcgatggacttctcggatgcagagcatcgtaatgtcagcttcaatcgtctggtcgccaaaatgccgaccattgtcgcgatggcctataagtacaacactggtgcgccgttcatgtatccggataacagcctggattacaccgccaacttcatgcgcatgatgttcggcaacccgtgtgaaaaatatgtgccgaatccggttctggtccgcgcactcgacaccatcttcacactgcatgccgaccacgagcaaaacgcttctacgtcgaccgtgcgcctggctggctcttcgggtgccaacccgttcgcctgtatcgctgccggtatcgcctgtctgtggggtccggcacacggtggtgccaacgaagcttgcttgcagatgctggaagaaatcggtgatgtttcccgcgtgccggaatacattgctcgcgccaaggacaagaacgattcgttcaagttgatgggctttggtcaccgcgtttacaagaacttcgacccgcgcgccaagctgatgcgccaggtttgcaatgaagtgttggctgagctcggtctggaaaatgaccgcctgttcaagctggccatggaacttgagcgcattgcgctggaagatccgtacttcgtcgagaagaagctttacccgaacgtcgacttctattctggcattgttcagaaagccatcggcattccgactgaaatgttcacctgtatcttcgcattggcccgtaccgtcggctggatgacccagtgggaagaaatgatttccgatccggaatacaagatcggtcgtccgcgtcaactgtacatgggtgcagcaaagcgcgacgtagtgccgctggcccaacgcggctaa

SEQ ID NO: 37081 - protein, 432 aa, Dechloromonas aromatica RCB
MTTERKATLSIDGQAPVDFSIMSPTHGNDCIDIRTLGGKTGLFTYDSGFLSTASCKSKITFIDGDVGQLLYRGYPIEQLAENCNFLEVTYLLKNGELPNAKQKADFESTIKNHTMVHEQLSKFFSGFRRDAHPMAVMTGVVGALSAFYHDAMDFSDAEHRNVSFNRLVAKMPTIVAMAYKYNTGAPFMYPDNSLDYTANFMRMMFGNPCEKYVPNPVLVRALDTIFTLHADHEQNASTSTVRLAGSSGANPFACIAAGIACLWGPAHGGANEACLQMLEEIGDVSRVPEYIARAKDKNDSFKLMGFGHRVYKNFDPRAKLMRQVCNEVLAELGLENDRLFKLAMELERIALEDPYFVEKKLYPNVDFYSGIVQKAIGIPTEMFTCIFALARTVGWMTQWEEMISDPEYKIGRPRQLYMGAAKRDVVPLAQRG

SEQ ID NO: 37082 - DNA, 1128 bp, Prochlorococcus marinus str. NATL2A
  CDS (1)..(1128): transl_table=11
ttggttctaaagccaggcttggaaggggttccagtaaccaactcagggatatgcgaaataaatggaacagaaggaaggcttagctacagaggttatccaatatctgagctagcccaaaaaagtagttttttagaaactgcatttctcttgatctggggagaacttcccactgaaaatgagcttgagaaatttgaaaaggacgttcaaatgcatagacgagtgagctttagaattagagatatgctcaagtgttttccagagtctgggcatcctatggatgctcttcaagcaagtgctgcatctttgggcctcttttattctcgaagagcaattgatgatccaaaatatatctacgacgcagtagtgaggttgattgcaaaaattccaactatggttgctgctttcgagcaaataagaaaaggagacgatccaattcaacctcaagatgatttgccttactcttccaatttcctttatatgctcaccgagagggagccaaatcctcttgcagcaagagttttcgacagatgtttaattcttcatgccgagcacagtctcaatgcaagtacgtttagcgcaagagtaactgcaagcacattgactgatccttatgccgtcgtcgcttctgccgttgggacattagccggtcctcttcatggaggggccaatgaagatgtgatagcaatgctagaagaaattggaagacctgatgaagtctcttcatttctcaatgatgcaattgcaaaaaaaaggaaaatcatgggctttggacacagggagtatcgtgtcaaagaccctagagcaacaattttacaagccttcgcagaggaacttttctcggaatttggtaaagatgaaatgtatgaagtagccaaagcacttgaagaagaggctatttccaagctggggccaaaaggtatattcccaaatgttgacttttattctggactggtttatcgaaagcttggtattcctcgagatttatttacaccagtttttgctatttccagagttgctggttggttggctcactggagagaacaacttggagcaaatagaattttcagaccatcacaaatttatgaaggagcaaaaatgagaaattggaagcctcttgaaagcagataa

SEQ ID NO: 37083 - protein, 375 aa, Prochlorococcus marinus str. NATL2A
MVLKPGLEGVPVTNSGICEINGTEGRLSYRGYPISELAQKSSFLETAFLLIWGELPTENELEKFEKDVQMHRRVSFRIRDMLKCFPESGHPMDALQASAASLGLFYSRRAIDDPKYIYDAVVRLIAKIPTMVAAFEQIRKGDDPIQPQDDLPYSSNFLYMLTEREPNPLAARVFDRCLILHAEHSLNASTFSARVTASTLTDPYAVVASAVGTLAGPLHGGANEDVIAMLEEIGRPDEVSSFLNDAIAKKRKIMGFGHREYRVKDPRATILQAFAEELFSEFGKDEMYEVAKALEEEAISKLGPKGIFPNVDFYSGLVYRKLGIPRDLFTPVFAISRVAGWLAHWREQLGANRIFRPSQIYEGAKMRNWKPLESR

SEQ ID NO: 37084 - DNA, 1302 bp, Ralstonia eutropha JMP134
  CDS (1)..(1302): transl_table=11
atgaccccgtccgaagtgaaagccacgctatcgttctccgatggttcccccagcgtcgacctgccgatctatcagggcaccgtaggcccggacgtgatcgacatccgcaagctgtacggccagaccggcaagttcacctacgaccccggtttcatgtcgacggcttcatgcaattcgaagatcacctacatcgacggcgacaagggtgagttgctgtaccgcggctacccgatcgagcacctggcgcagaagtgcgaccacctcgaaacctgctacttgctgctgaagggcgaactgcctgacgccacacagaaggaagagttcgtgggccgcgtgatgaagcacaccatggtgcatgagcaactgcagttcttcctgcgcggtttccgccgcgacgcccacccgatggccgtgctgaccggtctggtcggtgccatgagcgcgttctaccacgacgcaatggatatcgatgatccgcaccagcgtgaaatctcggccatccgcctgatcgccaagatgccgaccctggtcgccatggcgtacaagtacaacatcggccagccgtacatctatccgcagaacgacctgtcctattcgggtaacttcctgcgcatgatgttcgccacgccgtgtgccccgtacaccgtgaacccggtgctcgagcgcgcgctggaccgtatcttcatcctgcacgccgaccacgagcagaacgcttcgacctcgaccgtgcgcctggccggttcgtcgggtacgaacccgttcgcagcgatcgccgccggcgtggcctgtctgtggggtccggcccacggcggcgccaacgaagccgcgctgaagatgctggaagagatcggcagcgtcgacaacatcggcgagttcatcaagcaggtcaaggacaagaactcgggcgtgcgcctgatgggctttggccaccgcgtgtacaagaactacgatccgcgtgccaagctgatgcgcgaaacttgccatgaagtgctgaacgaactgggcctgcacaacgacccgctgttcaagctcgccatggagctggaaaagatcgcgctggaagacgagtacttcgtcagccgcaagctgtacccgaacgtcgacttctactcgggcatcgtccagcgcgcgctgggcatcccgacgtcgctgttcacctgcatcttcgcgctggcccgcaccccgggctggatctcgcagtgggaagagatgatcaccgatccggagtacaagatcggccgtccgcgccagctgttcaatggcgcggcttcgcgtgaccagtcggaagcggctgcatcctaa

SEQ ID NO: 37085 - protein, 433 aa, Ralstonia eutropha JMP134
MTPSEVKATLSFSDGSPSVDLPIYQGTVGPDVIDIRKLYGQTGKFTYDPGFMSTASCNSKITYIDGDKGELLYRGYPIEHLAQKCDHLETCYLLLKGELPDATQKEEFVGRVMKHTMVHEQLQFFLRGFRRDAHPMAVLTGLVGAMSAFYHDAMDIDDPHQREISAIRLIAKMPTLVAMAYKYNIGQPYIYPQNDLSYSGNFLRMMFATPCAPYTVNPVLERALDRIFILHADHEQNASTSTVRLAGSSGTNPFAAIAAGVACLWGPAHGGANEAALKMLEEIGSVDNIGEFIKQVKDKNSGVRLMGFGHRVYKNYDPRAKLMRETCHEVLNELGLHNDPLFKLAMELEKIALEDEYFVSRKLYPNVDFYSGIVQRALGIPTSLFTCIFALARTPGWISQWEEMITDPEYKIGRPRQLFNGAASRDQSEAAAS

SEQ ID NO: 37086 - DNA, 1302 bp, Ralstonia eutropha JMP134
  CDS (1)..(1302): transl_table=11
atgacgccgtccgatgtgaaagccacgctatcgttctccgatggttcccccagcgttgagctgccgatctacaagggcaccgtaggcccggacgtgatcgacattcgcaagctgtacggccagaccggcaagttcacctacgaccccggtttcatgtcgacggcttcgtgcaattcgaagatcacctacatcgacggcgacaagggcgagctgctgtaccgcggctacccgatcgagcaactggcgcagaagtgcgaccacctcgaaacctgctacctgttgctgaagggcgaactgcccaacgccaagcagaaggaagaattcaccggccacgtcatgaaccacaccatggttcacgagcagctgcagttcttcctgcgcggtttccgccgcgatgcgcacccgatggccgtgctgaccggcctggtcggtgccatgagcgcgttctaccacgacgcgatggacatcgatgatccgcaccagcgcgagatctcggccatccgcctgatcgccaagatgccgaccatggtcgccatggcgtacaagtacaacatcggccagccgtacatctacccgcagaacgacctgtcctactcgggcaacttcctgcgcatgctgttcggcacgccgtgcgccccgtacaccgtgaacccggtgctggagcgtgcgctggaccgaatcttcatcctgcacgccgaccacgagcagaacgcttcgacctcgaccgtgcgtctggccggttcgtcgggtacgaaccccttcgcagcgatcgccgctggcgtggcctgcctgtggggtccggctcacggcggcgccaacgaagccgcgctgaagatgctggaagagatcggcagcgtcgacaacatcggcgagttcatcaagcaggtcaaggacaagaactcgggcgtgcgcctgatgggctttggccaccgcgtgtacaagaactacgatccgcgcgccaagctgatgcgcgaaacctgccatgaagtgctgaacgaactgggcctgcacaacgacccgctgttcaagctcgccatggagctggaaaagatcgcgctggaagacgaatacttcgtcagccgcaagctgtacccgaacgtcgacttctactcgggcatcgtccagcgcgcgctgggtatcccgacgtcgctgttcacctgcatcttcgcgctggctcgtaccccgggctggatctcgcagtgggaagagatgatcaccgatccggaatacaagatcggccgtccgcgccagctgttcaacggcgccgcttcgcgcgacgtgccggacatttccaagcgctaa

SEQ ID NO: 37087 - protein, 433 aa, Ralstonia eutropha JMP134
MTPSDVKATLSFSDGSPSVELPIYKGTVGPDVIDIRKLYGQTGKFTYDPGFMSTASCNSKITYIDGDKGELLYRGYPIEQLAQKCDHLETCYLLLKGELPNAKQKEEFTGHVMNHTMVHEQLQFFLRGFRRDAHPMAVLTGLVGAMSAFYHDAMDIDDPHQREISAIRLIAKMPTMVAMAYKYNIGQPYIYPQNDLSYSGNFLRMLFGTPCAPYTVNPVLERALDRIFILHADHEQNASTSTVRLAGSSGTNPFAAIAAGVACLWGPAHGGANEAALKMLEEIGSVDNIGEFIKQVKDKNSGVRLMGFGHRVYKNYDPRAKLMRETCHEVLNELGLHNDPLFKLAMELEKIALEDEYFVSRKLYPNVDFYSGIVQRALGIPTSLFTCIFALARTPGWISQWEEMITDPEYKIGRPRQLFNGAASRDVPDISKR

SEQ ID NO: 37088 - DNA, 1251 bp, Ehrlichia canis str. Jake
  CDS (1)..(1251): transl_table=11
atggtcaaagaagcagtattggaattagatggtcaaaaagtgaaattaccggttttatgtgatactaatggaaataaagttatagatattacttctttgtataaaggtacaggaatattaacttatgatccaggatttatgtctactgctgcttgtgagtccaagattacatttattgatgggaataaggggatattatgctatagaggatataatatagctgatttagttaataacaataagagttttatagaaatcgtctatttattgttttatgggtcttttcctagtgttgataatttaaaagattttatgttacagatttctcaggagtatatgcctcctgaaatggtttgtgatgttataaagtcattttcacaagattcacatcctatgactatattaatggcatgtttttctgcattggcatcttattatcatgaccaagcagttgataaagatggattaaaacatcctaagttagcagtggctaaggttgcaagcataatagcaatgatttatagatacacgactaatcaggattttattgaacctaatcatggattgtcttatagtgaaaattttatacatatgatgtttgatatttcttcttataaatttactcaagttgttgctaaagctttggatgttatttttacattacatgctgatcatgagcaaaatgcttctactgctactgttaggttggctggttcttctggtgctgacttatttgcttgtttggtagcagggatagcaactttatgggggccagctcatggtggtgctaatgaagctgtgattaatatgttaatggcaattgaaaaaccaagtaacgtaaagcagtttattcaaaaagtaaaagatggtaataaaagtacgaggctaatgggttttggtcatagggtatataaaaattatgatccacgtgctaagataatttgtgaaatttgtaaagaagtcttaaatgatttaggtgtaaatgatccattattagaaatagctttggaattggaaaatatagctttgcaggatagttattttattgaacgtagcttgtatcctaatgtggatttttattctggaattattttaaaagctattggaataccagtgagaatgtttactacattatttgcgttggctagaacatctggttggtctgctcagtggtatgagatggtggcagataagaattataaaatatgtcgtccacgtcagttatatactggtcatattgcaaaaatctag

SEQ ID NO: 37089 - protein, 416 aa, Ehrlichia canis str. Jake
MVKEAVLELDGQKVKLPVLCDTNGNKVIDITSLYKGTGILTYDPGFMSTAACESKITFIDGNKGILCYRGYNIADLVNNNKSFIEIVYLLFYGSFPSVDNLKDFMLQISQEYMPPEMVCDVIKSFSQDSHPMTILMACFSALASYYHDQAVDKDGLKHPKLAVAKVASIIAMIYRYTTNQDFIEPNHGLSYSENFIHMMFDISSYKFTQVVAKALDVIFTLHADHEQNASTATVRLAGSSGADLFACLVAGIATLWGPAHGGANEAVINMLMAIEKPSNVKQFIQKVKDGNKSTRLMGFGHRVYKNYDPRAKIICEICKEVLNDLGVNDPLLEIALELENIALQDSYFIERSLYPNVDFYSGIILKAIGIPVRMFTTLFALARTSGWSAQWYEMVADKNYKICRPRQLYTGHIAKI

SEQ ID NO: 37090 - DNA, 1296 bp, Thiobacillus denitrificans ATCC 25259
  CDS (1)..(1296): transl_table=11
atgaagaaaaccgtcaccctcactttcagcgacggcagtcccgcgattgaattgccgatcgaagagggcacctacggcaagcccgtgatcgacatccgcgccctcggcgcacacggctatttcacgcacgacccgggcttcaccgcgacttcgagctgtacctcgtcgatcacctacatcgacggcgacgaaggcctgctgtactaccggggctacccgatcgaccaactcgcctaccagtcggacttcatggaagtcagctacctgctgctgcacggcgaactgccgacggcggaacagaaggccgggttcgagcagtcgatccgtcaccacacgctgctgcacgaccagatcgaaaacgtgttccgcggctttcgccgcagcgcgcacccgatggcggtgatgatcggcgtgaccggcgcgatgtcggccttctatcacgccggcctcgacaacttcaatcccgagcaccgcgagatcgtcgcccaccgcctgatcgccaagatcccgaccgtcgccgcgtgggcgtacaagttcaacgagggccagcccttcgtctacccgcagaaccgcctgtcctacgccgagaacttcatgtacatgatgttctcgagcccctgcgaggaatacgtgcccaacccggtgctggcgcgcgcgctcgaccgcatcttcatcctgcacgccgaccacgagcagaacgcgtcgacctcgacggtacggctcgccgggtcgagcggcgccaacccctacgcctgcatcgcgagcggcatggcgtcgctgtgggggccgctgcacggcggcgccaacgaagccgtgctccgcatgctcgaggagatcgacgacgcgtccaagattcccgatttcatcaagcgcgcgaaggacaaatccgatcctttccgcctgatgggcttcggtcatcgcgtctacaagaacatggacccgcgcgcggcgatcatccgccgcacctgctacgaggtgctcgacgagcttggcctgcgtgacgatccgcagttcaagatcgcgctcgagctcgagcgcatcgcgcttgaggacgagtacttcatcgagcgcaaactctatccgaacgtcgacttctattcgggcatcatcttccgcgcgatgggtattccgaccagcatgttcacggcattgttcgcgatggcgcgcacggccggctgggtcgcgcagtggcacgagatgttatccgacccggcgcacaagatcggccgcccgcgccagctctacgcgggtccggcgcgacgcgacttcgtgccgctcgaccagcgcagggcctga

SEQ ID NO: 37091 - protein, 431 aa, Thiobacillus denitrificans ATCC 25259
MKKTVTLTFSDGSPAIELPIEEGTYGKPVIDIRALGAHGYFTHDPGFTATSSCTSSITYIDGDEGLLYYRGYPIDQLAYQSDFMEVSYLLLHGELPTAEQKAGFEQSIRHHTLLHDQIENVFRGFRRSAHPMAVMIGVTGAMSAFYHAGLDNFNPEHREIVAHRLIAKIPTVAAWAYKFNEGQPFVYPQNRLSYAENFMYMMFSSPCEEYVPNPVLARALDRIFILHADHEQNASTSTVRLAGSSGANPYACIASGMASLWGPLHGGANEAVLRMLEEIDDASKIPDFIKRAKDKSDPFRLMGFGHRVYKNMDPRAAIIRRTCYEVLDELGLRDDPQFKIALELERIALEDEYFIERKLYPNVDFYSGIIFRAMGIPTSMFTALFAMARTAGWVAQWHEMLSDPAHKIGRPRQLYAGPARRDFVPLDQRRA

SEQ ID NO: 37092 - DNA, 1374 bp, Magnetospirillum magnetotacticum MS-1
  CDS (1)..(1374)
atgggtcactgtgcgggtgaggcggggtacggtcgaccgcgcggcaacggcgcgagcagcagcaggaagggaaccatgaacaccactcagcaggcgaaggtccgactcctcgtcgacgaccaggcgcaggacctgcccgtggtcgcggcgaccgagggcaacgacggcatcgtcgtgtcctccttgctcaagtcgaccggcctcgtgaccgtcgaccccggcttcatgaacaccgcgtcgtgcgagtcgagcatcacgtacatcgacggcgaggccggcatcctccggtaccgcggctacccgatcgagcagctcgccgagcggtcgagcttcctcgaggtggcgtacctcctcatccacggcgagctccccgacgcagcgacgctcgacgccttcgtcgagcgcgtcaaccggcacacgctcgtgcacgaggacttccgcacgttcatgggcacgttcccgcgcaacgcgcaccccatggcggtgctgtcgtccgcgatcaacgcgctgtccacgttctaccccgagtcgctcgacccgttcgacgacgagacggtcgagctcgcgacggtcctgctcctcgcgaagtcgcgcaccatcacgtcgtacctgcaccgccgccgcgtcggcgagccgctgctctacccggactactcgcgcggttacgtcgacgacttcctgcgcatgacgttcgcgacgccgtaccagcagtacgaggccgacccggtcgtcgtcgacgcgctcgacaagctgctcatcctgcacgccgaccacgagcagaactgctcgacgtcgacggtccgcgtcgtcgggtcctcgcacgcgaacctctacgcgtccgtcgcggccggggtcaacgcgctctcgggcccgctgcacggcggcgcgaacgagtcggtgctcaccatgctcgacaagatcgctggcgcggagtacgacgtcgacaccttcatgaagaaggtgaagaacaaggaggacggcgtccgcctcatgggcttcggccaccgggtctacaagaactacgacccgcgcgcggcgatcgtcaagaagtcggccgacgccgtgctctccaccctcggcaagaaggaccagctcctcgacatcgccatgggcctcgaggagatcgcgctcaacgacgactacttcatcgagcgcaagctctaccccaacgtggacttctacacgggcctcatctacaaggccatgggcttctcgcccgccatgttcacgccgctcttcgcgctgggccgcatgcccggctggatcgcgcagtggcgcgagatgatgaaggacccgcagaccaagatcggccgcccgcgccaggtctacgtcggcgagaccgagcgcgactacgtcgccgtctccgaccgctga

SEQ ID NO: 37093 - protein, 457 aa, Magnetospirillum magnetotacticum MS-1
MGHCAGEAGYGRPRGNGASSSRKGTMNTTQQAKVRLLVDDQAQDLPVVAATEGNDGIVVSSLLKSTGLVTVDPGFMNTASCESSITYIDGEAGILRYRGYPIEQLAERSSFLEVAYLLIHGELPDAATLDAFVERVNRHTLVHEDFRTFMGTFPRNAHPMAVLSSAINALSTFYPESLDPFDDETVELATVLLLAKSRTITSYLHRRRVGEPLLYPDYSRGYVDDFLRMTFATPYQQYEADPVVVDALDKLLILHADHEQNCSTSTVRVVGSSHANLYASVAAGVNALSGPLHGGANESVLTMLDKIAGAEYDVDTFMKKVKNKEDGVRLMGFGHRVYKNYDPRAAIVKKSADAVLSTLGKKDQLLDIAMGLEEIALNDDYFIERKLYPNVDFYTGLIYKAMGFSPAMFTPLFALGRMPGWIAQWREMMKDPQTKIGRPRQVYVGETERDYVAVSDR

SEQ ID NO: 37094 - DNA, 1137 bp, Anabaena variabilis ATCC 29413
  CDS (1)..(1137)
atgatggtgtgcgaatataagcctggtttagaaggcattcccgccgcccaatcgagtatcagttatgtagatgggcaaaagggaatactagaatatcgtggcatccggattgaggatttagcccagaagagtacttttctggaaactgcttatcttttaatctggggtgagttgccaacaaaagaagaattgcaagtatttgaggaggaagtccgtcttcatcggcggattaaataccggattcgggatatgatgaagtgctttcccgaatcgggtcatccaatggatgcactccaagcctctgctgcggctttaggcttgttttactcccgtcgagatttgcacaatcctgtctatattcgggatgctgtagtgcgcttaatagctactattccaacgatggtagctgcattccagttgatgcggaaaggcaatgaccccgttaaaccccgcgatgatttagattattccgccaattttctctacatgctcaacgagaaagaaccggatgctttggcggcaaaaatctttgatatctgcttgattctccatgtcgagcatacgatgaatgcttctaccttcagtgctagggtaacagcttcaaccttgacagacccctatgcggtggttgctagcgctgtgggaaccttgggagggcctttacacggtggagccaatgaagaagtaattcagatgttggaagaaatcggttccgtggagaatgtgcgttcttatgtcgaagagaggttgcaacggaaagacaagctcatgggctttggacatcgtgtttacaaggtgaaagacccacgggcaacaattttgcaaggtctcgcagaacagttgtttgccaagttcggcgcggataagtattacgacatcgcccaagaaatggaacgggtagtcgaagagaagcttggtcataaagggatttatcccaatgttgacttttactcaggtctagtgtataggaagatgggtattcctacagacttgtttacaccaatctttgcgatcgctcgtgtggctggttggttagcccactggaaagaacaacttgaagaaaaccgcatcttccgtcctacccaggtttataacggcaaacacagtgttacttacacccccattgaccaacgttaa

SEQ ID NO: 37095 - protein, 378 aa, Anabaena variabilis ATCC 29413
MMVCEYKPGLEGIPAAQSSISYVDGQKGILEYRGIRIEDLAQKSTFLETAYLLIWGELPTKEELQVFEEEVRLHRRIKYRIRDMMKCFPESGHPMDALQASAAALGLFYSRRDLHNPVYIRDAVVRLIATIPTMVAAFQLMRKGNDPVKPRDDLDYSANFLYMLNEKEPDALAAKIFDICLILHVEHTMNASTFSARVTASTLTDPYAVVASAVGTLGGPLHGGANEEVIQMLEEIGSVENVRSYVEERLQRKDKLMGFGHRVYKVKDPRATILQGLAEQLFAKFGADKYYDIAQEMERVVEEKLGHKGIYPNVDFYSGLVYRKMGIPTDLFTPIFAIARVAGWLAHWKEQLEENRIFRPTQVYNGKHSVTYTPIDQR

SEQ ID NO: 37096 - DNA, 1269 bp, Campylobacter coli RM2228
  CDS (1)..(1269): transl_table=11
atgtcaaattctgttactgtaactgacaatagaaatggtaaaagctacgaattccctatatatgatggtactactggtccaagtgttgtggatatggggagtttttataaacaaacaggaatgtttgcttatgatgaaggtttaacttctacagctacttgtaaatcaaaaattacttatattgatggtgaagagggtgttttaatgcaccgtggctatcctatagaatggcttgctgaaaataaactttttttagatgtagtgcatcttttactctataaagaacttccaagcaatgaaagacttgaagcatttagatatgagcttaaaaaacgctcttatatacatgagggtatgcatcgtctttttgattctttccctgataatgctcaccctatggccgttttacaaggcgctgtttcatctcttagtgctttttatcctgatcatttaaatatgaatgttagagaagagtacatggaaatggctgctagagttgtagcaaaaattcctactatagtagccgctgcttatcgttataaaaatggttttcctatggcttatcctaatttagatcgtggatttactgagaactttttatatatgttaagaacctatccttatgatcatgttgagcttaaacctatagaagtaaaagcactcgatactgtatttatgcttcatgcagatcatgaacaaaatgcttctacttctactgttcgtgccgtaggttctactcatgcgcatccttatgcatgtatttcagcaggtattggagcgctttggggtcatgctcatggaggtgcaaatgaaggcgttattagaatgcttgaggaaatagctactgttgatagggtggatgaatttataaaaagagcaaaagataaaaatgacccattccgcttgatgggctttgggcatagggtttataaaaattttgatccgcgtgcaaaagtacttaaaaagcttcgtgatcaattaatcgatgagttaggtattgatacgaatttgattaaggtggcaactcgtatagaagagattgccttgcaagatgattattttgtacaaagaaatctttatccaaatgtagattttcatagcggcttaattttaaaagctctaggaattccaaatgaaatgtttgcaacgcttttcgtgatcggacgtacaccaggctggatagcacaatggatagagcaaaaagagcaagaaacactaaaaattgttcgtccaagacagctttaccttggagaaaccagtaaaatttaa

SEQ ID NO: 37097 - protein, 422 aa, Campylobacter coli RM2228
MSNSVTVTDNRNGKSYEFPIYDGTTGPSVVDMGSFYKQTGMFAYDEGLTSTATCKSKITYIDGEEGVLMHRGYPIEWLAENKLFLDVVHLLLYKELPSNERLEAFRYELKKRSYIHEGMHRLFDSFPDNAHPMAVLQGAVSSLSAFYPDHLNMNVREEYMEMAARVVAKIPTIVAAAYRYKNGFPMAYPNLDRGFTENFLYMLRTYPYDHVELKPIEVKALDTVFMLHADHEQNASTSTVRAVGSTHAHPYACISAGIGALWGHAHGGANEGVIRMLEEIATVDRVDEFIKRAKDKNDPFRLMGFGHRVYKNFDPRAKVLKKLRDQLIDELGIDTNLIKVATRIEEIALQDDYFVQRNLYPNVDFHSGLILKALGIPNEMFATLFVIGRTPGWIAQWIEQKEQETLKIVRPRQLYLGETSKI

SEQ ID NO: 37098 - DNA, 1503 bp, Oryza sativa
  CDS (1)..(1503)
atggatcgcgcccgcctcgccgtgctctccgcccacctcgcctcccccgccgccgcctgcggggaggcggacgcggcggggccgctggagaggtcggcggcgtctgcgggggcgcgaggcggcgcgctggcggtggtggatgggaggacggggaagaggtacgaggtcaaggtgtcggacgaggggaccgtgcgcgccaccgacttcaagaagattaccactggaaaggacgacaagggtcttaagatctatgatcctggttatctcaacacagccccagttcgctcatccatctgctacattgatggggatgagggaattcttcgttacaggggatacccaattgaagagttggctgaaagcagctcatttgttgaggtggcctacctcctgatgtacggaagtttgcctacccagagccaattggctggatgggaatttgcgatttctcagcactctgctgttccccagggactcttggatatcatacaagcaatgcctcatgacgctcatcccatgggtgcccttgccagtgcaatgagcacgctttctgtcttccatccggatgcaaaccctgctcttagaggtcaagatctttacaagtcgaagcaggttagggataagcagattgtgcgagtacttgggaaggcaccaacaattgcagctgcagcgtacttgagattagctggaagacctcctatccttcctacaaatagtctctcttattcagagaacttcttgtatatgctagactctttgggtgacaaagaatacaagccaaatcctagacttgctagggttctagatatcctttttattctccatgctgaacatgaaatgaactgctctacagctgctgctaggcaccttgcttcaagtggtgttgatgtcttcactgctctttctggtgctgttggagctctatatggtccactgcatggtggtgcaaatgaggcggtacttaaaatgttaaatgaaattggaagtgtggagaatattccagatttcatcgagggagtgaaaaacaggaagagaaagatgtcaggttttgggcaccgtgtttacaagaattatgatccccgtgctaaagtcatccgaaagctagcagaggaggtcttctctattgtcggacgggatcctcttatcgaggttgctgttgcgttggagaaggcagcattgtcagatgattattttgtcaagaggaagctgtatccaaatgtggatttttactctggcttaatatatagggcaatgggattccctacagagttcttccctgttctgtttgcaattcctcgcatggctggttggttagcacattggaaagagtcacttgatgatccagacactaagattatgaggcctcagcaggtatacactggtgtttggctgaggcattacacacctgtcagagaacgagtcccagcaagccagggcgaacagcttggtcagattgctacctctaacgcaacaaggcgtcggcgtgcaggttctgccctgtaa

SEQ ID NO: 37099 - protein, 500 aa, Oryza sativa
MDRARLAVLSAHLASPAAACGEADAAGPLERSAASAGARGGALAVVDGRTGKRYEVKVSDEGTVRATDFKKITTGKDDKGLKIYDPGYLNTAPVRSSICYIDGDEGILRYRGYPIEELAESSSFVEVAYLLMYGSLPTQSQLAGWEFAISQHSAVPQGLLDIIQAMPHDAHPMGALASAMSTLSVFHPDANPALRGQDLYKSKQVRDKQIVRVLGKAPTIAAAAYLRLAGRPPILPTNSLSYSENFLYMLDSLGDKEYKPNPRLARVLDILFILHAEHEMNCSTAAARHLASSGVDVFTALSGAVGALYGPLHGGANEAVLKMLNEIGSVENIPDFIEGVKNRKRKMSGFGHRVYKNYDPRAKVIRKLAEEVFSIVGRDPLIEVAVALEKAALSDDYFVKRKLYPNVDFYSGLIYRAMGFPTEFFPVLFAIPRMAGWLAHWKESLDDPDTKIMRPQQVYTGVWLRHYTPVRERVPASQGEQLGQIATSNATRRRRAGSAL

SEQ ID NO: 37100 - DNA, 1233 bp, Thermoproteus tenax
  CDS (1)..(1233): transl_table=11
atgagcgaacagactgtatcaattaggacgaccggcaagatcatacagtcgccttgtggccccatcattcacggccttgaggatgtactggtgaaaataaccaccataagcgatatagatggccacacgggcagactctggtatagaggatatagaattgaggatttggcagagaataccacatatgaggaggtcgtctatcttcttttatacgggaagttgccgagtgcgagagaattggccgatataaagagcaggctcagcgcaaatagggagctgaaccctgccacgatagagattcttcgcgcgctcgccaaggcgcatcccatgttcgctctggaggccgcggtcgcaagcgagggcgcgttcgatgaagataacttaaagttggccgacgcgctgagggccggccgatataagcaagaggagaaggaccttgcgttaagaatagcggagaagctgattgccaaattgcccaccatagttgcatatcattatagattgtcgagggggttagagctagtcagacctaggggcgacttagcccactcggcaaatttcctctatatgttcttcggaaaagagcctgatcctcttgcgactaaagcgatagatctctatctaatcttacatgcagaccacgagatacctgcctcaacttttacggcgttggtcatcggagccactctcagcgatctgtactctgtaatagcgggcgccataggcgccctcaagggcccgctgcacggcggagccaatgaggccgccgtcaagtcctatttggagatcgcagatccctccaaggcgaaggagatagttgaggctgctacgaaacccggcggtccccgcctgatgggcgtaggacaccgcgtttacaaggcctatgatcctcgtgccaagatcttcaaaaagttggtggaggactacacagctaaattcggcgatcctcagagactgtacgccatagcgagcaatattgagcaagcagtgatggcgcatccctacttccaacagagaaagctctatccaaacgtggacttctggtcaggtatagtgttctactatatgggtataccctacgactacttcacgcccctcttcgccatgtccagagttgcgggttggacggcgcatgtattagaatattgggagaacaaccgcctcttcaggccgcgcgcgtgctacgtagggccgcacgaccaacaatttatcccgcttgaaaatagatcttga

SEQ ID NO: 37101 - protein, 410 aa, Thermoproteus tenax
MSEQTVSIRTTGKIIQSPCGPIIHGLEDVLVKITTISDIDGHTGRLWYRGYRIEDLAENTTYEEVVYLLLYGKLPSARELADIKSRLSANRELNPATIEILRALAKAHPMFALEAAVASEGAFDEDNLKLADALRAGRYKQEEKDLALRIAEKLIAKLPTIVAYHYRLSRGLELVRPRGDLAHSANFLYMFFGKEPDPLATKAIDLYLILHADHEIPASTFTALVIGATLSDLYSVIAGAIGALKGPLHGGANEAAVKSYLEIADPSKAKEIVEAATKPGGPRLMGVGHRVYKAYDPRAKIFKKLVEDYTAKFGDPQRLYAIASNIEQAVMAHPYFQQRKLYPNVDFWSGIVFYYMGIPYDYFTPLFAMSRVAGWTAHVLEYWENNRLFRPRACYVGPHDQQFIPLENRS

SEQ ID NO: 37102 - DNA, 1443 bp, Tetrahymena thermophila
  CDS (1)..(1443): transl_table=6
atggaaagaattactgatctcaattaataaattatcactaacgaaactggtgaaaaggaatactacacagtcacagataatagaaatggcaaaacttatgaagttcctatcagaaactctagagaaggaagatatataatggctaaggatattggtaaaattaaagatgctgaaggaaatgtcctccgtgtctacgatcctggttatatgaacactattgttaatacttccagaatttgctatattgatggtgacttgggtgtattagagtatagaggtattccaattgagtagcttgctgagaaatctactttcttggaagtagcttatcttcttatctacggagaattaccaaccaagacccaatttgaagaattcaactaaagaatttcaggtcacacattcttgcatactgatgtcttacaaatgatgaaacacttcagatatgatgctcatcctatgggtatgcttattagcactattgcagcattatctactttccgtcctggttccaaccctgccttagctggttaagatatctataaggacttgaagattcgtaacaaataaatttatcgtattcttggacaagttcctactattgctgctaacgcttatagatctcgtattggtagaaacttcaacaacccatcttctgatcttccttacgttgataacttcctttacatgatggataaattaaatgaaaataaatacagccctcatcctaagttagctaaggctttggatattctctttattctccatgctgaacacgaaatgaattgctcaacagcatttgttagacatttagcttcttctggtgttgatgtatactcttgcatagctggttctgctgctgctctttatggtcctaagcatggtggtgcaaatgaagccgttttaagaatgcttgaataaattggtgatgttaagaatattccctctttcattgataaggtcaagaatagaaaggctttacttttcggttttggtcacagagtctataagaactacgaccctcgtgctaaaatcgtcaagaagactgcttatgaagtttttgaaatctgtggaaaagaacctttaattgaaattgccatcgaattggaaaagatagctcttgaagatgaatttttcattaagagaaagttatatccaaatgttgatttctactctggtgttatttatagagctatgggtttccccactgatatgttcccagtccttttcactattccaagagttgctggttggttagctcattgggttgaatacctcgatgataaggaaaacaacattgttagacccagacaaaactatgttggctatgctaaaagagattatgttcctatggaataaagacaagaagctaaatttaacttagaaagctccaagagttctacttccaagagaagagaagctggtacaagcgttgttttgtga

SEQ ID NO: 37103 - protein, 480 aa, Tetrahymena thermophila
MERITDLNQQIITNETGEKEYYTVTDNRNGKTYEVPIRNSREGRYIMAKDIGKIKDAEGNVLRVYDPGYMNTIVNTSRICYIDGDLGVLEYRGIPIEQLAEKSTFLEVAYLLIYGELPTKTQFEEFNQRISGHTFLHTDVLQMMKHFRYDAHPMGMLISTIAALSTFRPGSNPALAGQDIYKDLKIRNKQIYRILGQVPTIAANAYRSRIGRNFNNPSSDLPYVDNFLYMMDKLNENKYSPHPKLAKALDILFILHAEHEMNCSTAFVRHLASSGVDVYSCIAGSAAALYGPKHGGANEAVLRMLEQIGDVKNIPSFIDKVKNRKALLFGFGHRVYKNYDPRAKIVKKTAYEVFEICGKEPLIEIAIELEKIALEDEFFIKRKLYPNVDFYSGVIYRAMGFPTDMFPVLFTIPRVAGWLAHWVEYLDDKENNIVRPRQNYVGYAKRDYVPMEQRQEAKFNLESSKSSTSKRREAGTSVVL

SEQ ID NO: 37104 - DNA, 1290 bp, Rhizobium fredii
  CDS (1)..(1290): transl_table=11
atgtcaggaacaaacgcgacgatctctatcgatggaaaaacagcggacctcccggtgcgatcgggctccatcggtccggacgtggtggacatctggtcgctctacaagcagaccaagatgttcacctacgatcctggcttcacgtcgacggcatcgtgtgaatccaagatcacctatatcgacggcgacgagggcgtattgctgcaccgcggctacccgatcgagcagcttgccgatcacggtgacttcctcgaagtctgctatcttctgctttacggcgaactgccgaccaaggcgcagaaggacgacttcgactatcgcgtgacgcatcacaccatgattcacgagcagatgtcgcggttcttcaccggcttccgtcgcgacgcccacccgatggccgtcatgtgcggctgcgtcggggcgctgtcggccttctatcatgactcgaccgacatcactgacccgcatcagcgcatggtcgcctcgctgcgcatgatcgccaagatgccgacgattgcggcaatggcctacaagtaccatatcggccagcccttcatttatccgaagaacgacctcgactacgcctcgaacttcctgcgcatgtgctttgccgtgccctgcgaggactatgtcgtcaatccggtcctgtcgcgcgcgatggatcgcatcttcatcctgcacgctgaccatgagcagaacgcctcgacctcgaccgttcgccttgccggctcgtcgggcgccaatccgttcgcctgtatcgctgccggcattgcctgcctatggggtcccgctcacggcggcgccaacgaagcggccctcaacatgctcgccgagatcggcagcgtcgatcgcattccggaatttatcaccagggccaaggacaagaacgacccgttccgcctgatgggcttcggtcaccgcgtctacaagaactatgatccgcgtgcgaagatcatgcagaagacgacgcatgaggtgctggccgaactcggtcacaaggacgacccgctcctcgaagtggcgatggagctcgagcgcatcgcactgacggacgagtacttcatcgagaagaagctctacccgaacatcgacttctattccggtatcacgctgaaggcgctgggcttccccaccacgatgttcaccgttctcttcgcgcttgctcgcacggtcggctggatcgcccagtggaacgagatgatcgaggatccggaacagcgcatcggtcggccgcgccagctgtatgtcggcgcaccgctgcgcgattacgtgccgctctccaagcgctga

SEQ ID NO: 37105 - protein, 429 aa, Rhizobium fredii
MSGTNATISIDGKTADLPVRSGSIGPDVVDIWSLYKQTKMFTYDPGFTSTASCESKITYIDGDEGVLLHRGYPIEQLADHGDFLEVCYLLLYGELPTKAQKDDFDYRVTHHTMIHEQMSRFFTGFRRDAHPMAVMCGCVGALSAFYHDSTDITDPHQRMVASLRMIAKMPTIAAMAYKYHIGQPFIYPKNDLDYASNFLRMCFAVPCEDYVVNPVLSRAMDRIFILHADHEQNASTSTVRLAGSSGANPFACIAAGIACLWGPAHGGANEAALNMLAEIGSVDRIPEFITRAKDKNDPFRLMGFGHRVYKNYDPRAKIMQKTTHEVLAELGHKDDPLLEVAMELERIALTDEYFIEKKLYPNIDFYSGITLKALGFPTTMFTVLFALARTVGWIAQWNEMIEDPEQRIGRPRQLYVGAPLRDYVPLSKR

SEQ ID NO: 37106 - DNA, 1134 bp, Thermus aquaticus
  CDS (1)..(1134): transl_table=11
atggaagtggcacggggtcttgagggcgttctcttcacggaaactcggatgtgctttattgacggggaggcgggccgcctttactactacggcatccccattcaggagctggcggagaagagcacctttgaggagaccacctacttgcttctccacggcagactgcctcagcgaggggagctagaggcctttaaaaaggacctggcggccaggcgggctttgccttctcacctcctggagtccttccggcgctaccccgcctcggcccaccccatgagctttttgcgcaccgccgtctccgagctgggcatgctggaccccaccgagggagatatctcccgggaggccctgtaccagaagggcctggacctgatcgccaagttcgccaccatcgtggccgccaacaagcgcctcaaggagggtaaggagccccttcctccccgggaggacctctcccacgccgccaacttcctttacatggcgaacggcgtggagccttcccctgagcaagagcgcctcatggacgcggccctcatcctccacgccgagcacggcttcaacgccagcaccttcaccgccatcgccgccttctccacggagaccgacctctactcggccatcaccgccgccgtggcctctttgaagggccccaggcacggtggggccaacgaggcggtcatgaagatgatccaggagatcggcgcgcccgaaagggcccgggagtgggtgcgggaaaagctttccaagaaagagcggatcatgggcatgggccaccgggtctacaaggcctttgaccccagggccggggttctggagaagctggcccgccgcgtggcggagaagcacgggcactcccccgagtaccagatcctcaagatcgtggaggaggaggcggggaaggtgctgaacccgcggggcatctaccccaacgtggacttctattccggggtggtctactccgacctgggcttcgggctggagttcttcacccccatcttcgccgtggcccgcatctccggctgggtggggcacatcctggagtacaaggagcaggacaaccgcctcctgcgccccgacgccaagtacatcggggagctggaccggccctacgtgcccctggaggccaggggctga

SEQ ID NO: 37107 - protein, 377 aa, Thermus aquaticus
MEVARGLEGVLFTETRMCFIDGEAGRLYYYGIPIQELAEKSTFEETTYLLLHGRLPQRGELEAFKKDLAARRALPSHLLESFRRYPASAHPMSFLRTAVSELGMLDPTEGDISREALYQKGLDLIAKFATIVAANKRLKEGKEPLPPREDLSHAANFLYMANGVEPSPEQERLMDAALILHAEHGFNASTFTAIAAFSTETDLYSAITAAVASLKGPRHGGANEAVMKMIQEIGAPERAREWVREKLSKKERIMGMGHRVYKAFDPRAGVLEKLARRVAEKHGHSPEYQILKIVEEEAGKVLNPRGIYPNVDFYSGVVYSDLGFGLEFFTPIFAVARISGWVGHILEYKEQDNRLLRPDAKYIGELDRPYVPLEARG

SEQ ID NO: 37108 - DNA, 1212 bp, Neorickettsia helminthoeca
  CDS (1)..(1212): transl_table=11
atggacactgacgaggtcacgataaagatacaggctacggtcaaaagcagtgggggccccaatggaatattgatttcttcggagcccagaagttttatctacgatcctggttatgtctccacggcttcgtgtaaatctgagatcaccttcgtagacggtgaggagggtgtactcttgtacagaggttaccctgtagatgaacttgctactcaatgcgattttcttcgagtcgtatacctacttctgtatggtgaactcccagaccctgtccgcgcaaaagaattccgtactttcattcagaattttccacagcttccagattgcgtcctcgagaatatttgctcctttccaagggatgcacatcccatggtgattctgatttctgcttttgcagccctggcttctgctcaccatgactctgacttcgagacgcacaaagaagtgctaatcgctaatgtgccaagacttgtagcatatatttatagatatattacttctcaggacttcataccgcctgatgcatgcctttcctacgttgggaactttttttatatgatgttcggggagaaaaaacctgattatgaaagcatcttagataagattctgattctacatgcagatcatgagcagaacgcttccacatcgactgctaggatggttgtttcttctggtgcaagcccaattgctgcagtcagcgctgcaacggctacgttatggggtccactgcacggcggtgcaaatgagaaagtcctgcacatgctgggagaaatcgaaaaacaaggtgggagcgtggaggaattcattgagcgcgtcaaaagaaaagaagaaagactaatgggtttcgggcatagggtctacaagaactatgatcccagagcggtaattctgaagagtacggctcaggatattttaaagggaagttcttctattctgagtatcgcaagcaaacttgaaagtattgcttccaatgatgagtatttcataagtcgcaagctctatccgaatgtagatttctactcgggaataatactcaatgcattagggattccaacatatatgtttacacctatctttgctctcgcaaggacgtctggctgggtcgcccagataaaagagttcctaagtgacaaggagcagaaaatcgctagacctagacagatttatataggtaaacccttcaggaaagttgcctcacagagtgaaaaactctag

SEQ ID NO: 37109 - protein, 403 aa, Neorickettsia helminthoeca
MDTDEVTIKIQATVKSSGGPNGILISSEPRSFIYDPGYVSTASCKSEITFVDGEEGVLLYRGYPVDELATQCDFLRVVYLLLYGELPDPVRAKEFRTFIQNFPQLPDCVLENICSFPRDAHPMVILISAFAALASAHHDSDFETHKEVLIANVPRLVAYIYRYITSQDFIPPDACLSYVGNFFYMMFGEKKPDYESILDKILILHADHEQNASTSTARMVVSSGASPIAAVSAATATLWGPLHGGANEKVLHMLGEIEKQGGSVEEFIERVKRKEERLMGFGHRVYKNYDPRAVILKSTAQDILKGSSSILSIASKLESIASNDEYFISRKLYPNVDFYSGIILNALGIPTYMFTPIFALARTSGWVAQIKEFLSDKEQKIARPRQIYIGKPFRKVASQSEKL

SEQ ID NO: 37110 - DNA, 1197 bp, Ehrlichia sennetsu
  CDS (1)..(1197): transl_table=11
atgaattctgaaaaagtaaaagtgaatgtggaggaatttttaaaaagcacagctggacccttcggtgtctctgcctctttggaaccaaagggattcttttatgatccagggtatgcaaaaactgctccatgcaaatctagcattactttcatagatggtgaaaatgggatacttctgcacaggggctacccaatagaggaattggcacaaacttctgactttttgcaggtcggctaccttctcattgacggcaaacttccagattccgctgctacgcgagagtttgaagagaggataaaacacgtaccgcagcttcctgagtgtgtcttgaaaaatatccgttctttcccaacgagtgcgcacccgatggcagttttaatctctgcacttgcttcgctcgcctcagtgtacggagaaatggactttaatcagaagaagttacttttagttgcctatacgccatggctcatagcgcatatataccgacacatcaattctctggagttcgttgaacctgacatcaggcttccttataccgagaatttcctgtacatgatgtttggtgagaaaaagcccaaagatgcggaaatcttggacaaaatctttatcttgcatgcggaccatggtcaaactgcttcgacctctgttgcacggatggttgtatcttcaggagcaagcccgattgcggcatgttctgcggctacagctagtttatggggaccactgcacggtggcgcaaatgagcgagtcctggaaatgttgagaggtatagttgaaagcggtgagaaggtagaaaacttcattgagcgcgttaaaagaaaagaagagagacttatgggttttgggcacagggtgtataaaaactatgatcctcgtgcagccatattaaagcaaaaggctcatgatgtgctaaaagccgattcacctattctaaaaactgctggcgaacttgaaacaatcacagcaagggaagagtactttctgagtcgcaaattatatcctaatgtcgacttctattcgggaatagtgctagacgcactgggaatatcatcttgcatgttcacaccgattttcgcacttgctagaacagtaggttgggttgcacaaatcacagagttcttgagtgacagtgaacaaaaactttgcagacctagacaaatttacgtaggcgaaccaagaagaaacgtacacggttga

SEQ ID NO: 37111 - protein, 398 aa, Ehrlichia sennetsu
MNSEKVKVNVEEFLKSTAGPFGVSASLEPKGFFYDPGYAKTAPCKSSITFIDGENGILLHRGYPIEELAQTSDFLQVGYLLIDGKLPDSAATREFEERIKHVPQLPECVLKNIRSFPTSAHPMAVLISALASLASVYGEMDFNQKKLLLVAYTPWLIAHIYRHINSLEFVEPDIRLPYTENFLYMMFGEKKPKDAEILDKIFILHADHGQTASTSVARMVVSSGASPIAACSAATASLWGPLHGGANERVLEMLRGIVESGEKVENFIERVKRKEERLMGFGHRVYKNYDPRAAILKQKAHDVLKADSPILKTAGELETITAREEYFLSRKLYPNVDFYSGIVLDALGISSCMFTPIFALARTVGWVAQITEFLSDSEQKLCRPRQIYVGEPRRNVHG

SEQ ID NO: 37112 - DNA, 1197 bp, Ehrlichia risticii
  CDS (1)..(1197): transl_table=11
atgaattctgaaaaagtaaaagtaaatgtggaggaatttttaaaaagcacagctggaccctccggtgtctctgcctctttggaaccaaggggattcttttatgatccagggtatgcaaaaactgctccttgcaaatctagcattactttcatagatggtgaaaacgggatacttttgcacaggggctacccaatagaggaattggcacaaacttctgactttttgcaggttggctaccttctcattaacggcaaacttccagattccattgctacgcgagagtttgaagagaagataaagcacgtaccgcagcttcctgaatgcgtcttaaaaaatatccgttctttcccaacaagtgcacacccgatggcagttttaatctctgcacttgcttcgctcgcctcagtgtatggagaaatggactttcatgagaagaagttacttctagttgcctacacgccatggcttgtagcgtatatataccgacacatcaattctcaggagttcattgaacctgacatcaggcttccttacactgagaatttcctgtacatgatgtttggtgagaaaaagcccaaagatgcggaaatcttggacaaaatctttatcttgcatgcagaccatggtcaaactgcttctacctctgttgcacggatggttgtatcctcaggagcaagcccaattgtcgcatgttctgcggctacagctagtttatggggaccactgcacggtggcgcaaatgagcgagtcctagaaatgttgagaggtatcattgaaagcggtgagaacgtagagaactttattgagcgcgttaaaagaaaagaagagagacttatgggtttcgggcacagggtgtataaaaactatgatcctcgtgcagccatattgaagcaaaaagctcatgatgtgctaaaagccgattcacctattctaaaaactgctggcaaacttgaaacgattgcaacaagggaagagtactttctgagtcgcaaattataccctaatgtcgacttctattcgggaatagtgctggacgcactagggataccatcctgcatgttcacaccgattttcgcacttgctagaacagtaggttgggttgcacaaatcgcagaattcttgagtgacagtgaacagaaactttgtagacctagacaaatttacgtaggcgaaccaagaagaagcgtacacggttaa

SEQ ID NO: 37113 - protein, 398 aa, Ehrlichia risticii
MNSEKVKVNVEEFLKSTAGPSGVSASLEPRGFFYDPGYAKTAPCKSSITFIDGENGILLHRGYPIEELAQTSDFLQVGYLLINGKLPDSIATREFEEKIKHVPQLPECVLKNIRSFPTSAHPMAVLISALASLASVYGEMDFHEKKLLLVAYTPWLVAYIYRHINSQEFIEPDIRLPYTENFLYMMFGEKKPKDAEILDKIFILHADHGQTASTSVARMVVSSGASPIVACSAATASLWGPLHGGANERVLEMLRGIIESGENVENFIERVKRKEERLMGFGHRVYKNYDPRAAILKQKAHDVLKADSPILKTAGKLETIATREEYFLSRKLYPNVDFYSGIVLDALGIPSCMFTPIFALARTVGWVAQIAEFLSDSEQKLCRPRQIYVGEPRRSVHG

SEQ ID NO: 37114 - DNA, 1236 bp, Anaplasma phagocytophilum
  CDS (1)..(1236): transl_table=11
atggtagaaaaagctgttttggagtgtggagaccgtaggattagtttgccggttttacgcggcacggacgggaccccagtggttgatatcacaaccctatatagggagaacaatgtgctcacatatgacccgggttttatgtccactgctgcttgcagatcagagataactttcattgatggaaacaagggaactctacgctacaggggtattgatatagaaaatctgatcggtacacccaatagcttcagtagtatagtgtatttgttattgaatggtactctgccttctgaaactgagcatgaagagtttgcgcggattttgggcgctgaatacgatgtgcctgaacaagttatgaacgttattagatcattccctcgagattcgcatcctatggctattctcatagctagcttttctgctttagctgctaattaccacgcaagtcgcattgatccgcttacaggtgctatcatcgcaattgcgaaagtacccggcattgttgcaagtatttataggcacactgcaaatctagattttatacaagctgacgcaaacttagagtacacgcatcactttatcaggatgatgtttggcgacatggatgatgcacatcgtgatattatgcacaaagctctagatgcaatttttataatgcacgcagatcatgagcagaatgcctctacttccactgtgcgtatgacaggatcttctggagcaggtttatttgcatgtttgtgcgcaggagtggccactctgtgggggccagcgcatgggggcgcaaatgaggctgttataaagatgcttgctgagattggttcaccagaaaatgtttcgtcatttatcgacaaggtaaaaaacaacaagggcaaaagtcgtcttatggggttcgggcaccgtgtttataaaagctatgaccctagagcgcgtgttttgcgtacaatctgtaaagatgtattagattctctaggtagagatgagaatttgctagctgttgcagaagagttagaaagtcaggctttgcaggatgagtattttattgagcgcaagttgtacccaaatgtcgacttttactcaggtatagtgctaagagctatgggggttccggtagatatgtatactgcattctttgccttggcacggacgtctggatgggcatctcaatggtatgagatgattcaaagtgatgaagggaaacggatcagccgcccacgccagttatacacaggaaaataa

SEQ ID NO: 37115 - protein, 411 aa, Anaplasma phagocytophilum
MVEKAVLECGDRRISLPVLRGTDGTPVVDITTLYRENNVLTYDPGFMSTAACRSEITFIDGNKGTLRYRGIDIENLIGTPNSFSSIVYLLLNGTLPSETEHEEFARILGAEYDVPEQVMNVIRSFPRDSHPMAILIASFSALAANYHASRIDPLTGAIIAIAKVPGIVASIYRHTANLDFIQADANLEYTHHFIRMMFGDMDDAHRDIMHKALDAIFIMHADHEQNASTSTVRMTGSSGAGLFACLCAGVATLWGPAHGGANEAVIKMLAEIGSPENVSSFIDKVKNNKGKSRLMGFGHRVYKSYDPRARVLRTICKDVLDSLGRDENLLAVAEELESQALQDEYFIERKLYPNVDFYSGIVLRAMGVPVDMYTAFFALARTSGWASQWYEMIQSDEGKRISRPRQLYTGK

SEQ ID NO: 37116 - DNA, 1236 bp, Anaplasma phagocytophilum
  CDS (1)..(1236): transl_table=11
atggtagaaaaagctgttttggagtgtggagaccgtaggattagtttgccggttttacgcggcacggacgggaccccagtggttgatatcacaaccctatatagggagaacaatgtgctcacatatgacccgggttttatgtccactgctgcttgcagatcagagataactttcattgatggaaacaagggaactctacgctacaggggtattgatatagaaaatctgatcggtacacccaatagcttcagtagtatagtgtatttgttattgaagggtactctgccttctgaaactgagcatgaagagtttgtgcggattttgggcgctgaatacgatgtgcctgaacaagttatgaacgttattagatcattccctcgagattcgcatcctatggctattctcatagctagcttttctgctttagctgctaattaccacgcaagtcgcattgatccgcttacaggtgctatcatcgcaattgcgaaagtacccggcattgttgcaagtatttataggcacactgcaaatctagattttatacaagctgacgcaaacttagagtacacgcatcactttatcaggatgatgtttggcgacatggatgatgcacatcgtgatattatgcacaaagctctagatgcaatttttataatgcacgcagatcatgagcagaatgcctctacttccactgtgcgtatgacaggatcttctggagcaggtttatttgcatgtttgtgcgcaggagtggccactctgtgggggccagcgcatgggggcgcaaatgaggctgttataaagatgcttgctgagattggttcaccagaaaatgtttcgtcatttatcgacaaggtaaaaaacaacaagggcaaaagtcgtcttatggggtttgggcaccgtgtttataaaagctatgaccctagagcgcgtgttttgcgtacaatctgtaaagatgtattagattctctaggtagagatgagaatttgctagctgttgcagaagagttagaaagtcaggctttgcaggatgagtattttattgagcgcaagttgtacccaaatgtcgacttttactcaggtatagtgctaagagctatgggggttccggtagatatgtatactgcattctttgccttggcacggacgtctggatgggcatctcaatggtatgagatgattcaaagtgatgaagggaaacggatcagccgcccacgccagttatacacaggaaaataa

SEQ ID NO: 37117 - protein, 411 aa, Anaplasma phagocytophilum
MVEKAVLECGDRRISLPVLRGTDGTPVVDITTLYRENNVLTYDPGFMSTAACRSEITFIDGNKGTLRYRGIDIENLIGTPNSFSSIVYLLLKGTLPSETEHEEFVRILGAEYDVPEQVMNVIRSFPRDSHPMAILIASFSALAANYHASRIDPLTGAIIAIAKVPGIVASIYRHTANLDFIQADANLEYTHHFIRMMFGDMDDAHRDIMHKALDAIFIMHADHEQNASTSTVRMTGSSGAGLFACLCAGVATLWGPAHGGANEAVIKMLAEIGSPENVSSFIDKVKNNKGKSRLMGFGHRVYKSYDPRARVLRTICKDVLDSLGRDENLLAVAEELESQALQDEYFIERKLYPNVDFYSGIVLRAMGVPVDMYTAFFALARTSGWASQWYEMIQSDEGKRISRPRQLYTGK

SEQ ID NO: 37118 - DNA, 1326 bp, Mycobacterium smegmatis
  CDS (1)..(1326): transl_table=11
gtgtgtatgctcaaacagtcccagccgaccaggcgtccgacacggcctcagcgtaccttcacctaccccggtggaaagctggagctcccgatcctgaaggccaccgaggggacagactcggtcgctctcggcaagttcctggccgagacaaacctgaccacgttcgacagtgggttcatgaacaccgcgtcgacgaagtcggccatcacctacatcgacggtgagcagggcatcctccgctaccggggcatcccgatcgagcagctcgcggagaagtcgaccttcatcgaggtgagctacctgctcatctacggcgagctcccgaccccgacccagctcgaggagttcaccaccaagatccagcggcacaccctgctgcacgaggatctcaagcgcttcttcgacggcttcccccgcaacgcgcaccccatgccggtgctgtcgagcgcggtcaacgccctgtcggcctactaccaggactcgctcgatcccaaggacgacgagcaggtcgagctgtcgaccatccgcctcctggcgaagctgccgaccatcgccgcctacgcctacaagaagtcggccggtcagcctttcctgtacccggacaactcgctgagcctcgtcgagaacttcctgcggatgaccttcggcttcccggccgagccctacgaggtcaacccggatgtcgccaaggcgctcgacatgctgttcatcctgcatgccgaccacgagcagaactgctcgacctcgaccgtccgcctcgtcggctcgtcgcaggccaacctcttcacctcgatctcgggcggcatcaacgccctctggggcccgctgcacggcggcgccaaccaggcggtcctcgagatgctcgacgccatcaaggccgacggcggcgacaccaagaagttcatggagcgggtcaagaacaaggaagccggcgtcaagctgatgggcttcggtcaccgcgtctacaagaactacgatccgcgcgccgcgatcgtgaagaagaccgccgaccagatcctggaaaccctcggtgtccaggacgatctgctcgagatcgccaagggtctcgaagaggtcgccctcaacgacgactacttcatcgagcgcaagctgtacccgaacgtggacttctacaccggtgtcatctaccgtgcgatgggcttcccgacgcgcatgttcaccgttctgttcgcgttgggtcgccttccgggctggatcgcccactggcgtgagatgcacgaggatccgaccaccaagatcggccgtccgcgtcagctctacaccggctacaccgagcgcgactacgtgccgatgagcgatcgctga

SEQ ID NO: 37119 - protein, 441 aa, Mycobacterium smegmatis
MCMLKQSQPTRRPTRPQRTFTYPGGKLELPILKATEGTDSVALGKFLAETNLTTFDSGFMNTASTKSAITYIDGEQGILRYRGIPIEQLAEKSTFIEVSYLLIYGELPTPTQLEEFTTKIQRHTLLHEDLKRFFDGFPRNAHPMPVLSSAVNALSAYYQDSLDPKDDEQVELSTIRLLAKLPTIAAYAYKKSAGQPFLYPDNSLSLVENFLRMTFGFPAEPYEVNPDVAKALDMLFILHADHEQNCSTSTVRLVGSSQANLFTSISGGINALWGPLHGGANQAVLEMLDAIKADGGDTKKFMERVKNKEAGVKLMGFGHRVYKNYDPRAAIVKKTADQILETLGVQDDLLEIAKGLEEVALNDDYFIERKLYPNVDFYTGVIYRAMGFPTRMFTVLFALGRLPGWIAHWREMHEDPTTKIGRPRQLYTGYTERDYVPMSDR

SEQ ID NO: 37120 - DNA, 1137 bp, Anabaena sp
  CDS (1)..(1137): transl_table=11
atgatggtgtgcgaatacaagcctggtttagaaggcattcccgccgcccaatcgagtatcagttatgtagatgggcaaaagggaatactagaatatcgtggcatccggattgaggatttagcccagcaaagtacttttctggagactgcttatcttttaatctggggtgagttgccaacaaaagaagaattgcaagtatttgaggaggaagtccgtcttcatcggcggattaaataccggattcgggatatgatgaagtgctttcccgaatctggtcatccaatggatgcactccaagcctctgcggcggctttaggcttgttttactcccgtcgagatttgcacaatcgctgctatattcgggatgctgtagtgcggctaatagctactattccgacgatggtagctgcattccagttgatgcggaaaggtaatgaccccgttaagccccgtgatgatttagattattccgccaattttctctacatgctcaacgagaaagaaccggatgctttggcggcaaaaatctttgatatctgcttgattctccatgtcgagcatacgatgaatgcttccacctttagtgctagggtaacagcttccaccttgactgacccgtatgcggtggttgctagcgctgtggggactttaggagggcctttacacggtggagccaatgaagaagtaatccagatgttggaagagattggttccgtggagaatgtgcgttcttatgtcgaggagaggttgcaacgtaaagacaagctcatgggctttggacatcgtgtctacaaagttaaagacccacgggcgacaattttgcaaggcctcgcagaacagttgtttgccaagttcggcgcagataagtattacgacatcgcccaagaaatggaacgggtagtcgaagagaaacttggtcataaagggatttatcccaatgttgacttctactctggtttagtgtatcggaagatgggtattcctacagacttgtttacaccaatctttgcgatcgctcgtgttgctggttggttagcccactggaaagaacaactcgaagagaaccgcattttccgtcctacccaggtttacaacggcaaacacagtgttacctacacccccattgaccaacgttaa

SEQ ID NO: 37121 - protein, 378 aa, Anabaena sp
MMVCEYKPGLEGIPAAQSSISYVDGQKGILEYRGIRIEDLAQQSTFLETAYLLIWGELPTKEELQVFEEEVRLHRRIKYRIRDMMKCFPESGHPMDALQASAAALGLFYSRRDLHNRCYIRDAVVRLIATIPTMVAAFQLMRKGNDPVKPRDDLDYSANFLYMLNEKEPDALAAKIFDICLILHVEHTMNASTFSARVTASTLTDPYAVVASAVGTLGGPLHGGANEEVIQMLEEIGSVENVRSYVEERLQRKDKLMGFGHRVYKVKDPRATILQGLAEQLFAKFGADKYYDIAQEMERVVEEKLGHKGIYPNVDFYSGLVYRKMGIPTDLFTPIFAIARVAGWLAHWKEQLEENRIFRPTQVYNGKHSVTYTPIDQR

SEQ ID NO: 37122 - DNA, 1443 bp, Arabidopsis thaliana
  CDS (1)..(1443)
atggagatttcggagagagctagagctcgattagccgttctcaatgcgcacttgacagtatctgagccgaatcaggtgttgccagcgatcgaaccatggtgcacatcggctcacataaccgctgcaccgcatggatcgcttaaaggaaatttgaagatcgtcgatgagcgtacggggaatgaatatcaggtcccagtctcagagcatggtaccgttaaaaccgttgatctcaagaagataacgacagggaaggatgacaaggggcttaacttatacgatcctggttacttaaacacggctcctgttcgatcttcgatttcttacatcgatggagatgagggaatcctacgttatcggggatacccagttgaggagttggctgagaaaagtacttatacagaggttacttatctcctaatttatgggaatctgccttctcaaagacagctagctgattgggagtttgcgatttctcagaattcagctgtgccacaaggagtattggatatgatacagtccatgcctaatgatgtacatccagtaggagctcttgtcactgcaatgagtgcactttccatcttttatcctgatgcaaatccgtctcttatgggcctaggtgtttacaagtcaaaacaagttcgtgataaacagattgttcgtgttcttggacaggccccaacaattgcagcagctgcttatttgaggaaggcaggcaagcctcctgttcaacctttgagcaacctttcttattcagagaatttcctctatatggtggaatcaatgggagataggtcttacaagcctaatcctcgtttggctcgagtgctggacatcctcttcatactgcaagctgaacatgaaatgaactgctctactgctgctgctaggcacctttcctctagtggtggtgatgtgtatactgctgtttcgggaggtgttggagccatttatggtccccttcatggtggtgcagttgaggctacgattaacatgttatcagagattgggactgttgaaaatattccagagttcattgaaagcgtgaagaataagaagaggaggttgtcgggttttggacaccgcatttacaaaaactacgatcccagaggaaaagtcgttaagaaactggcggatgaagtgttctccattcttggaagggatcctctggttgaggtaggagatgctctagagaaggcggcactttctgatgaatattttgttaagagaaagctgtacccaaatgttgatttctactctggattaatcaatagggcaatgggaatcccatcatcattcaccgcagtatcacgtatcgctggatacttgtcacactggcgtgagtctttagatgatcctgacacaaagatcatgagaccccaacaggtctatactggagcggggataaggcattacgagacagtgagagaaagaaccaagctgtga

SEQ ID NO: 37123 - protein, 480 aa, Arabidopsis thaliana
MEISERARARLAVLNAHLTVSEPNQVLPAIEPWCTSAHITAAPHGSLKGNLKIVDERTGNEYQVPVSEHGTVKTVDLKKITTGKDDKGLNLYDPGYLNTAPVRSSISYIDGDEGILRYRGYPVEELAEKSTYTEVTYLLIYGNLPSQRQLADWEFAISQNSAVPQGVLDMIQSMPNDVHPVGALVTAMSALSIFYPDANPSLMGLGVYKSKQVRDKQIVRVLGQAPTIAAAAYLRKAGKPPVQPLSNLSYSENFLYMVESMGDRSYKPNPRLARVLDILFILQAEHEMNCSTAAARHLSSSGGDVYTAVSGGVGAIYGPLHGGAVEATINMLSEIGTVENIPEFIESVKNKKRRLSGFGHRIYKNYDPRGKVVKKLADEVFSILGRDPLVEVGDALEKAALSDEYFVKRKLYPNVDFYSGLINRAMGIPSSFTAVSRIAGYLSHWRESLDDPDTKIMRPQQVYTGAGIRHYETVRERTKL

SEQ ID NO: 37124 - DNA, 1296 bp, Mycobacterium tuberculosis
  CDS (1)..(1296): transl_table=11
gtggccgacaccgacgacaccgcaaccctccgttacccgggaggcgagatcgacctgcagatcgtgcacgccaccgaaggcgccgacggcattgcgctcgggccgctgctggcaaaaaccgggcacaccacgttcgacgtcggcttcgccaacacggccgccgctaaaagctccatcacctacatcgacggagatgccggcattctgcgttatcgcggctacccgatcgaccaactggcggagaagtcaaccttcatcgaggtctgctacctgttgatttacggcgagctgcccgataccgaccagcttgcccagttcaccggccggatccagcgccacaccatgctgcacgaggatctcaagcggttcttcgacggctttccgcgcaatgcccacccgatgccggtgttgtccagcgtggtcaatgcgctgtcggcgtactaccaggatgctctggaccccatggacaacggtcaagtcgagctgtcgaccattcggctgctggccaagctgcccaccatcgccgcgtacgcctacaagaaatcggtcggccagcccttcctctacccagataactcactgacgctggtggagaacttcctacggttgacgttcggatttcccgccgagccctaccaggccgaccccgaggtggtgcgggcgctggacatgttgttcatcttgcacgccgaccacgagcagaactgctcgacgtcgacggttcggctggttggctcgtcgcgagccaacctgttcacctcgatctcgggtggcatcaacgcactatggggtccgcttcatggcggcgccaatcaggctgtcctggagatgctcgagggcattcgcgacagcggcgacgacgtcagcgagtttgtacgcaaggtcaagaaccgcgaggccggggtcaaattgatgggtttcggtcatcgtgtctacaagaactacgatccgcgggcccgcatcgtcaaggaacaggccgacaagatcctggccaagctcggcggcgatgactccttgctgggcatcgccaaggagctcgaagaggcggcgctgaccgacgactacttcatcgaacgcaagctttaccccaacgtcgacttctacaccggcctgatctaccgggccctcggcttcccgaccaggatgttcaccgtgttgtttgccctgggcaggcttcccggctggatcgcgcactggcgtgagatgcacgacgagggcgacagcaagatcggccggccccgccagatctacaccggctacacggagcgcgactacgtcaccatagacgcgcggtag

SEQ ID NO: 37125 - protein, 431 aa, Mycobacterium tuberculosis
MADTDDTATLRYPGGEIDLQIVHATEGADGIALGPLLAKTGHTTFDVGFANTAAAKSSITYIDGDAGILRYRGYPIDQLAEKSTFIEVCYLLIYGELPDTDQLAQFTGRIQRHTMLHEDLKRFFDGFPRNAHPMPVLSSVVNALSAYYQDALDPMDNGQVELSTIRLLAKLPTIAAYAYKKSVGQPFLYPDNSLTLVENFLRLTFGFPAEPYQADPEVVRALDMLFILHADHEQNCSTSTVRLVGSSRANLFTSISGGINALWGPLHGGANQAVLEMLEGIRDSGDDVSEFVRKVKNREAGVKLMGFGHRVYKNYDPRARIVKEQADKILAKLGGDDSLLGIAKELEEAALTDDYFIERKLYPNVDFYTGLIYRALGFPTRMFTVLFALGRLPGWIAHWREMHDEGDSKIGRPRQIYTGYTERDYVTIDAR

SEQ ID NO: 37126 - DNA, 1290 bp, Rhizobium tropici
  CDS (1)..(1290): transl_table=11
atgacggaacaaagcgcgaaactaacttggggtgaaaagacggtggatttgccggttaagaccggaaccatcggcccaagtgtcattgatattggtgccctttataagaacacctccactttcacctatgatcctggcttcacttcgactgcgtcgtgcgagtccagcatcacctttattgatggcgacgaaggcgttctgctgcatcgcggttatccgatcgaacagcttgccgagcacggcgacttcctcgaagtctgttacctgctgctctacggcgaattgccgaccgcagcccagaagaaggacttcgactatcgggtcgtgcaccacaccatggtgcatgaacaaatgtcccgcttcttcaccggtttccgccgcgatgcgcatccgatggccgtcatgtgcggctgcgtcggcgctctgtcggccttctatcacgactcgaccgacatcaccgatccgcaccagcgcatggtcgcaagccttcgtatgatcgccaagatgccgacgcttgccgccatggcctacaagtaccatatcggccagcccttcgtttacccgaagaacgatctcgactatgcatcgaacttcctgcgcatgtgctttgccgtgccctgcgaggaatatgtggtcaatccggtgcttgcccgcgccatggaccgcatcttcatcctgcacgcggatcatgagcagaacgcatcgacctcgacggttcgccttgccggctcttccggcgccaatccctttgcttgcatcgccgccggcatcgcatgcctctgggggccggcccatggcggcgccaacgaagctgcgctcaacatgctaacggaaatcggcacggtcgaccgcattccggaatatatcgcccgcgccaaggacaagaacgatccgttccgattgatgggcttcggtcatcgcgtttacaagaactacgatccgcgcgccaagatcatgcagaagacggcgcacgaggtcctcggcgaactcggcatcaaggacgatccgctgctcgacatcgcgatcgaactggagcgtatcgccctgaccgatgactatttcatcgagaagaagctttacccgaatgtcgacttctattccggtatcacgctgaaggcgctcggcttccccacgaccatgttcacggtactgtttgcgcttgcccgaaccgtcggctggattgcccagtggaacgagatgatcgaagatccggatcagcgtatcggccgcccgcgccacgtctataccggcgcaccgctgcgcgaatacgttccggtttccaagcgttaa

SEQ ID NO: 37127 - protein, 429 aa, Rhizobium tropici
MTEQSAKLTWGEKTVDLPVKTGTIGPSVIDIGALYKNTSTFTYDPGFTSTASCESSITFIDGDEGVLLHRGYPIEQLAEHGDFLEVCYLLLYGELPTAAQKKDFDYRVVHHTMVHEQMSRFFTGFRRDAHPMAVMCGCVGALSAFYHDSTDITDPHQRMVASLRMIAKMPTLAAMAYKYHIGQPFVYPKNDLDYASNFLRMCFAVPCEEYVVNPVLARAMDRIFILHADHEQNASTSTVRLAGSSGANPFACIAAGIACLWGPAHGGANEAALNMLTEIGTVDRIPEYIARAKDKNDPFRLMGFGHRVYKNYDPRAKIMQKTAHEVLGELGIKDDPLLDIAIELERIALTDDYFIEKKLYPNVDFYSGITLKALGFPTTMFTVLFALARTVGWIAQWNEMIEDPDQRIGRPRHVYTGAPLREYVPVSKR

SEQ ID NO: 37128 - DNA, 1545 bp, Arabidopsis thaliana
  CDS (1)..(1545)
atggagatttcgcagagagtgaaagctagattagccgttctcaccgcgcatttggcggtgtctgataccgtcggattggaacaggtgttgccggcgatcgcgccatggtgtacatcggctcacattaccgctgcacctcatggatcactcaaaggaaacttgacgatcgtcgatgagcgtacggggaagaaatatcaggtccccgtctcagagcatggtaccgttaaagccgttgatctcaagaagataacgacggggaaggatgataaggggctgaagttgtacgatcctggttacttgaacacggctccggttcgatcttcgatttgttacatcgacggagatgaaggaatcttacgttatcggggatacccaattgaagagttggctgagagcagtacttttattgaggttgcttatctcctcatgtatggaaatctgccttctcaaagtcagctagctgattgggagttcactgtttctcagcattcagctgtgccacaaggagtattggatatcatacagtccatgcctcatgatgcacacccaatgggagttcttgtgagtgccatgagtgcactttctatctttcaccctgatgcaaatcctgctcttagtggccaagacatttacaagtcaaaacaagttcgtgataaacagattgttcgcattctcggaaaggcaccaacaattgcagcagctgcttatttgaggacggcaggcaggcctcctgttcttccttcggccaacctttcttattcagagaatttcctctatatgctggattcaatgggcaataggtcttacaagcctaatcctcgtttggctcgagtgctggacatcctcttcatactgcatgctgaacatgaaatgaactgctctactgctgctgctcggcatcttgcctctagtggtgttgatgtgtacaccgcatgtgctggagctgttggggcgctttatggtccacttcatggtggcgcgaacgaggccgtgcttaagatgttagcagagattgggactgctgaaaatattccagatttcattgaaggcgtgaagaacagaaagaggaagatgtcaggttttggacatcgtgtttacaaaaactatgacccccgagcaaaagttataaaaaaactggcagatgaagtgttctccattgttggtagggatcctctcatcgaggtagcagttgctctagagaaggcggcactgtctgatgaatattttgttaagagaaagctgtacccaaatgttgatttctactctggattaatctatagggcaatgggattcccaccagaattcttcacagtcctgttcgcagtcccgcgtatggctggatacttgtcacactggcgtgagtcgttagatgatcctgacactaggatcatgagaccccaacaggcctatactggagtgtggatgaggcattacgagccagtgagagaacgaacgttatcaagtgattcggataaggataagtttggtcaagtttccatttcgaatgcatcaagaaggcgtttagctggatcatctgccctttag

SEQ ID NO: 37129 - protein, 514 aa, Arabidopsis thaliana
MEISQRVKARLAVLTAHLAVSDTVGLEQVLPAIAPWCTSAHITAAPHGSLKGNLTIVDERTGKKYQVPVSEHGTVKAVDLKKITTGKDDKGLKLYDPGYLNTAPVRSSICYIDGDEGILRYRGYPIEELAESSTFIEVAYLLMYGNLPSQSQLADWEFTVSQHSAVPQGVLDIIQSMPHDAHPMGVLVSAMSALSIFHPDANPALSGQDIYKSKQVRDKQIVRILGKAPTIAAAAYLRTAGRPPVLPSANLSYSENFLYMLDSMGNRSYKPNPRLARVLDILFILHAEHEMNCSTAAARHLASSGVDVYTACAGAVGALYGPLHGGANEAVLKMLAEIGTAENIPDFIEGVKNRKRKMSGFGHRVYKNYDPRAKVIKKLADEVFSIVGRDPLIEVAVALEKAALSDEYFVKRKLYPNVDFYSGLIYRAMGFPPEFFTVLFAVPRMAGYLSHWRESLDDPDTRIMRPQQAYTGVWMRHYEPVRERTLSSDSDKDKFGQVSISNASRRRLAGSSAL

SEQ ID NO: 37130 - DNA, 1290 bp, Rhizobium tropici
  CDS (1)..(1290): transl_table=11
atggataacaacaatgcttgtgtcttagtcgacggccatagtgccgaattgaaacttcgatcaagcacgatcggtccgaacgtcctcggcattggatccctctacgagcagacgaagatgttcacctatgatcctggcttcacttcgactgcgtcgtgcgagtccagcatcacctttattgatggcgacgaaggcgttctgctgcatcgcggttatccgatcgaacagcttgccgagcacggcgacttcctcgaagtctgttacctgctgctctacggcgaattgccgaccgcagcccagaagaaggacttcgactatcgggtcgtgcaccacaccatggtgcatgaacaaatgtcccgcttcttcaccggtttccgccgcgatgcgcatccgatggccgtcatgtgcggctgcgtcggcgctctgtcggccttctatcacgactccaccgacatcaccgatccgcaccagcgcatggtcgcaagccttcgtatgatcgccaagatgccgacgcttgccgccatggcctacaagtaccatatcggccagcccttcgtttacccgaagaacgatctcgactatgcgtcgaatttcctgcgcatgtgctttgccgtgccctgcgaggaatatgtggtcaatccggtgcttgcccgcgccatggaccgcatcttcatcctgcacgcggatcatgaacagaacgcatcgacctcgacggttcgcctcgccggctcttccggcgccaatccctttgcttgcatcgccgccggcatcgcatgcctctggggcccggcccatggcggcgccaacgaacgtgcgctcaacatgctgacggaaatcggcacggtcgaccgcattccggaatatatcgcccgcgccaaggacaagaacgatccgttccgattgatgggcttcggtcatcgcgtttacaagaactacgatccgcgcgccaagatcatgcagaagacggcgcacgaggtcctcggcgaactcggcatcaaggacgatccgctgctcgacatcgcgatcgaactggagcgtatcgcgctgaccgatgactatttcatcgagaagaagctttacccgaatgtcgacttctattccggcatcacgctgaaggcgctcggcttccccacgaccatgttcacggtactatttgcgctcgcccgcaccgtcggctggattgcccagtggaacgagatgatcgaagatccggatcagcgtatcggccgcccgcgccagctctataccggcgcaccgctgcgcgaatacgttccgctttcaaagcgctga

SEQ ID NO: 37131 - protein, 429 aa, Rhizobium tropici
MDNNNACVLVDGHSAELKLRSSTIGPNVLGIGSLYEQTKMFTYDPGFTSTASCESSITFIDGDEGVLLHRGYPIEQLAEHGDFLEVCYLLLYGELPTAAQKKDFDYRVVHHTMVHEQMSRFFTGFRRDAHPMAVMCGCVGALSAFYHDSTDITDPHQRMVASLRMIAKMPTLAAMAYKYHIGQPFVYPKNDLDYASNFLRMCFAVPCEEYVVNPVLARAMDRIFILHADHEQNASTSTVRLAGSSGANPFACIAAGIACLWGPAHGGANERALNMLTEIGTVDRIPEYIARAKDKNDPFRLMGFGHRVYKNYDPRAKIMQKTAHEVLGELGIKDDPLLDIAIELERIALTDDYFIEKKLYPNVDFYSGITLKALGFPTTMFTVLFALARTVGWIAQWNEMIEDPDQRIGRPRQLYTGAPLREYVPLSKR

SEQ ID NO: 37132 - DNA, 1530 bp, Arabidopsis thaliana
  CDS (1)..(1530)
atggagatatcagagagagttcgagctcgattagctgttctctcaggtcatttatcggaaggaaaacaggattctccagcgatcgagcgatggtgcacgtcggcggatacgagtgtcgcaccgcttggatctttgaagggaacactgacgatcgtcgacgaacgcaccggaaaaaattataaagttccggtctcagatgatggtaccgttaaagccgttgatttcaaaaagatagtgacggggaaggaagacaaggggcttaagttatacgatccaggttacttgaacacggctcctgttcgatcttcgatttcttacatcgatggagatgaagggatccttcgttaccgtggctacccaattgaggaaatggctgagaacagtacttttctggaggtggcttatcttctcatgtatgggaatctgccctctgaaagtcagctatctgattgggagtttgcagtttctcagcattcagctgtgccacaaggtgtattagatattatacagtctatgcctcatgatgcacacccaatgggagttcttgtgagtgcaatgagtgcgctttccatctttcatcctgatgctaatcctgctcttaggggccaggatatttacgattcaaaacaagttagagataaacaaattatccgcattattggaaaggcaccaacaattgcagcagctgcttatctgaggatggcaggaaggcctcctgttcttccttcaggaaaccttccttatgcagataatttcctctatatgcttgattccctgggaaatagatcctacaaacctaatcctcggctggctcgggtgttggacatcctcttcatactgcatgcagagcatgaaatgaactgctccaccgctgctgctcggcatcttgcctctagcggtgttgatgtctacactgctgttgctggagctgtgggagcgctttatggtccacttcatggtggtgcaaacgaggctgtgcttaagatgttgtcagagattgggactgttgaaaatattccagagttcattgagggtgtgaagaacaggaagaggaagatgtctggttttggacaccgtgtgtacaaaaactatgaccctcgagctaaagtcatcaagaacctggctgatgaagtattttccattgttggaaaggatcctctaattgaggttgctgttgcacttgagaaggcagctctctctgacgattactttgttaagagaaagctgtatccaaatgttgacttctactctggattaatatacagggcaatgggatttccaccggagttcttcacggtcttattcgcgattcctcgcatggctggatacttgtcacattggaaagagtcactggatgatcctgacaccaagatcatgagaccacaacaggtgtacacaggcgtgtggctgaggcattacacaccagtgagagagagaatagtgacggatgactcgaaagagtcagacaaattgggtcaagtcgcgacttcaaatgcatcaagaagacgtttggctggatcttcagtttag

SEQ ID NO: 37133 - protein, 509 aa, Arabidopsis thaliana
MEISERVRARLAVLSGHLSEGKQDSPAIERWCTSADTSVAPLGSLKGTLTIVDERTGKNYKVPVSDDGTVKAVDFKKIVTGKEDKGLKLYDPGYLNTAPVRSSISYIDGDEGILRYRGYPIEEMAENSTFLEVAYLLMYGNLPSESQLSDWEFAVSQHSAVPQGVLDIIQSMPHDAHPMGVLVSAMSALSIFHPDANPALRGQDIYDSKQVRDKQIIRIIGKAPTIAAAAYLRMAGRPPVLPSGNLPYADNFLYMLDSLGNRSYKPNPRLARVLDILFILHAEHEMNCSTAAARHLASSGVDVYTAVAGAVGALYGPLHGGANEAVLKMLSEIGTVENIPEFIEGVKNRKRKMSGFGHRVYKNYDPRAKVIKNLADEVFSIVGKDPLIEVAVALEKAALSDDYFVKRKLYPNVDFYSGLIYRAMGFPPEFFTVLFAIPRMAGYLSHWKESLDDPDTKIMRPQQVYTGVWLRHYTPVRERIVTDDSKESDKLGQVATSNASRRRLAGSSV

SEQ ID NO: 37134 - DNA, 1311 bp, Acetobacter aceti
  CDS (1)..(1311): transl_table=11
atgagcgcgtcgcagaaagaaggtaagctatctaccgctaccatttcggttgatggaaaatccgccgaaatgcctgtgctttcaggcactctgggaccggatgttatcgacatccgcaaacttccggcgcaactgggcgttttcacgtttgacccaggttacggggaaacagcggcctgcaacagcaaaatcacctttattgatggtgataaaggcgttctgctgcaccgtggttaccctattgcgcagctggacgaaaatgcttcctacgaagaagttatttatctgcttttgaatggcgaactgcccaacaaggtgcagtacgacaccttcaccaacacccttacaaaccatacgctgctgcacgagcagatccgtaacttctttaacggcttccggcgtgatgcccacccaatggccattctgtgtggtacggttggggctttgtctgccttctacccagatgccaacgatattgccattcccgccaatcgggatctggccgccatgcggctgattgccaaaatcccaaccattgcggcatgggcttacaaatacacgcagggtgaagcctttatctacccgcggaatgatctgaactacgcagaaaacttcctgtccatgatgttcgcgcgcatgtccgaaccttacaaggtcaaccctgttctggcccgcgccatgaaccggattctgattctgcatgccgatcatgagcagaatgcctctacctccaccgtacgtctggctggttctacaggggccaatccgtttgcctgtattgctgcgggcattgccgctctgtggggacctgcacatggtggcgcaaacgaagctgtgctgaaaatgctggcccgtattggcaagaaagaaaatattcctgcctttatcgcacaggtgaaggacaagaacagcggcgtaaagctgatgggctttggccaccgcgtttacaagaacttcgacccacgtgcgaagatcatgcagcagacctgccacgaagtgctgacagaacttggcattaaggatgatccgctgctggatctggcggttgagctggaaaagattgctctgagcgatgattacttcgtgcagcgcaaactttacccgaatgtggatttctactctggcatcattctcaaggccatgggcatccccaccagtatgtttactgtgctgtttgccgtagcccgcaccaccggctgggtgagccagtggaaggaaatgattgaagaaccgggccagcgtatcagccgccctcgccagctttatattggcgcaccgcagcgtgactatgtgccgcttgccaaacgctaa

SEQ ID NO: 37135 - protein, 436 aa, Acetobacter aceti
MSASQKEGKLSTATISVDGKSAEMPVLSGTLGPDVIDIRKLPAQLGVFTFDPGYGETAACNSKITFIDGDKGVLLHRGYPIAQLDENASYEEVIYLLLNGELPNKVQYDTFTNTLTNHTLLHEQIRNFFNGFRRDAHPMAILCGTVGALSAFYPDANDIAIPANRDLAAMRLIAKIPTIAAWAYKYTQGEAFIYPRNDLNYAENFLSMMFARMSEPYKVNPVLARAMNRILILHADHEQNASTSTVRLAGSTGANPFACIAAGIAALWGPAHGGANEAVLKMLARIGKKENIPAFIAQVKDKNSGVKLMGFGHRVYKNFDPRAKIMQQTCHEVLTELGIKDDPLLDLAVELEKIALSDDYFVQRKLYPNVDFYSGIILKAMGIPTSMFTVLFAVARTTGWVSQWKEMIEEPGQRISRPRQLYIGAPQRDYVPLAKR

SEQ ID NO: 37136 - DNA, 1296 bp, Bartonella henselae
  CDS (1)..(1296): transl_table=11
atgtctaagaataaagcgcacattactgtgaatgataaaaaaatagaactctccgtgcgtaaaggtacacttggtcctgacgttattgaaattgcttctctctacaaagaaacagatacttttacttatgatcctggctttacctcaactgcttcgtgtgaatcgaaaatcacttatattgatggtaatgaaggaattttgctttatcgtggttatcctattgaccaattggctgaaaaaggagactttctcgaaagctgctatcttttgctttacggtgaactgccaacaaaacaagaaaaaattgattttgatcgctgtattatgcagcatacgatggttcacgaacagtttgcaagatttttccatggtttccgtcgcgactctcatcctatggccgtcatgattgcatgtcttggagctatgtctgcattctatcacgactctattgatattacagatcctcaacagagaatgatcgcttctattcgtctcatttcaaaggtcccaactcttgccgctatggcctataaatatagcattggacaagcatttgtttatccacgtaatgatcttagttacgctgcaaattttctccgtatgtgtttttctgttccttgtgaagaatataaaattaatccggtgctgactcgagctatggatagaatctttactcttcatgcagatcatgaacaaaatgcttcgacatccactgtacgtcttgcaggttcatcaggtgctaatccatttgcatgtattgcagcaggtgttgcatgcctttggggaccagctcatggtggagctaatgaagcatgcctaaaaatgttacaagaaataggttctgttgaaagaattcctgaattcattgcacgtgcaaaagataaaaatgattctttccgccttatgggttttggtcatcgagtctataaaaattatgatccacgcgcaaaaatcatgcaacaaacctgccatgaggttttaaaagaattgaacattcaaaatgatccacttcttgatattgctatcacgcttgaaaatattgctctaaatgatgaatattttattgaaaaaaaactttaccctaatgtcgatttctattctggcattacattaaaagctctaggatttccaacagaaatgtttactgttctttttgcattagcacgcagtgtcggctgggttgcgcaatggaaagaaatgattgaggatcctgcacaaaaaattagccgaccacgccaactctacacaggctacgctgcgcgtgaatatatccctatagacaagcgtgtaaactaa

SEQ ID NO: 37137 - protein, 431 aa, Bartonella henselae
MSKNKAHITVNDKKIELSVRKGTLGPDVIEIASLYKETDTFTYDPGFTSTASCESKITYIDGNEGILLYRGYPIDQLAEKGDFLESCYLLLYGELPTKQEKIDFDRCIMQHTMVHEQFARFFHGFRRDSHPMAVMIACLGAMSAFYHDSIDITDPQQRMIASIRLISKVPTLAAMAYKYSIGQAFVYPRNDLSYAANFLRMCFSVPCEEYKINPVLTRAMDRIFTLHADHEQNASTSTVRLAGSSGANPFACIAAGVACLWGPAHGGANEACLKMLQEIGSVERIPEFIARAKDKNDSFRLMGFGHRVYKNYDPRAKIMQQTCHEVLKELNIQNDPLLDIAITLENIALNDEYFIEKKLYPNVDFYSGITLKALGFPTEMFTVLFALARSVGWVAQWKEMIEDPAQKISRPRQLYTGYAAREYIPIDKRVN

SEQ ID NO: 37138 - DNA, 1317 bp, Bartonella quintana
  CDS (1)..(1317): transl_table=11
atgtctgagaataaagcacacattactgtgaacaataaaaaaatagaactctccgtgcggaaaggcactcttggtcctggcgtcattgaaattgcttctctctacaaagaaacagatacttttacttatgatcctggtttcacttcaaccgcttcttgtgaatcaaaaatcacttatattgatggggataaaggaatcttgctttattgcggttatcctatcgaccaattagctgaaaaaggagactttctcgaaagctgctatcttttactttacggtgaattaccaacaaaacaagaaaaaattgatttcgaccgttgtattatgcagcacatgatggtgcatgagcagtttacaaggttttttcatggctttcgtcgtgattctcaccctatggccgttatggttgcgtgtcttggagctatgtctgcattctatcacgactctattgatattaaagacgctcaacagagaatgatcgctgctattcgcttgatttcaaaggttccaactcttgctgctatggcgtataaatatagcatcggacaggcatttgtttatccacgtaatgatcttagttacgctgcaaatttcctccacatgtgtttttccgttccttgtgaagaatacaaaattaatccagtacttagtcgagctatggatcgaatctttactcttcatgcagatcatgaacaaaatgcttctacatccactgtacgtcttgtaggatcatcgggagctaatccatttgcatgtatcgcagcaggtgttgcatgcctttggggaccagctcatggtggagcgaatgaagcgtgcctaaagatgttacaaaaaataggctctgtcgaaagaattcctgagttcattgcacgagcaaaagataaaaatgatcctttccgtcttatgggttttggtcaccgagtttataaaaattatgatccacgtgcaaaaatcatgcaacaaacctgccatgaggttttaaaagaactgaacattcaagatgatccgcttcttgatatcgctatcgcacttgaaaatactgctctgaatgatgaatattttattgaaaaaaagctttatcctaatgttgatttttattctggcattacattaaaagctctaggttttccgaccgaaatgtttactgttctttttgcattagcacgcagtatcggctgggttgcgcaatggaaagaaatgattgaagatcctgcacaaaaaattggtcgaccacgccaactctacacaggctatgctgcacgtgaatatgtttctatagacaaacgtataagcaaaaataaaatgaccacccaataa

SEQ ID NO: 37139 - protein, 438 aa, Bartonella quintana
MSENKAHITVNNKKIELSVRKGTLGPGVIEIASLYKETDTFTYDPGFTSTASCESKITYIDGDKGILLYCGYPIDQLAEKGDFLESCYLLLYGELPTKQEKIDFDRCIMQHMMVHEQFTRFFHGFRRDSHPMAVMVACLGAMSAFYHDSIDIKDAQQRMIAAIRLISKVPTLAAMAYKYSIGQAFVYPRNDLSYAANFLHMCFSVPCEEYKINPVLSRAMDRIFTLHADHEQNASTSTVRLVGSSGANPFACIAAGVACLWGPAHGGANEACLKMLQKIGSVERIPEFIARAKDKNDPFRLMGFGHRVYKNYDPRAKIMQQTCHEVLKELNIQDDPLLDIAIALENTALNDEYFIEKKLYPNVDFYSGITLKALGFPTEMFTVLFALARSIGWVAQWKEMIEDPAQKIGRPRQLYTGYAAREYVSIDKRISKNKMTTQ

SEQ ID NO: 37140 - DNA, 1305 bp, Bradyrhizobium japonicum
  CDS (1)..(1305): transl_table=11
atggacgcaaaagcaagcaataagaccgccacgctgacggtcggaaacaagaactacgatctcccgatccacagcggcagcgtcgggcctgatgtcatcgatatcggcaagctctacggccagtcgggcctgttcacctatgacccgggcttcacctcgaccgcgagctgccagtccaagatcacctatatcgacggcgacgcgggcgtgctggaataccgcggctatccgatcgagcagctcgccgagaacggcgacttcctggagacctgctacctcctgctctacgggaacctgccgaccgccgcgcagaagaaggatttcgacgaccgcgtgatccatcacacgatggtgcacgagcagatggcccgcttcttccagggcttccgccgcgacgcccatccgatggccgtcatggtggcctccgtcggcgcgctcgccgcgttctaccacgactccaccgacatcaacgacccgaagcagcgcatgatcgcttccatgcgcatgatcgcgaagatcccgacgctggcggcgatggcctacaagtacacgatcggccagcccttcgtgtatccgaagaactcgctgaagttcgccgagaacttcctgcacatgtgcttcgccgtgccgtgcgaggagtacaagatcaatccggtgctggctgacgcgctggacaagatcttcatcctgcacgccgaccacgagcagaacgcctcgacctcgacggtgcgcatcgccggctcctccggcgccaacccgttcgcctgcatcgccgccggcatcgcctgcctctggggcccggcccacggcggcgccaacgaagccgcgctcgcgatgctcgccgagatcggttcggtcgacaagattccggaattcatcgccaaggtgaaggacaagaacagcgaagtccgcctgatgggcttcggtcatcgcgtctacaagaactacgatccgcgcgccaagatcatgcagaagatgtgtcacgccgtgctcaaggagaccggccatggcgacgatccgatgctgaaggtggcgatggagctcgagaagatcgcgctcagcgaccagtacttcatcgaccgcaagctgtacccgaacgtcgacttctattcgggcatcacgctgaaggcgatgggcttcccggtctcgatgttcaccgtgctgttcgcggtcgcccgcaccgtcggctggatcagccagtggagcgagatgatcgaggatccgcagcagaagattggtcgtccgcgccagctctacaccggcgtcacccgccgcgactacgtggcgatcaaggatcgcaagtaa

SEQ ID NO: 37141 - protein, 434 aa, Bradyrhizobium japonicum
MDAKASNKTATLTVGNKNYDLPIHSGSVGPDVIDIGKLYGQSGLFTYDPGFTSTASCQSKITYIDGDAGVLEYRGYPIEQLAENGDFLETCYLLLYGNLPTAAQKKDFDDRVIHHTMVHEQMARFFQGFRRDAHPMAVMVASVGALAAFYHDSTDINDPKQRMIASMRMIAKIPTLAAMAYKYTIGQPFVYPKNSLKFAENFLHMCFAVPCEEYKINPVLADALDKIFILHADHEQNASTSTVRIAGSSGANPFACIAAGIACLWGPAHGGANEAALAMLAEIGSVDKIPEFIAKVKDKNSEVRLMGFGHRVYKNYDPRAKIMQKMCHAVLKETGHGDDPMLKVAMELEKIALSDQYFIDRKLYPNVDFYSGITLKAMGFPVSMFTVLFAVARTVGWISQWSEMIEDPQQKIGRPRQLYTGVTRRDYVAIKDRK

SEQ ID NO: 37142 - DNA, 1314 bp, Corynebacterium glutamicum
  CDS (1)..(1314): transl_table=11
atgtttgaaagggatatcgtggctactgataacaacaaggctgtcctgcactaccccggtggcgagttcgaaatggacatcatcgaggcttctgagggtaacaacggtgttgtcctgggcaagatgctgtctgagactggactgatcacttttgacccaggttatgtgagcactggctccaccgagtcgaagatcacctacatcgatggcgatgcgggaatcctgcgttaccgcggctatgacatcgctgatctggctgagaatgccaccttcaacgaggtttcttacctacttatcaacggtgagctaccaaccccagatgagcttcacaagtttaacgacgagattcgccaccacacccttctggacgaggacttcaagtcccagttcaacgtgttcccacgcgacgctcacccaatggcaaccttggcttcctcggttaacattttgtctacctactaccaggaccagctgaacccactcgatgaggcacagcttgataaggcaaccgttcgcctcatggcaaaggttccaatgctggctgcgtacgcacaccgcgcacgcaagggtgctccttacatgtacccagacaactccctcaatgcgcgtgagaacttcctgcgcatgatgttcggttacccaaccgagccatacgagatcgacccaatcatggtcaaggctctggacaagctgctcatcctgcacgctgaccacgagcagaactgctccacctccaccgttcgtatgatcggttccgcacaggccaacatgtttgtctccatcgctggtggcatcaacgctctgtccggcccactgcacggtggcgcaaaccaggctgttctggagatgctcgaagacatcaagagcaaccacggtggcgacgcaaccgagttcatgaacaaggtcaagaacaaggaagacggcgtccgcctcatgggcttcggacaccgcgtttacaagaactacgatccacgtgcagcaatcgtcaaggagaccgcacacgagatcctcgagcacctcggtggcgacgatcttctggatctggcaatcaagctggaagaaattgcactggctgatgattacttcatctcccgcaagctctacccgaacgtagacttctacaccggcctgatctaccgcgcaatgggcttcccaactgacttcttcaccgtattgttcgcaatcggtcgtctgccaggatggatcgctcactaccgcgagcagctcggtgcagcaggcaacaagatcaaccgcccacgccaggtctacaccggcaacgaatcccgcaagttggttcctcgcgaggagcgctaa

SEQ ID NO: 37143 - protein, 437 aa, Corynebacterium glutamicum [sequence omitted]

SEQ ID NO: 37144 - DNA, 1281 bp, Helicobacter pylori J99
  CDS (1)..(1281): transl_table=11
atgtctgttactttaatcaataatgaaaataatgcacgctatgaatttgaaacgattgaatgcactcgtgggccaaaagcggtggatttttccaagctttttgaaacgaccgggtttttttcctacgatccagggtattcttctaccgctgggtgtcaatctaagatcagctatatcaatggcaaaaaaggcgaattgtattacagagggcataggatagaggatttagtcgccaaatacaaatatgtagatgtgtgcaggctattactcacaggggaattacccaaaaatcaagatgaaagcttggaatttgaactggaattgcgccacagaagctttgtgcatgagagcttactcaacatgttttcagctttccctagcaacgcccaccctatggcgaaactctctagcggggtgtctattttatctactctttattccacgcaccaaaacatgcacactgaagaagattaccagactatggccagaaggattgtcgctaaaatccccacgcttgcggctatttgctatcgtaatgaagtgggagcacccattatttatccggacatcgcgcgctcttatgtggaaaatatccttttcatgctgagaggttatccttatagccgattgaaacacaccactcaaggcgaagtgggaatcacgcccctagaagtggaagcctttgataaaatcctaaccttacacgccgatcatgggcaaaacgcctcttctaccacggtaaggaatgtcgctagcaccggcgtgcatccttatgccgccattagcgcgggtattagcgctttatgggggcatttgcatggcggagcgaatgaaaaagtccttttacaattagaagaaatcggcgatgtgaaaaacgtggataaatacatcgcgcgcgtaaaagacaaaaacgacaatttcaaactcatgggctttgggcatagggtgtataaaagctacgatccgcgcgcaaaaatcttaaaaggtctgaaagatgaactgcatcaaaaaggcgttaaaatggacgaacgcttgagcgaaatcgctgcgaaagtggaagaaatcgcgctaaaagacgagtatttcattgaaaggaatctctaccccaatgtggatttttactccggcaccattttaagggctttaaaaatcccggtgcgttttttcacgccggtgtttgtcattggcagaaccgtaggctggtgcgctcaacttttagagcatgtcaaaagcccgcaagccaggatcacgcgcccaagacaagtctatgtaggggattaa

SEQ ID NO: 37145 - protein, 426 aa, Helicobacter pylori J99
MSVTLINNENNARYEFETIECTRGPKAVDFSKLFETTGFFSYDPGYSSTAGCQSKISYINGKKGELYYRGHRIEDLVAKYKYVDVCRLLLTGELPKNQDESLEFELELRHRSFVHESLLNMFSAFPSNAHPMAKLSSGVSILSTLYSTHQNMHTEEDYQTMARRIVAKIPTLAAICYRNEVGAPIIYPDIARSYVENILFMLRGYPYSRLKHTTQGEVGITPLEVEAFDKILTLHADHGQNASSTTVRNVASTGVHPYAAISAGISALWGHLHGGANEKVLLQLEEIGDVKNVDKYIARVKDKNDNFKLMGFGHRVYKSYDPRAKILKGLKDELHQKGVKMDERLSEIAAKVEEIALKDEYFIERNLYPNVDFYSGTILRALKIPVRFFTPVFVIGRTVGWCAQLLEHVKSPQARITRPRQVYVGD

SEQ ID NO: 37146 - DNA, 1281 bp, Helicobacter pylori
  CDS (1)..(1281): transl_table=11
atgtctgtcactttagtcaataatgaaaataatgaacgctatgaatttgaaacgattgaaagcactcgtgggcctaaagcggtggatttttccaagctttttgaaacgaccgggtttttttcttacgatccagggtattcttctaccgctggatgccaatctaagatcagctatgtcaatggcaaaaaaggcgaattgtattacagagggcataggatagaagatttagtcgccaaatacaaatatgtagatgtgtgcaaattactcctcacaggggaattacccaaaaatcaagatgaaagcttggaatttgaattggaattgcgccacaggagctttgtgcatgagagcttactcaacatgttttcagccttccctagcaacgcccaccctatggcgaaactctctagcggagtgtctatcttatccaccctttattccacgcaccaaaacatgcacactgaagaagattaccaaactatggccagaaggattgtcgctaaaatccccacgcttgcggctatttgctatcgtaatgaagtgggagcgcctatcatttatccggacatcgcacgctcttatgtggaaaatatccttttcatgctgagagggtatccttatagtcgcttaaaacacaccactcaaggcgaagtggaaatcacgcccctagaagtggaagcctttgataaaatcctaaccttgcacgctgatcacagccaaaacgcctcttctaccacggtaaggaatgtcgctagcaccggcgtgcatccttatgccgccattagcgcgggcattagcgctttatgggggcatttgcatggcggagcgaatgaaaaagtccttttacaattagaagaaatcggcgatgtgaaaaatgtggataaatacatcgcgcgagtgaaagacaaaaacgacaatttcaaactcatgggctttgggcatagggtgtataaaagctacgatccgcgcgctaaaatcttaaaaggcttgaaagacgaactgcaccaaaaaggcgttaaaatggacgagaggttgagcgaaatcgccgcgaaagtggaagaaatcgcgctaaaagacgagtatttcattgaaaggaatctctaccctaatgtggatttttactccggcaccattttaagggctttaaaaatcccggtgcgttttttcacgccggtgtttgtcattggccgaaccgtaggctggtgcgctcagcttttagagcatgtcaaaagcccgcaagccaggatcacacgcccaagacaagtctatgtaggggattaa

SEQ ID NO: 37147 - protein, 426 aa, Helicobacter pylori
MSVTLVNNENNERYEFETIESTRGPKAVDFSKLFETTGFFSYDPGYSSTAGCQSKISYVNGKKGELYYRGHRIEDLVAKYKYVDVCKLLLTGELPKNQDESLEFELELRHRSFVHESLLNMFSAFPSNAHPMAKLSSGVSILSTLYSTHQNMHTEEDYQTMARRIVAKIPTLAAICYRNEVGAPIIYPDIARSYVENILFMLRGYPYSRLKHTTQGEVEITPLEVEAFDKILTLHADHSQNASSTTVRNVASTGVHPYAAISAGISALWGHLHGGANEKVLLQLEEIGDVKNVDKYIARVKDKNDNFKLMGFGHRVYKSYDPRAKILKGLKDELHQKGVKMDERLSEIAAKVEEIALKDEYFIERNLYPNVDFYSGTILRALKIPVRFFTPVFVIGRTVGWCAQLLEHVKSPQARITRPRQVYVGD

SEQ ID NO: 37148 - DNA, 1287 bp, Pseudomonas aeruginosa
  CDS (1)..(1287): transl_table=11
atggctgacaaaaaagcgcagttgatcatcgagggctcagcccccgtcgaactgcccgtcctatccggtaccatgggtcccgatgtagtggatgtacggggcctcaccgccacgggccacttcaccttcgatcctggcttcatgtcgaccgcctcctgcgagtcgaagatcacctatatcgacggcgacaaaggcgtcctcctccatcgcggctaccccatcgagcaactggcagagaaatccgactacctggaaacctgctacctgctgctgaacggcgagctgcccaccgccgcgcagaaggaacagttcgtcggcaccatcaagaaccacaccatggttcacgagcagttgaagaccttcttcaacggcttccgccgcgacgcccacccgatggccgtgatgtgcggcgtgatcggcgccctctcggccttctaccacgactccctggacatcaataacccgaagcatcgcgaagtctccgcgcatcgcctgatcgccaagatgccgaccatcgccgccatggtgtacaagtactccaagggcgagccgatgatgtatccgcgtaacgacctgaactacgcggaaaacttcctgcacatgatgttcaacaccccctgcgagaccaagccgatcagccccgtgctggccaaggccatggaccgcatcttcattctccacgccgaccacgagcagaacgcctccacctccacggtgcgtctggccggctcctccggcgccaatccgttcgcctgcatcgcctccggcatcgccgccctgtggggaccggcccatggcggcgcgaacgaagcggtgctgcgcatgctcgacgagatcggcgacgtgtccaacatcgacaagttcgtcgagaaggccaaggacaagaacgatccgttcaagctgatgggcttcggccatcgtgtctacaagaacttcgacccgcgcgccaaggtcatgaagcagacctgcgacgaggtcctccaggagctgggcatcaacgacccgcaactggaactggcgatgaagctagaagaaatcgcccgccacgacccctacttcgtggaacgcaacctgtacccgaacgtcgacttctactcggggatcatcctcaaggcgatcggcattccgaccagcatgttcaccgtgatcttcgccctggcgcgtaccgtcggctggatctcgcactggcaggaaatgctctccggcccctacaagatcggccgcccgcgccagctctataccggccacacccagcgcgacttcaccgccctcaaggatcgcggctga

SEQ ID NO: 37149 - protein, 428 aa, Pseudomonas aeruginosa
MADKKAQLIIEGSAPVELPVLSGTMGPDVVDVRGLTATGHFTFDPGFMSTASCESKITYIDGDKGVLLHRGYPIEQLAEKSDYLETCYLLLNGELPTAAQKEQFVGTIKNHTMVHEQLKTFFNGFRRDAHPMAVMCGVIGALSAFYHDSLDINNPKHREVSAHRLIAKMPTIAAMVYKYSKGEPMMYPRNDLNYAENFLHMMFNTPCETKPISPVLAKAMDRIFILHADHEQNASTSTVRLAGSSGANPFACIASGIAALWGPAHGGANEAVLRMLDEIGDVSNIDKFVEKAKDKNDPFKLMGFGHRVYKNFDPRAKVMKQTCDEVLQELGINDPQLELAMKLEEIARHDPYFVERNLYPNVDFYSGIILKAIGIPTSMFTVIFALARTVGWISHWQEMLSGPYKIGRPRQLYTGHTQRDFTALKDRG

SEQ ID NO: 37150 - DNA, 1308 bp, Rickettsia conorii
  CDS (1)..(1308): transl_table=11
atgaccaatgaaaataataatgattcagaatttgctgaattaaaaatcagaggaaaaatatttaaattacctatacttaaagcaagtatcggtgaggatgtaatcgatataagtagggtatctgcggaagccgattgctttacttacgacccgggttttatgtctactgcttcttgtcagtctactatcacctatatagacggtgataaaggaatcttgcggcatcgaggatatgatattaaagacttagctgagaaaagtgattttttagaagtggcatatttactgatttatggggaactaccaagtggcgagcagtataataatttcactaaacaggttgctcatcattcattagtgaatgaaagattacactatttatttcaaaccttttgtagctcttctcatcctatggctattatgcttgcggctgtcggttctctttcggcattttatcctgatttattgaattttaaggaagcagattacgaacttaccgctattagaatgattgctaagatacctaccatcgctgcaatgtcttataaatattctataggacaaccgtttatttatcctgataattcgttagattttaccgaaaattttctgcatatgatgtttgcaacgccttgtacgaaatatacagtaaatccaataataaaaaatgctcttaataagatatttatcctacatgccgatcatgagcagaatgcttctacttcaacagtccgaattgctggctcatccggagctaacccttttgcttgtattagcacgggtattgcctcactttggggacctgctcacggcggggctaatgaagcggtaataaatatgattaaagaaatcggtagttctgagtatattcctaaatatatagctaaagctaaggataaaaatgatccatttagattaatgggttttggtcatcgtgtatataaaaactatgacccgcgtgccgcagtacttaaagaaacgtgcaaagaagtattaaaggaactcgggcagctagacaacaatccgttcttacaaatagcaatagaacttgaagctatcgctcttaaagatgaatattttattgagagaaaattatatccaaatgttgatttttattcgggtattatctataaagctatgggtataccgtcgcaaatgttcacggtactttttgcaatagcaagaaccgtaggctggatggcacaatggaaagaaatgcacgaagaccctgaacaaaaaatcagcagacctagacagctttacaccggttatgtacatagagagtataagggtattcgggagaggtaa

SEQ ID NO: 37151 - protein, 435 aa, Rickettsia conorii
MTNENNNDSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMIKEIGSSEYIPKYIAKAKDKNDPFRLMGFGHRVYKNYDPRAAVLKETCKEVLKELGQLDNNPFLQIAIELEAIALKDEYFIERKLYPNVDFYSGIIYKAMGIPSQMFTVLFAIARTVGWMAQWKEMHEDPEQKISRPRQLYTGYVHREYKGIRER

SEQ ID NO: 37152 - DNA, 1308 bp, Rickettsia felis
  CDS (1)..(1308): transl_table=11
atgaccaatgaaaatagtaatgattcagaatttgccgaattaaaaatcagaggaaaaatatttaaattacctatacttaaagcaagtattggtgaggatgtaatcgatataagcagggtatcttcggaagccgattgttttacttatgacccgggctttatgtctactgcttcttgtcagtctactatcacttatatagacggtgataaaggaatcttgcgacatcgaggatatgacattaaagatttagccgagaaaagtgattttttagaagtggcatatttgctaatctacggagaattgccaagcatcgagcagtataataatttcactaaacaggttgctcatcattcattagtgaatgaaagattacactatttatttcaaacattttgtagctcttctcatcctatggctattatgcttgcggccgttggttctctttcggcattttatcctgatttactgaattttaaagaagcagactacgaacttaccgctattagaatgattgctaagataccaactatcgccgcaatgtcctataaatattctataggacaaccgtttatttatcctgataattcgttagattttactgaaaattttctgcatatgatgtttgcaacgccttgtacaaaatataaagtaaatccaataataaaaaatgctcttaataaaatatttattctgcatgctgaccatgagcagaacgcttctacttcaacagtccgaattgccggctcatccggggctaacccttttgcttgcgtaagtacagggattgcctcactttgggggcctgcccacggcggggctaatgaagcggtaataaatatgcttaaagaaatcggtagttctgagaatattcctaaatatatagctaaagctaaggataaaaatgatccgtttaggttaatgggtttcggtcatcgtgtttataaaaactatgacccacgtgccgcagtacttaaagaaacttgcaaagaagtattaaaggaactcggacagctagaaaacaatccgcttttgcaaatagcaatagaacttgaagctatcgctcttaaagatgaatattttattgagagaaaattatatccaaatgttgatttttattcaggtattatctataaagctatgggtataccgtcgcaaatgtttacggtactttttgcaatagcaagaaccgtaggctggatggcacagtggaaagaaatgcacgaagaccctgaacaaaaaatcagcagacctagacagctttacaccggttatgtacatagagagtataagggtatcggggagaggtag

SEQ ID NO: 37153 - protein, 435 aa, Rickettsia felis
MTNENSNDSEFAELKIRGKIFKLPILKASIGEDVIDISRVSSEADCFTYDPGFMSTASCQSTITYIDGDKGILRHRGYDIKDLAEKSDFLEVAYLLIYGELPSIEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACVSTGIASLWGPAHGGANEAVINMLKEIGSSENIPKYIAKAKDKNDPFRLMGFGHRVYKNYDPRAAVLKETCKEVLKELGQLENNPLLQIAIELEAIALKDEYFIERKLYPNVDFYSGIIYKAMGIPSQMFTVLFAIARTVGWMAQWKEMHEDPEQKISRPRQLYTGYVHREYKGIGER

SEQ ID NO: 37154 - DNA, 1311 bp, Rickettsia prowazekii
  CDS (1)..(1311): transl_table=11
atgactaatggcaataataataacttagaatttgcagaattaaaaattagaggtaaactatttaagttacctatacttaaagcaagtatcggtaaagatgtaatcgatataagtagggtatctgcggaagccgattactttacttatgatccgggttttatgtctactgcttcttgtcaatctactatcacatatatagacggtgataaaggcatattatggtatcgaggatatgatattaaagacttagctgagaaaagtgattttttagaagtggcatatttgatgatttatggggagctaccaagtagtgatcagtattgtaattttactaaaaaggttgctcatcattcattagtgaatgaaagattacactatttatttcaaaccttttgtagttcttctcatcctatggctattatgcttgcagctgttggttctctttcagcattctatcctgatttattaaattttaatgaaacagactatgaacttaccgctattagaatgattgctaagatacctactatcgctgcaatgtcttataaatattctatagggcaaccgtttatttatcctgataattcattagattttaccgaaaattttctacatatgatgtttgcaactccttgtactaaatataaagtaaatccaataataaaaaatgctcttaataagatatttatcttacatgcagaccatgagcagaatgcttctacttcaacagttcggattgctggctcatcaggagctaatccttttgcatgtattagcactggtattgcatcactttgggggcctgctcacggcggggctaatgaagcagtgataaatatgcttaaagaaattggcagttctgagaatattcctaaatatgtagctaaagctaaagataagaatgatccatttaggttaatgggttttggtcatcgagtatataaaagctatgacccgcgtgccgcagtacttaaagaaacttgtaaagaagtattaaatgaattaggtcagttagacaataatccgctgttacaaatagcaatagaacttgaagctctcgctcttaaagatgaatattttattgaaagaaaattatatccaaatgttgatttttattcaggcattatctataaagctatgggtataccgtcgcaaatgttcactgtactttttgcaatagcaagaaccgtaggttggatggcacaatggaaagaaatgcacgaagatcctgaacaaaaaatcagtagacctagacagctttacactggttatgtacatagagagtataagtgtattgtagaaagaaagtga

SEQ ID NO: 37155 - protein, 436 aa, Rickettsia prowazekii
MTNGNNNNLEFAELKIRGKLFKLPILKASIGKDVIDISRVSAEADYFTYDPGFMSTASCQSTITYIDGDKGILWYRGYDIKDLAEKSDFLEVAYLMIYGELPSSDQYCNFTKKVAHHSLVNERLHYLFQTFCSSSHPMAIMLAAVGSLSAFYPDLLNFNETDYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSENIPKYVAKAKDKNDPFRLMGFGHRVYKSYDPRAAVLKETCKEVLNELGQLDNNPLLQIAIELEALALKDEYFIERKLYPNVDFYSGIIYKAMGIPSQMFTVLFAIARTVGWMAQWKEMHEDPEQKISRPRQLYTGYVHREYKCIVERK

SEQ ID NO: 37156 - DNA, 1311 bp, Rickettsia typhi
  CDS (1)..(1311): transl_table=11
atgactaatggaaataataataatttagaatttgcggaattaaaaattagaggtaaaatgtttaaattacctatacttaaagcaagtataggtaaagatgtaatagatataagtagggtatctgcggaagccgattgctttacttacgatccaggttttatgtctactgcttcttgtcaatctaccatcacatatatagacggtgataaaggaatcttatggcatcgaggatatgatattaaagacttagctgagaaaagtgattttttagaagtggcatatttgatgatttatggggaactaccaagtagtgagcagtatcataattttactacaaagattgctcatcatgcattagtaaatgaaagattacactatttatttcaaaccttttgtagttcttctcatcctatggctattatgcttgcagctgttggttctctttcagcattttatcctgatttattgaattttaatgaaacagactatgaacttaccgctattagaatgattgctaagatacctactatcgctgcaatgtcttataaatattctatagggcagccatttatttatcctgataattcattagattttaccgaaaattttctacatatgatgtttgcaactccttgtactaaatataaagtaaatccaataataaaaaatgcgcttaataagatatttatcttacatgcagaccatgagcagaatgcttctacttcaacagtacgaattgctggctcatcaggagctaatccttttgcatgtattagcactggtattgcatcactttgggggcctgctcacggtggagctaatgaagcagtgataaatatgcttaaagaaattggtagttctgagaatattcctaaatatgtagctaaagctaaagacaaaaatgatccatttaggttaatgggttttggtcatcgagtatataaaagttatgacccgcgtgctgcagtacttaaagaaacttgtaaagaagtattaaatgaactagggcagttagaaaataatccgttgttacaaatagcaatagaacttgaagctcttgctcttaaagatgaatattttattgagagaaaattatatccaaatgttgatttttattcaggcattatctataaagctatgggtataccgtcgcaaatgttcactgtactttttgcaatagcaagaaccgtaggttggatggcgcaatggaaagaaatgcacgaagatcctgaacaaaaaatcagtagacctagacaactttacactggttatgtacatagagaatataagtgtattgtagaaagaaagtga

SEQ ID NO: 37157 - protein, 436 aa, Rickettsia typhi
MTNGNNNNLEFAELKIRGKMFKLPILKASIGKDVIDISRVSAEADCFTYDPGFMSTASCQSTITYIDGDKGILWHRGYDIKDLAEKSDFLEVAYLMIYGELPSSEQYHNFTTKIAHHALVNERLHYLFQTFCSSSHPMAIMLAAVGSLSAFYPDLLNFNETDYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSENIPKYVAKAKDKNDPFRLMGFGHRVYKSYDPRAAVLKETCKEVLNELGQLENNPLLQIAIELEALALKDEYFIERKLYPNVDFYSGIIYKAMGIPSQMFTVLFAIARTVGWMAQWKEMHEDPEQKISRPRQLYTGYVHREYKCIVERK

SEQ ID NO: 37158 - DNA, 1134 bp, Sulfolobus solfataricus
  CDS (1)..(1134): transl_table=11
atgagtgtcgtaagtaaaggtttggagaatgttattataaaggttacaaatttaacattcatagatggggagaaaggaatactgaggtatagaggatataatattgaagatctagttaactatggcagttacgaagagactatctacttaatgctttatggaaaattacctacaaagaaagaattaaacgatttaaaggctaaacttaatgaggaatacgaggtacctcaggaagttttagacacaatataccttatgccgaaagaagcagacgcaataggtcttttagaagtaggaacagcagcattagcctctattgataagaactttaaatggaaggaaaacgataaagaaaaagcaattagcattattgctaaaatggctactctagtagcaaatgtatatagaagaaaggagggtaataagccaagaattccagagccctcagatagttttgcaaaaagctttcttttagcgagtttcgctagggaacctactacagatgagataaacgcaatggataaggcgttaatactttatactgatcatgaagtgccagcatcgacaacggcagcacttgttgcagcatccactttgtcggatatgtattcttcccttactgcagccttagctgcgttaaaaggtccattacatggtggagcagctgaagaggcttttaagcaattcattgaaataggtgatccaaatagagtacaaaactggtttaatgataaggtagtgaatcagaagaatagactaatgggatttggtcatagagtttacaagacttatgatcccagggcaaagatatttaagaaactagccttaacgctaattgaaaggaatgctgatgcaaggagatattttgagatagctcaaaaacttgaggagttgggaattaagcaattttctagcaagggaatctatcctaacactgatttctattctggaatagtcttctacgctttaggatttccagtatacatgtttactgccttatttgccttatcgagaactttaggttggttagcacatataatagaatatgtagaggaacagcacagacttattagaccaagagccttatatgttggaccagaatatcaagagtatgtttctatagataaacgataa

SEQ ID NO: 37159 - protein, 377 aa, Sulfolobus solfataricus
MSVVSKGLENVIIKVTNLTFIDGEKGILRYRGYNIEDLVNYGSYEETIYLMLYGKLPTKKELNDLKAKLNEEYEVPQEVLDTIYLMPKEADAIGLLEVGTAALASIDKNFKWKENDKEKAISIIAKMATLVANVYRRKEGNKPRIPEPSDSFAKSFLLASFAREPTTDEINAMDKALILYTDHEVPASTTAALVAASTLSDMYSSLTAALAALKGPLHGGAAEEAFKQFIEIGDPNRVQNWFNDKVVNQKNRLMGFGHRVYKTYDPRAKIFKKLALTLIERNADARRYFEIAQKLEELGIKQFSSKGIYPNTDFYSGIVFYALGFPVYMFTALFALSRTLGWLAHIIEYVEEQHRLIRPRALYVGPEYQEYVSIDKR

SEQ ID NO: 37160 - DNA, 1194 bp, Synechocystis sp
  CDS (1)..(1194): transl_table=11
gtgaattatatgatgactgataacgaagtgtttaaagaaggcctagccggagtccccgccgctaaatcgagggtgagccatgtggatggcaccgacggtattttggagtaccggggcattcgcatcgaagaattagccaaatccagtagttttatcgaagtagcctatctgctcatctggggtaaattgcccacccaggcagagatcgaagagtttgagtacgaaattcgcacccatcgacgcattaagtaccacatccgggacatgatgaaatgttttcccgaaacagggcaccccatggatgccttgcaaacttcagcggcggccttgggattgttctatgctcgacgggccttggatgaccccaaatatatccgggcggcggtggtgcgtctgttagccaaaatccccaccatggtggcagctttccacatgatccgggagggtaacgatcccattcagcccaatgataaattggattacgcttccaacttcctttacatgctgacggagaaggagccagacccctttgccgccaaagtgtttgatgtgtgtttgaccctccatgctgagcacaccatgaatgcgtccaccttttcggcccgggtaacggcttctactctcacggatccctatgcagtggttgcctcggcggtggggactttggcggggccgctccacgggggagccaacgaagaagtgctaaatatgcttgaagaaattggctcagtggaaaatgtccgcccctacgtggaaaaatgcctggccaacaaacagcgcatcatgggctttggccaccgagtttataaagtcaaagacccccgggcaattattttgcaggatttggctgaacagttatttgccaaaatgggccacgacgaatattacgaaatcgcagtggagttggaaaaagtagtggaagaatacgtgggtcaaaagggcatttaccccaatgtggacttctattccggtttggtttaccgcaagctagacatccccgccgatctgtttacgcccctatttgcgatcgccagggtggcgggttggttggcccactggaaggaacaattatcagtcaataaaatttaccgtcctacccaaatttacatcggtgaccataatttatcttatgttcccatgacagaacgggtagtttccgtggcccgcaatgaagaccccaatgcgattatttaa

SEQ ID NO: 37161 - protein, 397 aa, Synechocystis sp
MNYMMTDNEVFKEGLAGVPAAKSRVSHVDGTDGILEYRGIRIEELAKSSSFIEVAYLLIWGKLPTQAEIEEFEYEIRTHRRIKYHIRDMMKCFPETGHPMDALQTSAAALGLFYARRALDDPKYIRAAVVRLLAKIPTMVAAFHMIREGNDPIQPNDKLDYASNFLYMLTEKEPDPFAAKVFDVCLTLHAEHTMNASTFSARVTASTLTDPYAVVASAVGTLAGPLHGGANEEVLNMLEEIGSVENVRPYVEKCLANKQRIMGFGHRVYKVKDPRAIILQDLAEQLFAKMGHDEYYEIAVELEKVVEEYVGQKGIYPNVDFYSGLVYRKLDIPADLFTPLFAIARVAGWLAHWKEQLSVNKIYRPTQIYIGDHNLSYVPMTERVVSVARNEDPNAII

SEQ ID NO: 37162 - DNA, 1161 bp, Thiobacillus ferrooxidans
  CDS (1)..(1161): transl_table=11
atggcggaaccgaactttgcgccaggtctggagggtgtggctgcaacccagtccagcatttccaacatcgatggcgctgccggcctgctgagttaccgtggttttgccattgcggatcttgcggcgcacagcagtttcgaggaggtggcgctcttgctgctggatggtgtcctgcccggcgccgcagatctggaacggttcgaccacggtctgcgtgcgcaccgccaagtcaaatataatgtccgggaaatcatgaagttcatgcccgtgaccggacaccccatggatatgctgcactgtgccgtggccagtctgggcatgttctacccgcagcaggagctttccgatgccgaacgcggaaatacgctccatttggacgccatggcgatgcggattatcgcgcgcatgcccaccattgtcgcgatgtgggagcagatgcgtttcggcaatgatcctatttcacctcgcccggatctcagccatgcggccaactttctctatatgctgtcgggtcgcgaacctgatccggcccataccaaaatcctcgactcctgcctgattctgcatgccgagcacaccatcaatgccagtaccttctcggtactggtgaccggatccaccctgaccaatccttaccatgtcatcgggggggcgatcggaaccctggccggcccgttgcatggtggtgccaatcagaaggtggtggaaatgctggaagaaatcagctccgtccagcaggtgggtgcctatctcgacaggaagatggccaacaaggagaagatctggggtttcgggcatcgcatctacaaaacccgcgatccgcgtgcagtgattctcaaggggatgatggaggatatggccagtcatggaaatctgcggcatagcagcctctttgaaattgccatcgaagtggaacgccaggctacggagcggctcggtgcccaagggattcacgccaatgtggatttctattcgggcgtgctgtatcacgagatgggcatcaaagcggacctttttacgcctatttttgctatggctcgttctgcgggctggctggctcactggcgggagcaactggcggataaccggatcttccggcctacgcaggtgtatacaggggaacaggatcgacgctatgtgcctgtggcccaacgtacttag

SEQ ID NO: 37163 - protein, 386 aa, Thiobacillus ferrooxidans
MAEPNFAPGLEGVAATQSSISNIDGAAGLLSYRGFAIADLAAHSSFEEVALLLLDGVLPGAADLERFDHGLRAHRQVKYNVREIMKFMPVTGHPMDMLHCAVASLGMFYPQQELSDAERGNTLHLDAMAMRIIARMPTIVAMWEQMRFGNDPISPRPDLSHAANFLYMLSGREPDPAHTKILDSCLILHAEHTINASTFSVLVTGSTLTNPYHVIGGAIGTLAGPLHGGANQKVVEMLEEISSVQQVGAYLDRKMANKEKIWGFGHRIYKTRDPRAVILKGMMEDMASHGNLRHSSLFEIAIEVERQATERLGAQGIHANVDFYSGVLYHEMGIKADLFTPIFAMARSAGWLAHWREQLADNRIFRPTQVYTGEQDRRYVPVAQRT

SEQ ID NO: 37164 - DNA, 1551 bp, Cucurbita maxima
  CDS (1)..(1551)
atgcccaccgacatggaattgtcgccttcgaacgttgctcgtcatcgcttggccgttctggcagcgcatctgagcgctgcgtccttggaaccgccggtgatggcttcgtccctcgaggctcattgcgtgtcagctcagaccatggttgcgccgcctgaattggtgaagggtacgttgacgattgtagatgagagaactggaaagaggtaccaggtccaggtatctgaagaaggcacgatcaaggccaccgatttgaagaagataactacaggaccaaatgacaaggggcttaagctgtatgatccaggctatctcaacactgctccagttcggtcgtcgatcagttatattgatggtgacttgggaattcttaggtacagaggctacccgattgaggaattggctgagagtagtacctatgtggaagttgcatacctcttgatgtatgggaatttgccttctcagagtcaattggcagactgggaatttgctatttctcagcattcggctgtaccgcagggacttgtggatattattcaagcaatgcctcatgatgcacatccaatgggtgtgcttgttagtgcaatgagtgctctatctgtctttcatccagatgccaatcctgcccttagaggacaagatctttacaagtctaagcaagtgagagacaaacaaatagctcgtattatagggaaggctcccaccattgcagcagcagcttatcttagacttgctggaagacctccagttctcccttccagcaatctttcttattcggagaatttcctgtacatgcttgattctttgggtaataggtcttacaaacccaatcctcggcttgctagagtcctcgacattctattcatccttcatgcagaacatgaaatgaactgctcaacatctgctgctcgccatctggcttcaagtggtgttgatgtgttcactgctctttctggagctgtcggagcactgtatggccctcttcatggtggggccaatgaggctgtgcttaaaatgctaagtgagattggaactgttaataatattccagaattcatcgagggtgttaaaaacaggaaaaggaagatgtcaggttttggccatagggtttacaagaactacgatccaagagctaaggttataagaaaacttgccgaagaagtgttttccattgttggtcgggatcctctcattgaggtggctgttgctctggagaaggctgctctttcagatgagtattttgtcaagaggaaattatacccaaacgttgacttttactccggattaatatatagggctatgggatttccacctgaatttttcactgtgctgtttgcaatccctcgaatggctggatacttggcacattggcgagaatcgctggatgatcccgacactaagataattcgacctcaacaggtctacactggggaatggctgcgacattatataccacccaacgaacgacttgtaccggccaaggcagacaggcttggtcaggtttccgtttccaacgcctccaaacgccgattgtctggatcggggatctag

SEQ ID NO: 37165 - protein, 516 aa, Cucurbita maxima
MPTDMELSPSNVARHRLAVLAAHLSAASLEPPVMASSLEAHCVSAQTMVAPPELVKGTLTIVDERTGKRYQVQVSEEGTIKATDLKKITTGPNDKGLKLYDPGYLNTAPVRSSISYIDGDLGILRYRGYPIEELAESSTYVEVAYLLMYGNLPSQSQLADWEFAISQHSAVPQGLVDIIQAMPHDAHPMGVLVSAMSALSVFHPDANPALRGQDLYKSKQVRDKQIARIIGKAPTIAAAAYLRLAGRPPVLPSSNLSYSENFLYMLDSLGNRSYKPNPRLARVLDILFILHAEHEMNCSTSAARHLASSGVDVFTALSGAVGALYGPLHGGANEAVLKMLSEIGTVNNIPEFIEGVKNRKRKMSGFGHRVYKNYDPRAKVIRKLAEEVFSIVGRDPLIEVAVALEKAALSDEYFVKRKLYPNVDFYSGLIYRAMGFPPEFFTVLFAIPRMAGYLAHWRESLDDPDTKIIRPQQVYTGEWLRHYIPPNERLVPAKADRLGQVSVSNASKRRLSGSGI

SEQ ID NO: 37166 - DNA, 25 bp, Artificial sequence
  (1)..(25): primer
atggctgatacaaaagcaaaactca

SEQ ID NO: 37167 - DNA, 26 bp, Artificial sequence
  (1)..(26): primer
ttaacgcttgatatcgcttttaaagt

SEQ ID NO: 37168 - protein, 436 aa, Artificial sequence
  Variant (2)..(13): xaa in position 2 to 13 is any amino acid
  Variant (14)..(25): xaa in position 14 to 25 is any or no amino acid
  Variant (27)..(34): xaa in position 27 to 34 is any amino acid
  Variant (36)..(36): xaa in position 36 is any amino acid
  Variant (43)..(43): xaa in position 43 is any amino acid
  Variant (44)..(44): xaa in position 44 is any or no amino acid
  Variant (46)..(46): xaa in position 46 is any or no amino acid
  Variant (48)..(48): xaa in position 48 is any amino acid
  Variant (53)..(53): xaa in position 53 is any amino acid
  Variant (55)..(56): xaa in position 55 to 56 is any amino acid
  Variant (59)..(62): xaa in position 59 to 62 is any amino acid
  Variant (63)..(63): xaa in position 63 is any or no amino acid
  Variant (65)..(65): xaa in position 65 is any amino acid
  Variant (67)..(68): xaa in position 67 to 68 is any amino acid
  Variant (73)..(73): xaa in position 73 is any amino acid
  Variant (75)..(75): xaa in position 75 is any amino acid
  Variant (78)..(84): xaa in position 78 to 84 is any amino acid
  Variant (85)..(86): xaa in position 85 to 86 is any or no amino acid
  Variant (88)..(90): xaa in position 88 to 90 is any amino acid
  Variant (92)..(96): xaa in position 92 to 96 is any amino acid
  Variant (98)..(100): xaa in position 98 to 100 is any amino acid
  Variant (102)..(107): xaa in position 102 to 107 is any amino acid
  Variant (109)..(110): xaa in position 109 to 110 is any amino acid
  Variant (111)..(112): xaa in position 111 to 112 is any or no amino acid
  Variant (117)..(118): xaa in position 117 to 118 is any amino acid
  Variant (120)..(124): xaa in position 120 to 124 is any amino acid
  Variant (128)..(128): xaa in position 128 is any amino acid
  Variant (131)..(140): xaa in position 131 to 140 is any amino acid
  Variant (141)..(158): xaa in position 141 to 158 is any or no amino acid
  Variant (168)..(168): xaa in position 168 is any amino acid
  Variant (170)..(171): xaa in position 170 to 171 is any amino acid
  Variant (174)..(176): xaa in position 174 to 176 is any amino acid
  Variant (178)..(180): xaa in position 178 to 180 is any amino acid
  Variant (182)..(182): xaa in position 182 is any amino acid
  Variant (184)..(186): xaa in position 184 to 186 is any amino acid
  Variant (188)..(188): xaa in position 188 is any amino acid
  Variant (190)..(191): xaa in position 190 to 191 is any amino acid
  Variant (195)..(195): xaa in position 195 is any amino acid
  Variant (197)..(205): xaa in position 197 to 205 is any amino acid
  Variant (206)..(220): xaa in position 206 to 220 is any or no amino acid
  Variant (222)..(222): xaa in position 222 is any amino acid
  Variant (225)..(227): xaa in position 225 to 227 is any amino acid
  Variant (235)..(235): xaa in position 235 is any amino acid
  Variant (237)..(237): xaa in position 237 is any amino acid
  Variant (240)..(240): xaa in position 240 is any amino acid
  Variant (242)..(242): xaa in position 242 is any amino acid
  Variant (245)..(245): xaa in position 245 is any amino acid
  Variant (249)..(252): xaa in position 249 to 252 is any amino acid
  Variant (255)..(255): xaa in position 255 is any amino acid
  Variant (261)..(262): xaa in position 261 to 262 is any amino acid
  Variant (264)..(264): xaa in position 264 is any amino acid
  Variant (267)..(267): xaa in position 267 is any amino acid
  Variant (274)..(275): xaa in position 274 to 275 is any amino acid
  Variant (277)..(277): xaa in position 277 is any amino acid
  Variant (280)..(281): xaa in position 280 to 281 is any amino acid
  Variant (283)..(287): xaa in position 283 to 287 is any amino acid
  Variant (288)..(290): xaa in position 288 to 290 is any or no amino acid
  Variant (292)..(293): xaa in position 292 to 293 is any amino acid
  Variant (296)..(303): xaa in position 296 to 303 is any amino acid
  Variant (304)..(307): xaa in position 304 to 307 is any or no amino acid
  Variant (319)..(320): xaa in position 319 to 320 is any amino acid
  Variant (325)..(325): xaa in position 325 is any amino acid
  Variant (328)..(333): xaa in position 328 to 333 is any amino acid
  Variant (335)..(341): xaa in position 335 to 341 is any amino acid
  Variant (342)..(352): xaa in position 342 to 352 is any or no amino acid
  Variant (355)..(356): xaa in position 355 to 356 is any amino acid
  Variant (359)..(359): xaa in position 359 is any amino acid
  Variant (360)..(360): xaa in position 360 is any or no amino acid
  Variant (363)..(363): xaa in position 363 is any amino acid
  Variant (364)..(365): xaa in position 364 to 365 is any or no amino acid
  Variant (368)..(368): xaa in position 368 is any amino acid
  Variant (369)..(369): xaa in position 369 is any or no amino acid
  Variant (371)..(371): xaa in position 371 is any amino acid
  Variant (384)..(385): xaa in position 384 to 385 is any amino acid
  Variant (389)..(389): xaa in position 389 is any amino acid
  Variant (391)..(392): xaa in position 391 to 392 is any amino acid
  Variant (396)..(396): xaa in position 396 is any or no amino acid
  Variant (401)..(401): xaa in position 401 is any amino acid
  Variant (403)..(404): xaa in position 403 to 404 is any amino acid
  Variant (409)..(409): xaa in position 409 is any amino acid
  Variant (411)..(411): xaa in position 411 is any amino acid
  Variant (413)..(418): xaa in position 413 to 418 is any amino acid
  Variant (419)..(422): xaa in position 419 to 422 is any or no amino acid
  Variant (424)..(424): xaa in position 424 is any amino acid
  Variant (431)..(431): xaa in position 431 is any amino acid
  Variant (433)..(435): xaa in position 433 to 435 is any amino acid
GXXXXXXXXXXXXXXXXXXXXXXXXGXXXXXXXXSXITYIDGXXGXLXYRGYXIXXLAXXXXXFXEXXYLLLXGXLPXXXXXXXXXFXXXIXXXXXVXXXLXXXXXXFXXXXAHPMXXLXXXXXALSXFYXXXXXXXXXXXXXXXXXXXXXXXXXXXXRLIAKIPTIXAXXYKXXXGXXXIXPXXXLXYXXNFLXMXXXXXXXXXXXXXXXXXXXXXXXXRXLDXXXILHADHEXNXSTXTXRLXGSSXXXXFAXIAAGIXXLXGPXHGGANEXXLXMLXXIXXXXXXXXVXXFIXXXXXXXXXXXXRLMGFGHRVYKXXDPRAXIMXXXXXXVXXXXXXXXXXXXXXXXXXIAXXLEXXALXXXYFXXRXLYPNVDFYSGIIXXALGXPXXMFTXIFALXRXXGWIAXWXEXXXXXXXXXXIXRPRQLYXGXXXR

SEQ ID NO: 37169 - protein, 52 aa, Artificial sequence
  Variant (2)..(9): xaa in position 2 to 9 is any amino acid
  Variant (11)..(11): xaa in position 11 is any amino acid
  Variant (13)..(13): xaa in position 13 is Cys, Ser or Thr
  Variant (14)..(14): xaa in position 14 is any amino acid
  Variant (15)..(15): xaa in position 15 is Ile, Leu or Val
  Variant (18)..(19): xaa in position 18 to 19 is any amino acid
  Variant (21)..(21): xaa in position 21 is any amino acid
  Variant (23)..(23): xaa in position 23 is any amino acid
  Variant (24)..(24): xaa in position 24 is His or Tyr
  Variant (27)..(43): xaa in position 27 to 43 is any amino acid
  Variant (44)..(44): xaa in position 44 is any or no amino acid
  Variant (46)..(50): xaa in position 46 to 50 is any amino acid
  Variant (51)..(51): xaa in position 51 is any or no amino acid
GXXXXXXXXSXIXXXDGXXGXLXXRGXXXXXXXXXXXXXXXXXXLXXXXXXP

SEQ ID NO: 37170 - protein, 29 aa, Artificial sequence
  Variant (2)..(2): xaa in position 2 is any amino acid
  Variant (3)..(3): xaa in position 3 is any or no amino acid
  Variant (5)..(11): xaa in position 5 to 11 is any amino acid
  Variant (12)..(12): xaa in position 12 is any or no amino acid
  Variant (14)..(18): xaa in position 14 to 18 is any amino acid
  Variant (20)..(23): xaa in position 20 to 23 is any amino acid
  Variant (24)..(24): xaa in position 24 is Ala, Asp, Gly, Asn, Pro, Ser or Thr
  Variant (25)..(25): xaa in position 25 is any amino acid
  Variant (26)..(26): xaa in position 26 is Ala, Cys, Ser, Thr or Val
  Variant (27)..(27): xaa in position 27 is Ala, Asp, Glu, Gly, Gln, Ser or Thr
  Variant (28)..(28): xaa in position 28 is Asn, Arg or Ser
TXXAXXXXXXXXGXXXXXPXXXXXXXXXF

SEQ ID NO: 37171 - protein, 57 aa, Artificial sequence
  Variant (2)..(4): xaa in position 2 to 4 is any or no amino acid
  Variant (7)..(7): xaa in position 7 is Asp or Glu
  Variant (9)..(9): xaa in position 9 is Glu, Gly, Ser or Thr
  Variant (10)..(10): xaa in position 10 is any amino acid
  Variant (12)..(12): xaa in position 12 is Ala or Cys
  Variant (15)..(16): xaa in position 15 to 16 is any amino acid
  Variant (17)..(17): xaa in position 17 is Ala or Val
  Variant (18)..(21): xaa in position 18 to 21 is any amino acid
  Variant (22)..(22): xaa in position 22 is Ala or Ser
  Variant (23)..(23): xaa in position 23 is Ala, Ser or Thr
  Variant (24)..(29): xaa in position 24 to 29 is any amino acid
  Variant (30)..(30): xaa in position 30 is Ala, Cys, Gly, Ser or Val
  Variant (31)..(32): xaa in position 31 to 32 is any amino acid
  Variant (33)..(33): xaa in position 33 is Ala, Gly, Ser or Thr
  Variant (34)..(34): xaa in position 34 is Ala, Cys, Gly or Ser
  Variant (35)..(35): xaa in position 35 is any amino acid
  Variant (36)..(36): xaa in position 36 is Ala, Cys, Gly, Asn, Ser or Thr
  Variant (37)..(37): xaa in position 37 is Ala, Cys, Ser or Thr
  Variant (39)..(39): xaa in position 39 is any amino acid
  Variant (41)..(42): xaa in position 41 to 42 is any amino acid
  Variant (48)..(48): xaa in position 48 is Ala, Glu or Gln
  Variant (49)..(49): xaa in position 49 is any amino acid
  Variant (50)..(50): xaa in position 50 is Ala, Cys, Thr or Val
  Variant (51)..(51): xaa in position 51 is Ile, Leu, Met or Val
  Variant (52)..(52): xaa in position 52 is any amino acid
  Variant (54)..(54): xaa in position 54 is Ile or Leu
  Variant (55)..(56): xaa in position 55 to 56 is any amino acid
  Variant (57)..(57): xaa in position 57 is Ile, Leu or Val
LXXXHAXHXXNXSTXXXXXXXXXXXXXXXXXXXXXXXLXGXXHGGANXXXXXMXXXX

SEQ ID NO: 37172 - protein, 17 aa, Artificial sequence
  Variant (9)..(9): xaa in position 9 is Asn, Ser, Thr or Val
  Variant (10)..(10): xaa in position 10 is any amino acid
  Variant (15)..(16): xaa in position 15 to 16 is any amino acid
  Variant (17)..(17): xaa in position 17 is Phe, Ile, Leu, Met or Val
GFGHRVYKXXDPRAXXX

SEQ ID NO: 37173 - protein, 59 aa, Artificial sequence
  Variant (2)..(2): xaa in position 2 is any amino acid
  Variant (3)..(4): xaa in position 3 to 4 is any or no amino acid
  Variant (6)..(17): xaa in position 6 to 17 is any amino acid
  Variant (18)..(19): xaa in position 18 to 19 is any or no amino acid
  Variant (26)..(26): xaa in position 26 is His, Trp or Tyr
  Variant (27)..(27): xaa in position 27 is Ser or Thr
  Variant (29)..(33): xaa in position 29 to 33 is any amino acid
  Variant (34)..(34): xaa in position 34 is Ile, Leu or Met
  Variant (35)..(35): xaa in position 35 is any amino acid
  Variant (36)..(36): xaa in position 36 is Phe, Ile or Val
  Variant (37)..(40): xaa in position 37 to 40 is any amino acid
  Variant (41)..(41): xaa in position 41 is Phe or Tyr
  Variant (42)..(42): xaa in position 42 is Ala, Pro or Thr
  Variant (43)..(43): xaa in position 43 is Ala, Cys, Pro, Thr or Val
  Variant (44)..(44): xaa in position 44 is Phe, Ile, Leu, Met or Val
  Variant (46)..(46): xaa in position 46 is Ala, Ser, Thr or Val
  Variant (47)..(47): xaa in position 47 is any amino acid
  Variant (48)..(48): xaa in position 48 is Ala, Gly, Pro or Ser
  Variant (50)..(51): xaa in position 50 to 51 is any amino acid
  Variant (53)..(53): xaa in position 53 is Trp or Tyr
  Variant (54)..(54): xaa in position 54 is any amino acid
  Variant (55)..(55): xaa in position 55 is Ala, Gly, Ser or Thr
  Variant (56)..(58): xaa in position 56 to 58 is any amino acid
AXXXEXXXXXXXXXXXXXXYPNVDFXXGXXXXXXXXXXXXXXXXFXXXRXXGXXXXXXE

SEQ ID NO: 37174 - protein, 12 aa, Artificial sequence
  Variant (2)..(2): xaa in position 2 is any amino acid
  Variant (3)..(4): xaa in position 3 to 4 is any or no amino acid
  Variant (6)..(7): xaa in position 6 to 7 is any or no amino acid
  Variant (9)..(9): xaa in position 9 is Ile, Leu or Val
  Variant (10)..(10): xaa in position 10 is Phe or Tyr
  Variant (11)..(11): xaa in position 11 is any amino acid
IXXXRXXQXXXG

SEQ ID NO: 37175 - DNA, 1203 bp, Escherichia coli; identical to SEQ ID NO: 13945
  CDS (1)..(1203)

SEQ ID NO: 37176 - protein, 400 aa, Escherichia coli; identical to SEQ ID NO: 13946

SEQ ID NO: 37177 - DNA, 1281 bp, Aquifex aeolicus VF5; identical to SEQ ID NO: 13947
  CDS (1)..(1281): transl_table=11

SEQ ID NO: 37178 - protein, 426 aa, Aquifex aeolicus VF5; identical to SEQ ID NO: 13948

SEQ ID NO: 37179 - DNA, 1260 bp, Neisseria meningitidis Z2491; identical to SEQ ID NO: 13949
  CDS (1)..(1260): transl_table=11

SEQ ID NO: 37180 - protein, 419 aa, Neisseria meningitidis Z2491; identical to SEQ ID NO: 13950

SEQ ID NO: 37181 - DNA, 1425 bp, Deinococcus radiodurans R1; identical to SEQ ID NO: 13951
  CDS (1)..(1425): transl_table=11

SEQ ID NO: 37182 - protein, 474 aa, Deinococcus radiodurans R1; identical to SEQ ID NO: 13952

SEQ ID NO: 37183 - DNA, 1392 bp, Mycobacterium tuberculosis CDC1551; identical to SEQ ID NO: 13953
  CDS (1)..(1392): transl_table=11

SEQ ID NO: 37184 - protein, 463 aa, Mycobacterium tuberculosis CDC1551; identical to SEQ ID NO: 13954

SEQ ID NO: 37185 - DNA, 1203 bp, Salmonella typhimurium LT2; identical to SEQ ID NO: 13955
  CDS (1)..(1203): transl_table=11

SEQ ID NO: 37186 - protein, 400 aa, Salmonella typhimurium LT2; identical to SEQ ID NO: 13956

SEQ ID NO: 37187 - DNA, 1320 bp, Agrobacterium tumefaciens str. C58; identical to SEQ ID NO: 13957
  CDS (1)..(1320): transl_table=11

SEQ ID NO: 37188 - protein, 439 aa, Agrobacterium tumefaciens str. C58; identical to SEQ ID NO: 13958

SEQ ID NO: 37189 - DNA, 1251 bp, Yersinia pestis KIM; identical to SEQ ID NO: 13959
  CDS (1)..(1251): transl_table=11

SEQ ID NO: 37190 - protein, 416 aa, Yersinia pestis KIM; identical to SEQ ID NO: 13960

SEQ ID NO: 37191 - DNA, 1314 bp, Thermosynechococcus elongatus BP-1; identical to SEQ ID NO: 13961
  CDS (1)..(1314): transl_table=11

SEQ ID NO: 37192 - protein, 437 aa, Thermosynechococcus elongatus BP-1; identical to SEQ ID NO: 13962

SEQ ID NO: 37193 - DNA, 1464 bp, Oceanobacillus iheyensis HTE831; identical to SEQ ID NO: 13963
  CDS (1)..(1464): transl_table=11

SEQ ID NO: 37194 - protein, 487 aa, Oceanobacillus iheyensis HTE831; identical to SEQ ID NO: 13964

SEQ ID NO: 37195 - DNA, 1209 bp, Pseudomonas putida KT2440; identical to SEQ ID NO: 13965
  CDS (1)..(1209): transl_table=11

SEQ ID NO: 37196 - protein, 402 aa, Pseudomonas putida KT2440; identical to SEQ ID NO: 13966

SEQ ID NO: 37197 - DNA, 1305 bp, Bradyrhizobium japonicum USDA 110; identical to SEQ ID NO: 13967
  CDS (1)..(1305)

SEQ ID NO: 37198 - protein, 434 aa, Bradyrhizobium japonicum USDA 110; identical to SEQ ID NO: 13968

SEQ ID NO: 37199 - DNA, 1434 bp, Lactobacillus plantarum WCFS1; identical to SEQ ID NO: 13969
  CDS (1)..(1434): transl_table=11

SEQ ID NO: 37200 - protein, 477 aa, Lactobacillus plantarum WCFS1; identical to SEQ ID NO: 13970

SEQ ID NO: 37201 - DNA, 1203 bp, Salmonella enterica subsp. enterica serovar Typhi Ty2; identical to SEQ ID NO: 13971
  CDS (1)..(1203): transl_table=11

SEQ ID NO: 37202 - protein, 400 aa, Salmonella enterica subsp. enterica serovar Typhi Ty2; identical to SEQ ID NO: 13972

SEQ ID NO: 37203 - DNA, 1170 bp, Bacteroides thetaiotaomicron VPI-5482; identical to SEQ ID NO: 13973
  CDS (1)..(1170): transl_table=11

SEQ ID NO: 37204 - protein, 389 aa, Bacteroides thetaiotaomicron VPI-5482; identical to SEQ ID NO: 13974

SEQ ID NO: 37205 - DNA, 1407 bp, Coxiella burnetii RSA 493; identical to SEQ ID NO: 13975
  CDS (1)..(1407): transl_table=11

SEQ ID NO: 37206 - protein, 468 aa, Coxiella burnetii RSA 493; identical to SEQ ID NO: 13976

SEQ ID NO: 37207 - DNA, 1185 bp, Porphyromonas gingivalis W83; identical to SEQ ID NO: 13977
  CDS (1)..(1185): transl_table=11

SEQ ID NO: 37208 - protein, 394 aa, Porphyromonas gingivalis W83; identical to SEQ ID NO: 13978

SEQ ID NO: 37209 - DNA, 1608 bp, Oryza sativa (japonica cultivar-group); identical to SEQ ID NO: 13979
  CDS (1)..(1608)

SEQ ID NO: 37210 - protein, 535 aa, Oryza sativa (japonica cultivar-group); identical to SEQ ID NO: 13980

SEQ ID NO: 37211 - DNA, 1446 bp, Geobacter sulfurreducens PCA; identical to SEQ ID NO: 13981
  CDS (1)..(1446): transl_table=11

SEQ ID NO: 37212 - protein, 481 aa, Geobacter sulfurreducens PCA; identical to SEQ ID NO: 13982

SEQ ID NO: 37213 - DNA, 1437 bp, Treponema denticola ATCC 35405; identical to SEQ ID NO: 13983
  CDS (1)..(1437): transl_table=11

SEQ ID NO: 37214 - protein, 478 aa, Treponema denticola ATCC 35405; identical to SEQ ID NO: 13984

SEQ ID NO: 37215 - DNA, 1293 bp, Eremothecium gossypii; identical to SEQ ID NO: 13985
  CDS (1)..(1293)

SEQ ID NO: 37216 - protein, 430 aa, Eremothecium gossypii; identical to SEQ ID NO: 13986

SEQ ID NO: 37217 - DNA, 1434 bp, Neurospora crassa; identical to SEQ ID NO: 13987
  CDS (1)..(1434)

SEQ ID NO: 37218 - protein, 477 aa, Neurospora crassa; identical to SEQ ID NO: 13988

SEQ ID NO: 37219 - DNA, 5916 bp, Magnaporthe grisea 70-15; identical to SEQ ID NO: 13989
  CDS (1)..(5916)

SEQ ID NO: 37220 - protein, 1971 aa, Magnaporthe grisea 70-15; identical to SEQ ID NO: 13990

SEQ ID NO: 37221 - DNA, 1380 bp, Gibberella zeae PH-1; identical to SEQ ID NO: 13991
  CDS (1)..(1380)

SEQ ID NO: 37222 - protein, 459 aa, Gibberella zeae PH-1; identical to SEQ ID NO: 13992

SEQ ID NO: 37223 - DNA, 1839 bp, Ustilago maydis 521; identical to SEQ ID NO: 13993
  CDS (1)..(1839)

SEQ ID NO: 37224 - protein, 612 aa, Ustilago maydis 521; identical to SEQ ID NO: 13994

SEQ ID NO: 37225 - DNA, 1464 bp, Aspergillus nidulans FGSC A4; identical to SEQ ID NO: 13995
  CDS (1)..(1464)

SEQ ID NO: 37226 - protein, 487 aa, Aspergillus nidulans FGSC A4; identical to SEQ ID NO: 13996

SEQ ID NO: 37227 - DNA, 1296 bp, Candida glabrata CBS138; identical to SEQ ID NO: 13997
  CDS (1)..(1296)

SEQ ID NO: 37228 - protein, 431 aa, Candida glabrata CBS138; identical to SEQ ID NO: 13998

SEQ ID NO: 37229 - DNA, 1284 bp, Kluyveromyces lactis NRRL Y-1140; identical to SEQ ID NO: 13999
  CDS (1)..(1284)

SEQ ID NO: 37230 - protein, 427 aa, Kluyveromyces lactis NRRL Y-1140; identical to SEQ ID NO: 14000

SEQ ID NO: 37231 - DNA, 1269 bp, Debaryomyces hansenii CBS767; identical to SEQ ID NO: 14001
  CDS (1)..(1269)

SEQ ID NO: 37232 - protein, 422 aa, Debaryomyces hansenii CBS767; identical to SEQ ID NO: 14002

SEQ ID NO: 37233 - DNA, 1245 bp, Yarrowia lipolytica CLIB99; identical to SEQ ID NO: 14003
  CDS (1)..(1245)

SEQ ID NO: 37234 - protein, 414 aa, Yarrowia lipolytica CLIB99; identical to SEQ ID NO: 14004

SEQ ID NO: 37235 - DNA, 1362 bp, Cryptococcus neoformans var. neoformans JEC21; identical to SEQ ID NO: 14005
  CDS (1)..(1362)

SEQ ID NO: 37236 - protein, 453 aa, Cryptococcus neoformans var. neoformans JEC21; identical to SEQ ID NO: 14006

SEQ ID NO: 37237 - DNA, 1173 bp, Entamoeba histolytica HM-1:IMSS; identical to SEQ ID NO: 14007
  CDS (1)..(1173)

SEQ ID NO: 37238 - protein, 390 aa, Entamoeba histolytica HM-1:IMSS; identical to SEQ ID NO: 14008

SEQ ID NO: 37239 - DNA, 1266 bp, Candida albicans SC5314; identical to SEQ ID NO: 14009
  CDS (1)..(1266): transl_table=12

SEQ ID NO: 37240 - protein, 421 aa, Candida albicans SC5314; identical to SEQ ID NO: 14010

SEQ ID NO: 37241 - DNA, 1305 bp, Bartonella quintana str. Toulouse; identical to SEQ ID NO: 14011
  CDS (1)..(1305): transl_table=11

SEQ ID NO: 37242 - protein, 434 aa, Bartonella quintana str. Toulouse; identical to SEQ ID NO: 14012

SEQ ID NO: 37243 - DNA, 1305 bp, Bartonella henselae str. Houston-1; identical to SEQ ID NO: 14013
  CDS (1)..(1305): transl_table=11

SEQ ID NO: 37244 - protein, 434 aa, Bartonella henselae str. Houston-1; identical to SEQ ID NO: 14014

SEQ ID NO: 37245 - DNA, 1470 bp, Bacillus licheniformis ATCC 14580; identical to SEQ ID NO: 14015
  CDS (1)..(1470): transl_table=11

SEQ ID NO: 37246 - protein, 489 aa, Bacillus licheniformis ATCC 14580; identical to SEQ ID NO: 14016

SEQ ID NO: 37247 - DNA, 1167 bp, Bacteroides fragilis YCH46; identical to SEQ ID NO: 14017
  CDS (1)..(1167): transl_table=11

SEQ ID NO: 37248 - protein, 388 aa, Bacteroides fragilis YCH46; identical to SEQ ID NO: 14018

SEQ ID NO: 37249 - DNA, 1350 bp, Methylococcus capsulatus str. Bath; identical to SEQ ID NO: 14019
  CDS (1)..(1350): transl_table=11

SEQ ID NO: 37250 - protein, 449 aa, Methylococcus capsulatus str. Bath; identical to SEQ ID NO: 14020

SEQ ID NO: 37251 - DNA, 1317 bp, Nocardia farcinica IFM 10152; identical to SEQ ID NO: 14021
  CDS (1)..(1317): transl_table=11

SEQ ID NO: 37252 - protein, 438 aa, Nocardia farcinica IFM 10152; identical to SEQ ID NO: 14022

SEQ ID NO: 37253 - DNA, 1404 bp, Legionella pneumophila str. Paris; identical to SEQ ID NO: 14023
  CDS (1)..(1404): transl_table=11

SEQ ID NO: 37254 - protein, 467 aa, Legionella pneumophila str. Paris; identical to SEQ ID NO: 14024

SEQ ID NO: 37255 - DNA, 1404 bp, Legionella pneumophila str. Lens; identical to SEQ ID NO: 14025
  CDS (1)..(1404): transl_table=11

SEQ ID NO: 37256 - protein, 467 aa, Legionella pneumophila str. Lens; identical to SEQ ID NO: 14026

SEQ ID NO: 37257 - DNA, 1473 bp, Geobacillus kaustophilus HTA426; identical to SEQ ID NO: 14027
  CDS (1)..(1473): transl_table=11

SEQ ID NO: 37258 - protein, 490 aa, Geobacillus kaustophilus HTA426; identical to SEQ ID NO: 14028

SEQ ID NO: 37259 - DNA, 1347 bp, Idiomarina loihiensis L2TR; identical to SEQ ID NO: 14029
  CDS (1)..(1347): transl_table=11

SEQ ID NO: 37260 - protein, 448 aa, Idiomarina loihiensis L2TR; identical to SEQ ID NO: 14030

SEQ ID NO: 37261 - DNA, 1344 bp, Silicibacter pomeroyi DSS-3; identical to SEQ ID NO: 14031
  CDS (1)..(1344): transl_table=11

SEQ ID NO: 37262 - protein, 447 aa, Silicibacter pomeroyi DSS-3; identical to SEQ ID NO: 14032

SEQ ID NO: 37263 - DNA, 1260 bp, Neisseria gonorrhoeae FA 1090; identical to SEQ ID NO: 14033
  CDS (1)..(1260): transl_table=11

SEQ ID NO: 37264 - protein, 419 aa, Neisseria gonorrhoeae FA 1090; identical to SEQ ID NO: 14034

SEQ ID NO: 37265 - DNA, 1167 bp, Bacteroides fragilis NCTC 9343; identical to SEQ ID NO: 14035
  CDS (1)..(1167): transl_table=11

SEQ ID NO: 37266 - protein, 388 aa, Bacteroides fragilis NCTC 9343; identical to SEQ ID NO: 14036

SEQ ID NO: 37267 - DNA, 1251 bp, Salmonella enterica subsp. enterica serovar Choleraesuis str; identical to SEQ ID NO: 14037
  CDS (1)..(1251): transl_table=11

SEQ ID NO: 37268 - protein, 416 aa, Salmonella enterica subsp. enterica serovar Choleraesuis str; identical to SEQ ID NO: 14038

SEQ ID NO: 37269 - DNA, 1224 bp, Pseudomonas syringae pv. syringae B728a; identical to SEQ ID NO: 14039
  CDS (1)..(1224)

SEQ ID NO: 37270 - protein, 407 aa, Pseudomonas syringae pv. syringae B728a; identical to SEQ ID NO: 14040

SEQ ID NO: 37271 - DNA, 1326 bp, Corynebacterium jeikeium K411; identical to SEQ ID NO: 14041
  CDS (1)..(1326): transl_table=11

SEQ ID NO: 37272 - protein, 441 aa, Corynebacterium jeikeium K411; identical to SEQ ID NO: 14042

SEQ ID NO: 37273 - DNA, 1293 bp, Rhodobacter sphaeroides 2.4.1; identical to SEQ ID NO: 14043
  CDS (1)..(1293)

SEQ ID NO: 37274 - protein, 430 aa, Rhodobacter sphaeroides 2.4.1; identical to SEQ ID NO: 14044

SEQ ID NO: 37275 - DNA, 1134 bp, Xylella fastidiosa Ann-1; identical to SEQ ID NO: 14045
  CDS (1)..(1134)

SEQ ID NO: 37276 - protein, 377 aa, Xylella fastidiosa Ann-1; identical to SEQ ID NO: 14046

SEQ ID NO: 37277 - DNA, 1464 bp, Leuconostoc mesenteroides subsp. mesenteroides ATCC 8293; identical to SEQ ID NO: 14047
  CDS (1)..(1464)

SEQ ID NO: 37278 - protein, 487 aa, Leuconostoc mesenteroides subsp. mesenteroides ATCC 8293; identical to SEQ ID NO: 14048

SEQ ID NO: 37279 - DNA, 1242 bp, Psychrobacter sp. 273-4; identical to SEQ ID NO: 14049
  CDS (1)..(1242)

SEQ ID NO: 37280 - protein, 413 aa, Psychrobacter sp. 273-4; identical to SEQ ID NO: 14050

SEQ ID NO: 37281 - DNA, 1179 bp, Ralstonia eutropha JMP134; identical to SEQ ID NO: 14051
  CDS (1)..(1179)

SEQ ID NO: 37282 - protein, 392 aa, Ralstonia eutropha JMP134; identical to SEQ ID NO: 14052

SEQ ID NO: 37283 - DNA, 1200 bp, Burkholderia cepacia R18194; identical to SEQ ID NO: 14053
  CDS (1)..(1200)

SEQ ID NO: 37284 - protein, 399 aa, Burkholderia cepacia R18194; identical to SEQ ID NO: 14054

SEQ ID NO: 37285 - DNA, 1224 bp, Pseudomonas fluorescens PfO-1; identical to SEQ ID NO: 14055
  CDS (1)..(1224)

SEQ ID NO: 37286 - protein, 407 aa, Pseudomonas fluorescens PfO-1; identical to SEQ ID NO: 14056

SEQ ID NO: 37287 - DNA, 1197 bp, Burkholderia fungorum LB400; identical to SEQ ID NO: 14057
  CDS (1)..(1197)

SEQ ID NO: 37288 - protein, 398 aa, Burkholderia fungorum LB400; identical to SEQ ID NO: 14058

SEQ ID NO: 37289 - DNA, 1428 bp, Oenococcus oeni PSU-1; identical to SEQ ID NO: 14059
  CDS (1)..(1428)

SEQ ID NO: 37290 - protein, 475 aa, Oenococcus oeni PSU-1; identical to SEQ ID NO: 14060

SEQ ID NO: 37291 - DNA, 1380 bp, Trichodesmium erythraeum IMS101; identical to SEQ ID NO: 14061
  CDS (1)..(1380)

SEQ ID NO: 37292 - protein, 459 aa, Trichodesmium erythraeum IMS101; identical to SEQ ID NO: 14062

SEQ ID NO: 37293 - DNA, 1434 bp, Campylobacter upsaliensis RM3195; identical to SEQ ID NO: 14063
  CDS (1)..(1434): transl_table=11

SEQ ID NO: 37294 - protein, 477 aa, Campylobacter upsaliensis RM3195; identical to SEQ ID NO: 14064

SEQ ID NO: 37295 - DNA, 1488 bp, Lactococcus lactis subsp. cremoris SK11; identical to SEQ ID NO: 14065
  CDS (1)..(1488)

SEQ ID NO: 37296 - protein, 495 aa, Lactococcus lactis subsp. cremoris SK11; identical to SEQ ID NO: 14066

SEQ ID NO: 37297 - DNA, 1461 bp, Deinococcus geothermalis DSM 11300; identical to SEQ ID NO: 14067
  CDS (1)..(1461): transl_table=11

SEQ ID NO: 37298 - protein, 486 aa, Deinococcus geothermalis DSM 11300; identical to SEQ ID NO: 14068

SEQ ID NO: 37299 - DNA, 1359 bp, Azotobacter vinelandii AvOP; identical to SEQ ID NO: 14069
  CDS (1)..(1359): transl_table=11

SEQ ID NO: 37300 - protein, 452 aa, Azotobacter vinelandii AvOP; identical to SEQ ID NO: 14070

SEQ ID NO: 37301 - DNA, 1356 bp, Burkholderia vietnamiensis G4; identical to SEQ ID NO: 14071
  CDS (1)..(1356): transl_table=11

SEQ ID NO: 37302 - protein, 451 aa, Burkholderia vietnamiensis G4; identical to SEQ ID NO: 14072

SEQ ID NO: 37303 - DNA, 1200 bp, Burkholderia mallei 10229; identical to SEQ ID NO: 14073
  CDS (1)..(1200)

SEQ ID NO: 37304 - protein, 399 aa, Burkholderia mallei 10229; identical to SEQ ID NO: 14074

SEQ ID NO: 37305 - DNA, 1200 bp, Burkholderia cenocepacia AU 1054; identical to SEQ ID NO: 14075
  CDS (1)..(1200): transl_table=11

SEQ ID NO: 37306 - protein, 399 aa, Burkholderia cenocepacia AU 1054; identical to SEQ ID NO: 14076

SEQ ID NO: 37307 - DNA, 1356 bp, Burkholderia pseudomallei 1655; identical to SEQ ID NO: 14077
  CDS (1)..(1356)

SEQ ID NO: 37308 - protein, 451 aa, Burkholderia pseudomallei 1655; identical to SEQ ID NO: 14078

SEQ ID NO: 37309 - DNA, 1173 bp, Chromohalobacter salexigens DSM 3043; identical to SEQ ID NO: 14079
  CDS (1)..(1173): transl_table=11

SEQ ID NO: 37310 - protein, 390 aa, Chromohalobacter salexigens DSM 3043; identical to SEQ ID NO: 14080

SEQ ID NO: 37311 - DNA, 1356 bp, Burkholderia pseudomallei 668; identical to SEQ ID NO: 14081
  CDS (1)..(1356)

SEQ ID NO: 37312 - protein, 451 aa, Burkholderia pseudomallei 668; identical to SEQ ID NO: 14082

SEQ ID NO: 37313 - DNA, 1269 bp, Polaromonas sp. JS666; identical to SEQ ID NO: 14083
  CDS (1)..(1269): transl_table=11

SEQ ID NO: 37314 - protein, 422 aa, Polaromonas sp. JS666; identical to SEQ ID NO: 14084

SEQ ID NO: 37315 - DNA, 1341 bp, Crocosphaera watsonii WH 8501; identical to SEQ ID NO: 14085
  CDS (1)..(1341): transl_table=11

SEQ ID NO: 37316 - protein, 446 aa, Crocosphaera watsonii WH 8501; identical to SEQ ID NO: 14086

SEQ ID NO: 37317 - DNA, 1431 bp, Geobacter metallireducens GS-15; identical to SEQ ID NO: 14087
  CDS (1)..(1431): transl_table=11

SEQ ID NO: 37318 - protein, 476 aa, Geobacter metallireducens GS-15; identical to SEQ ID NO: 14088

SEQ ID NO: 37319 - DNA, 1206 bp, Methanosarcina barkeri str. fusaro; identical to SEQ ID NO: 14089
  CDS (1)..(1206): transl_table=11

SEQ ID NO: 37320 - protein, 401 aa, Methanosarcina barkeri str. fusaro; identical to SEQ ID NO: 14090

SEQ ID NO: 37321 - DNA, 1206 bp, Desulfuromonas acetoxidans DSM 684; identical to SEQ ID NO: 14091
  CDS (1)..(1206): transl_table=11

SEQ ID NO: 37322 - protein, 401 aa, Desulfuromonas acetoxidans DSM 684; identical to SEQ ID NO: 14092

SEQ ID NO: 37323 - DNA, 1293 bp, Jannaschia sp. CCS1; identical to SEQ ID NO: 14093
  CDS (1)..(1293): transl_table=11

SEQ ID NO: 37324 - protein, 430 aa, Jannaschia sp. CCS1; identical to SEQ ID NO: 14094

SEQ ID NO: 37325 - DNA, 1458 bp, Desulfitobacterium hafniense DCB-2; identical to SEQ ID NO: 14095
  CDS (1)..(1458): transl_table=11

SEQ ID NO: 37326 - protein, 485 aa, Desulfitobacterium hafniense DCB-2; identical to SEQ ID NO: 14096

SEQ ID NO: 37327 - DNA, 1218 bp, Methanococcoides burtonii DSM 6242; identical to SEQ ID NO: 14097
  CDS (1)..(1218): transl_table=11

SEQ ID NO: 37328 - protein, 405 aa, Methanococcoides burtonii DSM 6242; identical to SEQ ID NO: 14098

SEQ ID NO: 37329 - DNA, 1575 bp, Frankia sp. EAN1pec; identical to SEQ ID NO: 14099
  CDS (1)..(1575): transl_table=11

SEQ ID NO: 37330 - protein, 524 aa, Frankia sp. EAN1pec; identical to SEQ ID NO: 14100

SEQ ID NO: 37331 - DNA, 1200 bp, Ralstonia metallidurans CH34; identical to SEQ ID NO: 14101
  CDS (1)..(1200): transl_table=11

SEQ ID NO: 37332 - protein, 399 aa, Ralstonia metallidurans CH34; identical to SEQ ID NO: 14102

SEQ ID NO: 37333 - DNA, 1341 bp, Magnetococcus sp. MC-1; identical to SEQ ID NO: 14103
  CDS (1)..(1341): transl_table=11

SEQ ID NO: 37334 - protein, 446 aa, Magnetococcus sp. MC-1; identical to SEQ ID NO: 14104

SEQ ID NO: 37335 - DNA, 1305 bp, Mesorhizobium sp. BNC1; identical to SEQ ID NO: 14105
  CDS (1)..(1305): transl_table=11

SEQ ID NO: 37336 - protein, 434 aa, Mesorhizobium sp. BNC1; identical to SEQ ID NO: 14106

SEQ ID NO: 37337 - DNA, 1290 bp, Silicibacter sp. TM1040; identical to SEQ ID NO: 14107
  CDS (1)..(1290): transl_table=11

SEQ ID NO: 37338 - protein, 429 aa, Silicibacter sp. TM1040; identical to SEQ ID NO: 14108

SEQ ID NO: 37339 - DNA, 1305 bp, Nitrobacter hamburgensis X14; identical to SEQ ID NO: 14109
  CDS (1)..(1305): transl_table=11

SEQ ID NO: 37340 - protein, 434 aa, Nitrobacter hamburgensis X14; identical to SEQ ID NO: 14110

SEQ ID NO: 37341 - DNA, 1308 bp, Paracoccus denitrificans PD1222; identical to SEQ ID NO: 14111
  CDS (1)..(1308): transl_table=11

SEQ ID NO: 37342 - protein, 435 aa, Paracoccus denitrificans PD1222; identical to SEQ ID NO: 14112

SEQ ID NO: 37343 - DNA, 1230 bp, Pseudomonas fluorescens; identical to SEQ ID NO: 14113
  CDS (1)..(1230): transl_table=11

SEQ ID NO: 37344 - protein, 409 aa, Pseudomonas fluorescens; identical to SEQ ID NO: 14114

SEQ ID NO: 37345 - DNA, 1215 bp, Pseudomonas fluorescens; identical to SEQ ID NO: 14115
  CDS (1)..(1215): transl_table=11

SEQ ID NO: 37346 - protein, 404 aa, Pseudomonas fluorescens; identical to SEQ ID NO: 14116

SEQ ID NO: 37347 - DNA, 1443 bp, Staphylococcus haemolyticus; identical to SEQ ID NO: 14117
  CDS (1)..(1443): transl_table=11

SEQ ID NO: 37348 - protein, 480 aa, Staphylococcus haemolyticus; identical to SEQ ID NO: 14118

SEQ ID NO: 37349 - DNA, 1245 bp, Leishmania major; identical to SEQ ID NO: 14119
  CDS (1)..(1245)

SEQ ID NO: 37350 - protein, 414 aa, Leishmania major; identical to SEQ ID NO: 14120

SEQ ID NO: 37351 - DNA, 1380 bp, Gibberella moniliformis; identical to SEQ ID NO: 14121
  CDS (1)..(1380)

SEQ ID NO: 37352 - protein, 459 aa, Gibberella moniliformis; identical to SEQ ID NO: 14122

SEQ ID NO: 37353 - DNA, 1233 bp, Schizosaccharomyces pombe; identical to SEQ ID NO: 14123
  CDS (1)..(1233)

SEQ ID NO: 37354 - protein, 410 aa, Schizosaccharomyces pombe; identical to SEQ ID NO: 14124

SEQ ID NO: 37355 - DNA, 1290 bp, Saccharomyces cerevisiae; identical to SEQ ID NO: 14125
  CDS (1)..(1290)

SEQ ID NO: 37356 - protein, 429 aa, Saccharomyces cerevisiae; identical to SEQ ID NO: 14126

SEQ ID NO: 37357 - DNA, 1200 bp, Pseudomonas aeruginosa; identical to SEQ ID NO: 14127
  CDS (1)..(1200): transl_table=11

SEQ ID NO: 37358 - protein, 399 aa, Pseudomonas aeruginosa; identical to SEQ ID NO: 14128

SEQ ID NO: 37359 - DNA, 1197 bp, Pseudomonas aeruginosa; identical to SEQ ID NO: 14129
  CDS (1)..(1197): transl_table=11

SEQ ID NO: 37360 - protein, 398 aa, Pseudomonas aeruginosa; identical to SEQ ID NO: 14130

SEQ ID NO: 37361 - DNA, 1224 bp, Acinetobacter sp; identical to SEQ ID NO: 14131
  CDS (1)..(1224): transl_table=11

SEQ ID NO: 37362 - protein, 407 aa, Acinetobacter sp; identical to SEQ ID NO: 14132

SEQ ID NO: 37363 - DNA, 1218 bp, Bordetella pertussis; identical to SEQ ID NO: 14133
  CDS (1)..(1218): transl_table=11

SEQ ID NO: 37364 - protein, 405 aa, Bordetella pertussis; identical to SEQ ID NO: 14134

SEQ ID NO: 37365 - DNA, 1305 bp, Brucella melitensis; identical to SEQ ID NO: 14135
  CDS (1)..(1305): transl_table=11

SEQ ID NO: 37366 - protein, 434 aa, Brucella melitensis; identical to SEQ ID NO: 14136

SEQ ID NO: 37367 - DNA, 1305 bp, Brucella suis; identical to SEQ ID NO: 14137
  CDS (1)..(1305)

SEQ ID NO: 37368 - protein, 434 aa, Brucella suis; identical to SEQ ID NO: 14138

SEQ ID NO: 37369 - DNA, 1200 bp, Buchnera aphidicola; identical to SEQ ID NO: 14139
  CDS (1)..(1200): transl_table=11

SEQ ID NO: 37370 - protein, 399 aa, Buchnera aphidicola; identical to SEQ ID NO: 14140

SEQ ID NO: 37371 - DNA, 1197 bp, Buchnera aphidicola; identical to SEQ ID NO: 14141
  CDS (1)..(1197): transl_table=11

SEQ ID NO: 37372 - protein, 398 aa, Buchnera aphidicola; identical to SEQ ID NO: 14142

SEQ ID NO: 37373 - DNA, 1200 bp, Burkholderia mallei; identical to SEQ ID NO: 14143
  CDS (1)..(1200): transl_table=11

SEQ ID NO: 37374 - protein, 399 aa, Burkholderia mallei; identical to SEQ ID NO: 14144

SEQ ID NO: 37375 - DNA, 1209 bp, Chromobacterium violaceum; identical to SEQ ID NO: 14145
  CDS (1)..(1209): transl_table=11

SEQ ID NO: 37376 - protein, 402 aa, Chromobacterium violaceum; identical to SEQ ID NO: 14146

SEQ ID NO: 37377 - DNA, 1206 bp, Erwinia carotovora; identical to SEQ ID NO: 14147
  CDS (1)..(1206): transl_table=11

SEQ ID NO: 37378 - protein, 401 aa, Erwinia carotovora; identical to SEQ ID NO: 14148

SEQ ID NO: 37379 - DNA, 1215 bp, Methanosarcina acetivorans; identical to SEQ ID NO: 14149
  CDS (1)..(1215): transl_table=11

SEQ ID NO: 37380 - protein, 404 aa, Methanosarcina acetivorans; identical to SEQ ID NO: 14150

SEQ ID NO: 37381 - DNA, 1209 bp, Neisseria gonorrhoeae; identical to SEQ ID NO: 14151
  CDS (1)..(1209)

SEQ ID NO: 37382 - protein, 402 aa, Neisseria gonorrhoeae; identical to SEQ ID NO: 14152

SEQ ID NO: 37383 - DNA, 1209 bp, Neisseria meningitidis; identical to SEQ ID NO: 14153
  CDS (1)..(1209)

SEQ ID NO: 37384 - protein, 402 aa, Neisseria meningitidis; identical to SEQ ID NO: 14154

SEQ ID NO: 37385 - DNA, 1209 bp, Neisseria meningitidis; identical to SEQ ID NO: 14155
  CDS (1)..(1209): transl_table=11

SEQ ID NO: 37386 - protein, 402 aa, Neisseria meningitidis; identical to SEQ ID NO: 14156

SEQ ID NO: 37387 - DNA, 1215 bp, Photorhabdus luminescens; identical to SEQ ID NO: 14157
  CDS (1)..(1215): transl_table=11

SEQ ID NO: 37388 - protein, 404 aa, Photorhabdus luminescens; identical to SEQ ID NO: 14158

SEQ ID NO: 37389 - DNA, 1218 bp, Photobacterium profundum; identical to SEQ ID NO: 14159
  CDS (1)..(1218): transl_table=11

SEQ ID NO: 37390 - protein, 405 aa, Photobacterium profundum; identical to SEQ ID NO: 14160

SEQ ID NO: 37391 - DNA, 1170 bp, Ralstonia solanacearum; identical to SEQ ID NO: 14161
  CDS (1)..(1170)

SEQ ID NO: 37392 - protein, 389 aa, Ralstonia solanacearum; identical to SEQ ID NO: 14162

SEQ ID NO: 37393 - DNA, 1305 bp, Rhizobium loti; identical to SEQ ID NO: 14163
  CDS (1)..(1305): transl_table=11

SEQ ID NO: 37394 - protein, 434 aa, Rhizobium loti; identical to SEQ ID NO: 14164

SEQ ID NO: 37395 - DNA, 1305 bp, Rhizobium meliloti; identical to SEQ ID NO: 14165
  CDS (1)..(1305): transl_table=11

SEQ ID NO: 37396 - protein, 434 aa, Rhizobium meliloti; identical to SEQ ID NO: 14166

SEQ ID NO: 37397 - DNA, 1203 bp, Salmonella choleraesuis; identical to SEQ ID NO: 14167
  CDS (1)..(1203)

SEQ ID NO: 37398 - protein, 400 aa, Salmonella choleraesuis; identical to SEQ ID NO: 14168

SEQ ID NO: 37399 - DNA, 1203 bp, Salmonella paratyphi; identical to SEQ ID NO: 14169
  CDS (1)..(1203): transl_table=11

SEQ ID NO: 37400 - protein, 400 aa, Salmonella paratyphi; identical to SEQ ID NO: 14170

SEQ ID NO: 37401 - DNA, 1308 bp, Vibrio cholerae; identical to SEQ ID NO: 14171
  CDS (1)..(1308): transl_table=11

SEQ ID NO: 37402 - protein, 435 aa, Vibrio cholerae; identical to SEQ ID NO: 14172

SEQ ID NO: 37403 - DNA, 1311 bp, Vibrio parahaemolyticus; identical to SEQ ID NO: 14173
  CDS (1)..(1311): transl_table=11

SEQ ID NO: 37404 - protein, 436 aa, Vibrio parahaemolyticus; identical to SEQ ID NO: 14174

SEQ ID NO: 37405 - DNA, 1314 bp, Vibrio vulnificus; identical to SEQ ID NO: 14175
  CDS (1)..(1314): transl_table=11

SEQ ID NO: 37406 - protein, 437 aa, Vibrio vulnificus; identical to SEQ ID NO: 14176

SEQ ID NO: 37407 - DNA, 1314 bp, Vibrio vulnificus; identical to SEQ ID NO: 14177
  CDS (1)..(1314): transl_table=11

SEQ ID NO: 37408 - protein, 437 aa, Vibrio vulnificus; identical to SEQ ID NO: 14178

SEQ ID NO: 37409 - DNA, 1179 bp, Xanthomonas axonopodis; identical to SEQ ID NO: 14179
  CDS (1)..(1179): transl_table=11

SEQ ID NO: 37410 - protein, 392 aa, Xanthomonas axonopodis; identical to SEQ ID NO: 14180

SEQ ID NO: 37411 - DNA, 1197 bp, Xanthomonas campestris; identical to SEQ ID NO: 14181
  CDS (1)..(1197): transl_table=11

SEQ ID NO: 37412 - protein, 398 aa, Xanthomonas campestris; identical to SEQ ID NO: 14182

SEQ ID NO: 37413 - DNA, 1185 bp, Xylella fastidiosa; identical to SEQ ID NO: 14183
  CDS (1)..(1185): transl_table=11

SEQ ID NO: 37414 - protein, 394 aa, Xylella fastidiosa; identical to SEQ ID NO: 14184

SEQ ID NO: 37415 - DNA, 1185 bp, Xylella fastidiosa; identical to SEQ ID NO: 14185
  CDS (1)..(1185): transl_table=11

SEQ ID NO: 37416 - protein, 394 aa, Xylella fastidiosa; identical to SEQ ID NO: 14186

SEQ ID NO: 37417 - DNA, 24 bp, Artificial sequence
  (1)..(24): primer
atgacacaattcgcttctcctgtt

SEQ ID NO: 37418 - DNA, 26 bp, Artificial sequence
  (1)..(26): primer
ttaactggcttttttaatatgcggaa

SEQ ID NO: 37419 - protein, 581 aa, Artificial sequence; identical to SEQ ID NO: 14189
  Variant (3)..(3): xaa in position 3 is any amino acid
  Variant (20)..(22): xaa in position 20 to 22 is any amino acid
  Variant (23)..(24): xaa in position 23 to 24 is any or no amino acid
  Variant (27)..(29): xaa in position 27 to 29 is any amino acid
  Variant (31)..(31): xaa in position 31 is any amino acid
  Variant (33)..(33): xaa in position 33 is any amino acid
  Variant (35)..(36): xaa in position 35 to 36 is any amino acid
  Variant (38)..(42): xaa in position 38 to 42 is any amino acid
  Variant (43)..(53): xaa in position 43 to 53 is any or no amino acid
  Variant (56)..(57): xaa in position 56 to 57 is any amino acid
  Variant (60)..(60): xaa in position 60 is any amino acid
  Variant (62)..(63): xaa in position 62 to 63 is any amino acid
  Variant (68)..(68): xaa in position 68 is any amino acid
  Variant (72)..(72): xaa in position 72 is any amino acid
  Variant (75)..(76): xaa in position 75 to 76 is any amino acid
  Variant (78)..(78): xaa in position 78 is any amino acid
  Variant (80)..(88): xaa in position 80 to 88 is any or no amino acid
  Variant (95)..(96): xaa in position 95 to 96 is any amino acid
  Variant (100)..(103): xaa in position 100 to 103 is any amino acid
  Variant (105)..(105): xaa in position 105 is any amino acid
  Variant (107)..(109): xaa in position 107 to 109 is any amino acid
  Variant (110)..(126): xaa in position 110 to 126 is any or no amino acid
  Variant (128)..(128): xaa in position 128 is any or no amino acid
  Variant (130)..(130): xaa in position 130 is any or no amino acid
  Variant (132)..(132): xaa in position 132 is any or no amino acid
  Variant (134)..(134): xaa in position 134 is any or no amino acid
  Variant (136)..(137): xaa in position 136 to 137 is any amino acid
  Variant (138)..(138): xaa in position 138 is any or no amino acid
  Variant (153)..(154): xaa in position 153 to 154 is any amino acid
  Variant (156)..(156): xaa in position 156 is any amino acid
  Variant (158)..(161): xaa in position 158 to 161 is any amino acid
  Variant (162)..(162): xaa in position 162 is any or no amino acid
  Variant (164)..(172): xaa in position 164 to 172 is any amino acid
  Variant (174)..(176): xaa in position 174 to 176 is any amino acid
  Variant (178)..(183): xaa in position 178 to 183 is any amino acid
  Variant (184)..(198): xaa in position 184 to 198 is any or no amino acid
  Variant (208)..(208): xaa in position 208 is any amino acid
  Variant (210)..(212): xaa in position 210 to 212 is any amino acid
  Variant (214)..(215): xaa in position 214 to 215 is any amino acid
  Variant (218)..(218): xaa in position 218 is any amino acid
  Variant (221)..(222): xaa in position 221 to 222 is any amino acid
  Variant (224)..(224): xaa in position 224 is any amino acid
  Variant (225)..(236): xaa in position 225 to 236 is any or no amino acid
  Variant (238)..(238): xaa in position 238 is any or no amino acid
  Variant (244)..(245): xaa in position 244 to 245 is any amino acid
  Variant (250)..(250): xaa in position 250 is any amino acid
  Variant (252)..(252): xaa in position 252 is any amino acid
  Variant (263)..(263): xaa in position 263 is any amino acid
  Variant (265)..(266): xaa in position 265 to 266 is any amino acid
  Variant (269)..(270): xaa in position 269 to 270 is any amino acid
  Variant (271)..(288): xaa in position 271 to 288 is any or no amino acid
  Variant (290)..(291): xaa in position 290 to 291 is any amino acid
  Variant (294)..(295): xaa in position 294 to 295 is any amino acid
  Variant (298)..(299): xaa in position 298 to 299 is any amino acid
  Variant (302)..(303): xaa in position 302 to 303 is any amino acid
  Variant (305)..(305): xaa in position 305 is any amino acid
  Variant (306)..(316): xaa in position 306 to 316 is any or no amino acid
  Variant (318)..(318): xaa in position 318 is any amino acid
  Variant (326)..(329): xaa in position 326 to 329 is any amino acid
  Variant (334)..(334): xaa in position 334 is any amino acid
  Variant (337)..(337): xaa in position 337 is any amino acid
  Variant (338)..(391): xaa in position 338 to 391 is any or no amino acid
  Variant (394)..(394): xaa in position 394 is any amino acid
  Variant (397)..(397): xaa in position 397 is any amino acid
  Variant (401)..(401): xaa in position 401 is any amino acid
  Variant (407)..(408): xaa in position 407 to 408 is any amino acid
  Variant (416)..(416): xaa in position 416 is any amino acid
  Variant (418)..(418): xaa in position 418 is any amino acid
  Variant (419)..(427): xaa in position 419 to 427 is any or no amino acid
  Variant (430)..(430): xaa in position 430 is any amino acid
  Variant (433)..(442): xaa in position 433 to 442 is any or no amino acid
  Variant (453)..(453): xaa in position 453 is any amino acid
  Variant (455)..(455): xaa in position 455 is any amino acid
  Variant (457)..(457): xaa in position 457 is any amino acid
  Variant (459)..(459): xaa in position 459 is any amino acid
  Variant (461)..(466): xaa in position 461 to 466 is any amino acid
  Variant (468)..(474): xaa in position 468 to 474 is any or no amino acid
  Variant (484)..(484): xaa in position 484 is any amino acid
  Variant (489)..(491): xaa in position 489 to 491 is any amino acid
  Variant (492)..(531): xaa in position 492 to 531 is any or no amino acid
  Variant (541)..(542): xaa in position 541 to 542 is any amino acid
  Variant (545)..(545): xaa in position 545 is any amino acid
  Variant (553)..(553): xaa in position 553 is any amino acid
  Variant (557)..(557): xaa in position 557 is any amino acid
  Variant (559)..(560): xaa in position 559 to 560 is any amino acid
  Variant (561)..(575): xaa in position 561 to 575 is any or no amino acid
  Variant (578)..(579): xaa in position 578 to 579 is any amino acid

SEQ ID NO: 37420 - protein, 10 aa, Artificial sequence
  Variant (2)..(2): xaa in position 2 is any amino acid
  Variant (3)..(3): xaa in position 3 is Asn or Thr
  Variant (5)..(5): xaa in position 5 is any amino acid
  Variant (7)..(7): xaa in position 7 is any amino acid
  Variant (8)..(8): xaa in position 8 is Phe, Ile, Leu or Val
  Variant (9)..(9): xaa in position 9 is any amino acid
LXXDXYXXXM

SEQ ID NO: 37421 - protein, 25 aa, Artificial sequence
  Variant (2)..(4): xaa in position 2 to 4 is any or no amino acid
  Variant (8)..(10): xaa in position 8 to 10 is any amino acid
  Variant (11)..(11): xaa in position 11 is Ala or Gly
  Variant (12)..(14): xaa in position 12 to 14 is any amino acid
  Variant (15)..(15): xaa in position 15 is Ala, Asp, Glu, Gly, Asn, Gln or Ser
  Variant (16)..(19): xaa in position 16 to 19 is any amino acid
  Variant (22)..(22): xaa in position 22 is any amino acid
  Variant (25)..(25): xaa in position 25 is Ala, Glu, Gln or Ser
GXXXTSNXXXXXXXXXXXXGTXAHX

SEQ ID NO: 37422 - DNA, 1242 bp, Escherichia coli K12; identical to SEQ ID NO: 19626
  CDS (1)..(1242): transl_table=11

SEQ ID NO: 37423 - protein, 413 aa, Escherichia coli K12; identical to SEQ ID NO: 19627

SEQ ID NO: 37424 - DNA, 1212 bp, Caenorhabditis elegans; identical to SEQ ID NO: 19628
  CDS (1)..(1212)

SEQ ID NO: 37425 - protein, 403 aa, Caenorhabditis elegans; identical to SEQ ID NO: 19629

SEQ ID NO: 37426 - DNA, 1329 bp, Saccharomyces cerevisiae; identical to SEQ ID NO: 19630
  CDS (1)..(1329)

SEQ ID NO: 37427 - protein, 442 aa, Saccharomyces cerevisiae; identical to SEQ ID NO: 19631

SEQ ID NO: 37428 - DNA, 1380 bp, Homo sapiens; identical to SEQ ID NO: 19632
  CDS (1)..(1380)

SEQ ID NO: 37429 - protein, 459 aa, Homo sapiens; identical to SEQ ID NO: 19633

SEQ ID NO: 37430 - DNA, 1380 bp, Mus musculus; identical to SEQ ID NO: 19634
  CDS (1)..(1380)

SEQ ID NO: 37431 - protein, 459 aa, Mus musculus [sequence omitted]

SEQ ID NO: 37432 - DNA, 1302 bp, Mesorhizobium loti MAFF303099; identical to SEQ ID NO: 19636
  CDS (1)..(1302): transl_table=11

SEQ ID NO: 37433 - protein, 433 aa, Mesorhizobium loti MAFF303099; identical to SEQ ID NO: 19637

SEQ ID NO: 37434 - DNA, 1263 bp, Mesorhizobium loti MAFF303099; identical to SEQ ID NO: 19638
  CDS (1)..(1263): transl_table=11

SEQ ID NO: 37435 - protein, 420 aa, Mesorhizobium loti MAFF303099; identical to SEQ ID NO: 19639

SEQ ID NO: 37436 - DNA, 1245 bp, Clostridium acetobutylicum ATCC 824; identical to SEQ ID NO: 19640
  CDS (1)..(1245): transl_table=11

SEQ ID NO: 37437 - protein, 414 aa, Clostridium acetobutylicum ATCC 824; identical to SEQ ID NO: 19641

SEQ ID NO: 37438 - DNA, 1239 bp, Helicobacter pylori 26695; identical to SEQ ID NO: 19642
  CDS (1)..(1239): transl_table=11

SEQ ID NO: 37439 - protein, 412 aa, Helicobacter pylori 26695; identical to SEQ ID NO: 19643

SEQ ID NO: 37440 - DNA, 1248 bp, Aquifex aeolicus VF5; identical to SEQ ID NO: 19644
  CDS (1)..(1248): transl_table=11

SEQ ID NO: 37441 - protein, 415 aa, Aquifex aeolicus VF5; identical to SEQ ID NO: 19645

SEQ ID NO: 37442 - DNA, 1257 bp, Chlamydia trachomatis D/UW-3/CX; identical to SEQ ID NO: 19646
  CDS (1)..(1257): transl_table=11

SEQ ID NO: 37443 - protein, 418 aa, Chlamydia trachomatis D/UW-3/CX; identical to SEQ ID NO: 19647

SEQ ID NO: 37444 - DNA, 1281 bp, Rickettsia prowazekii str. Madrid E; identical to SEQ ID NO: 19648
  CDS (1)..(1281): transl_table=11

SEQ ID NO: 37445 - protein, 426 aa, Rickettsia prowazekii str. Madrid E; identical to SEQ ID NO: 19649

SEQ ID NO: 37446 - DNA, 1239 bp, Helicobacter pylori J99; identical to SEQ ID NO: 19650
  CDS (1)..(1239): transl_table=11

SEQ ID NO: 37447 - protein, 412 aa, Helicobacter pylori J99; identical to SEQ ID NO: 19651

SEQ ID NO: 37448 - DNA, 1239 bp, Thermotoga maritima MSB8; identical to SEQ ID NO: 19652
  CDS (1)..(1239): transl_table=11

SEQ ID NO: 37449 - protein, 412 aa, Thermotoga maritima MSB8; identical to SEQ ID NO: 19653

SEQ ID NO: 37450 - DNA, 1245 bp, Vibrio cholerae O1 biovar eltor str. N16961; identical to SEQ ID NO: 19654
  CDS (1)..(1245): transl_table=11

SEQ ID NO: 37451 - protein, 414 aa, Vibrio cholerae O1 biovar eltor str. N16961; identical to SEQ ID NO: 19655

SEQ ID NO: 37452 - DNA, 1236 bp, Bacillus halodurans C-125; identical to SEQ ID NO: 19656
  CDS (1)..(1236): transl_table=11

SEQ ID NO: 37453 - protein, 411 aa, Bacillus halodurans C-125; identical to SEQ ID NO: 19657

SEQ ID NO: 37454 - DNA, 1221 bp, Pasteurella multocida subsp. multocida str. Pm70; identical to SEQ ID NO: 19658
  CDS (1)..(1221): transl_table=11

SEQ ID NO: 37455 - protein, 406 aa, Pasteurella multocida subsp. multocida str. Pm70; identical to SEQ ID NO: 19659

SEQ ID NO: 37456 - DNA, 1269 bp, Pseudomonas aeruginosa PAO1; identical to SEQ ID NO: 19660
  CDS (1)..(1269): transl_table=11

SEQ ID NO: 37457 - protein, 422 aa, Pseudomonas aeruginosa PAO1; identical to SEQ ID NO: 19661

SEQ ID NO: 37458 - DNA, 1245 bp, Pseudomonas aeruginosa PAO1; identical to SEQ ID NO: 19662
  CDS (1)..(1245): transl_table=11

SEQ ID NO: 37459 - protein, 414 aa, Pseudomonas aeruginosa PAO1; identical to SEQ ID NO: 19663

SEQ ID NO: 37460 - DNA, 1230 bp, Lactococcus lactis subsp. lactis Il1403; identical to SEQ ID NO: 19664
  CDS (1)..(1230): transl_table=11

SEQ ID NO: 37461 - protein, 409 aa, Lactococcus lactis subsp. lactis Il1403; identical to SEQ ID NO: 19665

SEQ ID NO: 37462 - DNA, 1248 bp, Neisseria meningitidis MC58; identical to SEQ ID NO: 19666
  CDS (1)..(1248): transl_table=11

SEQ ID NO: 37463 - protein, 415 aa, Neisseria meningitidis MC58; identical to SEQ ID NO: 19667

SEQ ID NO: 37464 - DNA, 1215 bp, Campylobacter jejuni subsp. jejuni NCTC 11168; identical to SEQ ID NO: 19668
  CDS (1)..(1215): transl_table=11

SEQ ID NO: 37465 - protein, 404 aa, Campylobacter jejuni subsp. jejuni NCTC 11168; identical to SEQ ID NO: 19669

SEQ ID NO: 37466 - DNA, 1248 bp, Neisseria meningitidis Z2491; identical to SEQ ID NO: 19670
  CDS (1)..(1248): transl_table=11

SEQ ID NO: 37467 - protein, 415 aa, Neisseria meningitidis Z2491; identical to SEQ ID NO: 19671

SEQ ID NO: 37468 - DNA, 1287 bp, Deinococcus radiodurans R1; identical to SEQ ID NO: 19672
  CDS (1)..(1287): transl_table=11

SEQ ID NO: 37469 - protein, 428 aa, Deinococcus radiodurans R1; identical to SEQ ID NO: 19673

SEQ ID NO: 37470 - DNA, 1257 bp, Chlamydia muridarum Nigg; identical to SEQ ID NO: 19674
  CDS (1)..(1257): transl_table=11

SEQ ID NO: 37471 - protein, 418 aa, Chlamydia muridarum Nigg; identical to SEQ ID NO: 19675

SEQ ID NO: 37472 - DNA, 1236 bp, Xylella fastidiosa 9a5c; identical to SEQ ID NO: 19676
  CDS (1)..(1236): transl_table=11

SEQ ID NO: 37473 - protein, 411 aa, Xylella fastidiosa 9a5c; identical to SEQ ID NO: 19677

SEQ ID NO: 37474 - DNA, 1236 bp, Streptococcus pneumoniae TIGR4; identical to SEQ ID NO: 19678
  CDS (1)..(1236): transl_table=11

SEQ ID NO: 37475 - protein, 411 aa, Streptococcus pneumoniae TIGR4; identical to SEQ ID NO: 19679

SEQ ID NO: 37476 - DNA, 1236 bp, Clostridium acetobutylicum ATCC 824; identical to SEQ ID NO: 19680
  CDS (1)..(1236): transl_table=11

SEQ ID NO: 37477 - protein, 411 aa, Clostridium acetobutylicum ATCC 824; identical to SEQ ID NO: 19681

SEQ ID NO: 37478 - DNA, 1329 bp, Agrobacterium tumefaciens str. C58; identical to SEQ ID NO: 19682
  CDS (1)..(1329): transl_table=11

SEQ ID NO: 37479 - protein, 442 aa, Agrobacterium tumefaciens str. C58; identical to SEQ ID NO: 19683

SEQ ID NO: 37480 - DNA, 1383 bp, Agrobacterium tumefaciens str. C58; identical to SEQ ID NO: 19684
  CDS (1)..(1383): transl_table=11

SEQ ID NO: 37481 - protein, 460 aa, Agrobacterium tumefaciens str. C58; identical to SEQ ID NO: 19685

SEQ ID NO: 37482 - DNA, 1245 bp, Streptococcus pneumoniae R6; identical to SEQ ID NO: 19686
  CDS (1)..(1245): transl_table=11

SEQ ID NO: 37483 - protein, 414 aa, Streptococcus pneumoniae R6; identical to SEQ ID NO: 19687

SEQ ID NO: 37484 - DNA, 1287 bp, Rickettsia conorii str. Malish 7; identical to SEQ ID NO: 19688
  CDS (1)..(1287): transl_table=11

SEQ ID NO: 37485 - protein, 428 aa, Rickettsia conorii str. Malish 7; identical to SEQ ID NO: 19689

SEQ ID NO: 37486 - DNA, 1245 bp, Staphylococcus aureus subsp. aureus Mu50; identical to SEQ ID NO: 19690
  CDS (1)..(1245): transl_table=11

SEQ ID NO: 37487 - protein, 414 aa, Staphylococcus aureus subsp. aureus Mu50; identical to SEQ ID NO: 19691

SEQ ID NO: 37488 - DNA, 1242 bp, Bacillus subtilis subsp. subtilis str. 168; identical to SEQ ID NO: 19692
  CDS (1)..(1242): transl_table=11

SEQ ID NO: 37489 - protein, 413 aa, Bacillus subtilis subsp. subtilis str. 168; identical to SEQ ID NO: 19693

SEQ ID NO: 37490 - DNA, 1281 bp, Caulobacter crescentus CB15; identical to SEQ ID NO: 19694
  CDS (1)..(1281): transl_table=11

SEQ ID NO: 37491 - protein, 426 aa, Caulobacter crescentus CB15; identical to SEQ ID NO: 19695

SEQ ID NO: 37492 - DNA, 1251 bp, Chlamydophila pneumoniae AR39; identical to SEQ ID NO: 19696
  CDS (1)..(1251): transl_table=11

SEQ ID NO: 37493 - protein, 416 aa, Chlamydophila pneumoniae AR39; identical to SEQ ID NO: 19697

SEQ ID NO: 37494 - DNA, 1242 bp, Listeria monocytogenes EGD-e; identical to SEQ ID NO: 19698
  CDS (1)..(1242): transl_table=11

SEQ ID NO: 37495 - protein, 413 aa, Listeria monocytogenes EGD-e; identical to SEQ ID NO: 19699

SEQ ID NO: 37496 - DNA, 1242 bp, Listeria innocua Clip11262; identical to SEQ ID NO: 19700
  CDS (1)..(1242): transl_table=11

SEQ ID NO: 37497 - protein, 413 aa, Listeria innocua Clip11262; identical to SEQ ID NO: 19701

SEQ ID NO: 37498 - DNA, 1251 bp, Nostoc sp. PCC 7120; identical to SEQ ID NO: 19702
  CDS (1)..(1251): transl_table=11

SEQ ID NO: 37499 - protein, 416 aa, Nostoc sp. PCC 7120; identical to SEQ ID NO: 19703

SEQ ID NO: 37500 - DNA, 1233 bp, Ralstonia solanacearum GMI1000; identical to SEQ ID NO: 19704
  CDS (1)..(1233): transl_table=11

SEQ ID NO: 37501 - protein, 410 aa, Ralstonia solanacearum GMI1000; identical to SEQ ID NO: 19705

SEQ ID NO: 37502 - DNA, 1263 bp, Agrobacterium tumefaciens str. C58; identical to SEQ ID NO: 19706
  CDS (1)..(1263): transl_table=11

SEQ ID NO: 37503 - protein, 420 aa, Agrobacterium tumefaciens str. C58; identical to SEQ ID NO: 19707

SEQ ID NO: 37504 - DNA, 1299 bp, Agrobacterium tumefaciens str. C58; identical to SEQ ID NO: 19708
  CDS (1)..(1299): transl_table=11

SEQ ID NO: 37505 - protein, 432 aa, Agrobacterium tumefaciens str. C58; identical to SEQ ID NO: 19709

SEQ ID NO: 37506 - DNA, 1242 bp, Clostridium perfringens str. 13; identical to SEQ ID NO: 19710
  CDS (1)..(1242): transl_table=11

SEQ ID NO: 37507 - protein, 413 aa, Clostridium perfringens str. 13; identical to SEQ ID NO: 19711

SEQ ID NO: 37508 - DNA, 1281 bp, Schizosaccharomyces pombe 972h-; identical to SEQ ID NO: 19712
  CDS (1)..(1281)

SEQ ID NO: 37509 - protein, 426 aa, Schizosaccharomyces pombe 972h-; identical to SEQ ID NO: 19713

SEQ ID NO: 37510 - DNA, 1242 bp, Fusobacterium nucleatum subsp. nucleatum ATCC 25586; identical to SEQ ID NO: 19714
  CDS (1)..(1242): transl_table=11

SEQ ID NO: 37511 - protein, 413 aa, Fusobacterium nucleatum subsp. nucleatum ATCC 25586; identical to SEQ ID NO: 19715

SEQ ID NO: 37512 - DNA, 1230 bp, Thermoanaerobacter tengcongensis MB4; identical to SEQ ID NO: 19716
  CDS (1)..(1230): transl_table=11

SEQ ID NO: 37513 - protein, 409 aa, Thermoanaerobacter tengcongensis MB4; identical to SEQ ID NO: 19717

SEQ ID NO: 37514 - DNA, 1287 bp, Streptomyces coelicolor A3(2); identical to SEQ ID NO: 19718
  CDS (1)..(1287): transl_table=11

SEQ ID NO: 37515 - protein, 428 aa, Streptomyces coelicolor A3(2); identical to SEQ ID NO: 19719

SEQ ID NO: 37516 - DNA, 1269 bp, Streptomyces coelicolor A3(2); identical to SEQ ID NO: 19720
  CDS (1)..(1269): transl_table=11

SEQ ID NO: 37517 - protein, 422 aa, Streptomyces coelicolor A3(2); identical to SEQ ID NO: 19721

SEQ ID NO: 37518 - DNA, 1290 bp, Streptomyces coelicolor A3(2); identical to SEQ ID NO: 19722
  CDS (1)..(1290): transl_table=11

SEQ ID NO: 37519 - protein, 429 aa, Streptomyces coelicolor A3(2); identical to SEQ ID NO: 19723

SEQ ID NO: 37520 - DNA, 1224 bp, Streptomyces coelicolor A3(2); identical to SEQ ID NO: 19724
  CDS (1)..(1224): transl_table=11

SEQ ID NO: 37521 - protein, 407 aa, Streptomyces coelicolor A3(2); identical to SEQ ID NO: 19725

SEQ ID NO: 37522 - DNA, 1236 bp, Xanthomonas axonopodis pv. citri str. 306; identical to SEQ ID NO: 19726
  CDS (1)..(1236): transl_table=11

SEQ ID NO: 37523 - protein, 411 aa, Xanthomonas axonopodis pv. citri str. 306; identical to SEQ ID NO: 19727

SEQ ID NO: 37524 - DNA, 1317 bp, Drosophila melanogaster; identical to SEQ ID NO: 19728
  CDS (1)..(1317)

SEQ ID NO: 37525 - protein, 438 aa, Drosophila melanogaster; identical to SEQ ID NO: 19729

SEQ ID NO: 37526 - DNA, 1242 bp, Chlorobium tepidum TLS; identical to SEQ ID NO: 19730
  CDS (1)..(1242): transl_table=11

SEQ ID NO: 37527 - protein, 413 aa, Chlorobium tepidum TLS; identical to SEQ ID NO: 19731

SEQ ID NO: 37528 - DNA, 1029 bp, Yersinia pestis KIM; identical to SEQ ID NO: 19732
  CDS (1)..(1029): transl_table=11

SEQ ID NO: 37529 - protein, 342 aa, Yersinia pestis KIM; identical to SEQ ID NO: 19733

SEQ ID NO: 37530 - DNA, 1263 bp, Thermosynechococcus elongatus BP-1; identical to SEQ ID NO: 19734
  CDS (1)..(1263): transl_table=11

SEQ ID NO: 37531 - protein, 420 aa, Thermosynechococcus elongatus BP-1; identical to SEQ ID NO: 19735

SEQ ID NO: 37532 - DNA, 1233 bp, Streptococcus agalactiae 2603V/R; identical to SEQ ID NO: 19736
  CDS (1)..(1233): transl_table=11

SEQ ID NO: 37533 - protein, 410 aa, Streptococcus agalactiae 2603V/R; identical to SEQ ID NO: 19737

SEQ ID NO: 37534 - DNA, 1239 bp, Oceanobacillus iheyensis HTE831; identical to SEQ ID NO: 19738
  CDS (1)..(1239): transl_table=11

SEQ ID NO: 37535 - protein, 412 aa, Oceanobacillus iheyensis HTE831; identical to SEQ ID NO: 19739

SEQ ID NO: 37536 - DNA, 1263 bp, Brucella suis 1330; identical to SEQ ID NO: 19740
  CDS (1)..(1263): transl_table=11

SEQ ID NO: 37537 - protein, 420 aa, Brucella suis 1330; identical to SEQ ID NO: 19741

SEQ ID NO: 37538 - DNA, 1425 bp, Plasmodium falciparum 3D7; identical to SEQ ID NO: 19742
  CDS (1)..(1425)

SEQ ID NO: 37539 - protein, 474 aa, Plasmodium falciparum 3D7; identical to SEQ ID NO: 19743

SEQ ID NO: 37540 - DNA, 1239 bp, Shewanella oneidensis MR-1; identical to SEQ ID NO: 19744
  CDS (1)..(1239): transl_table=11

SEQ ID NO: 37541 - protein, 412 aa, Shewanella oneidensis MR-1; identical to SEQ ID NO: 19745

SEQ ID NO: 37542 - DNA, 1233 bp, Streptococcus mutans UA159; identical to SEQ ID NO: 19746
  CDS (1)..(1233): transl_table=11

SEQ ID NO: 37543 - protein, 410 aa, Streptococcus mutans UA159; identical to SEQ ID NO: 19747

SEQ ID NO: 37544 - DNA, 1245 bp, Pseudomonas putida KT2440; identical to SEQ ID NO: 19748
  CDS (1)..(1245): transl_table=11

SEQ ID NO: 37545 - protein, 414 aa, Pseudomonas putida KT2440; identical to SEQ ID NO: 19749

SEQ ID NO: 37546 - DNA, 1314 bp, Pseudomonas putida KT2440; identical to SEQ ID NO: 19750
  CDS (1)..(1314): transl_table=11

SEQ ID NO: 37547 - protein, 437 aa, Pseudomonas putida KT2440; identical to SEQ ID NO: 19751

SEQ ID NO: 37548 - DNA, 1263 bp, Vibrio vulnificus CMCP6; identical to SEQ ID NO: 19752
  CDS (1)..(1263): transl_table=11

SEQ ID NO: 37549 - protein, 420 aa, Vibrio vulnificus CMCP6; identical to SEQ ID NO: 19753

SEQ ID NO: 37550 - DNA, 1263 bp, Bradyrhizobium japonicum USDA 110; identical to SEQ ID NO: 19754
  CDS (1)..(1263): transl_table=11

SEQ ID NO: 37551 - protein, 420 aa, Bradyrhizobium japonicum USDA 110; identical to SEQ ID NO: 19755

SEQ ID NO: 37552 - DNA, 1266 bp, Bradyrhizobium japonicum USDA 110; identical to SEQ ID NO: 19756
  CDS (1)..(1266): transl_table=11

SEQ ID NO: 37553 - protein, 421 aa, Bradyrhizobium japonicum USDA 110; identical to SEQ ID NO: 19757

SEQ ID NO: 37554 - DNA, 1236 bp, Xylella fastidiosa Temecula1; identical to SEQ ID NO: 19758
  CDS (1)..(1236): transl_table=11

SEQ ID NO: 37555 - protein, 411 aa, Xylella fastidiosa Temecula1; identical to SEQ ID NO: 19759

SEQ ID NO: 37556 - DNA, 1245 bp, Clostridium tetani E88; identical to SEQ ID NO: 19760
  CDS (1)..(1245): transl_table=11

SEQ ID NO: 37557 - protein, 414 aa, Clostridium tetani E88; identical to SEQ ID NO: 19761

SEQ ID NO: 37558 - DNA, 1233 bp, Lactobacillus plantarum WCFS1; identical to SEQ ID NO: 19762
  CDS (1)..(1233): transl_table=11

SEQ ID NO: 37559 - protein, 410 aa, Lactobacillus plantarum WCFS1; identical to SEQ ID NO: 19763

SEQ ID NO: 37560 - DNA, 1245 bp, Pseudomonas syringae pv. tomato str. DC3000; identical to SEQ ID NO: 19764
  CDS (1)..(1245): transl_table=11

SEQ ID NO: 37561 - protein, 414 aa, Pseudomonas syringae pv. tomato str. DC3000; identical to SEQ ID NO: 19765

SEQ ID NO: 37562 - DNA, 1251 bp, Vibrio parahaemolyticus RIMD 2210633; identical to SEQ ID NO: 19766
  CDS (1)..(1251): transl_table=11

SEQ ID NO: 37563 - protein, 416 aa, Vibrio parahaemolyticus RIMD 2210633; identical to SEQ ID NO: 19767

SEQ ID NO: 37564 - DNA, 1212 bp, Vibrio parahaemolyticus RIMD 2210633; identical to SEQ ID NO: 19768
  CDS (1)..(1212): transl_table=11

SEQ ID NO: 37565 - protein, 403 aa, Vibrio parahaemolyticus RIMD 2210633; identical to SEQ ID NO: 19769

SEQ ID NO: 37566 - DNA, 1233 bp, Streptococcus pyogenes SSI-1; identical to SEQ ID NO: 19770
  CDS (1)..(1233): transl_table=11

SEQ ID NO: 37567 - protein, 410 aa, Streptococcus pyogenes SSI-1; identical to SEQ ID NO: 19771

SEQ ID NO: 37568 - DNA, 1242 bp, Salmonella enterica subsp. enterica serovar Typhi Ty2; identical to SEQ ID NO: 19772
  CDS (1)..(1242): transl_table=11

SEQ ID NO: 37569 - protein, 413 aa, Salmonella enterica subsp. enterica serovar Typhi Ty2; identical to SEQ ID NO: 19773

SEQ ID NO: 37570 - DNA, 1263 bp, Bacteroides thetaiotaomicron VPI-5482; identical to SEQ ID NO: 19774
  CDS (1)..(1263): transl_table=11

SEQ ID NO: 37571 - protein, 420 aa, Bacteroides thetaiotaomicron VPI-5482; identical to SEQ ID NO: 19775

SEQ ID NO: 37572 - DNA, 1239 bp, Enterococcus faecalis V583; identical to SEQ ID NO: 19776
  CDS (1)..(1239): transl_table=11

SEQ ID NO: 37573 - protein, 412 aa, Enterococcus faecalis V583; identical to SEQ ID NO: 19777

SEQ ID NO: 37574 - DNA, 1236 bp, Enterococcus faecalis V583; identical to SEQ ID NO: 19778
  CDS (1)..(1236): transl_table=11

SEQ ID NO: 37575 - protein, 411 aa, Enterococcus faecalis V583; identical to SEQ ID NO: 19779

SEQ ID NO: 37576 - DNA, 1245 bp, Coxiella burnetii RSA 493; identical to SEQ ID NO: 19780
  CDS (1)..(1245): transl_table=11

SEQ ID NO: 37577 - protein, 414 aa, Coxiella burnetii RSA 493; identical to SEQ ID NO: 19781

SEQ ID NO: 37578 - DNA, 1221 bp, Streptomyces avermitilis MA-4680; identical to SEQ ID NO: 19782
  CDS (1)..(1221): transl_table=11

SEQ ID NO: 37579 - protein, 406 aa, Streptomyces avermitilis MA-4680; identical to SEQ ID NO: 19783

SEQ ID NO: 37580 - DNA, 1251 bp, Streptomyces avermitilis MA-4680; identical to SEQ ID NO: 19784
  CDS (1)..(1251): transl_table=11

SEQ ID NO: 37581 - protein, 416 aa, Streptomyces avermitilis MA-4680; identical to SEQ ID NO: 19785

SEQ ID NO: 37582 - DNA, 1272 bp, Streptomyces avermitilis MA-4680; identical to SEQ ID NO: 19786
  CDS (1)..(1272): transl_table=11

SEQ ID NO: 37583 - protein, 423 aa, Streptomyces avermitilis MA-4680; identical to SEQ ID NO: 19787

SEQ ID NO: 37584 - DNA, 1251 bp, Chlamydophila caviae GPIC; identical to SEQ ID NO: 19788
  CDS (1)..(1251): transl_table=11

SEQ ID NO: 37585 - protein, 416 aa, Chlamydophila caviae GPIC; identical to SEQ ID NO: 19789

SEQ ID NO: 37586 - DNA, 1239 bp, Bacillus cereus ATCC 14579; identical to SEQ ID NO: 19790
  CDS (1)..(1239): transl_table=11

SEQ ID NO: 37587 - protein, 412 aa, Bacillus cereus ATCC 14579; identical to SEQ ID NO: 19791

SEQ ID NO: 37588 - DNA, 1242 bp, Nitrosomonas europaea ATCC 19718; identical to SEQ ID NO: 19792
  CDS (1)..(1242): transl_table=11

SEQ ID NO: 37589 - protein, 413 aa, Nitrosomonas europaea ATCC 19718; identical to SEQ ID NO: 19793

SEQ ID NO: 37590 - DNA, 1626 bp, Arabidopsis thaliana; identical to SEQ ID NO: 19794
  CDS (1)..(1626)

SEQ ID NO: 37591 - protein, 541 aa, Arabidopsis thaliana; identical to SEQ ID NO: 19795

SEQ ID NO: 37592 - DNA, 1266 bp, Streptomyces rochei; identical to SEQ ID NO: 19796
  CDS (1)..(1266): transl_table=11

SEQ ID NO: 37593 - protein, 421 aa, Streptomyces rochei; identical to SEQ ID NO: 19797

SEQ ID NO: 37594 - DNA, 1236 bp, Helicobacter hepaticus ATCC 51449; identical to SEQ ID NO: 19798
  CDS (1)..(1236): transl_table=11

SEQ ID NO: 37595 - protein, 411 aa, Helicobacter hepaticus ATCC 51449; identical to SEQ ID NO: 19799

SEQ ID NO: 37596 - DNA, 1290 bp, Rhodopirellula baltica SH 1; identical to SEQ ID NO: 19800
  CDS (1)..(1290): transl_table=11

SEQ ID NO: 37597 - protein, 429 aa, Rhodopirellula baltica SH 1; identical to SEQ ID NO: 19801

SEQ ID NO: 37598 - DNA, 1290 bp, Rhodopirellula baltica SH 1; identical to SEQ ID NO: 19802
  CDS (1)..(1290): transl_table=11

SEQ ID NO: 37599 - protein, 429 aa, Rhodopirellula baltica SH 1; identical to SEQ ID NO: 19803

SEQ ID NO: 37600 - DNA, 1248 bp, Prochlorococcus marinus subsp. marinus str. CCMP1375; identical to SEQ ID NO: 19804
  CDS (1)..(1248): transl_table=11

SEQ ID NO: 37601 - protein, 415 aa, Prochlorococcus marinus subsp. marinus str. CCMP1375; identical to SEQ ID NO: 19805

SEQ ID NO: 37602 - DNA, 1230 bp, Bordetella bronchiseptica RB50; identical to SEQ ID NO: 19806
  CDS (1)..(1230): transl_table=11

SEQ ID NO: 37603 - protein, 409 aa, Bordetella bronchiseptica RB50; identical to SEQ ID NO: 19807

SEQ ID NO: 37604 - DNA, 1245 bp, Prochlorococcus marinus subsp. pastoris str. CCMP1986; identical to SEQ ID NO: 19808
  CDS (1)..(1245): transl_table=11

SEQ ID NO: 37605 - protein, 414 aa, Prochlorococcus marinus subsp. pastoris str. CCMP1986; identical to SEQ ID NO: 19809

SEQ ID NO: 37606 - DNA, 1248 bp, Prochlorococcus marinus str. MIT 9313; identical to SEQ ID NO: 19810
  CDS (1)..(1248): transl_table=11

SEQ ID NO: 37607 - protein, 415 aa, Prochlorococcus marinus str. MIT 9313; identical to SEQ ID NO: 19811

SEQ ID NO: 37608 - DNA, 1248 bp, Synechococcus sp. WH 8102; identical to SEQ ID NO: 19812
  CDS (1)..(1248): transl_table=11

SEQ ID NO: 37609 - protein, 415 aa, Synechococcus sp. WH 8102; identical to SEQ ID NO: 19813

SEQ ID NO: 37610 - DNA, 1242 bp, Chromobacterium violaceum ATCC 12472; identical to SEQ ID NO: 19814
  CDS (1)..(1242): transl_table=11

SEQ ID NO: 37611 - protein, 413 aa, Chromobacterium violaceum ATCC 12472; identical to SEQ ID NO: 19815

SEQ ID NO: 37612 - DNA, 1257 bp, Porphyromonas gingivalis W83; identical to SEQ ID NO: 19816
  CDS (1)..(1257): transl_table=11

SEQ ID NO: 37613 - protein, 418 aa, Porphyromonas gingivalis W83; identical to SEQ ID NO: 19817

SEQ ID NO: 37614 - DNA, 1242 bp, Wolinella succinogenes DSM 1740; identical to SEQ ID NO: 19818
  CDS (1)..(1242): transl_table=11

SEQ ID NO: 37615 - protein, 413 aa, Wolinella succinogenes DSM 1740; identical to SEQ ID NO: 19819

SEQ ID NO: 37616 - DNA, 1272 bp, Gloeobacter violaceus PCC 7421; identical to SEQ ID NO: 19820
  CDS (1)..(1272): transl_table=11

SEQ ID NO: 37617 - protein, 423 aa, Gloeobacter violaceus PCC 7421; identical to SEQ ID NO: 19821

SEQ ID NO: 37618 - DNA, 1248 bp, Gloeobacter violaceus PCC 7421; identical to SEQ ID NO: 19822
  CDS (1)..(1248): transl_table=11

SEQ ID NO: 37619 - protein, 415 aa, Gloeobacter violaceus PCC 7421; identical to SEQ ID NO: 19823

SEQ ID NO: 37620 - DNA, 1251 bp, Photorhabdus luminescens subsp. laumondii TTO1; identical to SEQ ID NO: 19824
  CDS (1)..(1251): transl_table=11

SEQ ID NO: 37621 - protein, 416 aa, Photorhabdus luminescens subsp. laumondii TTO1; identical to SEQ ID NO: 19825

SEQ ID NO: 37622 - DNA, 1242 bp, Vibrio vulnificus YJ016; identical to SEQ ID NO: 19826
  CDS (1)..(1242): transl_table=11

SEQ ID NO: 37623 - protein, 413 aa, Vibrio vulnificus YJ016; identical to SEQ ID NO: 19827

SEQ ID NO: 37624 - DNA, 1266 bp, Rhodopseudomonas palustris CGA009; identical to SEQ ID NO: 19828
  CDS (1)..(1266): transl_table=11

SEQ ID NO: 37625 - protein, 421 aa, Rhodopseudomonas palustris CGA009; identical to SEQ ID NO: 19829

SEQ ID NO: 37626 - DNA, 1233 bp, Geobacter sulfurreducens PCA; identical to SEQ ID NO: 19830
  CDS (1)..(1233): transl_table=11

SEQ ID NO: 37627 - protein, 410 aa, Geobacter sulfurreducens PCA; identical to SEQ ID NO: 19831

SEQ ID NO: 37628 - DNA, 1251 bp, Mycobacterium avium subsp. paratuberculosis K-10; identical to SEQ ID NO: 19832
  CDS (1)..(1251): transl_table=11

SEQ ID NO: 37629 - protein, 416 aa, Mycobacterium avium subsp. paratuberculosis K-10; identical to SEQ ID NO: 19833

SEQ ID NO: 37630 - DNA, 1272 bp, Wolbachia endosymbiont of Drosophila melanogaster; identical to SEQ ID NO: 19834
  CDS (1)..(1272): transl_table=11

SEQ ID NO: 37631 - protein, 423 aa, Wolbachia endosymbiont of Drosophila melanogaster; identical to SEQ ID NO: 19835

SEQ ID NO: 37632 - DNA, 1272 bp, Bdellovibrio bacteriovorus HD100; identical to SEQ ID NO: 19836
  CDS (1)..(1272): transl_table=11

SEQ ID NO: 37633 - protein, 423 aa, Bdellovibrio bacteriovorus HD100; identical to SEQ ID NO: 19837

SEQ ID NO: 37634 - DNA, 1236 bp, Treponema denticola ATCC 35405; identical to SEQ ID NO: 19838
  CDS (1)..(1236): transl_table=11

SEQ ID NO: 37635 - protein, 411 aa, Treponema denticola ATCC 35405; identical to SEQ ID NO: 19839

SEQ ID NO: 37636 - DNA, 1239 bp, Bacillus cereus ATCC 10987; identical to SEQ ID NO: 19840
  CDS (1)..(1239): transl_table=11

SEQ ID NO: 37637 - protein, 412 aa, Bacillus cereus ATCC 10987; identical to SEQ ID NO: 19841

SEQ ID NO: 37638 - DNA, 1302 bp, Eremothecium gossypii; identical to SEQ ID NO: 19842
  CDS (1)..(1302)

SEQ ID NO: 37639 - protein, 433 aa, Eremothecium gossypii; identical to SEQ ID NO: 19843

SEQ ID NO: 37640 - DNA, 1335 bp, Anopheles gambiae str. PEST; identical to SEQ ID NO: 19844
  CDS (1)..(1335)

SEQ ID NO: 37641 - protein, 444 aa, Anopheles gambiae str. PEST; identical to SEQ ID NO: 19845

SEQ ID NO: 37642 - DNA, 1524 bp, Oryza sativa (japonica cultivar-group); identical to SEQ ID NO: 19846
  CDS (1)..(1524)

SEQ ID NO: 37643 - protein, 507 aa, Oryza sativa (japonica cultivar-group); identical to SEQ ID NO: 19847

SEQ ID NO: 37644 - DNA, 1245 bp, Anopheles gambiae str. PEST; identical to SEQ ID NO: 19848
  CDS (1)..(1245)

SEQ ID NO: 37645 - protein, 414 aa, Anopheles gambiae str. PEST; identical to SEQ ID NO: 19849

SEQ ID NO: 37646 - DNA, 1227 bp, Thermus thermophilus HB27; identical to SEQ ID NO: 19850
  CDS (1)..(1227): transl_table=11

SEQ ID NO: 37647 - protein, 408 aa, Thermus thermophilus HB27; identical to SEQ ID NO: 19851

SEQ ID NO: 37648 - DNA, 1257 bp, Parachlamydia sp. UWE25; identical to SEQ ID NO: 19852
  CDS (1)..(1257): transl_table=11

SEQ ID NO: 37649 - protein, 418 aa, Parachlamydia sp. UWE25; identical to SEQ ID NO: 19853

SEQ ID NO: 37650 - DNA, 1248 bp, Desulfovibrio vulgaris subsp. vulgaris str. Hildenborough; identical to SEQ ID NO: 19854
  CDS (1)..(1248): transl_table=11

SEQ ID NO: 37651 - protein, 415 aa, Desulfovibrio vulgaris subsp. vulgaris str. Hildenborough; identical to SEQ ID NO: 19855

SEQ ID NO: 37652 - DNA, 1242 bp, Listeria monocytogenes str. 4b F2365; identical to SEQ ID NO: 19856
  CDS (1)..(1242): transl_table=11

SEQ ID NO: 37653 - protein, 413 aa, Listeria monocytogenes str. 4b F2365; identical to SEQ ID NO: 19857

SEQ ID NO: 37654 - DNA, 1239 bp, Bacillus anthracis str. Sterne; identical to SEQ ID NO: 19858
  CDS (1)..(1239): transl_table=11

SEQ ID NO: 37655 - protein, 412 aa, Bacillus anthracis str. Sterne; identical to SEQ ID NO: 19859

SEQ ID NO: 37656 - DNA, 1263 bp, Bartonella quintana str. Toulouse; identical to SEQ ID NO: 19860
  CDS (1)..(1263): transl_table=11

SEQ ID NO: 37657 - protein, 420 aa, Bartonella quintana str. Toulouse; identical to SEQ ID NO: 19861

SEQ ID NO: 37658 - DNA, 1263 bp, Bartonella henselae str. Houston-1; identical to SEQ ID NO: 19862
  CDS (1)..(1263): transl_table=11

SEQ ID NO: 37659 - protein, 420 aa, Bartonella henselae str. Houston-1; identical to SEQ ID NO: 19863

SEQ ID NO: 37660 - DNA, 1245 bp, Staphylococcus aureus subsp. aureus MRSA252; identical to SEQ ID NO: 19864
  CDS (1)..(1245): transl_table=11

SEQ ID NO: 37661 - protein, 414 aa, Staphylococcus aureus subsp. aureus MRSA252; identical to SEQ ID NO: 19865

SEQ ID NO: 37662 - DNA, 1245 bp, Staphylococcus aureus subsp. aureus MSSA476; identical to SEQ ID NO: 19866
  CDS (1)..(1245): transl_table=11

SEQ ID NO: 37663 - protein, 414 aa, Staphylococcus aureus subsp. aureus MSSA476; identical to SEQ ID NO: 19867

SEQ ID NO: 37664 - DNA, 1242 bp, Erwinia carotovora subsp. atroseptica SCRI1043; identical to SEQ ID NO: 19868
  CDS (1)..(1242): transl_table=11

SEQ ID NO: 37665 - protein, 413 aa, Erwinia carotovora subsp. atroseptica SCRI1043; identical to SEQ ID NO: 19869

SEQ ID NO: 37666 - DNA, 1290 bp, Erwinia carotovora subsp. atroseptica SCRI1043; identical to SEQ ID NO: 19870
  CDS (1)..(1290): transl_table=11

SEQ ID NO: 37667 - protein, 429 aa, Erwinia carotovora subsp. atroseptica SCRI1043; identical to SEQ ID NO: 19871

SEQ ID NO: 37668 - DNA, 1272 bp, Propionibacterium acnes KPA171202; identical to SEQ ID NO: 19872
  CDS (1)..(1272): transl_table=11

SEQ ID NO: 37669 - protein, 423 aa, Propionibacterium acnes KPA171202; identical to SEQ ID NO: 19873

SEQ ID NO: 37670 - DNA, 1233 bp, Streptococcus pyogenes MGAS10394; identical to SEQ ID NO: 19874
  CDS (1)..(1233): transl_table=11

SEQ ID NO: 37671 - protein, 410 aa, Streptococcus pyogenes MGAS10394; identical to SEQ ID NO: 19875

SEQ ID NO: 37672 - DNA, 1263 bp, Leifsonia xyli subsp. xyli str. CTCB07; identical to SEQ ID NO: 19876
  CDS (1)..(1263): transl_table=11

SEQ ID NO: 37673 - protein, 420 aa, Leifsonia xyli subsp. xyli str. CTCB07; identical to SEQ ID NO: 19877

SEQ ID NO: 37674 - DNA, 1245 bp, Desulfotalea psychrophila LSv54; identical to SEQ ID NO: 19878
  CDS (1)..(1245): transl_table=11

SEQ ID NO: 37675 - protein, 414 aa, Desulfotalea psychrophila LSv54; identical to SEQ ID NO: 19879

SEQ ID NO: 37676 - DNA, 1281 bp, Rickettsia typhi str. Wilmington; identical to SEQ ID NO: 19880
  CDS (1)..(1281): transl_table=11

SEQ ID NO: 37677 - protein, 426 aa, Rickettsia typhi str. Wilmington; identical to SEQ ID NO: 19881

SEQ ID NO: 37678 - DNA, 1275 bp, Yersinia pseudotuberculosis IP 32953; identical to SEQ ID NO: 19882
  CDS (1)..(1275): transl_table=11

SEQ ID NO: 37679 - protein, 424 aa, Yersinia pseudotuberculosis IP 32953; identical to SEQ ID NO: 19883

SEQ ID NO: 37680 - DNA, 1242 bp, Yersinia pseudotuberculosis IP 32953; identical to SEQ ID NO: 19884
  CDS (1)..(1242): transl_table=11

SEQ ID NO: 37681 - protein, 413 aa, Yersinia pseudotuberculosis IP 32953; identical to SEQ ID NO: 19885

SEQ ID NO: 37682 - DNA, 1242 bp, Symbiobacterium thermophilum IAM 14863; identical to SEQ ID NO: 19886
  CDS (1)..(1242): transl_table=11

SEQ ID NO: 37683 - protein, 413 aa, Symbiobacterium thermophilum IAM 14863; identical to SEQ ID NO: 19887

SEQ ID NO: 37684 - DNA, 1239 bp, Bacillus licheniformis ATCC 14580; identical to SEQ ID NO: 19888
  CDS (1)..(1239): transl_table=11

SEQ ID NO: 37685 - protein, 412 aa, Bacillus licheniformis ATCC 14580; identical to SEQ ID NO: 19889

SEQ ID NO: 37686 - DNA, 1221 bp, Mannheimia succiniciproducens MBEL55E; identical to SEQ ID NO: 19890
  CDS (1)..(1221): transl_table=11

SEQ ID NO: 37687 - protein, 406 aa, Mannheimia succiniciproducens MBEL55E; identical to SEQ ID NO: 19891

SEQ ID NO: 37688 - DNA, 1230 bp, Legionella pneumophila subsp. pneumophila str. Philadelphia 1; identical to SEQ ID NO: 19892
  CDS (1)..(1230): transl_table=11

SEQ ID NO: 37689 - protein, 409 aa, Legionella pneumophila subsp. pneumophila str. Philadelphia 1; identical to SEQ ID NO: 19893

SEQ ID NO: 37690 - DNA, 1293 bp, Legionella pneumophila subsp. pneumophila str. Philadelphia 1; identical to SEQ ID NO: 19894
  CDS (1)..(1293): transl_table=11

SEQ ID NO: 37691 - protein, 430 aa, Legionella pneumophila subsp. pneumophila str. Philadelphia 1; identical to SEQ ID NO: 19895

SEQ ID NO: 37692 - DNA, 1239 bp, Legionella pneumophila subsp. pneumophila str. Philadelphia 1; identical to SEQ ID NO: 19896
  CDS (1)..(1239): transl_table=11

SEQ ID NO: 37693 - protein, 412 aa, Legionella pneumophila subsp. pneumophila str. Philadelphia 1; identical to SEQ ID NO: 19897

SEQ ID NO: 37694 - DNA, 1263 bp, Bacteroides fragilis YCH46; identical to SEQ ID NO: 19898
  CDS (1)..(1263): transl_table=11

SEQ ID NO: 37695 - protein, 420 aa, Bacteroides fragilis YCH46; identical to SEQ ID NO: 19899

SEQ ID NO: 37696 - DNA, 1239 bp, Burkholderia mallei ATCC 23344; identical to SEQ ID NO: 19900
  CDS (1)..(1239): transl_table=11

SEQ ID NO: 37697 - protein, 412 aa, Burkholderia mallei ATCC 23344; identical to SEQ ID NO: 19901

SEQ ID NO: 37698 - DNA, 1206 bp, Methylococcus capsulatus str. Bath; identical to SEQ ID NO: 19902
  CDS (1)..(1206): transl_table=11

SEQ ID NO: 37699 - protein, 401 aa, Methylococcus capsulatus str. Bath; identical to SEQ ID NO: 19903

SEQ ID NO: 37700 - DNA, 1251 bp, Nocardia farcinica IFM 10152; identical to SEQ ID NO: 19904
  CDS (1)..(1251): transl_table=11

SEQ ID NO: 37701 - protein, 416 aa, Nocardia farcinica IFM 10152; identical to SEQ ID NO: 19905

SEQ ID NO: 37702 - DNA, 1230 bp, Legionella pneumophila str. Paris; identical to SEQ ID NO: 19906
  CDS (1)..(1230): transl_table=11

SEQ ID NO: 37703 - protein, 409 aa, Legionella pneumophila str. Paris; identical to SEQ ID NO: 19907

SEQ ID NO: 37704 - DNA, 1293 bp, Legionella pneumophila str. Paris; identical to SEQ ID NO: 19908
  CDS (1)..(1293): transl_table=11

SEQ ID NO: 37705 - protein, 430 aa, Legionella pneumophila str. Paris; identical to SEQ ID NO: 19909

SEQ ID NO: 37706 - DNA, 1239 bp, Legionella pneumophila str. Paris; identical to SEQ ID NO: 19910
  CDS (1)..(1239): transl_table=11

SEQ ID NO: 37707 - protein, 412 aa, Legionella pneumophila str. Paris; identical to SEQ ID NO: 19911

SEQ ID NO: 37708 - DNA, 1239 bp, Legionella pneumophila str. Lens; identical to SEQ ID NO: 19912
  CDS (1)..(1239): transl_table=11

SEQ ID NO: 37709 - protein, 412 aa, Legionella pneumophila str. Lens; identical to SEQ ID NO: 19913

SEQ ID NO: 37710 - DNA, 1242 bp, Photobacterium profundum SS9; identical to SEQ ID NO: 19914
  CDS (1)..(1242): transl_table=11

SEQ ID NO: 37711 - protein, 413 aa, Photobacterium profundum SS9; identical to SEQ ID NO: 19915

SEQ ID NO: 37712 - DNA, 1233 bp, Streptococcus thermophilus LMG 18311; identical to SEQ ID NO: 19916
  CDS (1)..(1233): transl_table=11

SEQ ID NO: 37713 - protein, 410 aa, Streptococcus thermophilus LMG 18311; identical to SEQ ID NO: 19917

SEQ ID NO: 37714 - DNA, 1227 bp, Thermus thermophilus HB8; identical to SEQ ID NO: 19918
  CDS (1)..(1227): transl_table=11

SEQ ID NO: 37715 - protein, 408 aa, Thermus thermophilus HB8; identical to SEQ ID NO: 19919

SEQ ID NO: 37716 - DNA, 1239 bp, Geobacillus kaustophilus HTA426; identical to SEQ ID NO: 19920
  CDS (1)..(1239): transl_table=11

SEQ ID NO: 37717 - protein, 412 aa, Geobacillus kaustophilus HTA426; identical to SEQ ID NO: 19921

SEQ ID NO: 37718 - DNA, 1242 bp, Salmonella enterica subsp. enterica serovar Paratyphi A str. ATCC; identical to SEQ ID NO: 19922
  CDS (1)..(1242): transl_table=11

SEQ ID NO: 37719 - protein, 413 aa, Salmonella enterica subsp. enterica serovar Paratyphi A str. ATCC; identical to SEQ ID NO: 19923

SEQ ID NO: 37720 - DNA, 1284 bp, Anaplasma marginale str. St. Maries; identical to SEQ ID NO: 19924
  CDS (1)..(1284): transl_table=11

SEQ ID NO: 37721 - protein, 427 aa, Anaplasma marginale str. St. Maries; identical to SEQ ID NO: 19925

SEQ ID NO: 37722 - DNA, 1239 bp, Azoarcus sp. EbN1; identical to SEQ ID NO: 19926
  CDS (1)..(1239): transl_table=11

SEQ ID NO: 37723 - protein, 412 aa, Azoarcus sp. EbN1; identical to SEQ ID NO: 19927

SEQ ID NO: 37724 - DNA, 1299 bp, Zymomonas mobilis subsp. mobilis ZM4; identical to SEQ ID NO: 19928
  CDS (1)..(1299): transl_table=11

SEQ ID NO: 37725 - protein, 432 aa, Zymomonas mobilis subsp. mobilis ZM4; identical to SEQ ID NO: 19929

SEQ ID NO: 37726 - DNA, 1209 bp, Silicibacter pomeroyi DSS-3; identical to SEQ ID NO: 19930
  CDS (1)..(1209): transl_table=11

SEQ ID NO: 37727 - protein, 402 aa, Silicibacter pomeroyi DSS-3; identical to SEQ ID NO: 19931

SEQ ID NO: 37728 - DNA, 1266 bp, Silicibacter pomeroyi DSS-3; identical to SEQ ID NO: 19932
  CDS (1)..(1266): transl_table=11

SEQ ID NO: 37729 - protein, 421 aa, Silicibacter pomeroyi DSS-3; identical to SEQ ID NO: 19933

SEQ ID NO: 37730 - DNA, 1260 bp, Francisella tularensis subsp. tularensis SCHU S4; identical to SEQ ID NO: 19934
  CDS (1)..(1260): transl_table=11

SEQ ID NO: 37731 - protein, 419 aa, Francisella tularensis subsp. tularensis SCHU S4; identical to SEQ ID NO: 19935

SEQ ID NO: 37732 - DNA, 1254 bp, Synechococcus elongatus PCC 6301; identical to SEQ ID NO: 19936
  CDS (1)..(1254): transl_table=11

SEQ ID NO: 37733 - protein, 417 aa, Synechococcus elongatus PCC 6301; identical to SEQ ID NO: 19937

SEQ ID NO: 37734 - DNA, 1242 bp, Bacillus clausii KSM-K16; identical to SEQ ID NO: 19938
  CDS (1)..(1242): transl_table=11

SEQ ID NO: 37735 - protein, 413 aa, Bacillus clausii KSM-K16; identical to SEQ ID NO: 19939

SEQ ID NO: 37736 - DNA, 1215 bp, Campylobacter jejuni RM1221; identical to SEQ ID NO: 19940
  CDS (1)..(1215): transl_table=11

SEQ ID NO: 37737 - protein, 404 aa, Campylobacter jejuni RM1221; identical to SEQ ID NO: 19941

SEQ ID NO: 37738 - DNA, 1272 bp, Ehrlichia ruminantium str. Welgevonden; identical to SEQ ID NO: 19942
  CDS (1)..(1272): transl_table=11

SEQ ID NO: 37739 - protein, 423 aa, Ehrlichia ruminantium str. Welgevonden; identical to SEQ ID NO: 19943

SEQ ID NO: 37740 - DNA, 1269 bp, Dehalococcoides ethenogenes 195; identical to SEQ ID NO: 19944
  CDS (1)..(1269): transl_table=11

SEQ ID NO: 37741 - protein, 422 aa, Dehalococcoides ethenogenes 195; identical to SEQ ID NO: 19945

SEQ ID NO: 37742 - DNA, 1245 bp, Staphylococcus epidermidis RP62A; identical to SEQ ID NO: 19946
  CDS (1)..(1245): transl_table=11

SEQ ID NO: 37743 - protein, 414 aa, Staphylococcus epidermidis RP62A; identical to SEQ ID NO: 19947

SEQ ID NO: 37744 - DNA, 1287 bp, Gluconobacter oxydans 621H; identical to SEQ ID NO: 19948
  CDS (1)..(1287): transl_table=11

SEQ ID NO: 37745 - protein, 428 aa, Gluconobacter oxydans 621H; identical to SEQ ID NO: 19949

SEQ ID NO: 37746 - DNA, 1272 bp, Ehrlichia ruminantium str. Gardel; identical to SEQ ID NO: 19950
  CDS (1)..(1272): transl_table=11

SEQ ID NO: 37747 - protein, 423 aa, Ehrlichia ruminantium str. Gardel; identical to SEQ ID NO: 19951

SEQ ID NO: 37748 - DNA, 1269 bp, Wolbachia endosymbiont strain TRS of Brugia malayi; identical to SEQ ID NO: 19952
  CDS (1)..(1269): transl_table=11

SEQ ID NO: 37749 - protein, 422 aa, Wolbachia endosymbiont strain TRS of Brugia malayi; identical to SEQ ID NO: 19953

SEQ ID NO: 37750 - DNA, 1299 bp, Xanthomonas oryzae pv. oryzae KACC10331; identical to SEQ ID NO: 19954
  CDS (1)..(1299): transl_table=11

SEQ ID NO: 37751 - protein, 432 aa, Xanthomonas oryzae pv. oryzae KACC10331; identical to SEQ ID NO: 19955

SEQ ID NO: 37752 - DNA, 1245 bp, Vibrio fischeri ES114; identical to SEQ ID NO: 19956
  CDS (1)..(1245): transl_table=11

SEQ ID NO: 37753 - protein, 414 aa, Vibrio fischeri ES114; identical to SEQ ID NO: 19957

SEQ ID NO: 37754 - DNA, 1248 bp, Neisseria gonorrhoeae FA 1090; identical to SEQ ID NO: 19958
  CDS (1)..(1248): transl_table=11

SEQ ID NO: 37755 - protein, 415 aa, Neisseria gonorrhoeae FA 1090; identical to SEQ ID NO: 19959

SEQ ID NO: 37756 - DNA, 1263 bp, Bacteroides fragilis NCTC 9343; identical to SEQ ID NO: 19960
  CDS (1)..(1263): transl_table=11

SEQ ID NO: 37757 - protein, 420 aa, Bacteroides fragilis NCTC 9343; identical to SEQ ID NO: 19961

SEQ ID NO: 37758 - DNA, 1251 bp, Chlamydophila abortus S26/3; identical to SEQ ID NO: 19962
  CDS (1)..(1251): transl_table=11

SEQ ID NO: 37759 - protein, 416 aa, Chlamydophila abortus S26/3; identical to SEQ ID NO: 19963

SEQ ID NO: 37760 - DNA, 1263 bp, Brucella abortus biovar 1 str. 9-941; identical to SEQ ID NO: 19964
  CDS (1)..(1263): transl_table=11

SEQ ID NO: 37761 - protein, 420 aa, Brucella abortus biovar 1 str. 9-941; identical to SEQ ID NO: 19965

SEQ ID NO: 37762 - DNA, 1236 bp, Xanthomonas campestris pv. campestris str. 8004; identical to SEQ ID NO: 19966
  CDS (1)..(1236): transl_table=11

SEQ ID NO: 37763 - protein, 411 aa, Xanthomonas campestris pv. campestris str. 8004; identical to SEQ ID NO: 19967

SEQ ID NO: 37764 - DNA, 1281 bp, Rickettsia felis URRWXCal2; identical to SEQ ID NO: 19968
  CDS (1)..(1281): transl_table=11

SEQ ID NO: 37765 - protein, 426 aa, Rickettsia felis URRWXCal2; identical to SEQ ID NO: 19969

SEQ ID NO: 37766 - DNA, 1245 bp, Staphylococcus haemolyticus JCSC1435; identical to SEQ ID NO: 19970
  CDS (1)..(1245): transl_table=11

SEQ ID NO: 37767 - protein, 414 aa, Staphylococcus haemolyticus JCSC1435; identical to SEQ ID NO: 19971

SEQ ID NO: 37768 - DNA, 1245 bp, Pseudomonas fluorescens Pf-5; identical to SEQ ID NO: 19972
  CDS (1)..(1245): transl_table=11

SEQ ID NO: 37769 - protein, 414 aa, Pseudomonas fluorescens Pf-5; identical to SEQ ID NO: 19973

SEQ ID NO: 37770 - DNA, 1269 bp, Pseudomonas fluorescens Pf-5; identical to SEQ ID NO: 19974
  CDS (1)..(1269): transl_table=11

SEQ ID NO: 37771 - protein, 422 aa, Pseudomonas fluorescens Pf-5; identical to SEQ ID NO: 19975

SEQ ID NO: 37772 - DNA, 1416 bp, Psychrobacter arcticum 273-4; identical to SEQ ID NO: 19976
  CDS (1)..(1416): transl_table=11

SEQ ID NO: 37773 - protein, 471 aa, Psychrobacter arcticum 273-4; identical to SEQ ID NO: 19977

SEQ ID NO: 37774 - DNA, 1239 bp, Colwellia psychrerythraea 34H; identical to SEQ ID NO: 19978
  CDS (1)..(1239): transl_table=11

SEQ ID NO: 37775 - protein, 412 aa, Colwellia psychrerythraea 34H; identical to SEQ ID NO: 19979

SEQ ID NO: 37776 - DNA, 1212 bp, Colwellia psychrerythraea 34H; identical to SEQ ID NO: 19980
  CDS (1)..(1212): transl_table=11

SEQ ID NO: 37777 - protein, 403 aa, Colwellia psychrerythraea 34H; identical to SEQ ID NO: 19981

SEQ ID NO: 37778 - DNA, 1245 bp, Pseudomonas syringae pv. phaseolicola 1448A; identical to SEQ ID NO: 19982
  CDS (1)..(1245): transl_table=11

SEQ ID NO: 37779 - protein, 414 aa, Pseudomonas syringae pv. phaseolicola 1448A; identical to SEQ ID NO: 19983

SEQ ID NO: 37780 - DNA, 1233 bp, Streptococcus pyogenes MGAS5005; identical to SEQ ID NO: 19984
  CDS (1)..(1233): transl_table=11

SEQ ID NO: 37781 - protein, 410 aa, Streptococcus pyogenes MGAS5005; identical to SEQ ID NO: 19985

SEQ ID NO: 37782 - DNA, 1236 bp, Dechloromonas aromatica RCB; identical to SEQ ID NO: 19986
  CDS (1)..(1236): transl_table=11

SEQ ID NO: 37783 - protein, 411 aa, Dechloromonas aromatica RCB; identical to SEQ ID NO: 19987

SEQ ID NO: 37784 - DNA, 1263 bp, Thermobifida fusca YX; identical to SEQ ID NO: 19988
  CDS (1)..(1263): transl_table=11

SEQ ID NO: 37785 - protein, 420 aa, Thermobifida fusca YX; identical to SEQ ID NO: 19989

SEQ ID NO: 37786 - DNA, 1239 bp, Thermobifida fusca YX; identical to SEQ ID NO: 19990
  CDS (1)..(1239): transl_table=11

SEQ ID NO: 37787 - protein, 412 aa, Thermobifida fusca YX; identical to SEQ ID NO: 19991

SEQ ID NO: 37788 - DNA, 1248 bp, Prochlorococcus marinus str. NATL2A; identical to SEQ ID NO: 19992
  CDS (1)..(1248): transl_table=11

SEQ ID NO: 37789 - protein, 415 aa, Prochlorococcus marinus str. NATL2A; identical to SEQ ID NO: 19993

SEQ ID NO: 37790 - DNA, 1233 bp, Ralstonia eutropha JMP134; identical to SEQ ID NO: 19994
  CDS (1)..(1233): transl_table=11

SEQ ID NO: 37791 - protein, 410 aa, Ralstonia eutropha JMP134; identical to SEQ ID NO: 19995

SEQ ID NO: 37792 - DNA, 1245 bp, Staphylococcus saprophyticus subsp. saprophyticus ATCC 15305; identical to SEQ ID NO: 19996
  CDS (1)..(1245): transl_table=11

SEQ ID NO: 37793 - protein, 414 aa, Staphylococcus saprophyticus subsp. saprophyticus ATCC 15305; identical to SEQ ID NO: 19997

SEQ ID NO: 37794 - DNA, 1269 bp, Ehrlichia canis str. Jake; identical to SEQ ID NO: 19998
  CDS (1)..(1269): transl_table=11

SEQ ID NO: 37795 - protein, 422 aa, Ehrlichia canis str. Jake; identical to SEQ ID NO: 19999

SEQ ID NO: 37796 - DNA, 1269 bp, Dehalococcoides sp. CBDB1; identical to SEQ ID NO: 20000
  CDS (1)..(1269): transl_table=11

SEQ ID NO: 37797 - protein, 422 aa, Dehalococcoides sp. CBDB1; identical to SEQ ID NO: 20001

SEQ ID NO: 37798 - DNA, 1233 bp, Thiobacillus denitrificans ATCC 25259; identical to SEQ ID NO: 20002
  CDS (1)..(1233): transl_table=11

SEQ ID NO: 37799 - protein, 410 aa, Thiobacillus denitrificans ATCC 25259; identical to SEQ ID NO: 20003

SEQ ID NO: 37800 - DNA, 1215 bp, Pseudomonas syringae pv. syringae B728a; identical to SEQ ID NO: 20004
  CDS (1)..(1215)

SEQ ID NO: 37801 - protein, 404 aa, Pseudomonas syringae pv. syringae B728a; identical to SEQ ID NO: 20005

SEQ ID NO: 37802 - DNA, 1215 bp, Pseudomonas aeruginosa UCBPP-PA14; identical to SEQ ID NO: 20006
  CDS (1)..(1215)

SEQ ID NO: 37803 - protein, 404 aa, Pseudomonas aeruginosa UCBPP-PA14; identical to SEQ ID NO: 20007

SEQ ID NO: 37804 - DNA, 1215 bp, Pseudomonas fluorescens PfO-1; identical to SEQ ID NO: 20008
  CDS (1)..(1215)

SEQ ID NO: 37805 - protein, 404 aa, Pseudomonas fluorescens PfO-1; identical to SEQ ID NO: 20009

SEQ ID NO: 37806 - DNA, 1236 bp, Enterococcus faecium DO; identical to SEQ ID NO: 20010
  CDS (1)..(1236): transl_table=11

SEQ ID NO: 37807 - protein, 411 aa, Enterococcus faecium DO; identical to SEQ ID NO: 20011

SEQ ID NO: 37808 - DNA, 1308 bp, Neurospora crassa; identical to SEQ ID NO: 20012
  CDS (1)..(1308): n means a or g or c or t/u, s means g or c

SEQ ID NO: 37809 - protein, 435 aa, Neurospora crassa; identical to SEQ ID NO: 20013
  Xaa in the positions 84, 155, 174, 226, 302, 328, 332, 345, 346, 349, 356, 384, 422 and 434 is unknown

SEQ ID NO: 37810 - DNA, 1425 bp, Perilla frutescens; identical to SEQ ID NO: 20014
  CDS (1)..(1425)

SEQ ID NO: 37811 - protein, 474 aa, Perilla frutescens; identical to SEQ ID NO: 20015

SEQ ID NO: 37812 - DNA, 1593 bp, Perilla frutescens; identical to SEQ ID NO: 20016
  CDS (1)..(1593)

SEQ ID NO: 37813 - protein, 530 aa, Perilla frutescens; identical to SEQ ID NO: 20017

SEQ ID NO: 37814 - DNA, 1278 bp, Streptomyces roseofulvus; identical to SEQ ID NO: 20018
  CDS (1)..(1278): transl_table=11

SEQ ID NO: 37815 - protein, 425 aa, Streptomyces roseofulvus; identical to SEQ ID NO: 20019

SEQ ID NO: 37816 - DNA, 1467 bp, Capsicum chinense; identical to SEQ ID NO: 20020
  CDS (1)..(1467)

SEQ ID NO: 37817 - protein, 488 aa, Capsicum chinense; identical to SEQ ID NO: 20021

SEQ ID NO: 37818 - DNA, 1554 bp, Cuphea wrightii; identical to SEQ ID NO: 20022
  CDS (1)..(1554)

SEQ ID NO: 37819 - protein, 517 aa, Cuphea wrightii; identical to SEQ ID NO: 20023

SEQ ID NO: 37820 - DNA, 1623 bp, Cuphea wrightii; identical to SEQ ID NO: 20024
  CDS (1)..(1623)

SEQ ID NO: 37821 - protein, 540 aa, Cuphea wrightii; identical to SEQ ID NO: 20025

SEQ ID NO: 37822 - DNA, 1488 bp, Hordeum vulgare; identical to SEQ ID NO: 20026
  CDS (1)..(1488)

SEQ ID NO: 37823 - protein, 495 aa, Hordeum vulgare; identical to SEQ ID NO: 20027

SEQ ID NO: 37824 - DNA, 1470 bp, Hordeum vulgare; identical to SEQ ID NO: 20028
  CDS (1)..(1470)

SEQ ID NO: 37825 - protein, 489 aa, Hordeum vulgare; identical to SEQ ID NO: 20029

SEQ ID NO: 37826 - DNA, 1608 bp, Ricinus communis; identical to SEQ ID NO: 20030
  CDS (1)..(1608)

SEQ ID NO: 37827 - protein, 535 aa, Ricinus communis; identical to SEQ ID NO: 20031

SEQ ID NO: 37828 - DNA, 1410 bp, Ricinus communis; identical to SEQ ID NO: 20032
  CDS (1)..(1410)

SEQ ID NO: 37829 - protein, 469 aa, Ricinus communis; identical to SEQ ID NO: 20033

SEQ ID NO: 37830 - DNA, 1269 bp, Pseudomonas syringae pv; identical to SEQ ID NO: 20034
  CDS (1)..(1269): transl_table=11

SEQ ID NO: 37831 - protein, 422 aa, Pseudomonas syringae pv; identical to SEQ ID NO: 20035

SEQ ID NO: 37832 - DNA, 1272 bp, Streptomyces glaucescens; identical to SEQ ID NO: 20036
  CDS (1)..(1272): transl_table=11

SEQ ID NO: 37833 - protein, 423 aa, Streptomyces glaucescens; identical to SEQ ID NO: 20037

SEQ ID NO: 37834 - DNA, 1269 bp, Streptomyces griseus; identical to SEQ ID NO: 20038
  CDS (1)..(1269): transl_table=11

SEQ ID NO: 37835 - protein, 422 aa, Streptomyces griseus; identical to SEQ ID NO: 20039

SEQ ID NO: 37836 - DNA, 1293 bp, Streptomyces nogalater; identical to SEQ ID NO: 20040
  CDS (1)..(1293): transl_table=11

SEQ ID NO: 37837 - protein, 430 aa, Streptomyces nogalater; identical to SEQ ID NO: 20041

SEQ ID NO: 37838 - DNA, 1260 bp, Streptomyces peucetius; identical to SEQ ID NO: 20042
  CDS (1)..(1260): transl_table=11

SEQ ID NO: 37839 - protein, 419 aa, Streptomyces peucetius; identical to SEQ ID NO: 20043

SEQ ID NO: 37840 - DNA, 1278 bp, Streptomyces roseofulvus; identical to SEQ ID NO: 20044
  CDS (1)..(1278): transl_table=11

SEQ ID NO: 37841 - protein, 425 aa, Streptomyces roseofulvus; identical to SEQ ID NO: 20045

SEQ ID NO: 37842 - DNA, 1467 bp, Glycine max; identical to SEQ ID NO: 20046
  CDS (1)..(1467)

SEQ ID NO: 37843 - protein, 488 aa, Glycine max; identical to SEQ ID NO: 20047

SEQ ID NO: 37844 - DNA, 1470 bp, Glycine max; identical to SEQ ID NO: 20048
  CDS (1)..(1470)

SEQ ID NO: 37845 - protein, 489 aa, Glycine max; identical to SEQ ID NO: 20049

SEQ ID NO: 37846 - DNA, 1299 bp, Streptomyces spiramyceticus; identical to SEQ ID NO: 20050
  CDS (1)..(1299): transl_table=11

SEQ ID NO: 37847 - protein, 432 aa, Streptomyces spiramyceticus; identical to SEQ ID NO: 20051

SEQ ID NO: 37848 - DNA, 1218 bp, Saccharopolyspora erythraea; identical to SEQ ID NO: 20052
  CDS (1)..(1218): transl_table=11

SEQ ID NO: 37849 - protein, 405 aa, Saccharopolyspora erythraea; identical to SEQ ID NO: 20053

SEQ ID NO: 37850 - DNA, 1269 bp, Streptomyces griseoruber; identical to SEQ ID NO: 20054
  CDS (1)..(1269): transl_table=11

SEQ ID NO: 37851 - protein, 422 aa, Streptomyces griseoruber; identical to SEQ ID NO: 20055

SEQ ID NO: 37852 - DNA, 1398 bp, Oryza sativa; identical to SEQ ID NO: 20056
  CDS (1)..(1398)

SEQ ID NO: 37853 - protein, 465 aa, Oryza sativa; identical to SEQ ID NO: 20057

SEQ ID NO: 37854 - DNA, 1254 bp, Treponema hyodysenteriae; identical to SEQ ID NO: 20058
  CDS (1)..(1254): transl_table=11

SEQ ID NO: 37855 - protein, 417 aa, Treponema hyodysenteriae; identical to SEQ ID NO: 20059

SEQ ID NO: 37856 - DNA, 1269 bp, Rhizobium sp; identical to SEQ ID NO: 20060
  CDS (1)..(1269): transl_table=11

SEQ ID NO: 37857 - protein, 422 aa, Rhizobium sp; identical to SEQ ID NO: 20061

SEQ ID NO: 37858 - DNA, 1305 bp, Plasmodium yoelii yoelii; identical to SEQ ID NO: 20062
  CDS (1)..(1305)

SEQ ID NO: 37859 - protein, 434 aa, Plasmodium yoelii yoelii; identical to SEQ ID NO: 20063

SEQ ID NO: 37860 - DNA, 1275 bp, Streptomyces murayamaensis; identical to SEQ ID NO: 20064
  CDS (1)..(1275): transl_table=11

SEQ ID NO: 37861 - protein, 424 aa, Streptomyces murayamaensis; identical to SEQ ID NO: 20065

SEQ ID NO: 37862 - DNA, 1446 bp, Dictyostelium discoideum; identical to SEQ ID NO: 20066
  CDS (1)..(1446)

SEQ ID NO: 37863 - protein, 481 aa, Dictyostelium discoideum; identical to SEQ ID NO: 20067

SEQ ID NO: 37864 - DNA, 1248 bp, Heliobacillus mobilis; identical to SEQ ID NO: 20068
  CDS (1)..(1248): transl_table=11

SEQ ID NO: 37865 - protein, 415 aa, Heliobacillus mobilis; identical to SEQ ID NO: 20069

SEQ ID NO: 37866 - DNA, 1626 bp, Arabidopsis thaliana; identical to SEQ ID NO: 20070
  CDS (1)..(1626)

SEQ ID NO: 37867 - protein, 541 aa, Arabidopsis thaliana; identical to SEQ ID NO: 20071

SEQ ID NO: 37868 - DNA, 1272 bp, Streptomyces galilaeus; identical to SEQ ID NO: 20072
  CDS (1)..(1272): transl_table=11

SEQ ID NO: 37869 - protein, 423 aa, Streptomyces galilaeus; identical to SEQ ID NO: 20073

SEQ ID NO: 37870 - DNA, 1617 bp, Cuphea lanceolata; identical to SEQ ID NO: 20074
  CDS (1)..(1617)

SEQ ID NO: 37871 - protein, 538 aa, Cuphea lanceolata; identical to SEQ ID NO: 20075

SEQ ID NO: 37872 - DNA, 1371 bp, Coriandrum sativum; identical to SEQ ID NO: 20076
  CDS (1)..(1371)

SEQ ID NO: 37873 - protein, 456 aa, Coriandrum sativum; identical to SEQ ID NO: 20077

SEQ ID NO: 37874 - DNA, 1236 bp, Xanthomonas albilineans; identical to SEQ ID NO: 20078
  CDS (1)..(1236): transl_table=11

SEQ ID NO: 37875 - protein, 411 aa, Xanthomonas albilineans; identical to SEQ ID NO: 20079

SEQ ID NO: 37876 - DNA, 1272 bp, Streptomyces maritimus; identical to SEQ ID NO: 20080
  CDS (1)..(1272): transl_table=11

SEQ ID NO: 37877 - protein, 423 aa, Streptomyces maritimus; identical to SEQ ID NO: 20081

SEQ ID NO: 37878 - DNA, 1272 bp, Streptomyces galilaeus; identical to SEQ ID NO: 20082
  CDS (1)..(1272): transl_table=11

SEQ ID NO: 37879 - protein, 423 aa, Streptomyces galilaeus; identical to SEQ ID NO: 20083

SEQ ID NO: 37880 - DNA, 1635 bp, Brassica napus; identical to SEQ ID NO: 20084
  CDS (1)..(1635)

SEQ ID NO: 37881 - protein, 544 aa, Brassica napus; identical to SEQ ID NO: 20085

SEQ ID NO: 37882 - DNA, 1302 bp, Brassica napus; identical to SEQ ID NO: 20086
  CDS (1)..(1302)

SEQ ID NO: 37883 - protein, 433 aa, Brassica napus; identical to SEQ ID NO: 20087

SEQ ID NO: 37884 - DNA, 1467 bp, Glycine max; identical to SEQ ID NO: 20088
  CDS (1)..(1467)

SEQ ID NO: 37885 - protein, 488 aa, Glycine max; identical to SEQ ID NO: 20089

SEQ ID NO: 37886 - DNA, 1410 bp, Glycine max; identical to SEQ ID NO: 20090
  CDS (1)..(1410)

SEQ ID NO: 37887 - protein, 469 aa, Glycine max; identical to SEQ ID NO: 20091

SEQ ID NO: 37888 - DNA, 1410 bp, Glycine max; identical to SEQ ID NO: 20092
  CDS (1)..(1410)

SEQ ID NO: 37889 - protein, 469 aa, Glycine max; identical to SEQ ID NO: 20093

SEQ ID NO: 37890 - DNA, 1722 bp, Elaeis guineensis var; identical to SEQ ID NO: 20094
  CDS (1)..(1722)

SEQ ID NO: 37891 - protein, 573 aa, Elaeis guineensis var; identical to SEQ ID NO: 20095

SEQ ID NO: 37892 - DNA, 1248 bp, Vibrio marinus; identical to SEQ ID NO: 20096
  CDS (1)..(1248): transl_table=11

SEQ ID NO: 37893 - protein, 415 aa, Vibrio marinus; identical to SEQ ID NO: 20097

SEQ ID NO: 37894 - DNA, 1260 bp, Streptomyces rochei; identical to SEQ ID NO: 20098
  CDS (1)..(1260): transl_table=11

SEQ ID NO: 37895 - protein, 419 aa, Streptomyces rochei; identical to SEQ ID NO: 20099

SEQ ID NO: 37896 - DNA, 1689 bp, Arabidopsis thaliana; identical to SEQ ID NO: 20100
  CDS (1)..(1689)

SEQ ID NO: 37897 - protein, 562 aa, Arabidopsis thaliana; identical to SEQ ID NO: 20101

SEQ ID NO: 37898 - DNA, 1605 bp, Cuphea hookeriana; identical to SEQ ID NO: 20102
  CDS (1)..(1605)

SEQ ID NO: 37899 - protein, 534 aa, Cuphea hookeriana; identical to SEQ ID NO: 20103

SEQ ID NO: 37900 - DNA, 1641 bp, Cuphea pulcherrima; identical to SEQ ID NO: 20104
  CDS (1)..(1641)

SEQ ID NO: 37901 - protein, 546 aa, Cuphea pulcherrima; identical to SEQ ID NO: 20105

SEQ ID NO: 37902 - DNA, 1329 bp, Saccharomyces cerevisiae; identical to SEQ ID NO: 20106
  CDS (1)..(1329)

SEQ ID NO: 37903 - protein, 442 aa, Saccharomyces cerevisiae; identical to SEQ ID NO: 20107

SEQ ID NO: 37904 - DNA, 1251 bp, Mycobacterium leprae; identical to SEQ ID NO: 20108
  CDS (1)..(1251): transl_table=11

SEQ ID NO: 37905 - protein, 416 aa, Mycobacterium leprae; identical to SEQ ID NO: 20109

SEQ ID NO: 37906 - DNA, 1221 bp, Haemophilus influenzae; identical to SEQ ID NO: 20110
  CDS (1)..(1221): transl_table=11

SEQ ID NO: 37907 - protein, 406 aa, Haemophilus influenzae; identical to SEQ ID NO: 20111

SEQ ID NO: 37908 - DNA, 1266 bp, Rhizobium meliloti; identical to SEQ ID NO: 20112
  CDS (1)..(1266): transl_table=11

SEQ ID NO: 37909 - protein, 421 aa, Rhizobium meliloti; identical to SEQ ID NO: 20113

SEQ ID NO: 37910 - DNA, 1251 bp, Synechocystis sp; identical to SEQ ID NO: 20114
  CDS (1)..(1251): transl_table=11

SEQ ID NO: 37911 - protein, 416 aa, Synechocystis sp; identical to SEQ ID NO: 20115

SEQ ID NO: 37912 - DNA, 1245 bp, Vibrio cholerae; identical to SEQ ID NO: 20116
  CDS (1)..(1245)

SEQ ID NO: 37913 - protein, 414 aa, Vibrio cholerae; identical to SEQ ID NO: 19655

SEQ ID NO: 37914 - DNA, 1248 bp, Vibrio harveyi; identical to SEQ ID NO: 20118
  CDS (1)..(1248)

SEQ ID NO: 37915 - protein, 415 aa, Vibrio harveyi; identical to SEQ ID NO: 20119

SEQ ID NO: 37916 - DNA, 1272 bp, Streptomyces coelicolor; identical to SEQ ID NO: 20120
  CDS (1)..(1272): transl_table=11

SEQ ID NO: 37917 - protein, 423 aa, Streptomyces coelicolor; identical to SEQ ID NO: 20121

SEQ ID NO: 37918 - DNA, 1269 bp, Streptomyces halstedii; identical to SEQ ID NO: 20122
  CDS (1)..(1269): transl_table=11

SEQ ID NO: 37919 - protein, 422 aa, Streptomyces halstedii; identical to SEQ ID NO: 20123

SEQ ID NO: 37920 - DNA, 1422 bp, Arabidopsis thaliana; identical to SEQ ID NO: 20124
  CDS (1)..(1422)

SEQ ID NO: 37921 - protein, 473 aa, Arabidopsis thaliana; identical to SEQ ID NO: 20125

SEQ ID NO: 37922 - DNA, 1389 bp, Hordeum vulgare; identical to SEQ ID NO: 20126
  CDS (1)..(1389)

SEQ ID NO: 37923 - protein, 462 aa, Hordeum vulgare; identical to SEQ ID NO: 20127

SEQ ID NO: 37924 - DNA, 1386 bp, Arabidopsis thaliana; identical to SEQ ID NO: 20128
  CDS (1)..(1386)

SEQ ID NO: 37925 - protein, 461 aa, Arabidopsis thaliana; identical to SEQ ID NO: 20129

SEQ ID NO: 37926 - DNA, 24 bp, Artificial sequence
  (1)..(24): primer
atgtctaagcgtcgtgtagttgtg

SEQ ID NO: 37927 - DNA, 27 bp, Artificial sequence
  (1)..(27): primer
ttagatctttttaaagatcaaagaacc

SEQ ID NO: 37928 - protein, 494 aa, Artificial sequence; identical to SEQ ID NO: 20132
  Variant (10)..(10): xaa in position 10 is any amino acid
  Variant (16)..(21): xaa in position 16 to 21 is any amino acid
  Variant (23)..(24): xaa in position 23 to 24 is any amino acid
  Variant (26)..(27): xaa in position 26 to 27 is any amino acid
  Variant (29)..(30): xaa in position 29 to 30 is any amino acid
  Variant (33)..(34): xaa in position 33 to 34 is any amino acid
  Variant (36)..(45): xaa in position 36 to 45 is any amino acid
  Variant (46)..(57): xaa in position 46 to 57 is any or no amino acid
  Variant (60)..(60): xaa in position 60 is any amino acid
  Variant (62)..(69): xaa in position 62 to 69 is any amino acid
  Variant (70)..(86): xaa in position 70 to 86 is any or no amino acid
  Variant (88)..(89): xaa in position 88 to 89 is any amino acid
  Variant (94)..(97): xaa in position 94 to 97 is any amino acid
  Variant (101)..(101): xaa in position 101 is any amino acid
  Variant (104)..(105): xaa in position 104 to 105 is any amino acid
  Variant (108)..(109): xaa in position 108 to 109 is any amino acid
  Variant (111)..(117): xaa in position 111 to 117 is any amino acid
  Variant (118)..(131): xaa in position 118 to 131 is any or no amino acid
  Variant (133)..(133): xaa in position 133 is any amino acid
  Variant (136)..(136): xaa in position 136 is any amino acid
  Variant (145)..(157): xaa in position 145 to 157 is any amino acid
  Variant (158)..(172): xaa in position 158 to 172 is any or no amino acid
  Variant (174)..(179): xaa in position 174 to 179 is any or no amino acid
  Variant (181)..(181): xaa in position 181 is any amino acid
  Variant (183)..(184): xaa in position 183 to 184 is any amino acid
  Variant (187)..(188): xaa in position 187 to 188 is any amino acid
  Variant (190)..(191): xaa in position 190 to 191 is any amino acid
  Variant (193)..(193): xaa in position 193 is any amino acid
  Variant (196)..(196): xaa in position 196 is any amino acid
  Variant (200)..(201): xaa in position 200 to 201 is any amino acid
  Variant (203)..(204): xaa in position 203 to 204 is any amino acid
  Variant (206)..(211): xaa in position 206 to 211 is any amino acid
  Variant (215)..(215): xaa in position 215 is any amino acid
  Variant (217)..(220): xaa in position 217 to 220 is any amino acid
  Variant (223)..(223): xaa in position 223 is any amino acid
  Variant (225)..(227): xaa in position 225 to 227 is any amino acid
  Variant (229)..(230): xaa in position 229 to 230 is any amino acid
  Variant (232)..(232): xaa in position 232 is any amino acid
  Variant (234)..(244): xaa in position 234 to 244 is any or no amino acid
  Variant (246)..(246): xaa in position 246 is any amino acid
  Variant (249)..(249): xaa in position 249 is any amino acid
  Variant (252)..(252): xaa in position 252 is any amino acid
  Variant (254)..(254): xaa in position 254 is any amino acid
  Variant (255)..(255): xaa in position 255 is any or no amino acid
  Variant (257)..(258): xaa in position 257 to 258 is any amino acid
  Variant (260)..(260): xaa in position 260 is any amino acid
  Variant (265)..(265): xaa in position 265 is any amino acid
  Variant (267)..(267): xaa in position 267 is any amino acid
  Variant (272)..(272): xaa in position 272 is any amino acid
  Variant (273)..(274): xaa in position 273 to 274 is any or no amino acid
  Variant (276)..(277): xaa in position 276 to 277 is any or no amino acid
  Variant (279)..(279): xaa in position 279 is any or no amino acid
  Variant (281)..(282): xaa in position 281 to 282 is any or no amino acid
  Variant (289)..(290): xaa in position 289 to 290 is any amino acid
  Variant (292)..(292): xaa in position 292 is any amino acid
  Variant (307)..(308): xaa in position 307 to 308 is any amino acid
  Variant (312)..(313): xaa in position 312 to 313 is any amino acid
  Variant (317)..(317): xaa in position 317 is any amino acid
  Variant (319)..(319): xaa in position 319 is any amino acid
  Variant (323)..(323): xaa in position 323 is any amino acid
  Variant (325)..(325): xaa in position 325 is any amino acid
  Variant (327)..(327): xaa in position 327 is any amino acid
  Variant (329)..(329): xaa in position 329 is any amino acid
  Variant (332)..(332): xaa in position 332 is any amino acid
  Variant (336)..(336): xaa in position 336 is any amino acid
  Variant (338)..(338): xaa in position 338 is any amino acid
  Variant (339)..(340): xaa in position 339 to 340 is any or no amino acid
  Variant (342)..(342): xaa in position 342 is any amino acid
  Variant (344)..(346): xaa in position 344 to 346 is any amino acid
  Variant (347)..(347): xaa in position 347 is any or no amino acid
  Variant (349)..(350): xaa in position 349 to 350 is any amino acid
  Variant (353)..(354): xaa in position 353 to 354 is any amino acid
  Variant (356)..(356): xaa in position 356 is any amino acid
  Variant (358)..(363): xaa in position 358 to 363 is any or no amino acid
  Variant (365)..(365): xaa in position 365 is any amino acid
  Variant (375)..(376): xaa in position 375 to 376 is any amino acid
  Variant (377)..(377): xaa in position 377 is any or no amino acid
  Variant (379)..(380): xaa in position 379 to 380 is any amino acid
  Variant (382)..(383): xaa in position 382 to 383 is any amino acid
  Variant (386)..(389): xaa in position 386 to 389 is any amino acid
  Variant (391)..(392): xaa in position 391 to 392 is any amino acid
  Variant (393)..(406): xaa in position 393 to 406 is any or no amino acid
  Variant (408)..(408): xaa in position 408 is any or no amino acid
  Variant (410)..(410): xaa in position 410 is any amino acid
  Variant (415)..(416): xaa in position 415 to 416 is any amino acid
  Variant (419)..(419): xaa in position 419 is any amino acid
  Variant (430)..(431): xaa in position 430 to 431 is any amino acid
  Variant (433)..(433): xaa in position 433 is any amino acid
  Variant (436)..(441): xaa in position 436 to 441 is any amino acid
  Variant (446)..(452): xaa in position 446 to 452 is any amino acid
  Variant (453)..(459): xaa in position 453 to 459 is any or no amino acid
  Variant (461)..(462): xaa in position 461 to 462 is any amino acid
  Variant (464)..(473): xaa in position 464 to 473 is any amino acid
  Variant (474)..(480): xaa in position 474 to 480 is any or no amino acid
  Variant (484)..(484): xaa in position 484 is any amino acid
  Variant (490)..(490): xaa in position 490 is any amino acid
  Variant (492)..(493): xaa in position 492 to 493 is any amino acid

SEQ ID NO: 37929 - protein, 31 aa, Artificial sequence; identical to SEQ ID NO: 20133
  Variant (2)..(2): xaa in position 2 is any amino acid
  Variant (3)..(3): xaa in position 3 is any or no amino acid
  Variant (5)..(5): xaa in position 5 is Ile or Val
  Variant (8)..(8): xaa in position 8 is any amino acid
  Variant (10)..(11): xaa in position 10 to 11 is any amino acid
  Variant (12)..(12): xaa in position 12 is Ala, Ser or Thr
  Variant (13)..(14): xaa in position 13 to 14 is any amino acid
  Variant (15)..(15): xaa in position 15 is Ala or Gly
  Variant (16)..(16): xaa in position 16 is any amino acid
  Variant (17)..(17): xaa in position 17 is Asp, Glu, Gly, Asn, Ser or Thr
  Variant (18)..(27): xaa in position 18 to 27 is any amino acid
  Variant (29)..(30): xaa in position 29 to 30 is any amino acid
  Variant (31)..(31): xaa in position 31 is Ala or Gly

SEQ ID NO: 37930 - protein, 10 aa, Artificial sequence
  Variant (2)..(4): xaa in position 2 to 4 is any amino acid
  Variant (6)..(6): xaa in position 6 is Ala, Cys, Asn, Ser, Thr or Val
  Variant (7)..(8): xaa in position 7 to 8 is any amino acid
  Variant (10)..(10): xaa in position 10 is Ala, Cys, Asp, Gly, Asn or Ser
GXXXGXXXGX

SEQ ID NO: 37931 - protein, 45 aa, Artificial sequence; identical to SEQ ID NO: 20135
  Variant (2)..(5): xaa in position 2 to 5 is any amino acid
  Variant (6)..(6): xaa in position 6 is Asp or Asn
  Variant (7)..(7): xaa in position 7 is any amino acid
  Variant (8)..(8): xaa in position 8 is Ala, Gly, Ile, Leu, Pro or Val
  Variant (9)..(9): xaa in position 9 is Ala, Gly, Pro, Ser or Thr
  Variant (10)..(10): xaa in position 10 is Ala or Gly
  Variant (11)..(12): xaa in position 11 to 12 is any amino acid
  Variant (13)..(13): xaa in position 13 is Ala, Gly, Ser or Thr
  Variant (14)..(14): xaa in position 14 is Ile, Leu, Met or Val
  Variant (15)..(19): xaa in position 15 to 19 is any amino acid
  Variant (21)..(25): xaa in position 21 to 25 is any amino acid
  Variant (26)..(27): xaa in position 26 to 27 is any or no amino acid
  Variant (29)..(30): xaa in position 29 to 30 is any or no amino acid
  Variant (32)..(33): xaa in position 32 to 33 is Ala, Ser or Thr
  Variant (34)..(34): xaa in position 34 is Ala, Gly or Ser
  Variant (35)..(36): xaa in position 35 to 36 is any amino acid
  Variant (37)..(37): xaa in position 37 is Ala, Cys, Asn, Ser or Thr
  Variant (38)..(38): xaa in position 38 is Phe, Ile, Leu, Met or Val
  Variant (39)..(40): xaa in position 39 to 40 is any amino acid
  Variant (41)..(41): xaa in position 41 is Ala, Gly or Ser
  Variant (42)..(44): xaa in position 42 to 44 is any amino acid
  Variant (45)..(45): xaa in position 45 is Ile, Leu or Val

SEQ ID NO: 37932 - protein, 37 aa, Artificial sequence; identical to SEQ ID NO: 20136
  Variant (2)..(6): xaa in position 2 to 6 is any amino acid
  Variant (8)..(8): xaa in position 8 is Asp, Asn or Ser
  Variant (12)..(12): xaa in position 12 is Ile, Leu or Met
  Variant (13)..(13): xaa in position 13 is Ala, Gly or Ser
  Variant (14)..(14): xaa in position 14 is Asp, Glu or Gly
  Variant (16)..(16): xaa in position 16 is Ala, Cys, Gly or Ser
  Variant (17)..(17): xaa in position 17 is Ala or Gly
  Variant (18)..(18): xaa in position 18 is any amino acid
  Variant (19)..(19): xaa in position 19 is Phe, Ile, Leu, Met or Val
  Variant (20)..(20): xaa in position 20 is Ile, Leu, Met or Val
  Variant (21)..(21): xaa in position 21 is Phe, Ile, Leu, Met or Val
  Variant (23)..(23): xaa in position 23 is Ala, Asp, Glu, Ser or Thr
  Variant (24)..(26): xaa in position 24 to 26 is any amino acid
  Variant (28)..(29): xaa in position 28 to 29 is any amino acid
  Variant (31)..(31): xaa in position 31 is any amino acid
  Variant (33)..(33): xaa in position 33 is any amino acid
  Variant (34)..(34): xaa in position 34 is Ile, Pro or Val
  Variant (35)..(36): xaa in position 35 to 36 is any amino acid

SEQ ID NO: 37933 - protein, 23 aa, Artificial sequence
  Variant (2)..(2): xaa in position 2 is Ile, Leu or Val
  Variant (3)..(3): xaa in position 3 is Asn or Ser
  Variant (4)..(4): xaa in position 4 is Ala, Cys, Thr or Val
  Variant (6)..(6): xaa in position 6 is Ala or Gly
  Variant (7)..(7): xaa in position 7 is Ser or Thr
  Variant (8)..(8): xaa in position 8 is Ala, Gly or Ser
  Variant (10)..(11): xaa in position 10 to 11 is any amino acid
  Variant (12)..(12): xaa in position 12 is any or no amino acid
  Variant (14)..(15): xaa in position 14 to 15 is any amino acid
  Variant (17)..(18): xaa in position 17 to 18 is any amino acid
  Variant (19)..(22): xaa in position 19 to 22 is any or no amino acid
YXXXHXXXTXXXDXXEXXXXXXA

SEQ ID NO: 37934 - protein, 32 aa, Artificial sequence; identical to SEQ ID NO: 20138
  Variant (3)..(3): xaa in position 3 is Gly or Ser
  Variant (4)..(5): xaa in position 4 to 5 is any amino acid
  Variant (8)..(8): xaa in position 8 is any or no amino acid
  Variant (10)..(10): xaa in position 10 is any or no amino acid
  Variant (12)..(12): xaa in position 12 is Ala or Gly
  Variant (13)..(13): xaa in position 13 is Ala, Ser or Thr
  Variant (15)..(15): xaa in position 15 is Ala, Gly, Asn, Ser or Val
  Variant (16)..(16): xaa in position 16 is any amino acid
  Variant (18)..(30): xaa in position 18 to 30 is any amino acid
  Variant (31)..(31): xaa in position 31 is any or no amino acid

SEQ ID NO: 37935 - DNA, 216 bp, Escherichia coli; identical to SEQ ID NO: 17081
  CDS (1)..(216)

SEQ ID NO: 37936 - protein, 71 aa, Escherichia coli; identical to SEQ ID NO: 17082

SEQ ID NO: 37937 - DNA, 228 bp, Escherichia coli; identical to SEQ ID NO: 17083
  CDS (1)..(228): transl_table=11

SEQ ID NO: 37938 - protein, 75 aa, Escherichia coli; identical to SEQ ID NO: 17084

SEQ ID NO: 37939 - DNA, 210 bp, Shigella flexneri; identical to SEQ ID NO: 17085
  CDS (1)..(210): transl_table=11

SEQ ID NO: 37940 - protein, 69 aa, Shigella flexneri; identical to SEQ ID NO: 17086

SEQ ID NO: 37941 - DNA, 219 bp, Salmonella typhimurium LT2; identical to SEQ ID NO: 17087
  CDS (1)..(219): transl_table=11

SEQ ID NO: 37942 - protein, 72 aa, Salmonella typhimurium LT2; identical to SEQ ID NO: 17088

SEQ ID NO: 37943 - DNA, 231 bp, Salmonella typhimurium LT2; identical to SEQ ID NO: 17089
  CDS (1)..(231): transl_table=11

SEQ ID NO: 37944 - protein, 76 aa, Salmonella typhimurium LT2; identical to SEQ ID NO: 17090

SEQ ID NO: 37945 - DNA, 213 bp, Salmonella enterica subsp. enterica serovar Typhi str. CT18; identical to SEQ ID NO: 17091
  CDS (1)..(213): transl_table=11

SEQ ID NO: 37946 - protein, 70 aa, Salmonella enterica subsp. enterica serovar Typhi str. CT18; identical to SEQ ID NO: 17092

SEQ ID NO: 37947 - DNA, 231 bp, Escherichia coli CFT073; identical to SEQ ID NO: 17093
  CDS (1)..(231): transl_table=11

SEQ ID NO: 37948 - protein, 76 aa, Escherichia coli CFT073; identical to SEQ ID NO: 17094

SEQ ID NO: 37949 - DNA, 231 bp, Citrobacter freundii; identical to SEQ ID NO: 17095
  CDS (1)..(231): transl_table=11

SEQ ID NO: 37950 - protein, 76 aa, Citrobacter freundii; identical to SEQ ID NO: 17096

SEQ ID NO: 37951 - DNA, 210 bp, Escherichia coli; identical to SEQ ID NO: 17097
  CDS (1)..(210): transl_table=11

SEQ ID NO: 37952 - protein, 69 aa, Escherichia coli; identical to SEQ ID NO: 17098

SEQ ID NO: 37953 - DNA, 204 bp, Wigglesworthia glossinidia endosymbiont of Glossina brevipalpis; identical to SEQ ID NO: 17099
  CDS (1)..(204): transl_table=11

SEQ ID NO: 37954 - protein, 67 aa, Wigglesworthia glossinidia endosymbiont of Glossina brevipalpis; identical to SEQ ID NO: 17100

SEQ ID NO: 37955 - DNA, 204 bp, Photorhabdus luminescens subsp. laumondii TTO1; identical to SEQ ID NO: 17101
  CDS (1)..(204): transl_table=11

SEQ ID NO: 37956 - protein, 67 aa, Photorhabdus luminescens subsp. laumondii TTO1; identical to SEQ ID NO: 17102

SEQ ID NO: 37957 - DNA, 213 bp, Serratia marcescens; identical to SEQ ID NO: 17103
  CDS (1)..(213): transl_table=11

SEQ ID NO: 37958 - protein, 70 aa, Serratia marcescens; identical to SEQ ID NO: 17104

SEQ ID NO: 37959 - DNA, 231 bp, Erwinia amylovora; identical to SEQ ID NO: 17105
  CDS (1)..(231): transl_table=11

SEQ ID NO: 37960 - protein, 76 aa, Erwinia amylovora; identical to SEQ ID NO: 17106

SEQ ID NO: 37961 - DNA, 204 bp, Klebsiella pneumoniae; identical to SEQ ID NO: 17107
  CDS (1)..(204): transl_table=11

SEQ ID NO: 37962 - protein, 67 aa, Klebsiella pneumoniae; identical to SEQ ID NO: 17108

SEQ ID NO: 37963 - DNA, 210 bp, Escherichia coli O157:H7; identical to SEQ ID NO: 17109
  CDS (1)..(210): transl_table=11

SEQ ID NO: 37964 - protein, 69 aa, Escherichia coli O157:H7; identical to SEQ ID NO: 17110

SEQ ID NO: 37965 - DNA, 204 bp, Erwinia carotovora subsp. atroseptica SCRI1043; identical to SEQ ID NO: 17111
  CDS (1)..(204)

SEQ ID NO: 37966 - protein, 67 aa, Erwinia carotovora subsp. atroseptica SCRI1043; identical to SEQ ID NO: 17112

SEQ ID NO: 37967 - DNA, 210 bp, Escherichia coli; identical to SEQ ID NO: 17113
  CDS (1)..(210): transl_table=11

SEQ ID NO: 37968 - protein, 69 aa, Escherichia coli; identical to SEQ ID NO: 17114

SEQ ID NO: 37969 - DNA, 285 bp, Salmonella enterica subsp. enterica serovar Choleraesuis str; identical to SEQ ID NO: 17115
  CDS (1)..(285): transl_table=11

SEQ ID NO: 37970 - protein, 94 aa, Salmonella enterica subsp. enterica serovar Choleraesuis str; identical to SEQ ID NO: 17116

SEQ ID NO: 37971 - DNA, 210 bp, Escherichia coli; identical to SEQ ID NO: 17117
  CDS (1)..(210): transl_table=11

SEQ ID NO: 37972 - protein, 69 aa, Escherichia coli; identical to SEQ ID NO: 17118

SEQ ID NO: 37973 - DNA, 387 bp, Escherichia coli; identical to SEQ ID NO: 17119
  CDS (1)..(387): transl_table=11

SEQ ID NO: 37974 - protein, 128 aa, Escherichia coli; identical to SEQ ID NO: 17120

SEQ ID NO: 37975 - DNA, 210 bp, Escherichia coli; identical to SEQ ID NO: 17121
  CDS (1)..(210): transl_table=11

SEQ ID NO: 37976 - protein, 69 aa, Escherichia coli; identical to SEQ ID NO: 17122

SEQ ID NO: 37977 - DNA, 219 bp, Escherichia coli; identical to SEQ ID NO: 17123
  CDS (1)..(219): transl_table=11

SEQ ID NO: 37978 - protein, 72 aa, Escherichia coli; identical to SEQ ID NO: 17124

SEQ ID NO: 37979 - DNA, 216 bp, Salmonella paratyphi; identical to SEQ ID NO: 17125
  CDS (1)..(216): transl_table=11

SEQ ID NO: 37980 - protein, 71 aa, Salmonella paratyphi; identical to SEQ ID NO: 17126

SEQ ID NO: 37981 - DNA, 204 bp, Yersinia enterocolitica; identical to SEQ ID NO: 17127
  CDS (1)..(204): transl_table=11

SEQ ID NO: 37982 - protein, 67 aa, Yersinia enterocolitica; identical to SEQ ID NO: 17128

SEQ ID NO: 37983 - DNA, 26 bp, Artificial sequence
  (1)..(26): primer
atgactgttcaggactacttattaaa

SEQ ID NO: 37984 - DNA, 23 bp, Artificial sequence
  (1)..(23): primer
ttattggacatagtgccagacgg

SEQ ID NO: 37985 - protein, 72 aa, Artificial sequence; identical to SEQ ID NO: 17131
  Variant (4)..(4): xaa in position 4 is any amino acid
  Variant (29)..(29): xaa in position 29 is any amino acid
  Variant (34)..(35): xaa in position 34 to 35 is any or no amino acid
  Variant (39)..(39): xaa in position 39 is any amino acid
  Variant (54)..(54): xaa in position 54 is any amino acid
  Variant (55)..(57): xaa in position 55 to 57 is any or no amino acid
  Variant (65)..(65): xaa in position 65 is any amino acid

SEQ ID NO: 37986 - protein, 10 aa, Artificial sequence
  Variant (2)..(2): xaa in position 2 is Lys or Arg
  Variant (3)..(3): xaa in position 3 is any amino acid
  Variant (4)..(4): xaa in position 4 is Gln, Ser or Thr
  Variant (5)..(5): xaa in position 5 is Ser or Thr
  Variant (6)..(6): xaa in position 6 is any amino acid
  Variant (7)..(7): xaa in position 7 is Asp, Glu or Asn
  Variant (8)..(8): xaa in position 8 is Ser or Thr
RXXXXXXXLE

SEQ ID NO: 37987 - protein, 8 aa, Artificial sequence
  Variant (2)..(2): xaa in position 2 is Ala or Val
  Variant (6)..(6): xaa in position 6 is any amino acid
AXDHRXAE

SEQ ID NO: 37988 - protein, 5 aa, Artificial sequence
  Variant (2)..(2): xaa in position 2 is any amino acid
  Variant (3)..(3): xaa in position 3 is Ala, Gly, Ser, Thr or Val
PXXVW

SEQ ID NO: 37989 - DNA, 582 bp, Escherichia coli K12; identical to SEQ ID NO: 20184
  CDS (1)..(582): transl_table=11

SEQ ID NO: 37990 - protein, 193 aa, Escherichia coli K12; identical to SEQ ID NO: 20185

SEQ ID NO: 37991 - DNA, 603 bp, Thermotoga maritima MSB8; identical to SEQ ID NO: 20186
  CDS (1)..(603): transl_table=11

SEQ ID NO: 37992 - protein, 200 aa, Thermotoga maritima MSB8; identical to SEQ ID NO: 20187

SEQ ID NO: 37993 - DNA, 642 bp, Vibrio cholerae O1 biovar eltor str. N16961; identical to SEQ ID NO: 20188
  CDS (1)..(642): transl_table=11

SEQ ID NO: 37994 - protein, 213 aa, Vibrio cholerae O1 biovar eltor str. N16961; identical to SEQ ID NO: 20189

SEQ ID NO: 37995 - DNA, 729 bp, Pasteurella multocida subsp. multocida str. Pm70; identical to SEQ ID NO: 20190
  CDS (1)..(729): transl_table=11

SEQ ID NO: 37996 - protein, 242 aa, Pasteurella multocida subsp. multocida str. Pm70; identical to SEQ ID NO: 20191

SEQ ID NO: 37997 - DNA, 669 bp, Clostridium perfringens str. 13; identical to SEQ ID NO: 20192
  CDS (1)..(669): transl_table=11

SEQ ID NO: 37998 - protein, 222 aa, Clostridium perfringens str. 13; identical to SEQ ID NO: 20193

SEQ ID NO: 37999 - DNA, 576 bp, Clostridium perfringens str. 13; identical to SEQ ID NO: 20194
  CDS (1)..(576): transl_table=11

SEQ ID NO: 38000 - protein, 191 aa, Clostridium perfringens str. 13; identical to SEQ ID NO: 20195

SEQ ID NO: 38001 - DNA, 585 bp, Fusobacterium nucleatum subsp. nucleatum ATCC 25586; identical to SEQ ID NO: 20196
  CDS (1)..(585): transl_table=11

SEQ ID NO: 38002 - protein, 194 aa, Fusobacterium nucleatum subsp. nucleatum ATCC 25586; identical to SEQ ID NO: 20197

SEQ ID NO: 38003 - DNA, 618 bp, Fusobacterium nucleatum subsp. nucleatum ATCC 25586; identical to SEQ ID NO: 20198
  CDS (1)..(618): transl_table=11

SEQ ID NO: 38004 - protein, 205 aa, Fusobacterium nucleatum subsp. nucleatum ATCC 25586; identical to SEQ ID NO: 20199

SEQ ID NO: 38005 - DNA, 642 bp, Methanosarcina acetivorans C2A; identical to SEQ ID NO: 20200
  CDS (1)..(642): transl_table=11

SEQ ID NO: 38006 - protein, 213 aa, Methanosarcina acetivorans C2A; identical to SEQ ID NO: 20201

SEQ ID NO: 38007 - DNA, 600 bp, Methanosarcina acetivorans C2A; identical to SEQ ID NO: 20202
  CDS (1)..(600): transl_table=11

SEQ ID NO: 38008 - protein, 199 aa, Methanosarcina acetivorans C2A; identical to SEQ ID NO: 20203

SEQ ID NO: 38009 - DNA, 603 bp, Yersinia pestis KIM; identical to SEQ ID NO: 20204
  CDS (1)..(603): transl_table=11

SEQ ID NO: 38010 - protein, 200 aa, Yersinia pestis KIM; identical to SEQ ID NO: 20205

SEQ ID NO: 38011 - DNA, 645 bp, Yersinia pestis KIM; identical to SEQ ID NO: 20206
  CDS (1)..(645): transl_table=11

SEQ ID NO: 38012 - protein, 214 aa, Yersinia pestis KIM; identical to SEQ ID NO: 20207

SEQ ID NO: 38013 - DNA, 624 bp, Yersinia pestis KIM; identical to SEQ ID NO: 20208
  CDS (1)..(624): transl_table=11

SEQ ID NO: 38014 - protein, 207 aa, Yersinia pestis KIM; identical to SEQ ID NO: 20209

SEQ ID NO: 38015 - DNA, 696 bp, Shigella flexneri 2a str. 301; identical to SEQ ID NO: 20210
  CDS (1)..(696): transl_table=11

SEQ ID NO: 38016 - protein, 231 aa, Shigella flexneri 2a str. 301; identical to SEQ ID NO: 20211

SEQ ID NO: 38017 - DNA, 621 bp, Shewanella oneidensis MR-1; identical to SEQ ID NO: 20212
  CDS (1)..(621): transl_table=11

SEQ ID NO: 38018 - protein, 206 aa, Shewanella oneidensis MR-1; identical to SEQ ID NO: 20213

SEQ ID NO: 38019 - DNA, 609 bp, Shewanella oneidensis MR-1; identical to SEQ ID NO: 20214
  CDS (1)..(609): transl_table=11

SEQ ID NO: 38020 - protein, 202 aa, Shewanella oneidensis MR-1; identical to SEQ ID NO: 20215

SEQ ID NO: 38021 - DNA, 633 bp, Shewanella oneidensis MR-1; identical to SEQ ID NO: 20216
  CDS (1)..(633): transl_table=11

SEQ ID NO: 38022 - protein, 210 aa, Shewanella oneidensis MR-1; identical to SEQ ID NO: 20217

SEQ ID NO: 38023 - DNA, 609 bp, Shewanella oneidensis MR-1; identical to SEQ ID NO: 20218
  CDS (1)..(609): transl_table=11

SEQ ID NO: 38024 - protein, 202 aa, Shewanella oneidensis MR-1; identical to SEQ ID NO: 20219

SEQ ID NO: 38025 - DNA, 579 bp, Shewanella oneidensis MR-1; identical to SEQ ID NO: 20220
  CDS (1)..(579): transl_table=11

SEQ ID NO: 38026 - protein, 192 aa, Shewanella oneidensis MR-1; identical to SEQ ID NO: 20221

SEQ ID NO: 38027 - DNA, 699 bp, Shewanella oneidensis MR-1; identical to SEQ ID NO: 20222
  CDS (1)..(699): transl_table=11

SEQ ID NO: 38028 - protein, 232 aa, Shewanella oneidensis MR-1; identical to SEQ ID NO: 20223

SEQ ID NO: 38029 - DNA, 549 bp, Pseudomonas putida KT2440; identical to SEQ ID NO: 20224
  CDS (1)..(549): transl_table=11

SEQ ID NO: 38030 - protein, 182 aa, Pseudomonas putida KT2440; identical to SEQ ID NO: 20225

SEQ ID NO: 38031 - DNA, 603 bp, Clostridium tetani E88; identical to SEQ ID NO: 20226
  CDS (1)..(603): transl_table=11

SEQ ID NO: 38032 - protein, 200 aa, Clostridium tetani E88; identical to SEQ ID NO: 20227

SEQ ID NO: 38033 - DNA, 576 bp, Clostridium tetani E88; identical to SEQ ID NO: 20228
  CDS (1)..(576): transl_table=11

SEQ ID NO: 38034 - protein, 191 aa, Clostridium tetani E88; identical to SEQ ID NO: 20229

SEQ ID NO: 38035 - DNA, 639 bp, Vibrio parahaemolyticus RIMD 2210633; identical to SEQ ID NO: 20230
  CDS (1)..(639): transl_table=11

SEQ ID NO: 38036 - protein, 212 aa, Vibrio parahaemolyticus RIMD 2210633; identical to SEQ ID NO: 20231

SEQ ID NO: 38037 - DNA, 585 bp, Bacteroides thetaiotaomicron VPI-5482; identical to SEQ ID NO: 20232
  CDS (1)..(585): transl_table=11

SEQ ID NO: 38038 - protein, 194 aa, Bacteroides thetaiotaomicron VPI-5482; identical to SEQ ID NO: 20233

SEQ ID NO: 38039 - DNA, 573 bp, Bacteroides thetaiotaomicron VPI-5482; identical to SEQ ID NO: 20234
  CDS (1)..(573): transl_table=11

SEQ ID NO: 38040 - protein, 190 aa, Bacteroides thetaiotaomicron VPI-5482; identical to SEQ ID NO: 20235

SEQ ID NO: 38041 - DNA, 627 bp, Bacteroides thetaiotaomicron VPI-5482; identical to SEQ ID NO: 20236
  CDS (1)..(627): transl_table=11

SEQ ID NO: 38042 - protein, 208 aa, Bacteroides thetaiotaomicron VPI-5482; identical to SEQ ID NO: 20237

SEQ ID NO: 38043 - DNA, 642 bp, Bacteroides thetaiotaomicron VPI-5482; identical to SEQ ID NO: 20238
  CDS (1)..(642): transl_table=11

SEQ ID NO: 38044 - protein, 213 aa, Bacteroides thetaiotaomicron VPI-5482; identical to SEQ ID NO: 20239

SEQ ID NO: 38045 - DNA, 696 bp, Shigella flexneri 2a str. 2457T; identical to SEQ ID NO: 20240
  CDS (1)..(696): transl_table=11

SEQ ID NO: 38046 - protein, 231 aa, Shigella flexneri 2a str. 2457T; identical to SEQ ID NO: 20241

SEQ ID NO: 38047 - DNA, 609 bp, Nitrosomonas europaea ATCC 19718; identical to SEQ ID NO: 20242
  CDS (1)..(609): transl_table=11

SEQ ID NO: 38048 - protein, 202 aa, Nitrosomonas europaea ATCC 19718; identical to SEQ ID NO: 20243

SEQ ID NO: 38049 - DNA, 672 bp, Nitrosomonas europaea ATCC 19718; identical to SEQ ID NO: 20244
  CDS (1)..(672): transl_table=11

SEQ ID NO: 38050 - protein, 223 aa, Nitrosomonas europaea ATCC 19718; identical to SEQ ID NO: 20245

SEQ ID NO: 38051 - DNA, 627 bp, Rhodopirellula baltica SH 1; identical to SEQ ID NO: 20246
  CDS (1)..(627): transl_table=11

SEQ ID NO: 38052 - protein, 208 aa, Rhodopirellula baltica SH 1; identical to SEQ ID NO: 20247

SEQ ID NO: 38053 - DNA, 642 bp, Rhodopirellula baltica SH 1; identical to SEQ ID NO: 20248
  CDS (1)..(642): transl_table=11

SEQ ID NO: 38054 - protein, 213 aa, Rhodopirellula baltica SH 1; identical to SEQ ID NO: 20249

SEQ ID NO: 38055 - DNA, 591 bp, Porphyromonas gingivalis W83; identical to SEQ ID NO: 20250
  CDS (1)..(591): transl_table=11

SEQ ID NO: 38056 - protein, 196 aa, Porphyromonas gingivalis W83; identical to SEQ ID NO: 20251

SEQ ID NO: 38057 - DNA, 573 bp, Porphyromonas gingivalis W83; identical to SEQ ID NO: 20252
  CDS (1)..(573): transl_table=11

SEQ ID NO: 38058 - protein, 190 aa, Porphyromonas gingivalis W83; identical to SEQ ID NO: 20253

SEQ ID NO: 38059 - DNA, 615 bp, Porphyromonas gingivalis W83; identical to SEQ ID NO: 20254
  CDS (1)..(615): transl_table=11

SEQ ID NO: 38060 - protein, 204 aa, Porphyromonas gingivalis W83; identical to SEQ ID NO: 20255

SEQ ID NO: 38061 - DNA, 630 bp, Porphyromonas gingivalis W83; identical to SEQ ID NO: 20256
  CDS (1)..(630): transl_table=11

SEQ ID NO: 38062 - protein, 209 aa, Porphyromonas gingivalis W83; identical to SEQ ID NO: 20257

SEQ ID NO: 38063 - DNA, 630 bp, Photorhabdus luminescens subsp. laumondii TTO1; identical to SEQ ID NO: 20258
  CDS (1)..(630): transl_table=11

SEQ ID NO: 38064 - protein, 209 aa, Photorhabdus luminescens subsp. laumondii TTO1; identical to SEQ ID NO: 20259

SEQ ID NO: 38065 - DNA, 597 bp, Photorhabdus luminescens subsp. laumondii TTO1; identical to SEQ ID NO: 20260
  CDS (1)..(597): transl_table=11

SEQ ID NO: 38066 - protein, 198 aa, Photorhabdus luminescens subsp. laumondii TTO1; identical to SEQ ID NO: 20261

SEQ ID NO: 38067 - DNA, 582 bp, Photorhabdus luminescens subsp. laumondii TTO1; identical to SEQ ID NO: 20262
  CDS (1)..(582): transl_table=11

SEQ ID NO: 38068 - protein, 193 aa, Photorhabdus luminescens subsp. laumondii TTO1; identical to SEQ ID NO: 20263

SEQ ID NO: 38069 - DNA, 699 bp, Photorhabdus luminescens subsp. laumondii TTO1; identical to SEQ ID NO: 20264
  CDS (1)..(699): transl_table=11

SEQ ID NO: 38070 - protein, 232 aa, Photorhabdus luminescens subsp. laumondii TTO1; identical to SEQ ID NO: 20265

SEQ ID NO: 38071 - DNA, 705 bp, Vibrio vulnificus YJ016; identical to SEQ ID NO: 20266
  CDS (1)..(705): transl_table=11

SEQ ID NO: 38072 - protein, 234 aa, Vibrio vulnificus YJ016; identical to SEQ ID NO: 20267

SEQ ID NO: 38073 - DNA, 639 bp, Vibrio vulnificus YJ016; identical to SEQ ID NO: 20268
  CDS (1)..(639): transl_table=11

SEQ ID NO: 38074 - protein, 212 aa, Vibrio vulnificus YJ016; identical to SEQ ID NO: 20269

SEQ ID NO: 38075 - DNA, 573 bp, Treponema denticola ATCC 35405; identical to SEQ ID NO: 20270
  CDS (1)..(573): transl_table=11

SEQ ID NO: 38076 - protein, 190 aa, Treponema denticola ATCC 35405; identical to SEQ ID NO: 20271

SEQ ID NO: 38077 - DNA, 660 bp, Treponema denticola ATCC 35405; identical to SEQ ID NO: 20272
  CDS (1)..(660): transl_table=11

SEQ ID NO: 38078 - protein, 219 aa, Treponema denticola ATCC 35405; identical to SEQ ID NO: 20273

SEQ ID NO: 38079 - DNA, 744 bp, Parachlamydia sp. UWE25; identical to SEQ ID NO: 20274
  CDS (1)..(744): transl_table=11

SEQ ID NO: 38080 - protein, 247 aa, Parachlamydia sp. UWE25; identical to SEQ ID NO: 20275

SEQ ID NO: 38081 - DNA, 636 bp, Parachlamydia sp. UWE25; identical to SEQ ID NO: 20276
  CDS (1)..(636): transl_table=11

SEQ ID NO: 38082 - protein, 211 aa, Parachlamydia sp. UWE25; identical to SEQ ID NO: 20277

SEQ ID NO: 38083 - DNA, 576 bp, Desulfovibrio vulgaris subsp. vulgaris str. Hildenborough; identical to SEQ ID NO: 20278
  CDS (1)..(576): transl_table=11

SEQ ID NO: 38084 - protein, 191 aa, Desulfovibrio vulgaris subsp. vulgaris str. Hildenborough; identical to SEQ ID NO: 20279

SEQ ID NO: 38085 - DNA, 582 bp, Erwinia carotovora subsp. atroseptica SCRI1043; identical to SEQ ID NO: 20280
  CDS (1)..(582): transl_table=11

SEQ ID NO: 38086 - protein, 193 aa, Erwinia carotovora subsp. atroseptica SCRI1043; identical to SEQ ID NO: 20281

SEQ ID NO: 38087 - DNA, 624 bp, Desulfotalea psychrophila LSv54; identical to SEQ ID NO: 20282
  CDS (1)..(624): transl_table=11

SEQ ID NO: 38088 - protein, 207 aa, Desulfotalea psychrophila LSv54; identical to SEQ ID NO: 20283

SEQ ID NO: 38089 - DNA, 609 bp, Desulfotalea psychrophila LSv54; identical to SEQ ID NO: 20284
  CDS (1)..(609): transl_table=11

SEQ ID NO: 38090 - protein, 202 aa, Desulfotalea psychrophila LSv54; identical to SEQ ID NO: 20285

SEQ ID NO: 38091 - DNA, 597 bp, Yersinia pseudotuberculosis IP 32953; identical to SEQ ID NO: 20286
  CDS (1)..(597): transl_table=11

SEQ ID NO: 38092 - protein, 198 aa, Yersinia pseudotuberculosis IP 32953; identical to SEQ ID NO: 20287

SEQ ID NO: 38093 - DNA, 702 bp, Yersinia pseudotuberculosis IP 32953; identical to SEQ ID NO: 20288
  CDS (1)..(702): transl_table=11

SEQ ID NO: 38094 - protein, 233 aa, Yersinia pseudotuberculosis IP 32953; identical to SEQ ID NO: 20289

SEQ ID NO: 38095 - DNA, 708 bp, Symbiobacterium thermophilum IAM 14863; identical to SEQ ID NO: 20290
  CDS (1)..(708): transl_table=11

SEQ ID NO: 38096 - protein, 235 aa, Symbiobacterium thermophilum IAM 14863; identical to SEQ ID NO: 20291

SEQ ID NO: 38097 - DNA, 588 bp, Symbiobacterium thermophilum IAM 14863; identical to SEQ ID NO: 20292
  CDS (1)..(588): transl_table=11

SEQ ID NO: 38098 - protein, 195 aa, Symbiobacterium thermophilum IAM 14863; identical to SEQ ID NO: 20293

SEQ ID NO: 38099 - DNA, 597 bp, Mannheimia succiniciproducens MBEL55E; identical to SEQ ID NO: 20294
  CDS (1)..(597): transl_table=11

SEQ ID NO: 38100 - protein, 198 aa, Mannheimia succiniciproducens MBEL55E; identical to SEQ ID NO: 20295

SEQ ID NO: 38101 - DNA, 624 bp, Mannheimia succiniciproducens MBEL55E; identical to SEQ ID NO: 20296
  CDS (1)..(624): transl_table=11

SEQ ID NO: 38102 - protein, 207 aa, Mannheimia succiniciproducens MBEL55E; identical to SEQ ID NO: 20297

SEQ ID NO: 38103 - DNA, 648 bp, Mannheimia succiniciproducens MBEL55E; identical to SEQ ID NO: 20298
  CDS (1)..(648): transl_table=11

SEQ ID NO: 38104 - protein, 215 aa, Mannheimia succiniciproducens MBEL55E; identical to SEQ ID NO: 20299

SEQ ID NO: 38105 - DNA, 630 bp, Mannheimia succiniciproducens MBEL55E; identical to SEQ ID NO: 20300
  CDS (1)..(630): transl_table=11

SEQ ID NO: 38106 - protein, 209 aa, Mannheimia succiniciproducens MBEL55E; identical to SEQ ID NO: 20301

SEQ ID NO: 38107 - DNA, 609 bp, Methylococcus capsulatus str. Bath; identical to SEQ ID NO: 20302
  CDS (1)..(609): transl_table=11

SEQ ID NO: 38108 - protein, 202 aa, Methylococcus capsulatus str. Bath; identical to SEQ ID NO: 20303

SEQ ID NO: 38109 - DNA, 660 bp, Methylococcus capsulatus str. Bath; identical to SEQ ID NO: 20304
  CDS (1)..(660): transl_table=11

SEQ ID NO: 38110 - protein, 219 aa, Methylococcus capsulatus str. Bath; identical to SEQ ID NO: 20305

SEQ ID NO: 38111 - DNA, 687 bp, Methylococcus capsulatus str. Bath; identical to SEQ ID NO: 20306
  CDS (1)..(687): transl_table=11

SEQ ID NO: 38112 - protein, 228 aa, Methylococcus capsulatus str. Bath; identical to SEQ ID NO: 20307

SEQ ID NO: 38113 - DNA, 582 bp, Methylococcus capsulatus str. Bath; identical to SEQ ID NO: 20308
  CDS (1)..(582): transl_table=11

SEQ ID NO: 38114 - protein, 193 aa, Methylococcus capsulatus str. Bath; identical to SEQ ID NO: 20309

SEQ ID NO: 38115 - DNA, 582 bp, Methylococcus capsulatus str. Bath; identical to SEQ ID NO: 20310
  CDS (1)..(582): transl_table=11

SEQ ID NO: 38116 - protein, 193 aa, Methylococcus capsulatus str. Bath; identical to SEQ ID NO: 20311

SEQ ID NO: 38117 - DNA, 702 bp, Methylococcus capsulatus str. Bath; identical to SEQ ID NO: 20312
  CDS (1)..(702): transl_table=11

SEQ ID NO: 38118 - protein, 233 aa, Methylococcus capsulatus str. Bath; identical to SEQ ID NO: 20313

SEQ ID NO: 38119 - DNA, 633 bp, Photobacterium profundum SS9; identical to SEQ ID NO: 20314
  CDS (1)..(633): transl_table=11

SEQ ID NO: 38120 - protein, 210 aa, Photobacterium profundum SS9; identical to SEQ ID NO: 20315

SEQ ID NO: 38121 - DNA, 597 bp, Photobacterium profundum SS9; identical to SEQ ID NO: 20316
  CDS (1)..(597): transl_table=11

SEQ ID NO: 38122 - protein, 198 aa, Photobacterium profundum SS9; identical to SEQ ID NO: 20317

SEQ ID NO: 38123 - DNA, 582 bp, Photobacterium profundum SS9; identical to SEQ ID NO: 20318
  CDS (1)..(582): transl_table=11

SEQ ID NO: 38124 - protein, 193 aa, Photobacterium profundum SS9; identical to SEQ ID NO: 20319

SEQ ID NO: 38125 - DNA, 702 bp, Photobacterium profundum SS9; identical to SEQ ID NO: 20320
  CDS (1)..(702): transl_table=11

SEQ ID NO: 38126 - protein, 233 aa, Photobacterium profundum SS9; identical to SEQ ID NO: 20321

SEQ ID NO: 38127 - DNA, 609 bp, Idiomarina loihiensis L2TR; identical to SEQ ID NO: 20322
  CDS (1)..(609): transl_table=11

SEQ ID NO: 38128 - protein, 202 aa, Idiomarina loihiensis L2TR; identical to SEQ ID NO: 20323

SEQ ID NO: 38129 - DNA, 633 bp, Idiomarina loihiensis L2TR; identical to SEQ ID NO: 20324
  CDS (1)..(633): transl_table=11

SEQ ID NO: 38130 - protein, 210 aa, Idiomarina loihiensis L2TR; identical to SEQ ID NO: 20325

SEQ ID NO: 38131 - DNA, 582 bp, Idiomarina loihiensis L2TR; identical to SEQ ID NO: 20326
  CDS (1)..(582): transl_table=11

SEQ ID NO: 38132 - protein, 193 aa, Idiomarina loihiensis L2TR; identical to SEQ ID NO: 20327

SEQ ID NO: 38133 - DNA, 681 bp, Idiomarina loihiensis L2TR; identical to SEQ ID NO: 20328
  CDS (1)..(681): transl_table=11

SEQ ID NO: 38134 - protein, 226 aa, Idiomarina loihiensis L2TR; identical to SEQ ID NO: 20329

SEQ ID NO: 38135 - DNA, 582 bp, Azoarcus sp. EbN1; identical to SEQ ID NO: 20330
  CDS (1)..(582): transl_table=11

SEQ ID NO: 38136 - protein, 193 aa, Azoarcus sp. EbN1; identical to SEQ ID NO: 20331

SEQ ID NO: 38137 - DNA, 585 bp, Azoarcus sp. EbN1; identical to SEQ ID NO: 20332
  CDS (1)..(585): transl_table=11

SEQ ID NO: 38138 - protein, 194 aa, Azoarcus sp. EbN1; identical to SEQ ID NO: 20333

SEQ ID NO: 38139 - DNA, 582 bp, Zymomonas mobilis subsp. mobilis ZM4; identical to SEQ ID NO: 20334
  CDS (1)..(582): transl_table=11

SEQ ID NO: 38140 - protein, 193 aa, Zymomonas mobilis subsp. mobilis ZM4; identical to SEQ ID NO: 20335

SEQ ID NO: 38141 - DNA, 654 bp, Silicibacter pomeroyi DSS-3; identical to SEQ ID NO: 20336
  CDS (1)..(654): transl_table=11

SEQ ID NO: 38142 - protein, 217 aa, Silicibacter pomeroyi DSS-3; identical to SEQ ID NO: 20337

SEQ ID NO: 38143 - DNA, 609 bp, Silicibacter pomeroyi DSS-3; identical to SEQ ID NO: 20338
  CDS (1)..(609): transl_table=11

SEQ ID NO: 38144 - protein, 202 aa, Silicibacter pomeroyi DSS-3; identical to SEQ ID NO: 20339

SEQ ID NO: 38145 - DNA, 633 bp, Vibrio fischeri ES114; identical to SEQ ID NO: 20340
  CDS (1)..(633): transl_table=11

SEQ ID NO: 38146 - protein, 210 aa, Vibrio fischeri ES114; identical to SEQ ID NO: 20341

SEQ ID NO: 38147 - DNA, 684 bp, Vibrio fischeri ES114; identical to SEQ ID NO: 20342
  CDS (1)..(684): transl_table=11

SEQ ID NO: 38148 - protein, 227 aa, Vibrio fischeri ES114; identical to SEQ ID NO: 20343

SEQ ID NO: 38149 - DNA, 582 bp, Vibrio fischeri ES114; identical to SEQ ID NO: 20344
  CDS (1)..(582): transl_table=11

SEQ ID NO: 38150 - protein, 193 aa, Vibrio fischeri ES114; identical to SEQ ID NO: 20345

SEQ ID NO: 38151 - DNA, 594 bp, Neisseria gonorrhoeae FA 1090; identical to SEQ ID NO: 20346
  CDS (1)..(594): transl_table=11

SEQ ID NO: 38152 - protein, 197 aa, Neisseria gonorrhoeae FA 1090; identical to SEQ ID NO: 20347

SEQ ID NO: 38153 - DNA, 633 bp, Bacteroides fragilis NCTC 9343; identical to SEQ ID NO: 20348
  CDS (1)..(633): transl_table=11

SEQ ID NO: 38154 - protein, 210 aa, Bacteroides fragilis NCTC 9343; identical to SEQ ID NO: 20349

SEQ ID NO: 38155 - DNA, 627 bp, Bacteroides fragilis NCTC 9343; identical to SEQ ID NO: 20350
  CDS (1)..(627): transl_table=11

SEQ ID NO: 38156 - protein, 208 aa, Bacteroides fragilis NCTC 9343; identical to SEQ ID NO: 20351

SEQ ID NO: 38157 - DNA, 573 bp, Bacteroides fragilis NCTC 9343; identical to SEQ ID NO: 20352
  CDS (1)..(573): transl_table=11

SEQ ID NO: 38158 - protein, 190 aa, Bacteroides fragilis NCTC 9343; identical to SEQ ID NO: 20353

SEQ ID NO: 38159 - DNA, 588 bp, Bacteroides fragilis NCTC 9343; identical to SEQ ID NO: 20354
  CDS (1)..(588): transl_table=11

SEQ ID NO: 38160 - protein, 195 aa, Bacteroides fragilis NCTC 9343; identical to SEQ ID NO: 20355

SEQ ID NO: 38161 - DNA, 642 bp, Chlamydophila abortus S26/3; identical to SEQ ID NO: 20356
  CDS (1)..(642): transl_table=11

SEQ ID NO: 38162 - protein, 213 aa, Chlamydophila abortus S26/3; identical to SEQ ID NO: 20357

SEQ ID NO: 38163 - DNA, 597 bp, Haemophilus influenzae 86-028NP; identical to SEQ ID NO: 20358
  CDS (1)..(597): transl_table=11

SEQ ID NO: 38164 - protein, 198 aa, Haemophilus influenzae 86-028NP; identical to SEQ ID NO: 20359

SEQ ID NO: 38165 - DNA, 579 bp, Haemophilus influenzae 86-028NP; identical to SEQ ID NO: 20360
  CDS (1)..(579): transl_table=11

SEQ ID NO: 38166 - protein, 192 aa, Haemophilus influenzae 86-028NP; identical to SEQ ID NO: 20361

SEQ ID NO: 38167 - DNA, 708 bp, Haemophilus influenzae 86-028NP; identical to SEQ ID NO: 20362
  CDS (1)..(708): transl_table=11

SEQ ID NO: 38168 - protein, 235 aa, Haemophilus influenzae 86-028NP; identical to SEQ ID NO: 20363

SEQ ID NO: 38169 - DNA, 582 bp, Pseudomonas fluorescens Pf-5; identical to SEQ ID NO: 20364
  CDS (1)..(582): transl_table=11

SEQ ID NO: 38170 - protein, 193 aa, Pseudomonas fluorescens Pf-5; identical to SEQ ID NO: 20365

SEQ ID NO: 38171 - DNA, 672 bp, Psychrobacter arcticum 273-4; identical to SEQ ID NO: 20366
  CDS (1)..(672): transl_table=11

SEQ ID NO: 38172 - protein, 223 aa, Psychrobacter arcticum 273-4; identical to SEQ ID NO: 20367

SEQ ID NO: 38173 - DNA, 609 bp, Psychrobacter arcticum 273-4; identical to SEQ ID NO: 20368
  CDS (1)..(609): transl_table=11

SEQ ID NO: 38174 - protein, 202 aa, Psychrobacter arcticum 273-4; identical to SEQ ID NO: 20369

SEQ ID NO: 38175 - DNA, 624 bp, Colwellia psychrerythraea 34H; identical to SEQ ID NO: 20370
  CDS (1)..(624): transl_table=11

SEQ ID NO: 38176 - protein, 207 aa, Colwellia psychrerythraea 34H; identical to SEQ ID NO: 20371

SEQ ID NO: 38177 - DNA, 624 bp, Colwellia psychrerythraea 34H; identical to SEQ ID NO: 20372
  CDS (1)..(624): transl_table=11

SEQ ID NO: 38178 - protein, 207 aa, Colwellia psychrerythraea 34H; identical to SEQ ID NO: 20373

SEQ ID NO: 38179 - DNA, 792 bp, Colwellia psychrerythraea 34H; identical to SEQ ID NO: 20374
  CDS (1)..(792): transl_table=11

SEQ ID NO: 38180 - protein, 263 aa, Colwellia psychrerythraea 34H; identical to SEQ ID NO: 20375

SEQ ID NO: 38181 - DNA, 582 bp, Colwellia psychrerythraea 34H; identical to SEQ ID NO: 20376
  CDS (1)..(582): transl_table=11

SEQ ID NO: 38182 - protein, 193 aa, Colwellia psychrerythraea 34H; identical to SEQ ID NO: 20377

SEQ ID NO: 38183 - DNA, 693 bp, Dechloromonas aromatica RCB; identical to SEQ ID NO: 20378
  CDS (1)..(693): transl_table=11

SEQ ID NO: 38184 - protein, 230 aa, Dechloromonas aromatica RCB; identical to SEQ ID NO: 20379

SEQ ID NO: 38185 - DNA, 585 bp, Dechloromonas aromatica RCB; identical to SEQ ID NO: 20380
  CDS (1)..(585): transl_table=11

SEQ ID NO: 38186 - protein, 194 aa, Dechloromonas aromatica RCB; identical to SEQ ID NO: 20381

SEQ ID NO: 38187 - DNA, 675 bp, Dechloromonas aromatica RCB; identical to SEQ ID NO: 20382
  CDS (1)..(675): transl_table=11

SEQ ID NO: 38188 - protein, 224 aa, Dechloromonas aromatica RCB; identical to SEQ ID NO: 20383

SEQ ID NO: 38189 - DNA, 582 bp, Dechloromonas aromatica RCB; identical to SEQ ID NO: 20384
  CDS (1)..(582): transl_table=11

SEQ ID NO: 38190 - protein, 193 aa, Dechloromonas aromatica RCB; identical to SEQ ID NO: 20385

SEQ ID NO: 38191 - DNA, 576 bp, Thiobacillus denitrificans ATCC 25259; identical to SEQ ID NO: 20386
  CDS (1)..(576): transl_table=11

SEQ ID NO: 38192 - protein, 191 aa, Thiobacillus denitrificans ATCC 25259; identical to SEQ ID NO: 20387

SEQ ID NO: 38193 - DNA, 678 bp, Thiobacillus denitrificans ATCC 25259; identical to SEQ ID NO: 20388
  CDS (1)..(678): transl_table=11

SEQ ID NO: 38194 - protein, 225 aa, Thiobacillus denitrificans ATCC 25259; identical to SEQ ID NO: 20389

SEQ ID NO: 38195 - DNA, 570 bp, Pseudomonas fluorescens PfO-1; identical to SEQ ID NO: 20390
  CDS (1)..(570)

SEQ ID NO: 38196 - protein, 189 aa, Pseudomonas fluorescens PfO-1; identical to SEQ ID NO: 20391

SEQ ID NO: 38197 - DNA, 711 bp, Microbulbifer degradans 2-40; identical to SEQ ID NO: 20392
  CDS (1)..(711)

SEQ ID NO: 38198 - protein, 236 aa, Microbulbifer degradans 2-40; identical to SEQ ID NO: 20393

SEQ ID NO: 38199 - DNA, 714 bp, Azotobacter vinelandii AvOP; identical to SEQ ID NO: 20394
  CDS (1)..(714): transl_table=11

SEQ ID NO: 38200 - protein, 237 aa, Azotobacter vinelandii AvOP; identical to SEQ ID NO: 20395

SEQ ID NO: 38201 - DNA, 579 bp, Shewanella baltica OS155; identical to SEQ ID NO: 20396
  CDS (1)..(579): transl_table=11

SEQ ID NO: 38202 - protein, 192 aa, Shewanella baltica OS155; identical to SEQ ID NO: 20397

SEQ ID NO: 38203 - DNA, 627 bp, Shewanella amazonensis SB2B; identical to SEQ ID NO: 20398
  CDS (1)..(627): transl_table=11

SEQ ID NO: 38204 - protein, 208 aa, Shewanella amazonensis SB2B; identical to SEQ ID NO: 20399

SEQ ID NO: 38205 - DNA, 654 bp, Silicibacter sp. TM1040; identical to SEQ ID NO: 20400
  CDS (1)..(654): transl_table=11

SEQ ID NO: 38206 - protein, 217 aa, Silicibacter sp. TM1040; identical to SEQ ID NO: 20401

SEQ ID NO: 38207 - DNA, 579 bp, Shewanella denitrificans OS-217; identical to SEQ ID NO: 20402
  CDS (1)..(579): transl_table=11

SEQ ID NO: 38208 - protein, 192 aa, Shewanella denitrificans OS-217; identical to SEQ ID NO: 20403

SEQ ID NO: 38209 - DNA, 585 bp, Ectothiorhodospira halophila; identical to SEQ ID NO: 20404
  CDS (1)..(585): transl_table=11

SEQ ID NO: 38210 - protein, 194 aa, Ectothiorhodospira halophila; identical to SEQ ID NO: 20405

SEQ ID NO: 38211 - DNA, 573 bp, Pseudomonas stutzeri; identical to SEQ ID NO: 20406
  CDS (1)..(573): transl_table=11

SEQ ID NO: 38212 - protein, 190 aa, Pseudomonas stutzeri; identical to SEQ ID NO: 20407

SEQ ID NO: 38213 - DNA, 642 bp, Chlamydophila caviae; identical to SEQ ID NO: 20408
  CDS (1)..(642): transl_table=11

SEQ ID NO: 38214 - protein, 213 aa, Chlamydophila caviae; identical to SEQ ID NO: 20409

SEQ ID NO: 38215 - DNA, 642 bp, Chlamydia muridarum; identical to SEQ ID NO: 20410
  CDS (1)..(642): transl_table=11

SEQ ID NO: 38216 - protein, 213 aa, Chlamydia muridarum; identical to SEQ ID NO: 20411

SEQ ID NO: 38217 - DNA, 642 bp, Chlamydia pneumoniae; identical to SEQ ID NO: 20412
  CDS (1)..(642): transl_table=11

SEQ ID NO: 38218 - protein, 213 aa, Chlamydia pneumoniae; identical to SEQ ID NO: 20413

SEQ ID NO: 38219 - DNA, 642 bp, Chlamydia trachomatis; identical to SEQ ID NO: 20414
  CDS (1)..(642): transl_table=11

SEQ ID NO: 38220 - protein, 213 aa, Chlamydia trachomatis; identical to SEQ ID NO: 20415

SEQ ID NO: 38221 - DNA, 624 bp, Haemophilus ducreyi; identical to SEQ ID NO: 20416
  CDS (1)..(624): transl_table=11

SEQ ID NO: 38222 - protein, 207 aa, Haemophilus ducreyi; identical to SEQ ID NO: 20417

SEQ ID NO: 38223 - DNA, 627 bp, Haemophilus influenzae; identical to SEQ ID NO: 20418
  CDS (1)..(627): transl_table=11

SEQ ID NO: 38224 - protein, 208 aa, Haemophilus influenzae; identical to SEQ ID NO: 20419

SEQ ID NO: 38225 - DNA, 627 bp, Neisseria meningitidis serogroup A; identical to SEQ ID NO: 20420
  CDS (1)..(627): transl_table=11

SEQ ID NO: 38226 - protein, 208 aa, Neisseria meningitidis serogroup A; identical to SEQ ID NO: 20421

SEQ ID NO: 38227 - DNA, 627 bp, Neisseria meningitidis serogroup B; identical to SEQ ID NO: 20422
  CDS (1)..(627): transl_table=11

SEQ ID NO: 38228 - protein, 208 aa, Neisseria meningitidis serogroup B; identical to SEQ ID NO: 20423

SEQ ID NO: 38229 - DNA, 627 bp, Pasteurella multocida; identical to SEQ ID NO: 20424
  CDS (1)..(627): transl_table=11

SEQ ID NO: 38230 - protein, 208 aa, Pasteurella multocida; identical to SEQ ID NO: 20425

SEQ ID NO: 38231 - DNA, 675 bp, Pseudomonas aeruginosa; identical to SEQ ID NO: 20426
  CDS (1)..(675): transl_table=11

SEQ ID NO: 38232 - protein, 224 aa, Pseudomonas aeruginosa; identical to SEQ ID NO: 20427

SEQ ID NO: 38233 - DNA, 633 bp, Vibrio alginolyticus; identical to SEQ ID NO: 20428
  CDS (1)..(633)

SEQ ID NO: 38234 - protein, 210 aa, Vibrio alginolyticus; identical to SEQ ID NO: 20429

SEQ ID NO: 38235 - DNA, 633 bp, Vibrio anguillarum; identical to SEQ ID NO: 20430
  CDS (1)..(633): transl_table=11

SEQ ID NO: 38236 - protein, 210 aa, Vibrio anguillarum; identical to SEQ ID NO: 20431

SEQ ID NO: 38237 - DNA, 633 bp, Vibrio cholerae; identical to SEQ ID NO: 20432
  CDS (1)..(633): transl_table=11

SEQ ID NO: 38238 - protein, 210 aa, Vibrio cholerae; identical to SEQ ID NO: 20433

SEQ ID NO: 38239 - DNA, 633 bp, Vibrio harveyi; identical to SEQ ID NO: 20434
  CDS (1)..(633): transl_table=11

SEQ ID NO: 38240 - protein, 210 aa, Vibrio harveyi; identical to SEQ ID NO: 20435

SEQ ID NO: 38241 - DNA, 633 bp, Vibrio parahaemolyticus; identical to SEQ ID NO: 20436
  CDS (1)..(633): transl_table=11

SEQ ID NO: 38242 - protein, 210 aa, Vibrio parahaemolyticus; identical to SEQ ID NO: 20437

SEQ ID NO: 38243 - DNA, 633 bp, Vibrio vulnificus; identical to SEQ ID NO: 20438
  CDS (1)..(633): transl_table=11

SEQ ID NO: 38244 - protein, 210 aa, Vibrio vulnificus; identical to SEQ ID NO: 20439

SEQ ID NO: 38245 - DNA, 633 bp, Vibrio vulnificus; identical to SEQ ID NO: 20440
  CDS (1)..(633): transl_table=11

SEQ ID NO: 38246 - protein, 210 aa, Vibrio vulnificus; identical to SEQ ID NO: 20441

SEQ ID NO: 38247 - DNA, 630 bp, Yersinia pestis; identical to SEQ ID NO: 20442
  CDS (1)..(630): transl_table=11

SEQ ID NO: 38248 - protein, 209 aa, Yersinia pestis; identical to SEQ ID NO: 20443

SEQ ID NO: 38249 - DNA, 795 bp, Chlamydophila caviae; identical to SEQ ID NO: 20444
  CDS (1)..(795): transl_table=11

SEQ ID NO: 38250 - protein, 264 aa, Chlamydophila caviae; identical to SEQ ID NO: 20445

SEQ ID NO: 38251 - DNA, 735 bp, Chlamydia muridarum; identical to SEQ ID NO: 20446
  CDS (1)..(735): transl_table=11

SEQ ID NO: 38252 - protein, 244 aa, Chlamydia muridarum; identical to SEQ ID NO: 20447

SEQ ID NO: 38253 - DNA, 771 bp, Chlamydia pneumoniae; identical to SEQ ID NO: 20448
  CDS (1)..(771): transl_table=11

SEQ ID NO: 38254 - protein, 256 aa, Chlamydia pneumoniae; identical to SEQ ID NO: 20449

SEQ ID NO: 38255 - DNA, 735 bp, Chlamydia trachomatis; identical to SEQ ID NO: 20450
  CDS (1)..(735): transl_table=11

SEQ ID NO: 38256 - protein, 244 aa, Chlamydia trachomatis; identical to SEQ ID NO: 20451

SEQ ID NO: 38257 - DNA, 597 bp, Haemophilus ducreyi; identical to SEQ ID NO: 20452
  CDS (1)..(597): transl_table=11

SEQ ID NO: 38258 - protein, 198 aa, Haemophilus ducreyi; identical to SEQ ID NO: 20453

SEQ ID NO: 38259 - DNA, 597 bp, Haemophilus influenzae; identical to SEQ ID NO: 20454
  CDS (1)..(597): transl_table=11

SEQ ID NO: 38260 - protein, 198 aa, Haemophilus influenzae; identical to SEQ ID NO: 20455

SEQ ID NO: 38261 - DNA, 594 bp, Neisseria meningitidis serogroup A; identical to SEQ ID NO: 20456
  CDS (1)..(594): transl_table=11

SEQ ID NO: 38262 - protein, 197 aa, Neisseria meningitidis serogroup A; identical to SEQ ID NO: 20457

SEQ ID NO: 38263 - DNA, 594 bp, Neisseria meningitidis serogroup B; identical to SEQ ID NO: 20458
  CDS (1)..(594): transl_table=11

SEQ ID NO: 38264 - protein, 197 aa, Neisseria meningitidis serogroup B; identical to SEQ ID NO: 20459

SEQ ID NO: 38265 - DNA, 597 bp, Pasteurella multocida; identical to SEQ ID NO: 20460
  CDS (1)..(597): transl_table=11

SEQ ID NO: 38266 - protein, 198 aa, Pasteurella multocida; identical to SEQ ID NO: 20461

SEQ ID NO: 38267 - DNA, 609 bp, Pseudomonas aeruginosa; identical to SEQ ID NO: 20462
  CDS (1)..(609): transl_table=11

SEQ ID NO: 38268 - protein, 202 aa, Pseudomonas aeruginosa; identical to SEQ ID NO: 20463

SEQ ID NO: 38269 - DNA, 597 bp, Vibrio alginolyticus; identical to SEQ ID NO: 20464
  CDS (1)..(597): transl_table=11

SEQ ID NO: 38270 - protein, 198 aa, Vibrio alginolyticus; identical to SEQ ID NO: 20465

SEQ ID NO: 38271 - DNA, 597 bp, Vibrio anguillarum; identical to SEQ ID NO: 20466
  CDS (1)..(597): transl_table=11

SEQ ID NO: 38272 - protein, 198 aa, Vibrio anguillarum; identical to SEQ ID NO: 20467

SEQ ID NO: 38273 - DNA, 597 bp, Vibrio cholerae; identical to SEQ ID NO: 20468
  CDS (1)..(597): transl_table=11

SEQ ID NO: 38274 - protein, 198 aa, Vibrio cholerae [sequence omitted]

SEQ ID NO: 38275 - DNA, 597 bp, Vibrio harveyi; identical to SEQ ID NO: 20470
  CDS (1)..(597): transl_table=11

SEQ ID NO: 38276 - protein, 198 aa, Vibrio harveyi; identical to SEQ ID NO: 20471

SEQ ID NO: 38277 - DNA, 597 bp, Vibrio parahaemolyticus; identical to SEQ ID NO: 20472
  CDS (1)..(597): transl_table=11

SEQ ID NO: 38278 - protein, 198 aa, Vibrio parahaemolyticus; identical to SEQ ID NO: 20473

SEQ ID NO: 38279 - DNA, 597 bp, Vibrio vulnificus; identical to SEQ ID NO: 20474
  CDS (1)..(597): transl_table=11

SEQ ID NO: 38280 - protein, 198 aa, Vibrio vulnificus; identical to SEQ ID NO: 20475

SEQ ID NO: 38281 - DNA, 600 bp, Yersinia pestis; identical to SEQ ID NO: 20476
  CDS (1)..(600): transl_table=11

SEQ ID NO: 38282 - protein, 199 aa, Yersinia pestis; identical to SEQ ID NO: 20477

SEQ ID NO: 38283 - DNA, 582 bp, Buchnera aphidicola subsp; identical to SEQ ID NO: 20478
  CDS (1)..(582): transl_table=11

SEQ ID NO: 38284 - protein, 193 aa, Buchnera aphidicola subsp; identical to SEQ ID NO: 20479

SEQ ID NO: 38285 - DNA, 582 bp, Buchnera aphidicola subsp; identical to SEQ ID NO: 20480
  CDS (1)..(582): transl_table=11

SEQ ID NO: 38286 - protein, 193 aa, Buchnera aphidicola subsp; identical to SEQ ID NO: 20481

SEQ ID NO: 38287 - DNA, 585 bp, Buchnera aphidicola subsp; identical to SEQ ID NO: 20482
  CDS (1)..(585): transl_table=11

SEQ ID NO: 38288 - protein, 194 aa, Buchnera aphidicola subsp; identical to SEQ ID NO: 20483

SEQ ID NO: 38289 - DNA, 582 bp, Haemophilus ducreyi; identical to SEQ ID NO: 20484
  CDS (1)..(582): transl_table=11

SEQ ID NO: 38290 - protein, 193 aa, Haemophilus ducreyi; identical to SEQ ID NO: 20485

SEQ ID NO: 38291 - DNA, 579 bp, Haemophilus influenzae; identical to SEQ ID NO: 20486
  CDS (1)..(579): transl_table=11

SEQ ID NO: 38292 - protein, 192 aa, Haemophilus influenzae; identical to SEQ ID NO: 20487

SEQ ID NO: 38293 - DNA, 579 bp, Pasteurella multocida; identical to SEQ ID NO: 20488
  CDS (1)..(579): transl_table=11

SEQ ID NO: 38294 - protein, 192 aa, Pasteurella multocida; identical to SEQ ID NO: 20489

SEQ ID NO: 38295 - DNA, 585 bp, Pseudomonas aeruginosa; identical to SEQ ID NO: 20490
  CDS (1)..(585): transl_table=11

SEQ ID NO: 38296 - protein, 194 aa, Pseudomonas aeruginosa; identical to SEQ ID NO: 20491

SEQ ID NO: 38297 - DNA, 582 bp, Rhodobacter capsulatus; identical to SEQ ID NO: 20492
  CDS (1)..(582): transl_table=11

SEQ ID NO: 38298 - protein, 193 aa, Rhodobacter capsulatus; identical to SEQ ID NO: 20493

SEQ ID NO: 38299 - DNA, 717 bp, Azotobacter vinelandii; identical to SEQ ID NO: 20494
  CDS (1)..(717): transl_table=11

SEQ ID NO: 38300 - protein, 238 aa, Azotobacter vinelandii; identical to SEQ ID NO: 20495

SEQ ID NO: 38301 - DNA, 672 bp, Buchnera aphidicola subsp; identical to SEQ ID NO: 20496
  CDS (1)..(672): transl_table=11

SEQ ID NO: 38302 - protein, 223 aa, Buchnera aphidicola subsp; identical to SEQ ID NO: 20497

SEQ ID NO: 38303 - DNA, 726 bp, Buchnera aphidicola subsp; identical to SEQ ID NO: 20498
  CDS (1)..(726): transl_table=11

SEQ ID NO: 38304 - protein, 241 aa, Buchnera aphidicola subsp; identical to SEQ ID NO: 20499

SEQ ID NO: 38305 - DNA, 696 bp, Escherichia coli O157; identical to SEQ ID NO: 20500
  CDS (1)..(696): transl_table=11

SEQ ID NO: 38306 - protein, 231 aa, Escherichia coli O157; identical to SEQ ID NO: 20501

SEQ ID NO: 38307 - DNA, 696 bp, Escherichia coli O6; identical to SEQ ID NO: 20502
  CDS (1)..(696): transl_table=11

SEQ ID NO: 38308 - protein, 231 aa, Escherichia coli O6; identical to SEQ ID NO: 20503

SEQ ID NO: 38309 - DNA, 696 bp, Escherichia coli; identical to SEQ ID NO: 20504
  CDS (1)..(696): transl_table=11

SEQ ID NO: 38310 - protein, 231 aa, Escherichia coli; identical to SEQ ID NO: 20505

SEQ ID NO: 38311 - DNA, 684 bp, Haemophilus ducreyi; identical to SEQ ID NO: 20506
  CDS (1)..(684): transl_table=11

SEQ ID NO: 38312 - protein, 227 aa, Haemophilus ducreyi; identical to SEQ ID NO: 20507

SEQ ID NO: 38313 - DNA, 708 bp, Haemophilus influenzae; identical to SEQ ID NO: 20508
  CDS (1)..(708): transl_table=11

SEQ ID NO: 38314 - protein, 235 aa, Haemophilus influenzae; identical to SEQ ID NO: 20509

SEQ ID NO: 38315 - DNA, 723 bp, Pseudomonas aeruginosa; identical to SEQ ID NO: 20510
  CDS (1)..(723): transl_table=11

SEQ ID NO: 38316 - protein, 240 aa, Pseudomonas aeruginosa; identical to SEQ ID NO: 20511

SEQ ID NO: 38317 - DNA, 726 bp, Pseudomonas stutzeri; identical to SEQ ID NO: 20512
  CDS (1)..(726): transl_table=11

SEQ ID NO: 38318 - protein, 241 aa, Pseudomonas stutzeri; identical to SEQ ID NO: 20513

SEQ ID NO: 38319 - DNA, 732 bp, Rhodobacter capsulatus; identical to SEQ ID NO: 20514
  CDS (1)..(732): transl_table=11

SEQ ID NO: 38320 - protein, 243 aa, Rhodobacter capsulatus; identical to SEQ ID NO: 20515

SEQ ID NO: 38321 - DNA, 693 bp, Salmonella choleraesuis; identical to SEQ ID NO: 20516
  CDS (1)..(693): transl_table=11

SEQ ID NO: 38322 - protein, 230 aa, Salmonella choleraesuis; identical to SEQ ID NO: 20517

SEQ ID NO: 38323 - DNA, 693 bp, Salmonella paratyphi; identical to SEQ ID NO: 20518
  CDS (1)..(693): transl_table=11

SEQ ID NO: 38324 - protein, 230 aa, Salmonella paratyphi; identical to SEQ ID NO: 20519

SEQ ID NO: 38325 - DNA, 693 bp, Vibrio cholerae; identical to SEQ ID NO: 20520
  CDS (1)..(693): transl_table=11

SEQ ID NO: 38326 - protein, 230 aa, Vibrio cholerae; identical to SEQ ID NO: 20521

SEQ ID NO: 38327 - DNA, 693 bp, Vibrio parahaemolyticus; identical to SEQ ID NO: 20522
  CDS (1)..(693): transl_table=11

SEQ ID NO: 38328 - protein, 230 aa, Vibrio parahaemolyticus; identical to SEQ ID NO: 20523

SEQ ID NO: 38329 - DNA, 693 bp, Vibrio vulnificus; identical to SEQ ID NO: 20524
  CDS (1)..(693): transl_table=11

SEQ ID NO: 38330 - protein, 230 aa, Vibrio vulnificus; identical to SEQ ID NO: 20525

SEQ ID NO: 38331 - DNA, 702 bp, Yersinia pestis; identical to SEQ ID NO: 20526
  CDS (1)..(702): transl_table=11

SEQ ID NO: 38332 - protein, 233 aa, Yersinia pestis; identical to SEQ ID NO: 20527

SEQ ID NO: 38333 - DNA, 25 bp, Artificial sequence
  (1)..(25): primer
atgactgactacctgttactgtttg

SEQ ID NO: 38334 - DNA, 25 bp, Artificial sequence
  (1)..(25): primer
ttacaacttcaccaaaccactaaag

SEQ ID NO: 38335 - protein, 232 aa, Artificial sequence; identical to SEQ ID NO: 20530
  Variant (2)..(5): xaa in position 2 to 5 is any amino acid
  Variant (7)..(9): xaa in position 7 to 9 is any amino acid
  Variant (11)..(15): xaa in position 11 to 15 is any amino acid
  Variant (16)..(16): xaa in position 16 is any or no amino acid
  Variant (21)..(22): xaa in position 21 to 22 is any amino acid
  Variant (27)..(29): xaa in position 27 to 29 is any amino acid
  Variant (30)..(33): xaa in position 30 to 33 is any or no amino acid
  Variant (35)..(36): xaa in position 35 to 36 is any or no amino acid
  Variant (41)..(43): xaa in position 41 to 43 is any amino acid
  Variant (45)..(53): xaa in position 45 to 53 is any amino acid
  Variant (56)..(58): xaa in position 56 to 58 is any amino acid
  Variant (60)..(62): xaa in position 60 to 62 is any amino acid
  Variant (63)..(87): xaa in position 63 to 87 is any or no amino acid
  Variant (89)..(93): xaa in position 89 to 93 is any amino acid
  Variant (95)..(95): xaa in position 95 is any amino acid
  Variant (99)..(100): xaa in position 99 to 100 is any amino acid
  Variant (102)..(103): xaa in position 102 to 103 is any amino acid
  Variant (106)..(107): xaa in position 106 to 107 is any amino acid
  Variant (109)..(114): xaa in position 109 to 114 is any amino acid
  Variant (116)..(116): xaa in position 116 is any amino acid
  Variant (117)..(118): xaa in position 117 to 118 is any or no amino acid
  Variant (120)..(120): xaa in position 120 is any amino acid
  Variant (124)..(124): xaa in position 124 is any amino acid
  Variant (127)..(128): xaa in position 127 to 128 is any amino acid
  Variant (131)..(131): xaa in position 131 is any amino acid
  Variant (135)..(147): xaa in position 135 to 147 is any amino acid
  Variant (148)..(158): xaa in position 148 to 158 is any or no amino acid
  Variant (160)..(160): xaa in position 160 is any amino acid
  Variant (162)..(162): xaa in position 162 is any amino acid
  Variant (164)..(166): xaa in position 164 to 166 is any amino acid
  Variant (171)..(173): xaa in position 171 to 173 is any amino acid
  Variant (176)..(177): xaa in position 176 to 177 is any amino acid
  Variant (179)..(179): xaa in position 179 is any amino acid
  Variant (183)..(183): xaa in position 183 is any amino acid
  Variant (185)..(188): xaa in position 185 to 188 is any amino acid
  Variant (189)..(203): xaa in position 189 to 203 is any or no amino acid
  Variant (205)..(219): xaa in position 205 to 219 is any amino acid
  Variant (220)..(220): xaa in position 220 is any or no amino acid
  Variant (222)..(224): xaa in position 222 to 224 is any amino acid
  Variant (227)..(231): xaa in position 227 to 231 is any amino acid

SEQ ID NO: 38336 - protein, 30 aa, Artificial sequence; identical to SEQ ID NO: 20531
  Variant (2)..(4): xaa in position 2 to 4 is any or no amino acid
  Variant (7)..(7): xaa in position 7 is Ile, Leu, Met or Val
  Variant (9)..(9): xaa in position 9 is Pro, Ser or Thr
  Variant (10)..(10): xaa in position 10 is any amino acid
  Variant (11)..(11): xaa in position 11 is Leu or Met
  Variant (12)..(12): xaa in position 12 is Ala or Gly
  Variant (13)..(13): xaa in position 13 is any amino acid
  Variant (14)..(14): xaa in position 14 is Ser or Thr
  Variant (15)..(18): xaa in position 15 to 18 is any amino acid
  Variant (19)..(19): xaa in position 19 is Asn, Ser, Thr or Val
  Variant (20)..(20): xaa in position 20 is Ala, Gly, Ser or Thr
  Variant (21)..(22): xaa in position 21 to 22 is any amino acid
  Variant (23)..(23): xaa in position 23 is Leu or Met
  Variant (24)..(24): xaa in position 24 is Ala, Cys, Gly, Ser or Thr
  Variant (25)..(25): xaa in position 25 is any amino acid
  Variant (26)..(26): xaa in position 26 is Ala, Cys, Gly, Ser or Thr
  Variant (27)..(29): xaa in position 27 to 29 is any amino acid
  Variant (30)..(30): xaa in position 30 is Ala, Ile, Leu or Val

SEQ ID NO: 38337 - protein, 38 aa, Artificial sequence; identical to SEQ ID NO: 20532
  Variant (3)..(4): xaa in position 3 to 4 is any amino acid
  Variant (6)..(8): xaa in position 6 to 8 is any amino acid
  Variant (9)..(9): xaa in position 9 is Asp, Glu or Gln
  Variant (10)..(11): xaa in position 10 to 11 is any amino acid
  Variant (12)..(12): xaa in position 12 is Phe, Ile, Leu, Met or Val
  Variant (13)..(18): xaa in position 13 to 18 is any amino acid
  Variant (19)..(19): xaa in position 19 is Ile, Leu, Met or Val
  Variant (20)..(22): xaa in position 20 to 22 is any amino acid
  Variant (24)..(24): xaa in position 24 is Gly or Ser
  Variant (25)..(25): xaa in position 25 is Ile, Leu or Val
  Variant (26)..(26): xaa in position 26 is Phe or Tyr
  Variant (27)..(27): xaa in position 27 is Ile, Leu or Val
  Variant (28)..(28): xaa in position 28 is Ala, Gly, Pro or Ser
  Variant (30)..(30): xaa in position 30 is Ile or Leu
  Variant (31)..(31): xaa in position 31 is any amino acid
  Variant (32)..(32): xaa in position 32 is Thr or Val
  Variant (35)..(35): xaa in position 35 is any amino acid
  Variant (36)..(36): xaa in position 36 is Ile or Val
  Variant (37)..(37): xaa in position 37 is Phe, Ile, Leu, Met or Val
  Variant (38)..(38): xaa in position 38 is Ala or Gly

SEQ ID NO: 38338 - protein, 14 aa, Artificial sequence
  Variant (2)..(4): xaa in position 2 to 4 is any amino acid
  Variant (5)..(5): xaa in position 5 is Ala, Ile or Val
  Variant (6)..(6): xaa in position 6 is Ile, Leu or Met
  Variant (7)..(8): xaa in position 7 to 8 is any amino acid
  Variant (9)..(9): xaa in position 9 is Phe, Ile, Leu, Met or Val
  Variant (10)..(10): xaa in position 10 is Ala, Gly or Ser
  Variant (11)..(12): xaa in position 11 to 12 is any amino acid
GXXXXXXXXXXXRE

SEQ ID NO: 38339 - DNA, 294 bp, Escherichia coli K12; identical to SEQ ID NO: 18672
  CDS (1)..(294): transl_table=11

SEQ ID NO: 38340 - protein, 97 aa, Escherichia coli K12; identical to SEQ ID NO: 18673

SEQ ID NO: 38341 - DNA, 300 bp, Mesorhizobium loti MAFF303099; identical to SEQ ID NO: 18674
  CDS (1)..(300): transl_table=11

SEQ ID NO: 38342 - protein, 99 aa, Mesorhizobium loti MAFF303099; identical to SEQ ID NO: 18675

SEQ ID NO: 38343 - DNA, 273 bp, Thermoplasma volcanium GSS1; identical to SEQ ID NO: 18676
  CDS (1)..(273): transl_table=11

SEQ ID NO: 38344 - protein, 90 aa, Thermoplasma volcanium GSS1; identical to SEQ ID NO: 18677

SEQ ID NO: 38345 - DNA, 279 bp, Thermotoga maritima MSB8; identical to SEQ ID NO: 18678
  CDS (1)..(279): transl_table=11

SEQ ID NO: 38346 - protein, 92 aa, Thermotoga maritima MSB8; identical to SEQ ID NO: 18679

SEQ ID NO: 38347 - DNA, 297 bp, Escherichia coli O157:H7; identical to SEQ ID NO: 18680
  CDS (1)..(297): transl_table=11

SEQ ID NO: 38348 - protein, 98 aa, Escherichia coli O157:H7; identical to SEQ ID NO: 18681

SEQ ID NO: 38349 - DNA, 282 bp, Sulfolobus tokodaii str. 7; identical to SEQ ID NO: 18682
  CDS (1)..(282): transl_table=11

SEQ ID NO: 38350 - protein, 93 aa, Sulfolobus tokodaii str. 7; identical to SEQ ID NO: 18683

SEQ ID NO: 38351 - DNA, 273 bp, Thermoplasma acidophilum DSM 1728; identical to SEQ ID NO: 18684
  CDS (1)..(273): transl_table=11

SEQ ID NO: 38352 - protein, 90 aa, Thermoplasma acidophilum DSM 1728; identical to SEQ ID NO: 18685

SEQ ID NO: 38353 - DNA, 291 bp, Pyrobaculum aerophilum str. IM2; identical to SEQ ID NO: 18686
  CDS (1)..(291): transl_table=11

SEQ ID NO: 38354 - protein, 96 aa, Pyrobaculum aerophilum str. IM2; identical to SEQ ID NO: 18687

SEQ ID NO: 38355 - DNA, 285 bp, Fusobacterium nucleatum subsp. nucleatum ATCC 25586; identical to SEQ ID NO: 18688
  CDS (1)..(285): transl_table=11

SEQ ID NO: 38356 - protein, 94 aa, Fusobacterium nucleatum subsp. nucleatum ATCC 25586; identical to SEQ ID NO: 18689

SEQ ID NO: 38357 - DNA, 297 bp, Shigella flexneri 2a str. 301; identical to SEQ ID NO: 18690
  CDS (1)..(297): transl_table=11

SEQ ID NO: 38358 - protein, 98 aa, Shigella flexneri 2a str. 301; identical to SEQ ID NO: 18691

SEQ ID NO: 38359 - DNA, 297 bp, Escherichia coli CFT073; identical to SEQ ID NO: 18692
  CDS (1)..(297): transl_table=11

SEQ ID NO: 38360 - protein, 98 aa, Escherichia coli CFT073; identical to SEQ ID NO: 18693

SEQ ID NO: 38361 - DNA, 297 bp, Rhodopseudomonas palustris CGA009; identical to SEQ ID NO: 18694
  CDS (1)..(297): transl_table=11

SEQ ID NO: 38362 - protein, 98 aa, Rhodopseudomonas palustris CGA009; identical to SEQ ID NO: 18695

SEQ ID NO: 38363 - DNA, 294 bp, Salmonella enterica subsp. enterica serovar Choleraesuis str; identical to SEQ ID NO: 18696
  CDS (1)..(294): transl_table=11

SEQ ID NO: 38364 - protein, 97 aa, Salmonella enterica subsp. enterica serovar Choleraesuis str; identical to SEQ ID NO: 18697

SEQ ID NO: 38365 - DNA, 291 bp, Sulfolobus acidocaldarius DSM 639; identical to SEQ ID NO: 18698
  CDS (1)..(291): transl_table=11

SEQ ID NO: 38366 - protein, 96 aa, Sulfolobus acidocaldarius DSM 639; identical to SEQ ID NO: 18699

SEQ ID NO: 38367 - DNA, 297 bp, Shigella sonnei Ss046; identical to SEQ ID NO: 18700
  CDS (1)..(297): transl_table=11

SEQ ID NO: 38368 - protein, 98 aa, Shigella sonnei Ss046; identical to SEQ ID NO: 18701

SEQ ID NO: 38369 - DNA, 291 bp, Rhodospirillum rubrum; identical to SEQ ID NO: 18702
  CDS (1)..(291)

SEQ ID NO: 38370 - protein, 96 aa, Rhodospirillum rubrum; identical to SEQ ID NO: 18703

SEQ ID NO: 38371 - DNA, 300 bp, Burkholderia fungorum LB400; identical to SEQ ID NO: 18704
  CDS (1)..(300)

SEQ ID NO: 38372 - protein, 99 aa, Burkholderia fungorum LB400; identical to SEQ ID NO: 18705

SEQ ID NO: 38373 - DNA, 285 bp, Azotobacter vinelandii AvOP; identical to SEQ ID NO: 18706
  CDS (1)..(285): transl_table=11

SEQ ID NO: 38374 - protein, 94 aa, Azotobacter vinelandii AvOP; identical to SEQ ID NO: 18707

SEQ ID NO: 38375 - DNA, 300 bp, Burkholderia vietnamiensis G4; identical to SEQ ID NO: 18708
  CDS (1)..(300): transl_table=11

SEQ ID NO: 38376 - protein, 99 aa, Burkholderia vietnamiensis G4; identical to SEQ ID NO: 18709

SEQ ID NO: 38377 - DNA, 282 bp, Desulfitobacterium hafniense DCB-2; identical to SEQ ID NO: 18710
  CDS (1)..(282): transl_table=11

SEQ ID NO: 38378 - protein, 93 aa, Desulfitobacterium hafniense DCB-2; identical to SEQ ID NO: 18711

SEQ ID NO: 38379 - DNA, 279 bp, Desulfitobacterium hafniense DCB-2; identical to SEQ ID NO: 18712
  CDS (1)..(279): transl_table=11

SEQ ID NO: 38380 - protein, 92 aa, Desulfitobacterium hafniense DCB-2; identical to SEQ ID NO: 18713

SEQ ID NO: 38381 - DNA, 297 bp, Desulfitobacterium hafniense DCB-2; identical to SEQ ID NO: 18714
  CDS (1)..(297): transl_table=11

SEQ ID NO: 38382 - protein, 98 aa, Desulfitobacterium hafniense DCB-2; identical to SEQ ID NO: 18715

SEQ ID NO: 38383 - DNA, 288 bp, Desulfitobacterium hafniense DCB-2; identical to SEQ ID NO: 18716
  CDS (1)..(288): transl_table=11

SEQ ID NO: 38384 - protein, 95 aa, Desulfitobacterium hafniense DCB-2; identical to SEQ ID NO: 18717

SEQ ID NO: 38385 - DNA, 279 bp, Moorella thermoacetica ATCC 39073; identical to SEQ ID NO: 18718
  CDS (1)..(279): transl_table=11

SEQ ID NO: 38386 - protein, 92 aa, Moorella thermoacetica ATCC 39073; identical to SEQ ID NO: 18719

SEQ ID NO: 38387 - DNA, 285 bp, Syntrophomonas wolfei str. Goettingen; identical to SEQ ID NO: 18720
  CDS (1)..(285): transl_table=11

SEQ ID NO: 38388 - protein, 94 aa, Syntrophomonas wolfei str. Goettingen; identical to SEQ ID NO: 18721

SEQ ID NO: 38389 - DNA, 288 bp, Syntrophobacter fumaroxidans MPOB; identical to SEQ ID NO: 18722
  CDS (1)..(288): transl_table=11

SEQ ID NO: 38390 - protein, 95 aa, Syntrophobacter fumaroxidans MPOB; identical to SEQ ID NO: 18723

SEQ ID NO: 38391 - DNA, 297 bp, Rhizobium leguminosarum; identical to SEQ ID NO: 18724
  CDS (1)..(297): transl_table=11

SEQ ID NO: 38392 - protein, 98 aa, Rhizobium leguminosarum; identical to SEQ ID NO: 18725

SEQ ID NO: 38393 - DNA, 297 bp, Rhizobium leguminosarum bv; identical to SEQ ID NO: 18726
  CDS (1)..(297): transl_table=11

SEQ ID NO: 38394 - protein, 98 aa, Rhizobium leguminosarum bv; identical to SEQ ID NO: 18727

SEQ ID NO: 38395 - DNA, 300 bp, Rhizobium loti; identical to SEQ ID NO: 18728
  CDS (1)..(300): transl_table=11

SEQ ID NO: 38396 - protein, 99 aa, Rhizobium loti; identical to SEQ ID NO: 18729

SEQ ID NO: 38397 - DNA, 294 bp, Azospirillum brasilense; identical to SEQ ID NO: 18730
  CDS (1)..(294): transl_table=11

SEQ ID NO: 38398 - protein, 97 aa, Azospirillum brasilense; identical to SEQ ID NO: 18731

SEQ ID NO: 38399 - DNA, 285 bp, Acetobacter diazotrophicus; identical to SEQ ID NO: 18732
  CDS (1)..(285): transl_table=11

SEQ ID NO: 38400 - protein, 94 aa, Acetobacter diazotrophicus; identical to SEQ ID NO: 18733

SEQ ID NO: 38401 - DNA, 294 bp, Azorhizobium caulinodans; identical to SEQ ID NO: 18734
  CDS (1)..(294): transl_table=11

SEQ ID NO: 38402 - protein, 97 aa, Azorhizobium caulinodans; identical to SEQ ID NO: 18735

SEQ ID NO: 38403 - DNA, 285 bp, Azotobacter vinelandii; identical to SEQ ID NO: 18736
  CDS (1)..(285): transl_table=11

SEQ ID NO: 38404 - protein, 94 aa, Azotobacter vinelandii; identical to SEQ ID NO: 18737

SEQ ID NO: 38405 - DNA, 297 bp, Bradyrhizobium japonicum; identical to SEQ ID NO: 18738
  CDS (1)..(297): transl_table=11

SEQ ID NO: 38406 - protein, 98 aa, Bradyrhizobium japonicum; identical to SEQ ID NO: 18739

SEQ ID NO: 38407 - DNA, 288 bp, Escherichia coli O157; identical to SEQ ID NO: 18740
  CDS (1)..(288): transl_table=11

SEQ ID NO: 38408 - protein, 95 aa, Escherichia coli O157; identical to SEQ ID NO: 18741

SEQ ID NO: 38409 - DNA, 297 bp, Rhizobium leguminosarum; identical to SEQ ID NO: 18742
  CDS (1)..(297): transl_table=11

SEQ ID NO: 38410 - protein, 98 aa, Rhizobium leguminosarum; identical to SEQ ID NO: 18743

SEQ ID NO: 38411 - DNA, 300 bp, Rhizobium leguminosarum bv; identical to SEQ ID NO: 18744
  CDS (1)..(300): transl_table=11

SEQ ID NO: 38412 - protein, 99 aa, Rhizobium leguminosarum bv; identical to SEQ ID NO: 18745

SEQ ID NO: 38413 - DNA, 297 bp, Rhizobium leguminosarum bv; identical to SEQ ID NO: 18746
  CDS (1)..(297): transl_table=11

SEQ ID NO: 38414 - protein, 98 aa, Rhizobium leguminosarum bv; identical to SEQ ID NO: 18747

SEQ ID NO: 38415 - DNA, 297 bp, Rhizobium meliloti; identical to SEQ ID NO: 18748
  CDS (1)..(297): transl_table=11

SEQ ID NO: 38416 - protein, 98 aa, Rhizobium meliloti; identical to SEQ ID NO: 18749

SEQ ID NO: 38417 - DNA, 294 bp, Rhizobium sp; identical to SEQ ID NO: 18750
  CDS (1)..(294): transl_table=11

SEQ ID NO: 38418 - protein, 97 aa, Rhizobium sp; identical to SEQ ID NO: 18751

SEQ ID NO: 38419 - DNA, 288 bp, Salmonella typhi; identical to SEQ ID NO: 18752
  CDS (1)..(288): transl_table=11

SEQ ID NO: 38420 - protein, 95 aa, Salmonella typhi; identical to SEQ ID NO: 18753

SEQ ID NO: 38421 - DNA, 288 bp, Salmonella typhimurium; identical to SEQ ID NO: 18754
  CDS (1)..(288): transl_table=11

SEQ ID NO: 38422 - protein, 95 aa, Salmonella typhimurium; identical to SEQ ID NO: 18755

SEQ ID NO: 38423 - DNA, 288 bp, Shigella flexneri; identical to SEQ ID NO: 18756
  CDS (1)..(288): transl_table=11

SEQ ID NO: 38424 - protein, 95 aa, Shigella flexneri; identical to SEQ ID NO: 18757

SEQ ID NO: 38425 - DNA, 297 bp, Escherichia coli; identical to SEQ ID NO: 18758
  CDS (1)..(297): transl_table=11

SEQ ID NO: 38426 - protein, 98 aa, Escherichia coli; identical to SEQ ID NO: 18759

SEQ ID NO: 38427 - DNA, 23 bp, Artificial sequence
  (1)..(23): primer
atgagccagaacgctacggttaa

SEQ ID NO: 38428 - DNA, 24 bp, Artificial sequence
  (1)..(24): primer
ttagccgtagcgaaaatcaatacc

SEQ ID NO: 38429 - protein, 97 aa, Artificial sequence; identical to SEQ ID NO: 18762
  Variant (3)..(3): xaa in position 3 is any amino acid
  Variant (6)..(9): xaa in position 6 to 9 is any amino acid
  Variant (11)..(12): xaa in position 11 to 12 is any amino acid
  Variant (14)..(16): xaa in position 14 to 16 is any amino acid
  Variant (17)..(17): xaa in position 17 is any or no amino acid
  Variant (20)..(20): xaa in position 20 is any amino acid
  Variant (22)..(36): xaa in position 22 to 36 is any amino acid
  Variant (37)..(42): xaa in position 37 to 42 is any or no amino acid
  Variant (46)..(47): xaa in position 46 to 47 is any amino acid
  Variant (49)..(54): xaa in position 49 to 54 is any amino acid
  Variant (55)..(56): xaa in position 55 to 56 is any or no amino acid
  Variant (58)..(62): xaa in position 58 to 62 is any amino acid
  Variant (74)..(80): xaa in position 74 to 80 is any amino acid
  Variant (81)..(82): xaa in position 81 to 82 is any or no amino acid
  Variant (84)..(84): xaa in position 84 is any amino acid
  Variant (87)..(87): xaa in position 87 is any amino acid
  Variant (89)..(90): xaa in position 89 to 90 is any amino acid
  Variant (93)..(93): xaa in position 93 is any amino acid

SEQ ID NO: 38430 - protein, 11 aa, Artificial sequence
  Variant (3)..(3): xaa in position 3 is Ile, Leu, Met or Val
  Variant (9)..(9): xaa in position 9 is Asn or Arg
  Variant (10)..(10): xaa in position 10 is any amino acid
  Variant (11)..(11): xaa in position 11 is Ala, Gly, Ile, Leu or Val
GCXECGTCXXX

SEQ ID NO: 38431 - protein, 15 aa, Artificial sequence
  Variant (2)..(3): xaa in position 2 to 3 is any amino acid
  Variant (5)..(5): xaa in position 5 is any amino acid
  Variant (7)..(7): xaa in position 7 is Asp, Glu, Gly, Asn or Thr
  Variant (8)..(8): xaa in position 8 is any amino acid
  Variant (10)..(10): xaa in position 10 is Ile or Val
  Variant (11)..(11): xaa in position 11 is any amino acid
  Variant (12)..(12): xaa in position 12 is Phe, Trp or Tyr
  Variant (13)..(13): xaa in position 13 is Lys or Arg
  Variant (14)..(14): xaa in position 14 is any amino acid
WXXPXGXXGXXXXXG

SEQ ID NO: 38432 - DNA, 1515 bp, Escherichia coli
  CDS (1)..(1515)
atgcaacagtctaccccgtatctctcatttcgcggcatcggtaaaacgtttcccggcgttaaggcgctgacggatattagttttgactgctatgccggtcaggttcatgcgttgatgggtgaaaatggcgcaggaaaatcaactctcttaaaaatcctcagcggcaactatgcgccaaccacgggttctgtagtgattaatgggcaggaaatgtccttttccgacacgaccgcagcacttaacgcgggtgtggcgattatttaccaggaactgcatctcgtgccggaaatgaccgtcgcggaaaacatctatctcggccagctgccgcataaaggcggcattgtgaatcgctcattgctgaattatgaggcgggtttacaacttaaacatcttggtatggatattgacccggacacgccgctgaaatatctctccattggtcagtggcagatggttgaaatcgccaaggcgctggcgcgtaacgctaaaattatcgcctttgatgagccaaccagctccctttctgcccgcgaaatcgacaatcttttccgcgttattcgtgaactgcgaaaagaggggcgggtgatcttatacgtttctcaccgtatggaagaaatatttgccctcagcgatgccatcactgtctttaaagatggacgttatgtcaaaacctttaccgatatgcagcaggttgaccacgacgcgctggtgcaggcgatggtcgggcgcgacattggcgatatctacggctggcaaccgcgtagttatggcgaggagcgcctgcgtcttgatgctgtgaaagcaccaggcgtgcgtacgccaataagtctggcggttcgcagtggtgaaattgttgggctgtttggtctggtaggggcggggcgtagcgaattaatgaaaggcatgtttggcgggacgcaaatcaccgccggtcaggtttatatcgaccaacagccgatcgatattcgtaaaccgagccacgccattgccgcaggcatgatgctctgcccggaagatcgcaaagcggaaggcattattcctgtgcactccgttcgcgacaatatcaacatcagtgccagacgtaaacatgtgctcggcggttgtgtaatcaacaacggttgggaagaaaacaatgccgatcaccacattcgttcgctcaacatcaaaacgccgggcgctgagcaactgattatgaatctctcaggtggaaatcagcaaaaagccattctgggccgctggttatcggaagagatgaaggtcattttgctggatgaacctacgcgcggcattgatgttggtgctaagcacgaaatatataacgtgatttatgcgctggcggcgcagggtgtggcggtgctgtttgcctccagcgacttacctgaagtcctcggcgttgccgaccggattgtggtgatgcgcgaaggtgaaatcgccggtgaattgttacacgagcaggcagatgagcgtcaggcactgagccttgcgatgcctaaagtcagccaggcagttgcctga

SEQ ID NO: 38433 - protein, 504 aa, Escherichia coli
MQQSTPYLSFRGIGKTFPGVKALTDISFDCYAGQVHALMGENGAGKSTLLKILSGNYAPTTGSVVINGQEMSFSDTTAALNAGVAIIYQELHLVPEMTVAENIYLGQLPHKGGIVNRSLLNYEAGLQLKHLGMDIDPDTPLKYLSIGQWQMVEIAKALARNAKIIAFDEPTSSLSAREIDNLFRVIRELRKEGRVILYVSHRMEEIFALSDAITVFKDGRYVKTFTDMQQVDHDALVQAMVGRDIGDIYGWQPRSYGEERLRLDAVKAPGVRTPISLAVRSGEIVGLFGLVGAGRSELMKGMFGGTQITAGQVYIDQQPIDIRKPSHAIAAGMMLCPEDRKAEGIIPVHSVRDNINISARRKHVLGGCVINNGWEENNADHHIRSLNIKTPGAEQLIMNLSGGNQQKAILGRWLSEEMKVILLDEPTRGIDVGAKHEIYNVIYALAAQGVAVLFASSDLPEVLGVADRIVVMREGEIAGELLHEQADERQALSLAMPKVSQAVA

SEQ ID NO: 38434 - DNA, 1497 bp, Agrobacterium rhizogenes
  CDS (1)..(1497): transl_table=11
atggccaaccttatagaaatgtcgaacatttcaaagtcgtttggcggaagtctggcactggatagggtgtcgctggagctcttgccgggttccgtccatgccctgatgggcgaaaatggcgccggcaaatcgacgctgatgaagatcctcgcgggtgttcaccagcccgatagcggcgagatcttcaagaacggccacaagattgccttcctcaatccgaaagaggcgctcgacttcggcatctcgactgtcttccaggagatgacgcttctggcgaacctgacgatcgccgaaaacatgtttctcggacgtgagccggtcacgcgcttcggaacggtcgactacaagcgcatgaatgccgaaaccggaaaggcgttgaaggagctttcgctcgatctcgatcctcggacgctggtttcgaacctcaccattgccgagcggcaattcgtcgaaattgcccacgggatcaaggccgatgcctcgatcttcattctcgatgagccgacagcagcactcaacgccgccgacgtcgagatcctcaacaagcatatccgccgcttgcgcgatgcaggcaaggccctcgtctatatctcgcatcgcatggatgaaatcttccagatctgcgacaccgtcacggtgctgaaagatggcaagctgatcggcacgcgcccgctttcggaaatgacgccgacgtcgttgatcgcaatgatggtcggccgcgagctgaaggacctcttcccggcaagaaacggctcggcatccggcgagccgatgctcgacatcaagcatttcaagatcggtgcctcgacgaagcctttctcgctccatgtttgcaagggcgagatcgtcgccctggcagggctcgaaggacaaggccagcagaagcttctgcgctcgctcgtcggcaaattccaaccgttttccggtaccatcacgctgaacggaaaatcgctcgccctgccggtgccgaacgaaaacggtgtgcgcaagctgcagcagatgggtgtcggcttcattcctgaggaccgcaaggaggaaggcttgttcctcaacctcccgatcgcgcacaatatcgagattgcgctccattcggcgcgcgcaggattttctcccgccaagaactaccggacgttggttgccgacaccatcaagcggctgaacgtccggacgatcaacgcatccgcacccgtcggcgctctctccggcggcaatcagcagaaggtcctgcttggccgctatatcgccgccaatctcgatatcctgctgatcgaggagccgacgcgcggcgtcgatatcggcgccaagtcggaaatctacaaactgcttcgcgacttcacgcagaacggcggggccgtgctggtcctgtcgagagaaaccgttgagctcatcggcctttgcgatcgcatctatgtcgtccatggcgacacggttgtggccgacatgcccgccgccaaggcgacagagcacgacatcctcgacgccgccttgagcgcgtga

SEQ ID NO: 38435 - protein, 498 aa, Agrobacterium rhizogenes
MANLIEMSNISKSFGGSLALDRVSLELLPGSVHALMGENGAGKSTLMKILAGVHQPDSGEIFKNGHKIAFLNPKEALDFGISTVFQEMTLLANLTIAENMFLGREPVTRFGTVDYKRMNAETGKALKELSLDLDPRTLVSNLTIAERQFVEIAHGIKADASIFILDEPTAALNAADVEILNKHIRRLRDAGKALVYISHRMDEIFQICDTVTVLKDGKLIGTRPLSEMTPTSLIAMMVGRELKDLFPARNGSASGEPMLDIKHFKIGASTKPFSLHVCKGEIVALAGLEGQGQQKLLRSLVGKFQPFSGTITLNGKSLALPVPNENGVRKLQQMGVGFIPEDRKEEGLFLNLPIAHNIEIALHSARAGFSPAKNYRTLVADTIKRLNVRTINASAPVGALSGGNQQKVLLGRYIAANLDILLIEEPTRGVDIGAKSEIYKLLRDFTQNGGAVLVLSRETVELIGLCDRIYVVHGDTVVADMPAAKATEHDILDAALSA

SEQ ID NO: 38436 - DNA, 1494 bp, Mesorhizobium loti MAFF303099
  CDS (1)..(1494): transl_table=11
atgaaggacgcagttctcgaaatgcgcggcatccacaagcgctttccgggtgtgcatgcgctgaacaatgtcagcttcgccgtgcgcaagggaagcgtgcatggcgtcatcggtgaaaacggtgccggcaagtcgacattgatgcgcgtcctgtctggcgcgttcccggccaacgagggtgaagtggccatcgacggggatgtggtggcggcgccgacgcctgagcggatgcttgagctcggaatcgcggtcatttatcaagagctcgcccaggctccgcatctcacagtggttgaaaacatctttctcggccgcctgccgaaaacgcgtctgggcacgatcgactggcgccgggcgaaagccgcagctcaagatgtgctcgacaggcttggcttccgtgtcgatccggcagcgcgcatcgacacgatcagtgtcgcgcagcgccagatggtcgagatagccaaggcgattgcccgcgaggctcgcatcgtggtgctcgatgagccgtccgctgttctcggcgacttcgagcttgaacatcttttcaagacgatccggcggctgagcagcgaacacggcgtcgcgttcatctacatcacccatcgcctcaaggagctctatgagatttgcgacgaggtcaccgtgcttcgggatggccaggtcgttgcctcgatgccgcttggccagacgaccacggccgatctcatccgccatatggtcgggcgcgaattcaaggacgtatttccaccgcgctcgcagcccggcgacgagatccgcttagacgtacgcaacctatcgcggaacggcgtgctgaaggatatctccttcaatgtcaggcgcggcgaaatcgtcggcatctgcggtcttgccggagcgggccggaccgaggtgctgcgcgctatcgccggcgccgatccgatcgacggcggcgagatcaggatcgacggccaagtggtcgctatcgacgggccgcgtcgggcacttgcgcatggcgtcggtctgctgcccgaggatcgcaagacagaggggctgttcctcgaccagtcggtggcatttaacgtcaccgtttcccagatgacgccgttgacccgcagtggcctgatcagtggccgtcgcgagcacgaggctgtctccctgttcatccagcagatgcgcatcaagacgccgagccccagcaccaaggtccgcaccttgtcgggcggcaatcagcagaaatgtggcatcgcccgacaactgcatgcggggacggaaattctgctggtcgacgaaccgacgcgcggcgtcgacgtggcagccaagcgtgaaatctacgacctgctcgccgaactgacatcgaagcgcggcgcaagcgtcgtgatggtctcgtcagaattgccggaaatccttggcctctgcaatcgcatcatcgtcatgcgcgagggcgccatttcggcggttctcgacggcgaggacgcgaccgaggaaacaatcatggcccatgcggtttggcagtga

SEQ ID NO: 38437 - protein, 497 aa, Mesorhizobium loti MAFF303099
MKDAVLEMRGIHKRFPGVHALNNVSFAVRKGSVHGVIGENGAGKSTLMRVLSGAFPANEGEVAIDGDVVAAPTPERMLELGIAVIYQELAQAPHLTVVENIFLGRLPKTRLGTIDWRRAKAAAQDVLDRLGFRVDPAARIDTISVAQRQMVEIAKAIAREARIVVLDEPSAVLGDFELEHLFKTIRRLSSEHGVAFIYITHRLKELYEICDEVTVLRDGQVVASMPLGQTTTADLIRHMVGREFKDVFPPRSQPGDEIRLDVRNLSRNGVLKDISFNVRRGEIVGICGLAGAGRTEVLRAIAGADPIDGGEIRIDGQVVAIDGPRRALAHGVGLLPEDRKTEGLFLDQSVAFNVTVSQMTPLTRSGLISGRREHEAVSLFIQQMRIKTPSPSTKVRTLSGGNQQKCGIARQLHAGTEILLVDEPTRGVDVAAKREIYDLLAELTSKRGASVVMVSSELPEILGLCNRIIVMREGAISAVLDGEDATEETIMAHAVWQ

SEQ ID NO: 38438 - DNA, 1548 bp, Mesorhizobium loti MAFF303099
  CDS (1)..(1548): transl_table=11
atggacagtgcggttccgctcttccagatggaaggcatatccaagcgctatggtggcgtgcgcgctctggaaaaggcggagcttgtcgtcacatccggcagcatccacgccatccttggcgaaaacggtgccggcaagtcgacgctgatcaaggtcatggccggtgtcgtggcgcccgatgagggccgcatgacgctggatggccgggaggtgaccttcctgtcgccggccgccgcaaaccaggcaggcatcgtctgcatcttccaggagctgtcgctggttccagatctcagcgtcgccgacaacatcgtcatttccgatccccccaaacgcttcggcatgatcgaccgcaaggcgcaacgacgcgtcgcggaggaagcgcttgcccgcgcgggtgcggccgacatccatccgctggcgctggtcaaggatcttcccctttcaagaaggcagatggtcgagatcgccaaggcgctagccagaaagccgcgcatccttatcctcgacgaggcgacatccgcgctgacggcggcggatgtctcgaagatttttggcgtcctgaaacggctgcgttcggaaggtctggcgctgctctacatctcgcaccgcatgaacgagatcgccgaacttgccgatcagtgcacggtgttccgcaacggccgtaatgtcgccagctacaaggccggctcgaagagcgacaatgaggtggtcgagctgatgatcggccgcgaatacagccacatcttcccggccaagccggcggccgtgccagctacggccgcacccaggcttgaagcccgcaagctctcgtggaccgaccggttgcatgacatctcgctgaccgtcagggcaggcgaggtggtcggcctcggcggtctcgacggccagggccagcgcgaattgctgcttgccttcttcggcgtgctgcgcggcctttccggcgaggtgctgatcgatggcaagccggtcgcgatcggcagccccgccaaggcgcggcaggacggcatcggcatggcgctgatcccggaggaccgcaagaccgagggcttgatgctgccgatgacggtgcgcgagaacctgtccttcgccgcgctcgaccgcctgtccaaaggcggcattatcgaccgcgccgccgagcagcggctgatcgacgacatggtcggcctgctggcgatcaagacggcgggtctcgacataccggtcggcgcgctgtcgggcggcaaccagcagaaggtggtcatcgccaaatggctgatgcgccagccgcgcatcatcctgctcaacgatccgacgcggggcatcgatgtcggcaccaagcaggagctctatcagctgatgcgcaagctggcggacgccggggcggcgatcctgttctattcgaccgactatgacgagctgatcggctgctgcgaccgcgtgctggtgctctatgacggcgcgctcaagcgcgaactggtcggctccgagatcaccgagcgggcgctgatagcgagcgcgctcaacatccatggcgaggagagcccggtgggcctgggagcaagtgcgtga

SEQ ID NO: 38439 - protein, 515 aa, Mesorhizobium loti MAFF303099
MDSAVPLFQMEGISKRYGGVRALEKAELVVTSGSIHAILGENGAGKSTLIKVMAGVVAPDEGRMTLDGREVTFLSPAAANQAGIVCIFQELSLVPDLSVADNIVISDPPKRFGMIDRKAQRRVAEEALARAGAADIHPLALVKDLPLSRRQMVEIAKALARKPRILILDEATSALTAADVSKIFGVLKRLRSEGLALLYISHRMNEIAELADQCTVFRNGRNVASYKAGSKSDNEVVELMIGREYSHIFPAKPAAVPATAAPRLEARKLSWTDRLHDISLTVRAGEVVGLGGLDGQGQRELLLAFFGVLRGLSGEVLIDGKPVAIGSPAKARQDGIGMALIPEDRKTEGLMLPMTVRENLSFAALDRLSKGGIIDRAAEQRLIDDMVGLLAIKTAGLDIPVGALSGGNQQKVVIAKWLMRQPRIILLNDPTRGIDVGTKQELYQLMRKLADAGAAILFYSTDYDELIGCCDRVLVLYDGALKRELVGSEITERALIASALNIHGEESPVGLGASA

SEQ ID NO: 38440 - DNA, 1497 bp, Mesorhizobium loti MAFF303099
  CDS (1)..(1497): transl_table=11
atggaaccgatcgttcgcctggaaaacgtcaccaaaaactatcgtggtgtgcccgcggtcaagaatgtcagcttcgacttgcgcaagggtgaaatccacgcgctgcttggcgagaacggcgccggcaaatcgacgctgaccaagatcatcgccggagtggtcgacgccacgtcgggcaagatgttccacaagggccgcgagatcgcctacgcctcgccgcacgcggcccttgaggccggcatcgccatggtgttccaggaaaccagcctggtgccgtcgatgacggtggcgcagaacctctacctcggcactgaaaaattcctcaaccggctgcgcggcacgtatattgcagcacagcaattcctgcagtcgctgaatttcccggtcgatccgaacgccatggtggcgacgctgggtgcggccaagcggcagatggtcgagatcgcgcgcgcggtgcaccacaatgccgagatcatcatcttcgacgagccgacggcgacgctgacgccggaggaaaaacgccacttcttcgcactgatccgccggctgaaggccagcggcgtctccatcgtcttcatcagccacgcgctggaagaggcgcttgccattgccgaccgcatcaccattttgcgcgatggcgaactggtcatcaccgacgacacgtcggccttcgatcgcgacaagatcgtcgccgccatggtcgggcgcacattgtcgggccagatctaccgccagcgcgacgaggccaggctgcgcaaagcgggcaagaaagtgctgtcggtgcaggacatttcgatgagcaatgtcgtgcgcaacaattccttctcgatcttcgaaggccagattaccggcgtattcgggctgatcggctcgggcagaaccgagaccttcaagatcgtctcgggcatctacaagcgcgattttctgcgcggcggtgcgatcgagctcgacgacaggcccgtgcgctatcttgtgccaagcgaagccgttgccgacggtatcgtctacgtcaccgaggaccgcaagagcgaaggcattttcgagacgatgggcattgccgaaaacctgttcggcgggctgctcgccgcgggccgcgaaaaggcctgggtgatcaaccagcaggagatgcggcagctgtcggcgcaatggaccaagacgctcaacatcaaggcgatcaacgacaatgcccgcgtcgtcgaactgtcgggcggcaaccagcagaaggtggtgatcggcaagggactggtgcagcagccgcgcatcgtcatcttcgacgaaccgacgcgcggcgtcgatgtcggcgccatcgccgagatccaccagatcatcaaccggctggccgatgaggggctcgctgtcgtggtcatctcgtcctacttgccggagattatgaacctgtcggaccggatactcgtttgccgacagggccgcatcgtcgaggagtattcgccggcggaggcgacggaggagaagatcatgtacgcggcggttcactag

SEQ ID NO: 38441 - protein, 498 aa, Mesorhizobium loti MAFF303099
MEPIVRLENVTKNYRGVPAVKNVSFDLRKGEIHALLGENGAGKSTLTKIIAGVVDATSGKMFHKGREIAYASPHAALEAGIAMVFQETSLVPSMTVAQNLYLGTEKFLNRLRGTYIAAQQFLQSLNFPVDPNAMVATLGAAKRQMVEIARAVHHNAEIIIFDEPTATLTPEEKRHFFALIRRLKASGVSIVFISHALEEALAIADRITILRDGELVITDDTSAFDRDKIVAAMVGRTLSGQIYRQRDEARLRKAGKKVLSVQDISMSNVVRNNSFSIFEGQITGVFGLIGSGRTETFKIVSGIYKRDFLRGGAIELDDRPVRYLVPSEAVADGIVYVTEDRKSEGIFETMGIAENLFGGLLAAGREKAWVINQQEMRQLSAQWTKTLNIKAINDNARVVELSGGNQQKVVIGKGLVQQPRIVIFDEPTRGVDVGAIAEIHQIINRLADEGLAVVVISSYLPEIMNLSDRILVCRQGRIVEEYSPAEATEEKIMYAAVH

SEQ ID NO: 38442 - DNA, 1572 bp, Mesorhizobium loti MAFF303099
  CDS (1)..(1572): transl_table=11
atggtcgaacagggttcgattgcgccattttccgggacgcccttgctgcgcgtcgagggcgtcaggaagcggttcggcggcgtcaatgcgctgcgcggcgtcggtctcgaaatcctctccggcgaagtccacgcactgctcggcgaaaacggcgccggcaaatcgacgctgatcaagatcctgagcggcgtgcatgtgcatgatggcggctcgatcgaaatcgacggcaagcctgtctcgttttcttcgccggcccagtcgcgcgatgccggcgttgcggtggtttaccaggatctgagcctggtcgagtcgctgtcggtcgccgacaatctgcttctggggcgagagccgaagacccggctcggcttcctgaaaaaacgccagctggtagcgcaggccgaggcgttcctcaaatcgcagaacattccgctcgatgcccgcgccatggtcgggtcgctgcccttcgcctatcgccagatgaccgagatcgccaaggcgctgatgggcgatgtccgcctgctcatcctggacgagccgacctcggcgttgaccgatgatgaggagaagatcctgttcgaggcgatccgggcggtcgcagcacgtggcgtcggggtgatctacgtcacccaccgcctcaacgaagtgttccgcatctcgaaccgggtgactgtgttccgcgacggccagaacgccgggaccttcgtcacggcgcagaccaatatgcggcaattggtcggcgcgattgtcggggcggatcacgctgtgctgaaggcggatggcgccgcatctggacaaggcatggcgccatccgccggttcatctgaaaatcccgtgctcgaattgaaaagcgtcagcaatgaccggctcgacggggccagtctccaattgcgcgccggcgaaatccacggccttgccgggctgatcggcagcggtcgcaccgaaatcctgcagaccatcttcggcctgcggccggtccagtcgggcgaggccagcctggacggcgtgtcgctgaagggcacagacccggcggcggcgatcgggctgggcatcgcgctggtgccggaggaccggcacgtccagggcctggttctcgaacattcgatcgagcgcaacctgactttgccgcgcctgccttatttctcgcgccttggctggctgcagcgccggccggcgagcgagcatgccaatgcggcgatgcgccggctggccgtgaaggcgccaggcgcgtcgaccatggtgaagaacctgtcgggcggcaaccagcagaaggtggtgttcggcaagtggaacgagccgcggccgcgcgtgctgttgctcgacgagccgacggtcggggtcgatgtcggcgcgcgcgaggagatttacggcgtcattcgcgccgcggcggtggccggcagtggcgtgctgctggtgtcttcggatctctccgaactgctgcagctttgcgaccgcatctcgatcgtcgtcgatggccggatcaccaggactgtcgcgcggccggaattcggcagcgccgaggacctccatcacctcattcagatatcgcagccatcggaagagcacgcggcatga

SEQ ID NO: 38443 - protein, 523 aa, Mesorhizobium loti MAFF303099
MVEQGSIAPFSGTPLLRVEGVRKRFGGVNALRGVGLEILSGEVHALLGENGAGKSTLIKILSGVHVHDGGSIEIDGKPVSFSSPAQSRDAGVAVVYQDLSLVESLSVADNLLLGREPKTRLGFLKKRQLVAQAEAFLKSQNIPLDARAMVGSLPFAYRQMTEIAKALMGDVRLLILDEPTSALTDDEEKILFEAIRAVAARGVGVIYVTHRLNEVFRISNRVTVFRDGQNAGTFVTAQTNMRQLVGAIVGADHAVLKADGAASGQGMAPSAGSSENPVLELKSVSNDRLDGASLQLRAGEIHGLAGLIGSGRTEILQTIFGLRPVQSGEASLDGVSLKGTDPAAAIGLGIALVPEDRHVQGLVLEHSIERNLTLPRLPYFSRLGWLQRRPASEHANAAMRRLAVKAPGASTMVKNLSGGNQQKVVFGKWNEPRPRVLLLDEPTVGVDVGAREEIYGVIRAAAVAGSGVLLVSSDLSELLQLCDRISIVVDGRITRTVARPEFGSAEDLHHLIQISQPSEEHAA

SEQ ID NO: 38444 - DNA, 1614 bp, Mesorhizobium loti MAFF303099
  CDS (1)..(1614): transl_table=11
ttgccagctgaagccgcacctgtcctgcttgccgtcgagggcgtcaccaagcatttcgccggtgtcaccgcgctgagcgatgtcttgctcgacatccaccccggcgagatcctcggcctgctcggcgaaaacggcgcgggcaaatcgacgctgctcaaaatcctgtcgggcgtcatgccgccgtccagcgggcgcatcactttcgacggcgccgactatgcgccgtccagcccgcaggatgccaagcggctcggcatcgtcaccatttaccaggaattgagcctgatcccgacgctgacggtggcggagaacattttcatcggccgcgcgccggtcgggccactggggctggtgagctggaagcgcatggagcgggattcgcgcgacatcatcgcccgcgtcggcctttccatcgatccgatgacgccggtctcggcgctgtcggtggccgagcagcaactggtcgagatcgcccgggcgctatcgctaaagagccggctgatcatcatggacgagccgacctcggcgctgaccgaaacagaggtgcagcggctgttgtcgatcatgggccggctgcgccaggacaaggtcgccatcatgttcgtcacccaccggctggaggaggcgtcggcgatctgcgaccgcatgacggtgctgcgcgacggccggctggccgggcatctcgaccgcgacaagggacgaccgatccagctgccgcggatcatcgagaaaatggtcggccgcgccgcttcggaactttacgcgcggccggtgcaacgcgcggtggcgggcaatgtcgtgctgtcggtgcgtggtctgcgcaccgtgcgcgatcccgaggcgccgcatgccattgtgctcgacggcgtcgacatcgatctcaaggccggcgaaatcctcggcgtcgccggccttgtcggctccggccgcaccgagctggcacgcgccatttttggggccgaccgcatcgcggccggaaccatcacgctcgacggtaagccgatcgctccggcctcgccggccgacgccatcgcgctcggcatcggcctggtgccggaggaccgcaagcaccaggcgatcttcgccgccttgggcatcctgccgaatttctccgtcgcttcgctgggccgcttcagcaacggcttaggcttcatggccgagcggcgcgagcgtgatgcgctgtcgggtttcaggaaaatgctgtcgatccgcatggcctcggccgagcaggcgatcgagggcctgtcgggcggcaaccagcagaaagtgatcctggcgcgctggctggcgcgcgacccgaaagtgctgatcgtcgacgagccgacgcgcggcgtcgatgtcggcgccaaggcggaggtgcatcagatcctggtgcaactggcggcgcgcggcatcgcggtgatgatggtctcgtccgaactgcctgaagtgctggcggtgtcggaccgcatcgtcaccatgcgccggggtcgcatcactggtgagatgccgggcgtcgaggcaaacgaggaaaaactgatggaactgatggcgctcgacaagcaggatgctcttgggcaagacgcgcttgggcaagacgcgcttgggcaggatgcggaggatcaggcacgatga

SEQ ID NO: 38445 - protein, 537 aa, Mesorhizobium loti MAFF303099
MPAEAAPVLLAVEGVTKHFAGVTALSDVLLDIHPGEILGLLGENGAGKSTLLKILSGVMPPSSGRITFDGADYAPSSPQDAKRLGIVTIYQELSLIPTLTVAENIFIGRAPVGPLGLVSWKRMERDSRDIIARVGLSIDPMTPVSALSVAEQQLVEIARALSLKSRLIIMDEPTSALTETEVQRLLSIMGRLRQDKVAIMFVTHRLEEASAICDRMTVLRDGRLAGHLDRDKGRPIQLPRIIEKMVGRAASELYARPVQRAVAGNVVLSVRGLRTVRDPEAPHAIVLDGVDIDLKAGEILGVAGLVGSGRTELARAIFGADRIAAGTITLDGKPIAPASPADAIALGIGLVPEDRKHQAIFAALGILPNFSVASLGRFSNGLGFMAERRERDALSGFRKMLSIRMASAEQAIEGLSGGNQQKVILARWLARDPKVLIVDEPTRGVDVGAKAEVHQILVQLAARGIAVMMVSSELPEVLAVSDRIVTMRRGRITGEMPGVEANEEKLMELMALDKQDALGQDALGQDALGQDAEDQAR

SEQ ID NO: 38446 - DNA, 1518 bp, Mesorhizobium loti MAFF303099
  CDS (1)..(1518): transl_table=11
gtgctcgagcccggcaggacgatcctcgaactgcgtggcctcgagaagaaatatccgggcacccatgcgctgaagccggtgacactggccttcaagtcaggcgaaatccacgccatcgtcggcgagaacggtgccggcaaatccactctgatcaagcttctgaccggcgtcatgccgcgcacctctggcgatgtcatctgggaaggcaagccggcggcgctggcgaccccgcatgaggcgatggcgctcggcatcaatgccgtgcaccaggaagtcgtgctctgccgtcatttgaccgtcgccgccaacatgttcctcggcgaggagaattcgcgcttgggcatcctgcagcagcgcgccatggtcaaggaagcgcagaagatcatcgacgatctcggcttcgatctgccggcgcatgtcgtgctcggcgacctcaccatcggccagcagcagctgatcgccgccgctcgcgccaccgtgcgtggtaccaaattcctgatcttcgacgagccgaccgcctacctcacccgcaaggaggccgaccagctcttcaccctgatccgccgcctgaagtccgagggcgtgacgatcatctacatcagccatcgcatggaggaagtcttcgagctcgccgatcgcgtctccgtgctgcgtgacggcacgctggtcggtaccagaaacatcgctgagaccaacgatgccgaactggtcaagctgatgatcaatcgctcgatcgagcaggtctatcataaggagcacttcacgccgggtgccgcgatcgtggaaacgaggaacctgtcgggcaagggcttcgaaaatgtctcgatgacggtccgcgccggcgagatcgtcgggctctacgggctgatcggcgccgggcgcagcgaattcgtcaccacgctctacggccgccatcgcaaatcggccggccagatcctgtgggaaggcaagccggttcaggtcaattcggagcatgacgcgatcaagctcggcatggcgctggcgccggaaagccgccgcgatcagggtctctgtctcaatttgccggtcggcctcaacctcaacctgccgatctacaagcgcatctccaaaaacatgttgatttccggcgcgcaggagaagacccaggccgaccgccagatcgccgatctgcgcatcaagacgccgacacgccacgcgctggcctccagcctgtcgggcggcaatcagcagaagatcgtcatcggcaaatggctggcgcatggcgccaaactgttcatcttcgacgagccgacagtcggcgtcgatgtcggcaccaaggccgagatctaccgcctgttcggcgcgctcttgtcgaagggcgccggcatcatcctgatctcgtcctatctgccggaagtctatgaactggccgacacgctgcatgtgttccgccgtggcaagctggtggcgacacacggattccgcaccgccgatcacgaggaaattctcacacaggcgctcgccgagaaacaagaaaagctgggaggaaagatatga

SEQ ID NO: 38447 - protein, 505 aa, Mesorhizobium loti MAFF303099
MLEPGRTILELRGLEKKYPGTHALKPVTLAFKSGEIHAIVGENGAGKSTLIKLLTGVMPRTSGDVIWEGKPAALATPHEAMALGINAVHQEVVLCRHLTVAANMFLGEENSRLGILQQRAMVKEAQKIIDDLGFDLPAHVVLGDLTIGQQQLIAAARATVRGTKFLIFDEPTAYLTRKEADQLFTLIRRLKSEGVTIIYISHRMEEVFELADRVSVLRDGTLVGTRNIAETNDAELVKLMINRSIEQVYHKEHFTPGAAIVETRNLSGKGFENVSMTVRAGEIVGLYGLIGAGRSEFVTTLYGRHRKSAGQILWEGKPVQVNSEHDAIKLGMALAPESRRDQGLCLNLPVGLNLNLPIYKRISKNMLISGAQEKTQADRQIADLRIKTPTRHALASSLSGGNQQKIVIGKWLAHGAKLFIFDEPTVGVDVGTKAEIYRLFGALLSKGAGIILISSYLPEVYELADTLHVFRRGKLVATHGFRTADHEEILTQALAEKQEKLGGKI

SEQ ID NO: 38448 - DNA, 1545 bp, Mesorhizobium loti MAFF303099; identical to SEQ ID NO: 27152
  CDS (1)..(1545): transl_table=11

SEQ ID NO: 38449 - protein, 514 aa, Mesorhizobium loti MAFF303099; identical to SEQ ID NO: 27153

SEQ ID NO: 38450 - DNA, 1539 bp, Mesorhizobium loti MAFF303099
  CDS (1)..(1539): transl_table=11
atgaactattccgatacatccatcgcagcgaccacgccgttcctcagcctcgagagcgtgcgcaagacctatccgggcgtcgtcgcgttggatggcttctccatggaggtcaggccgggcgaggtcatcggcctggtcggcgagaacggcgccggcaagtcgaccctgatgaagatcctcggcggcgtcaccacgccggacaccggcacgatcacggtcgacggcaccgcccataaggggctgagtgtcgaaggcagcctgggttcgggcatcgccttcgtccaccaggaactcaatctgttcgaaaatctcgacgtcgccgccaacatcttcttcggccgcgagccgctgcgcgccgggccgctgaaactcgtcgaccgctcgaagctgcgcgagatggtggcgccgctcctgaagcgcgtcggcgccaatttctccgccgatgcgcaggtcgcttccctgtcgctggcgcagcagcagatggtcgagatcgccaaggcgctgtcgatcaaggcaaggctggtcatcctcgacgagccgacatccagcctgccgctcgccgagaccgacaaattgctcgacgtcatcaaggcgctgaaggccgacggcatcagcgtcatcttcatttcgcaccgcctgcacgaggtcgagcgtgtcgccgaccgcgtcgtcgtgctgcgcgacggcatgctggccggcacgctgggcaagcgcgacatcaaccacgaccagatggtcaagctgatgatcgggcgcatgctgaaggagcgcgagaaggcctccgaggccgcgcgtgcccctggcgccgtggcacttgcggccaaagccatccgcacccctacctatcccagccggcctgtcgacctcgatgtcaggcgcggcgagatcctcggccttgccggcctcgtcggctccggccgcactgagctcgcccgcgtgttcttcggcatcgacggcagcctcggcggcacgctcgagctcgacggcaagacgcttgtgctgggttcggcggccgacgccgtcgcgcacggcattttcctggtgccggaagaccgcaagctgaccggcatcctgctcgacctgtcgatcgcccagaacatttcgctgcccaatctgccggcgcatgccaggcgttcgctggtctcggcaagcgctgagacggcaaccgccgagaagcagaagaaaaatctcggcatcaaggcgccttcggtgcagacgcgcaccggcacgctgtcgggcggcaaccagcagaaggtcgtgctcggcaagtggctggccatgaacccgaaggtgatgatcctcgacgagccgacgcgcggcatcgacatcggcgccaaggcggaaatctacgggctgatgcgcgccctggccgatgccggcgtcgccgtgctgatgatctccagcgacatggaggaggtgatcggcgtgtccgaccgcatcgccgtcatgcatgagggccagatctcgggcattctcgacaaggaccagttcagccaggaaaacgtgctgctgctggcggtgggcaagcagccgaaatag

SEQ ID NO: 38451 - protein, 512 aa, Mesorhizobium loti MAFF303099
MNYSDTSIAATTPFLSLESVRKTYPGVVALDGFSMEVRPGEVIGLVGENGAGKSTLMKILGGVTTPDTGTITVDGTAHKGLSVEGSLGSGIAFVHQELNLFENLDVAANIFFGREPLRAGPLKLVDRSKLREMVAPLLKRVGANFSADAQVASLSLAQQQMVEIAKALSIKARLVILDEPTSSLPLAETDKLLDVIKALKADGISVIFISHRLHEVERVADRVVVLRDGMLAGTLGKRDINHDQMVKLMIGRMLKEREKASEAARAPGAVALAAKAIRTPTYPSRPVDLDVRRGEILGLAGLVGSGRTELARVFFGIDGSLGGTLELDGKTLVLGSAADAVAHGIFLVPEDRKLTGILLDLSIAQNISLPNLPAHARRSLVSASAETATAEKQKKNLGIKAPSVQTRTGTLSGGNQQKVVLGKWLAMNPKVMILDEPTRGIDIGAKAEIYGLMRALADAGVAVLMISSDMEEVIGVSDRIAVMHEGQISGILDKDQFSQENVLLLAVGKQPK

SEQ ID NO: 38452 - DNA, 1533 bp, Mesorhizobium loti MAFF303099
  CDS (1)..(1533): transl_table=11
atgacctcgacgattttggagatgcgcgacatcaccaagacgtttcccggcgtgaaggcgctgtcgaatgtcaacctcagcgtcgaggaaggcgaaatccacgccgtggtcggcgagaacggcgccggcaagtcgacgctgatgaaagtgctgtcgggcgtctatcccgcgggcacatatgacggccagatcatctttcaaggccaggaatgccagttcaaaggcatccatgacagcgaacacaagggcatcgtcatcatccaccaggagcttgcgctggtgccgatgctgtcgattgccgaaaacattttcctcggcaacgaacacgccaaatacggtgtgatcgactgggacgccaacgaggcgcgcaccagcgcgctgttgaagaaggtgggcctcaaggaggaccccaagacgctgatcaccaatatcggcgtcggcaagcagcagctggtcgagatcgccaaggcgctgagcaaggaagtcaagctcctgatcctcgacgagcccaccgcatcgctcagcgagaaggacagccaggcgctgctcgaccttttgctcgagttcaagcggcaaggcatgacctcgatcctgatctcgcacaaactcaacgaggtgaaccgggtcgccgacaaggttaccgtcatccgcgacgggcgcactatcgagacgctggccaggaaggacatctcggaagaccgcatcatcacctcgatggtcggccgctcgctcgacgaccgctatccgccgcgcgaaccaaagatcggcgaggtcgtcttcgaagtgaagaactggtcggtctatcacccgatccatgccgagcggcaagtgatcaagggcatcgacatcaacgtgcgcaagggcgaggtggtcggcatagctgggctgatgggcgccggccgcaccgaattcgccatgagcctgttcggccgttcctatggccgccgcatcacgggcgaggtgctgctcaaaggcaagccgatcgatgtctcgtccgtgagcaaggcggtcgaacacggcatcgcctacgtgaccgaggaccgcaagacttacggtctcaacctgatcgaccatatcaagcacaacatcacgcttgccaatctcggcggcgtgtcgcgtcacagcgtgatcgacgatctgcgcgaactcgccgttgccaacgattatcgcaagaagaccaacatccgcgcttcgagcgtctatcagatgacgggcaatctttccggcggcaaccagcagaaggtggtgctgtcgaaatggctgttcgccgacccggaattgctgatcctcgacgagccgacgcgcggcatcgatgtcggcgccaagtacgaaatctacacgatcatcgcgcgtcttgcctcggagggtaaggcgatcgtggtcatctcgtcggaaatgccggaattgctcggcatcaccgaccgcatctacgtcatgaacgaaggccgcatcgtcggcgaaatgcccgcggcggacgcaagccaggaaaaaataatgcgcgccatcgttcgcggagaaggaaaagcagcatga

SEQ ID NO: 38453 - protein, 510 aa, Mesorhizobium loti MAFF303099
MTSTILEMRDITKTFPGVKALSNVNLSVEEGEIHAVVGENGAGKSTLMKVLSGVYPAGTYDGQIIFQGQECQFKGIHDSEHKGIVIIHQELALVPMLSIAENIFLGNEHAKYGVIDWDANEARTSALLKKVGLKEDPKTLITNIGVGKQQLVEIAKALSKEVKLLILDEPTASLSEKDSQALLDLLLEFKRQGMTSILISHKLNEVNRVADKVTVIRDGRTIETLARKDISEDRIITSMVGRSLDDRYPPREPKIGEVVFEVKNWSVYHPIHAERQVIKGIDINVRKGEVVGIAGLMGAGRTEFAMSLFGRSYGRRITGEVLLKGKPIDVSSVSKAVEHGIAYVTEDRKTYGLNLIDHIKHNITLANLGGVSRHSVIDDLRELAVANDYRKKTNIRASSVYQMTGNLSGGNQQKVVLSKWLFADPELLILDEPTRGIDVGAKYEIYTIIARLASEGKAIVVISSEMPELLGITDRIYVMNEGRIVGEMPAADASQEKIMRAIVRGEGKAA

SEQ ID NO: 38454 - DNA, 1542 bp, Mesorhizobium loti MAFF303099
  CDS (1)..(1542): transl_table=11
atggacacgacagcccagcacggcacggtgaaggaggggcctcaggactccacgccacgcctgacgctgtccggcatctccaagagtttcccgggtgtgcgcgcgctgcacaatgtcagcctgtcgctctatcccggccaggtgacggcactgatcggcgagaacggcgccggcaagtcgacgctggtcaagatcatgaccggcatctaccagcccgacgccggcacgatcagcatcgacggccaggctgtcaccttgcccagcgcgcatgccgccttcggccatggcgttaccgccatccatcaggaaaccgtgctgttcgacgatctcacagtcgccgaaaatatctttctcggccatgcgccgcgcacacggctaggcaccatcgactggcgcacgatgcgcggaaatgcccgcgaagtgctcgacaccatgcatgccggccatatcgacgccgatgcgcggctgaaggacctcggcatcgccaacaagcatctcgtcgccgtcgcccgcgccatgtcgatcgacgcccagatcgtcatcatggacgagccgaccgccgcgctttcgatgaaggagatcgaggagcttttcctgctcatcgaattcctcaaggaggaaggcaaggcgatcctgttcatcagccacaagttcgacgagatctaccgcatcgccgaccgctacacggtgttccgcgacggcgaggtggttggcgaaggcctgatcaaggatgccggccagagccagatcgtgcgcatgatggtcggccgctcggtcgatcatatcttcccgcagcgcaaggccgagatcggcgcgccggtgctgtcggtcgccggcctgtcgcacccgaccgagttcaacgacatcggcttcgagctgcacaagggcgagatcctcggcttctacggccttgtcggcgccggccgcagcgaggtgatgcaagcgatatcgggcatcacccgaacctctggcggcacgatcacgctggaaggcaaggcgatagcgccgaaatcggcggcggattcgatcgaagccggcatcgtctacgtgccggaagagcgcggcaagcagggcgtggtgatcggcctgccgatcttccagaacgtctcgctgccctcgctcaagcgtacctccaagtctggcttgctgcggctggccgaagagttttcgctcgcccgctcctacaccgagcggcttgacctcagggcctcctcgctcagccaggatgtcggcacgctgtcgggcggcaaccagcagaagatcgttatcgccaagtggctggcgaccgcgcccaaggtgatcatcctggacgagccgaccaagggcatcgacatcggctcgaaagccgccgtgcacggcttcatggccgagctggtggcgcaaggcctgtcggtgatcatggtgtcgtcggaactgccggagatactcggcatgtccgaccgggtggtggttatgcgcgaaggccttgtcgcggcgacatatgacaataaggggctggacgccgagacgttggtgcggacggcagcggggatcgcggcatga

SEQ ID NO: 38455 - protein, 513 aa, Mesorhizobium loti MAFF303099
MDTTAQHGTVKEGPQDSTPRLTLSGISKSFPGVRALHNVSLSLYPGQVTALIGENGAGKSTLVKIMTGIYQPDAGTISIDGQAVTLPSAHAAFGHGVTAIHQETVLFDDLTVAENIFLGHAPRTRLGTIDWRTMRGNAREVLDTMHAGHIDADARLKDLGIANKHLVAVARAMSIDAQIVIMDEPTAALSMKEIEELFLLIEFLKEEGKAILFISHKFDEIYRIADRYTVFRDGEVVGEGLIKDAGQSQIVRMMVGRSVDHIFPQRKAEIGAPVLSVAGLSHPTEFNDIGFELHKGEILGFYGLVGAGRSEVMQAISGITRTSGGTITLEGKAIAPKSAADSIEAGIVYVPEERGKQGVVIGLPIFQNVSLPSLKRTSKSGLLRLAEEFSLARSYTERLDLRASSLSQDVGTLSGGNQQKIVIAKWLATAPKVIILDEPTKGIDIGSKAAVHGFMAELVAQGLSVIMVSSELPEILGMSDRVVVMREGLVAATYDNKGLDAETLVRTAAGIAA

SEQ ID NO: 38456 - DNA, 1572 bp, Mesorhizobium loti MAFF303099
  CDS (1)..(1572): transl_table=11
atgaccacggcgcttgatcatgacgtcatcctgaagctggaagacgtctccaaagtctatgccggcaccgtcgcggtcaagcaggccaatttcgaggtgcgcaagggtgcggtcaatgtgctcgttggcgaaaacggcgccggcaaatcgacgctgatgaagatcatcgccggcgtcgagcagccgacggccgggcgcatcctgctcgacggcaacgaggtttccttctcctcctcaggtgatgcggtgacccgcggcatcggtatggtgttccaggagctaaacctgttcggcaacatgaccgttgccgagaatatttttgccacgcgcgagatcaccaaccggtttcgcaagatcgaccgcaagaagcaggagcggcgggccggtgaattcctcgatcggctcgaagccggcatccggccggacatgctggtcgaggacctgcgcatcggccagcagcaactggtcgagatcgccaaggctgtctcgctcgacgcgcgcatcctgatcatggatgagccgacctcggcgctcagtgcggcggaagtcgagatcctgttcaaggtgatcgccgacctcaaggcgcgcggcgtggcgatcgtctacatctcgcaccggctggaggaactgatccgcatcggcgactacatcaccgtgctgcgcgacggccgcatcaccggccaggaggaggtgaagaacgtcgacacgcagtggatcgtgcggcagatgatcggctcggacgccaaggatttcgccaaggccgacggccatgttcccggcgaggagatcttccgcgccgaagacatctgcctgccgcgcgtcaccggcggactggcggtcgaccatgtctcgctgtcgctgcgcgccggcgagattctgggcatctacggactgatgggcgccggccgcagcgagctgttcgactgcatcatgggccgccacggccatgccagcggcaagatcttcatcgacggaaagcatatcagggaacgcgatacgacgcggcgcatacggcgcgggctggcgctgattccggaagaccgccaacgcgagggcctggtgtcgatcctctcggtcgccagcaacctgacgctggccagcctgtcgcgtttcgtgcgcgtcttccatatccgtggcggcgcagagcgtcaggcggtcacgcagatggtgcgggagctttcgatcaaggtcgcggatccgacgcaggaagtctcgtcgctttccggcggcaaccagcagaaggtggtaatcggcaaggcgctcctcaccgggccgaaggtgctgttgatggacgagccgagccgcgggatcgatgtcggcgccaaggcggatgtcttccgcaccatgcgcaagttgtcgcgcgatgggctcggcatcctcttcgccacttccgatctcgacgaggtgatggcgctatctgaccgcatcgcggtcatgagcaatggcaaactgaccggcatgttcgatcgcgccgaggcgagcgaagccgcgattgtcgccgcatcggcgctcggccatggacccgccccgcacatcttgccccagaatttggagagcaacgctgatgactga

SEQ ID NO: 38457 - protein, 523 aa, Mesorhizobium loti MAFF303099
MTTALDHDVILKLEDVSKVYAGTVAVKQANFEVRKGAVNVLVGENGAGKSTLMKIIAGVEQPTAGRILLDGNEVSFSSSGDAVTRGIGMVFQELNLFGNMTVAENIFATREITNRFRKIDRKKQERRAGEFLDRLEAGIRPDMLVEDLRIGQQQLVEIAKAVSLDARILIMDEPTSALSAAEVEILFKVIADLKARGVAIVYISHRLEELIRIGDYITVLRDGRITGQEEVKNVDTQWIVRQMIGSDAKDFAKADGHVPGEEIFRAEDICLPRVTGGLAVDHVSLSLRAGEILGIYGLMGAGRSELFDCIMGRHGHASGKIFIDGKHIRERDTTRRIRRGLALIPEDRQREGLVSILSVASNLTLASLSRFVRVFHIRGGAERQAVTQMVRELSIKVADPTQEVSSLSGGNQQKVVIGKALLTGPKVLLMDEPSRGIDVGAKADVFRTMRKLSRDGLGILFATSDLDEVMALSDRIAVMSNGKLTGMFDRAEASEAAIVAASALGHGPAPHILPQNLESNADD

SEQ ID NO: 38458 - DNA, 1524 bp, Mesorhizobium loti MAFF303099
  CDS (1)..(1524): transl_table=11
ttgacgcaatcggacttcttctcgctcgacggcatatcgaaacgcttcggcgtcgtccaggcgctcgacaacgtctcgattgctttccggccaggcgaggtgctcgctttggtcggcgagaatggcgccggcaaatcaacgatgatgcgcattctcgagggcgtgtccggaccggacaccggcaccgtgcggcatggttccacgccgatcgttttcggcgaaccgcgcgacagccaccgggccgggatccgcgtcatccatcaggagccggagatcgttccgaacctgacggtggccgagaacattttcgtcggcgaattgccgcgcctggcaggcgtcctgctcgactggcgcaagctggaggagcagaccgaccgggtccttgcgaccttcggcatgcagcaggacatgcggccacgccaactctgcggcacgctcggcccggcgcaacgccagatgattgagatcatgcgcgccatccgcgccggcggccggctgatcgccttcgatgagccgacctcgtcgctgaccgatgatgaagcgcgtcgcctgttttccgtcgtccgcaggctgcgcgagaagggcacgtcgatcatctacatctcgcaccggctgaacgagatcatcgatctggccgaccgcattgtcgttttgcgcgacggcaggctggtcgacgattcgccggcggccggcgccagcgagcagaccatcgccaagctcatggtcggccgcaacatcgacgatcttttcactcgcgagacctggcggtccggggaacaattgcttgatgtggcgggattgaccaccgaccgcgtcaacgatgtcagcctcagggttcgtcgcggtgaggtgctcggcatcgccggcctcatgggtgcgggccgctccgaactggcaaaggcgattgtcggatatgaccggcgcatcgccggcaccatagccatgaacggcgtgcccgttctccccaacagtccgcatgcggcgatcgtcgcgggcatcggttttgctcccgaagaccgcaagcacgaggcgttgctgctgttcagaagcattctcgacaacgcagcactttgcgtgcccgacaagacatcgagcttcggcttcttcaaccggcgcaaggcaatggagattgtctcgccgctggctgccaagatgtcgatcaaggcacccaacctcgacgagcaggtttcgaaactgtcgggtggcaatcagcagaaggtcgttctggcgcgctggcttgcccggcagccgatgctgctcatcctcgacgaaccgacgcgcggcatcgacatcggcgccaaggcggaaatctatcggctgatcgatgaactcgcggcaagcggcattggtatcatcctgatttcctcggaaatgccggaactgatcggtctcgccgacagggttcttgtcatggcaggaggccgcatcacggccgagcttgcccgccccgacatcgacgaagcgacgatcctcaaacacgccatgccgcaatccgcatcatcgcctggagactacattcaatga

SEQ ID NO: 38459 - protein, 507 aa, Mesorhizobium loti MAFF303099
MTQSDFFSLDGISKRFGVVQALDNVSIAFRPGEVLALVGENGAGKSTMMRILEGVSGPDTGTVRHGSTPIVFGEPRDSHRAGIRVIHQEPEIVPNLTVAENIFVGELPRLAGVLLDWRKLEEQTDRVLATFGMQQDMRPRQLCGTLGPAQRQMIEIMRAIRAGGRLIAFDEPTSSLTDDEARRLFSVVRRLREKGTSIIYISHRLNEIIDLADRIVVLRDGRLVDDSPAAGASEQTIAKLMVGRNIDDLFTRETWRSGEQLLDVAGLTTDRVNDVSLRVRRGEVLGIAGLMGAGRSELAKAIVGYDRRIAGTIAMNGVPVLPNSPHAAIVAGIGFAPEDRKHEALLLFRSILDNAALCVPDKTSSFGFFNRRKAMEIVSPLAAKMSIKAPNLDEQVSKLSGGNQQKVVLARWLARQPMLLILDEPTRGIDIGAKAEIYRLIDELAASGIGIILISSEMPELIGLADRVLVMAGGRITAELARPDIDEATILKHAMPQSASSPGDYIQ

SEQ ID NO: 38460 - DNA, 1518 bp, Mesorhizobium loti MAFF303099; identical to SEQ ID NO: 27156
  CDS (1)..(1518): transl_table=11

SEQ ID NO: 38461 - protein, 505 aa, Mesorhizobium loti MAFF303099; identical to SEQ ID NO: 27157

SEQ ID NO: 38462 - DNA, 1563 bp, Thermotoga maritima MSB8; identical to SEQ ID NO: 27158
  CDS (1)..(1563): transl_table=11

SEQ ID NO: 38463 - protein, 520 aa, Thermotoga maritima MSB8; identical to SEQ ID NO: 27159

SEQ ID NO: 38464 - DNA, 1572 bp, Thermotoga maritima MSB8
  CDS (1)..(1572): transl_table=11
atgatgctcaacacagaaaaagaaagggaagtattgctggaagccagaaatattaccaaaacttttccgggagtaatcgctgtcaataatgtaactcttcaaatatataaaggggaagtttgcgctctggttggagaaaacggagctggcaaatccactctcatgaagattttggccggggtatatccggattacgagggacagatctttctggaaggaaaagaggttcgattcaggaatccaagagaagcccaggagaatggaatcgccttaattcctcaagaactagatcttgtacctaatcttagttcagctgaaaatatctttctctccagagaaccggtcaacgagtttggtgtgattgaataccagaaaatgtttgaacaagcttcaaaattattttcaaagctaggagttaatatcgatccaaaaacaaaagtggaagatctgagcactagtcaacaacaaatggtagctattgctaaagcactttcacttgacgccaaaataatcatcatggacgaaccaacctctgccataggtaaacgtgaaactgaacaactgttcaatattataagatctttaaaaaatgaaggaaaatctgtgatttacatttctcatcgattagaggaaatattcgaaatagctgacagggttgttgtgatgagagatggtagaaaggtaggagagggtcccatagaagaatttgatcatgataaacttgttagattaatggtaggaagaagtatagatcagttttttataaaagaacgtgcgacaataacagacgaaattttcagagtggaaggtattaaactgtggagtttggacagaaagaaacttttagttgatgatgtgagtttttacgtcaggaagggagaagtattgggaatatatggattagtcggcgctggaagaacagaacttttggaggctatattcggcgcccatccaggtcgtacagaaggaaaggtattcattggaggaaaagaaataaaaattcactctcctagggacgctgtaaagaatgggataggattagtcccagaggatagaaaaactgcaggactgattcttcaaatgtctgttttgcataatataaccctcccttcagtggtaatgaaacttatcgttagaaaatttggattaatagatagtcaactcgaaaaagaaatcgttcgttcgtttatagaaaaattaaacattaaaactccttcaccctatcaaatcgtggagaacctcagtggaggaaaccagcaaaaagtagttctggcaaaatggcttgcaataaaaccaaaggtacttctcttagatgaacctaccagaggaattgatgtaaacgcaaagagtgagatttacaaactcataagtgaaatggctgtttcaggaatgggtgtagttatggtttcctctgaacttccagagatacttgccatgtccgacagaattcttgttatgtctgaggggcggaaaacagctgagtttctcagagaagaagtcaccgaggaagatcttctgaaagcagcaatccccagaagtgtgaaggtagaaacaacacaaagggaggagtga

SEQ ID NO: 38465 - protein, 523 aa, Thermotoga maritima MSB8
MMLNTEKEREVLLEARNITKTFPGVIAVNNVTLQIYKGEVCALVGENGAGKSTLMKILAGVYPDYEGQIFLEGKEVRFRNPREAQENGIALIPQELDLVPNLSSAENIFLSREPVNEFGVIEYQKMFEQASKLFSKLGVNIDPKTKVEDLSTSQQQMVAIAKALSLDAKIIIMDEPTSAIGKRETEQLFNIIRSLKNEGKSVIYISHRLEEIFEIADRVVVMRDGRKVGEGPIEEFDHDKLVRLMVGRSIDQFFIKERATITDEIFRVEGIKLWSLDRKKLLVDDVSFYVRKGEVLGIYGLVGAGRTELLEAIFGAHPGRTEGKVFIGGKEIKIHSPRDAVKNGIGLVPEDRKTAGLILQMSVLHNITLPSVVMKLIVRKFGLIDSQLEKEIVRSFIEKLNIKTPSPYQIVENLSGGNQQKVVLAKWLAIKPKVLLLDEPTRGIDVNAKSEIYKLISEMAVSGMGVVMVSSELPEILAMSDRILVMSEGRKTAEFLREEVTEEDLLKAAIPRSVKVETTQREE

SEQ ID NO: 38466 - DNA, 1545 bp, Vibrio cholerae O1 biovar eltor str. N16961
  CDS (1)..(1545): transl_table=11
gtgttgtctgaatttttgcataataaaagtgatgccatggtcaatcaaacacatgaattcctgttggaaatgacaggggtgagtaaagagttccccggagtgaaagctctggataaggtgaatttaaaagtgcgtccgcattcggttcatgccttgatgggtgaaaatggcgcaggcaaatccaccttgttgaaatgcttatttggtatttatgagaaagatgaaggcgatatcatttttcttggccagcatgtgaacttttcctcatcaaaagaggcgctggaatccggtgtctctatggttcaccaagagttgaaccaagtaaaacagtgctcggtgatggataatatttggcttggccgttatcccaccaaaggattttttgtcgatcacgacaaaatgtatcgggataccaaagcgatttttgccgaactcgatattgatatcgatccgaaggtcaaagtcgcgaccttgtcggtttcacagatgcagatgctcgagatcgccaaagcgttttcctacgatgccaaagtggtgatcatggatgaacctacctcatccctgaccgaaaaagaggtaaaccatctttttaccatcatcaaaaagctcaaagaaaaaggctgtggggtggtgtacatctcgcacaaaatggaagagatcttttctatttgcgatgagatcaccattttgcgtgatggccagtgggtcgatacgcgtccgttgaaagggttggacatggacaagatcatttcgatgatggttggccgtgaactgacccagcgtttccctgaaaaaagcaacgaaccgaagaatgtcattcttgaggtgaagaatctcaccgcactcaatcaaccctcgattcaagatatttcgtttgaactacgagctggggaaattttgggcgtggcgggtctcgtcggttcgcgccgtaccgacattgtggagaccatttttggtgtgcgtgaacgcagtgccggacatattctgctccatggtcgtgaaatgaaaaatcacgatgcgcatgaagcgatcagaaacggttttgcactcgtgaccgaagagcgccgctcgacggggatttactccaatctcgacatcacttttaactcgttagttgccaacgtggacgagtacaaaacgccttacggtctactcagtgacaagaagatgaaaagtgatacgcaatgggtgattgattctatgcgggtgaaaaccccgtcgcatcaaactcatatcggttcgctttccggtggtaaccagcaaaaagtcatcatcgggcgctggctgctgactcaacccgagattttgatgttggatgaaccgacacgcggtattgatgtgggcgcaaagtacgaaatttatcagctgattttagagctggccaagaaagacaaaggcatcatcattatttcctctgagatgccggaactgctcggaattaccgaccggatcatggtgatgagcaacggccgcaatgcaggcattgtgaataccaaacaaacttctcagaacgaaattctagaactggcctctcgatacctctaa

SEQ ID NO: 38467 - protein, 514 aa, Vibrio cholerae O1 biovar eltor str. N16961
MLSEFLHNKSDAMVNQTHEFLLEMTGVSKEFPGVKALDKVNLKVRPHSVHALMGENGAGKSTLLKCLFGIYEKDEGDIIFLGQHVNFSSSKEALESGVSMVHQELNQVKQCSVMDNIWLGRYPTKGFFVDHDKMYRDTKAIFAELDIDIDPKVKVATLSVSQMQMLEIAKAFSYDAKVVIMDEPTSSLTEKEVNHLFTIIKKLKEKGCGVVYISHKMEEIFSICDEITILRDGQWVDTRPLKGLDMDKIISMMVGRELTQRFPEKSNEPKNVILEVKNLTALNQPSIQDISFELRAGEILGVAGLVGSRRTDIVETIFGVRERSAGHILLHGREMKNHDAHEAIRNGFALVTEERRSTGIYSNLDITFNSLVANVDEYKTPYGLLSDKKMKSDTQWVIDSMRVKTPSHQTHIGSLSGGNQQKVIIGRWLLTQPEILMLDEPTRGIDVGAKYEIYQLILELAKKDKGIIIISSEMPELLGITDRIMVMSNGRNAGIVNTKQTSQNEILELASRYL

SEQ ID NO: 38468 - DNA, 1503 bp, Vibrio cholerae O1 biovar eltor str. N16961
  CDS (1)..(1503): transl_table=11
atgactcaagcaattttagccctgagccaaattgaaaaagcgttccctggcgtgaaagccttggacaaagcgagcctgaatgtctatccggggcgggtaatggcgttaatgggtgaaaacggtgctggcaaatcaaccttgatgaaagttctgaccggcatttatagcaaagatgcgggcagcattgagtatcaaggccaacctgtcagttttaaaggcccacgagattcgcagctggcgggcatcagcattattcaccaagagctcaacctgatcccgcagctgacgattgcggaaaatattttccttggccgtgagatgacttcgccattcggacgcattctgtgggatgaaatgcatcgtaaagcggatcaactgctcgcacgtttgaatgtgaaacacagtgctaaaaccttgctcggagagctgagcttgggtgagcagcagatggtggaaattgccaaagcgctgtcgtttgaatcgaaagttatcatcatggatgaaccgaccgatgcgctgaccgataccgaaaccgaatctctgtttaatgtcattaatgaactgcgcgaacaaggctgcggcattgtgtatatctcacaccgtttgaaagaaatttttgagatttgtgacgacatcacagtgctgcgtgacggcaaatttattggcgagtgccgcgtgtgcgataccaatgaagatggcctgattgagatgatggttggccgtaaactggaagagcagtacccacgtattgccgcgcagcagggtgacatcagccttgaggtgattggcctaactggctcgggtgtgcacgatgtcagctttacgcttaaaaaaggcgagattcttggtgtctctggcctgatgggggctgggcgcactgaactgatgaaggtgatttatggcgcgctcccttcggagcgtggcgtgattaacctcaacgggcgcacggttaaccctgtcagtccgcaagatggtttggccaatggcatcgcctatatttctgaagatcgtaaaggcgatggcttggtactcggtctttcggtgaaagagaacatgtcactttgcgcgctcgatcaactgagcaaaggtgtgcaaattcgtcatgccgatgaagtgattgctgtggatgactttattcgtctgttcaacatcaaaaccccaagtcgtgagcaaatcattggcaacctttctgggggcaatcagcagaaagtggcgatcgctaaaggactgatgaccaaacccaaagtactgattttggacgaaccgactcgcggtgttgacgttggcgccaaaaaagagatttaccaactgatcaaccaattcaaagctgaaggcatgagcatcattttagtctcctcagaaatgcccgaagtgctgggcatgagtgaccgcattctggtgatgcatgaagggcggattagcggcgagtttatggcgagcgaagccgatcaagagaaattaatggcgtgtgcggtagggcgtaaccctgctcacgcagcatga

SEQ ID NO: 38469 - protein, 500 aa, Vibrio cholerae O1 biovar eltor str. N16961
MTQAILALSQIEKAFPGVKALDKASLNVYPGRVMALMGENGAGKSTLMKVLTGIYSKDAGSIEYQGQPVSFKGPRDSQLAGISIIHQELNLIPQLTIAENIFLGREMTSPFGRILWDEMHRKADQLLARLNVKHSAKTLLGELSLGEQQMVEIAKALSFESKVIIMDEPTDALTDTETESLFNVINELREQGCGIVYISHRLKEIFEICDDITVLRDGKFIGECRVCDTNEDGLIEMMVGRKLEEQYPRIAAQQGDISLEVIGLTGSGVHDVSFTLKKGEILGVSGLMGAGRTELMKVIYGALPSERGVINLNGRTVNPVSPQDGLANGIAYISEDRKGDGLVLGLSVKENMSLCALDQLSKGVQIRHADEVIAVDDFIRLFNIKTPSREQIIGNLSGGNQQKVAIAKGLMTKPKVLILDEPTRGVDVGAKKEIYQLINQFKAEGMSIILVSSEMPEVLGMSDRILVMHEGRISGEFMASEADQEKLMACAVGRNPAHAA

SEQ ID NO: 38470 - DNA, 1569 bp, Bacillus halodurans C-125
  CDS (1)..(1569): transl_table=11
atgggtgaacattttttattagaaatggtagacatcacaaaggaattccccggcgtgaaggcgctcgatcgggttcaattaaaagtgagaaaaggctccgtccatgcattaatgggggaaaatggcgctgggaaatcaacgttaatgaaaatcttaatcggcatgtacaaaccgaacgagggaaaaattatttttgatggtgaggaagtgacgtttaacagtattaacgacgctctcgataaagggatatcgatgatccatcaagagttaagtccaattccagagatgacagtagcagaaaatatatttttaggcagagagcctacctttggaaagagtgggctcgtagacaataaaaaactaatagaaatgacacggaatttgttagaaagtttagagataaacatcgatccaagaaaaaagatgggcgagcttagcatagccaatacgcaaatgattgaaatcgcgaaagccatatcttttcattcaaagcttgtcattatggatgagccgacatctgccatcacagaaaaggaagtagcacagcttttcaaaatgattgaatcattgaaaaagaaaggtgttggcattatatacattactcataaaatgagcgaactggatgaaattgctgatgacatttctgtttttcgtgatggcaagtacattggtacggatacagcgaaaaacttaacgagagatgacttgattaaaatgatggtcggtcgcgaattgaaccaaattttcgataaacctgaaccgaagcttggcgaagtgatcctttccgtaaaaagcctaacaaaacaagactactttgaagacgttagctttgaagtccggaaaggagaaattgttggatttgcaggcttaatgggttcaggaagaaccgaagtgcttgagacgatcttcggcgtcaaggaagccgaatcaggggaaatttttgtaaacgggcaaaaagctagaataaagagcccgcaggatgctgtgaagaacaatatgggttttttaacggaggaccgcaagttgacaggtttatttcttcccttgtcggttagggagaacatgatcactgtcaatatcgataaatacattaacatgggttggcttaatggaaaacgagtgaaaaaagattgcgagcaacaaaaacaaaagctctacatcaaaactccgtccattgaacagatcgttgaaaatctgagcgggggtaatcaacagaaagtcttgcttgctagatggcttttaaaaaacccagatattttgtttctcgatgaaccgactcgaggaatcgatgtaggggcaaaatcagaattttacaatttaatctttgaattagcgagtcaagggaaagcaatcgttgttgtatcatcagagatggcagaaattcttgggttgtgtgatcgaattttggttatgcatgaagggaaggttaccggggagctcacacgggaggaagcgaaccaggagaagattatgcaatatgcgacaggccaagcaaaaatggcgaaaaagcttcacgttcataacaatttcgaacaaacggttacagccaataagatagagatcggttga

SEQ ID NO: 38471 - protein, 522 aa, Bacillus halodurans C-125
MGEHFLLEMVDITKEFPGVKALDRVQLKVRKGSVHALMGENGAGKSTLMKILIGMYKPNEGKIIFDGEEVTFNSINDALDKGISMIHQELSPIPEMTVAENIFLGREPTFGKSGLVDNKKLIEMTRNLLESLEINIDPRKKMGELSIANTQMIEIAKAISFHSKLVIMDEPTSAITEKEVAQLFKMIESLKKKGVGIIYITHKMSELDEIADDISVFRDGKYIGTDTAKNLTRDDLIKMMVGRELNQIFDKPEPKLGEVILSVKSLTKQDYFEDVSFEVRKGEIVGFAGLMGSGRTEVLETIFGVKEAESGEIFVNGQKARIKSPQDAVKNNMGFLTEDRKLTGLFLPLSVRENMITVNIDKYINMGWLNGKRVKKDCEQQKQKLYIKTPSIEQIVENLSGGNQQKVLLARWLLKNPDILFLDEPTRGIDVGAKSEFYNLIFELASQGKAIVVVSSEMAEILGLCDRILVMHEGKVTGELTREEANQEKIMQYATGQAKMAKKLHVHNNFEQTVTANKIEIG

SEQ ID NO: 38472 - DNA, 1500 bp, Bacillus halodurans C-125
  CDS (1)..(1500): transl_table=11
ttgatcgttgaaatgactggcatccataaatcatttagtggcaacccagtgttaaaggatgtctcattcaccctagaaaaaggggaaatccacgcccttatgggtgaaaatggcgctggaaagtccacgttaatgaagatcttaaccggcatttatgaacgagacagcggaacggtaaaaattaaaggacgtgaggtccattacaagcacccgaaagaagcggaagcggacgggcttgcggttatccaccaagagctaaacattcttcccgagctaacggttgctgaaaatctgtttgtcggcaaagaacgtacctacggaaaaacgggctggattaagtcgaaagaaatgaatcggctcgcagaagagaaattggctgagctcggattaaaggtgaaaggcactgagcgcgcagggaatctgtcggtcggaaaacaacagctcattgaaattgcaaaagcattgatgacgaatgccgatattattatcatggatgaaccgactgcggcgcttaccgatcgggaaattgacaccctttttgccaccgttcgcgagttgcaaaaaaaaggtgtaacgttcgtctacatttcccaccggatggaggaaatcttctctctctgtcaacggattacggtgcttcgtgatggtgaatatgttgggacaaaagtcattgccgagacgagcttcgatgaaatcgtgaaaatgatggtcggccgcgcattaggtaatcgcttccctgaacatacactcacgccaggtgacgtcaagcttgaaattaaacatttgactcgtgctggcgaatttgaaaacgtttccctttccgtcagagccggtgaaattctcggcatttccgggctcatgggggctggacgctctgagcttgtggaaacgattttcggctatcggaaggctgacagcggggaagtgtggatcgatggaaagcaagcggcgattaaaggaccggatcaagcgatcgcccaaggcatcggctttgtttcggaagatcgcaagtcaaaagggttaatcgttgatttttccattcgagacaacattagcttaacgaatctatcacgcatttcgacctcaagctggatctccagtgaaaaggaacgttcactctacgaagagctcgcgaaaaagctccacgtgaaggcgtctggcccttcgcaacaagcaaagtcactaagtggtggcaatcagcaaaagatcgtcattgccaagtggcttgggatcgagccgaaaattttaattttggatgagcctactcgcggagtggatgttggtgcgaaaaaagaaatttacacgattatgaatgaactcgctaagcaaggagtggccattatcatggtctcttccgaattgccagaagtcattggcctaagtacacgagtggctgtcatgtttgaaggaaagctgatgcacatccttgagcgggacgagctctcagaggagacgatcatgcattacgccacaggaggggataaacatgtccgacaataa

SEQ ID NO: 38473 - protein, 499 aa, Bacillus halodurans C-125
MIVEMTGIHKSFSGNPVLKDVSFTLEKGEIHALMGENGAGKSTLMKILTGIYERDSGTVKIKGREVHYKHPKEAEADGLAVIHQELNILPELTVAENLFVGKERTYGKTGWIKSKEMNRLAEEKLAELGLKVKGTERAGNLSVGKQQLIEIAKALMTNADIIIMDEPTAALTDREIDTLFATVRELQKKGVTFVYISHRMEEIFSLCQRITVLRDGEYVGTKVIAETSFDEIVKMMVGRALGNRFPEHTLTPGDVKLEIKHLTRAGEFENVSLSVRAGEILGISGLMGAGRSELVETIFGYRKADSGEVWIDGKQAAIKGPDQAIAQGIGFVSEDRKSKGLIVDFSIRDNISLTNLSRISTSSWISSEKERSLYEELAKKLHVKASGPSQQAKSLSGGNQQKIVIAKWLGIEPKILILDEPTRGVDVGAKKEIYTIMNELAKQGVAIIMVSSELPEVIGLSTRVAVMFEGKLMHILERDELSEETIMHYATGGDKHVRQ

SEQ ID NO: 38474 - DNA, 1497 bp, Pasteurella multocida subsp. multocida str. Pm70
  CDS (1)..(1497): transl_table=11
atgcaacacgaaaccttactccacatccaaggaattgataagtcttttcccggtgtcaaagcgctcagtaatgcttgcttatccgtttatgcaggacgtgccatggcattaatgggggaaaatggtgcgggtaaatcgaccttaatgaaagtgctcaccggcatttacagcaaagacgcaggcacaattgaatatttaggtaaacaagtcaccttcaaaggaccaaaagagtcgcaagaagccggcatcagcatcattcaccaagagttgaatttagttggcaacctaacaatcgcagaaaatattttcttaggccgtgaatttgtgacgccttggggaagtattgattggaaaaaaatgcaccaagaagcggacaaattacttaaacgtttaggtgttagccatagtagccatcaattgtgttccgaattatcaattggtgaacaacaaatggttgaaattgccaaagcactcagctttgaatctaaagtcattattatggatgaacccaccgatgcgctaaccgatacggaaacagccgctttatttaaggtgattcgggaactcaaagccgaaaaacgtggcattgtctatatctcgcatcgtatcaaagagatttttgaaatttgcgatgatgtgacggtattacgtgatggtgagtttattggtgaaaaagccgtcaatgtattagatgaagatcagctgattgaaatgatggttggacgccgtttagatgaacaatatccacatttagataaacctcgtggcgaattattacttgaagtcgaaaatctcagtggcagtggtgtacatgatgtcagtttcacattacatcgaggagaaattctaggggtttctggtctgatgggagcgggacgaacagagcttatgaaagtgttatatggcgcgctaccccgttcaagtggcaaagtgcggttagctcagcaagaaattcacaatacttgcccacaagatggcttaaatcatggcattgtgtacatttccgaagatcgcaaaggtgatggcttaattttaggcatgtcagtgaaagaaaatatgtcactcaccgctttagcctatttttctaaatctattcaaattgatcacaaagcagaacaattggcagtgggtgacttcatcaccatgtttaatatcaaaacaccaagccaagagcagcaaattgggctcttatctggcggtaatcagcaaaaagtggcgattgctaaaggcttaatgacacgtcccaacgtgttgattttagatgagccaacacgtggcgtggatgtgggggcgaaaaaagaaatttatcaactcattaatgaattcaaaaaagagggcttaagtatcattttagtgtcctctgaaatgccagaagtgcttggcatgagtgatcgtattttggtcatgcatgaagggcgaattagtgcagaattccaacgtggtgaagccacgcaagaaaaattattagccgcagccattggcaaaagtgcgctctaa

SEQ ID NO: 38475 - protein, 498 aa, Pasteurella multocida subsp. multocida str. Pm70
MQHETLLHIQGIDKSFPGVKALSNACLSVYAGRAMALMGENGAGKSTLMKVLTGIYSKDAGTIEYLGKQVTFKGPKESQEAGISIIHQELNLVGNLTIAENIFLGREFVTPWGSIDWKKMHQEADKLLKRLGVSHSSHQLCSELSIGEQQMVEIAKALSFESKVIIMDEPTDALTDTETAALFKVIRELKAEKRGIVYISHRIKEIFEICDDVTVLRDGEFIGEKAVNVLDEDQLIEMMVGRRLDEQYPHLDKPRGELLLEVENLSGSGVHDVSFTLHRGEILGVSGLMGAGRTELMKVLYGALPRSSGKVRLAQQEIHNTCPQDGLNHGIVYISEDRKGDGLILGMSVKENMSLTALAYFSKSIQIDHKAEQLAVGDFITMFNIKTPSQEQQIGLLSGGNQQKVAIAKGLMTRPNVLILDEPTRGVDVGAKKEIYQLINEFKKEGLSIILVSSEMPEVLGMSDRILVMHEGRISAEFQRGEATQEKLLAAAIGKSAL

SEQ ID NO: 38476 - DNA, 1521 bp, Pasteurella multocida subsp. multocida str. Pm70
  CDS (1)..(1521): transl_table=11
atgacaactcaaattccaaatcaagacagtgaaatactgctcacaatgaccaatgtctgtaaatcctttcccggtgttaaagcgttagacaatgcaaacctaactgtgcgctcgcattctgtccatgccttaatgggcgaaaatggggcgggcaaatcaaccttattaaaatgcttatttggtatttacagtaaagatgaaggtgacatccttttcttaggcaagccagtcaactttaaaacgtcgaaagaagccttagagaacgggatttccatggtgcaccaagaacttaacttggttaaacaatgtactgtaatggataatctttggttaggacgttatccattaaaagcaggctttgtcgatcacggcaaaatgtatcgtgataccaaagcgatttttgaagaattagatatcgatatcgatccaaaggaaaaagtggccaaattgtcagtgtcacaaatgcaaatgatcgagatcgcaaaggccttttcatacaatgccaaaatcgtaatcatggacgaaccgacttcttcgctttcagaaaaagaagttgaacacctatttaaaattatcgcgaagctgaaacaacgtggctgtggcattatttatatttcgcacaaaatggacgaaatcttcaaaatttgtgacgaaattacgattttacgcgatggtaaatggatcaatacagtcgctgttaaaggcaccacaatggatcagattgtatccatgatggttgggcgtgaactcacacaacgtttcccaccaaaaaccaataccccaaaagaaaccatcttaacggtggaaaatctgaccgcacttaatcagccatctattcaagatgtcagttttgaattacgcaaaggcgaagtgctcggcattgcgggactggttggggcaaaacgtaccgatattgtggaaacgatcttcggggtgcgtgaacgtaaatctggtgtgattaaactgcacgataaggaaatgaaaaaccgcaatgcgttcgaagccattaacaatggttttgctttggtcacggaagaacgtcgctctacagggatttatgcgaatctcagtattgagtttaactcattaatttctaacatgaaatcctatatcagcaagttaggtttattgagtaacacaaaaatgaaaagcgacacgcaatgggtcattgattccatgaatgtgaaaacgccatctcacaaaaccaatattggctcattatctggtggtaaccaacaaaaagtggtcattggtcgttggttattaacccaacctgaaatcttgatgttagacgaaccaacacgtggtatcgacattggtgcgaaatatgaaatttatcagctgattatggagttagccaaaaaagataaaggtatcatcatgatttcatctgaaatgccagagttattaggggttactgaccgaattcttgtgatgagtaacggtaaagtcgcaggtatcgtgaatactgctgaaacctcacaagaagaaattttacagctcgctgcaaaatatttataa

SEQ ID NO: 38477 - protein, 506 aa, Pasteurella multocida subsp. multocida str. Pm70
MTTQIPNQDSEILLTMTNVCKSFPGVKALDNANLTVRSHSVHALMGENGAGKSTLLKCLFGIYSKDEGDILFLGKPVNFKTSKEALENGISMVHQELNLVKQCTVMDNLWLGRYPLKAGFVDHGKMYRDTKAIFEELDIDIDPKEKVAKLSVSQMQMIEIAKAFSYNAKIVIMDEPTSSLSEKEVEHLFKIIAKLKQRGCGIIYISHKMDEIFKICDEITILRDGKWINTVAVKGTTMDQIVSMMVGRELTQRFPPKTNTPKETILTVENLTALNQPSIQDVSFELRKGEVLGIAGLVGAKRTDIVETIFGVRERKSGVIKLHDKEMKNRNAFEAINNGFALVTEERRSTGIYANLSIEFNSLISNMKSYISKLGLLSNTKMKSDTQWVIDSMNVKTPSHKTNIGSLSGGNQQKVVIGRWLLTQPEILMLDEPTRGIDIGAKYEIYQLIMELAKKDKGIIMISSEMPELLGVTDRILVMSNGKVAGIVNTAETSQEEILQLAAKYL

SEQ ID NO: 38478 - DNA, 1512 bp, Pasteurella multocida subsp. multocida str. Pm70
  CDS (1)..(1512): transl_table=11
atgtggattgacgttatgacgcagagagattgtattttaaagttaaaaaatatcggcaaaagcttttttgatgtaccggtattgaaaaacgtggatcttgatatttatgcgggtgaggttcactgtttagtgggtgaaaatggcgcaggaaaatccacattatgtaaaataattgcaggtatttatccatttgagcagggtgaaatgttttatgaaggaaagtcttattttcctaaaacagtgaaagaagcgcaatctctaggcatcggatttattcatcaagaattgatgttagtgccgcagttatccgtcttggaaaacatttttctagggaatgaaaaaacggtattttgtggaaaaatggattggcaaacgatgcgtcataaaacgcagcaaatcattagtgaattggagttagacattgatcctgatgcgaaagtagcggatctctccatcgcacagcaacaaatggttgagattgcaaaagccgtatttagtgaatataaagtgattatttttgatgagccaacctcttcaatttcgcgtaaaaatacacaaaccctgtttaaaattattcatcaattaaaagaaaaaaatgttgcaatgatttatatctctcaccgtctagatgaatttcaatacattgcggatcaagtaacggttttaagagatgggattcgaaccggtactatggcatatcgcgacacttctcctgatgaaatcgtcaaattaatggtagggcgggaaattaattttgctgaatatcatcgtcattatttaccaacacgagaagttttgcgcgtcgagagtttaacgaataaacatattaaaagcagttctttttctttatatgaaggtgaaatacttggttttgcgggattagtgggtgctggacgtacagagttattgcgagctatttttggtgcagatgaggctagcggagcgatttatctcaatgcgcaacgggtggaaattcgttcgccagaagatgcagtgaaacagaaaataggttttattaccgaagaccggaagcaacaaggcttaattttaggactcagtattcgagaaaatattacattaccgattttaaagcgcttttggaatggcttatttttaaataaaaagcaagagcgcttagtggcagaagaaaatcggcaaaaactccggattgtttcacatagccaagaccaaatcagccaaaccctttcaggcggtaatcaacaaaaagtgattattgctcgttggctcgaaagtggtgttaagattctgttttttgatgagccaacaaggggtatcgacgtgggagcgaagtccgaaatttatgatcttatgcggcagtttaccgataacggtggggcgattgtgatggtttcttcggatctgcctgaactgattacgatgtcagatcgtgttatcgtgatgcgacaaggtgggattgtgcgtgaagtaaaagataaagcagaaatgacagaagagaatttaatgcgtttaatgattggtgtagatgaatag

SEQ ID NO: 38479 - protein, 503 aa, Pasteurella multocida subsp. multocida str. Pm70
MWIDVMTQRDCILKLKNIGKSFFDVPVLKNVDLDIYAGEVHCLVGENGAGKSTLCKIIAGIYPFEQGEMFYEGKSYFPKTVKEAQSLGIGFIHQELMLVPQLSVLENIFLGNEKTVFCGKMDWQTMRHKTQQIISELELDIDPDAKVADLSIAQQQMVEIAKAVFSEYKVIIFDEPTSSISRKNTQTLFKIIHQLKEKNVAMIYISHRLDEFQYIADQVTVLRDGIRTGTMAYRDTSPDEIVKLMVGREINFAEYHRHYLPTREVLRVESLTNKHIKSSSFSLYEGEILGFAGLVGAGRTELLRAIFGADEASGAIYLNAQRVEIRSPEDAVKQKIGFITEDRKQQGLILGLSIRENITLPILKRFWNGLFLNKKQERLVAEENRQKLRIVSHSQDQISQTLSGGNQQKVIIARWLESGVKILFFDEPTRGIDVGAKSEIYDLMRQFTDNGGAIVMVSSDLPELITMSDRVIVMRQGGIVREVKDKAEMTEENLMRLMIGVDE

SEQ ID NO: 38480 - DNA, 1560 bp, Pasteurella multocida subsp. multocida str. Pm70
  CDS (1)..(1560): transl_table=11
atggttaaatgcgactatgtttactttatcaagggattttttcggatggagcacgttaattcaacaccacctgctcgccctctgttagaaatgaaaggtattgccaagcgctttggtaccttttatgcgctacaagatgtggatttatccatttatcgtggtgaaatccatgcattgatgggggaaaatggggcaggtaaaagtaccttaatgaaaattctcgctggggcgtacaccgcttctgcgggtgagatcttaattgacggtgaaccgtttcctatttcctcgccaaaagatgcgattaaagccggtattaccttgatttatcaagaaatccacctttcacctaatttaactgtggcagaaaatatttttctcggctgtgagattaaaaccctgtttggtttggatcgtaaaaccatggcagaagagtcacagaaagtacttgatcgtttaggcgcacagtttttagcgacgcaaaaagtctcatctttaacgatcgcagaacagcaacaagtggaaattgcccgtgccttatatcgaaaaagtcgtattctcgtgatggatgagccgactgcggcgttgtcttctcgtgaaacggaacgactgtttgccttagtgaaaaaattacgtgatgagggaatggcgatcatttatatcagtcaccgtatggcagaaatttatgagcttgctgaccgtgttagcgtgctacgcgatggtaagtatgtcggttctctaacccgcgataacttggattccgctactctcgtacagatgatggtaggacgcccgttaactgacttatttaataaagagaaagtgcctgttggggaagaggttctacgagtagaaaatttatccgatggacacaaacttaaagatgcctctttggttgttcgtgccggtgagattgtcggattgtctggattagtgggcgcgggacgctctgagctcgcacatttactcttcggcgtgaaacgcgcaacgaaaggcaaaatctatttgagtggcggtgaaatcagtttttcttcaccacgagaggcgatcgctcatcatgtagctttgttgccagaaaaccgtaaagaagaaggattgtttttagatctcaatattctcaaaaatgtcacaatggcgactttagagcgggatgccacgatgttggtgatcgaccaaaataaaggcaagcaaaccacgcaagcggcgattgaaggattgaaaatgcgtgtgccgagtgcgaatgtcaatgtcagtggcttatctggtgggaatcaacaaaaagtcttgttatcacgctgggcggcaattgaaccgaagctattcatcatggacgagccaacgcgcggtgtggatgtcggggcgaaaagtgaaatttatcgcatgatgattgaaatggcgaagaaaggggtcgcgattttaatgatttccagtgagttgcctgaaattgtgggtatgagcgatcgcgtttatgtcatgcgtgagggctataccgtgggtgaattagaaggcgatgacattaatcaagagcgtatcatggcatttgcttgtggcgcacaatcataa

SEQ ID NO: 38481 - protein, 519 aa, Pasteurella multocida subsp. multocida str. Pm70
MVKCDYVYFIKGFFRMEHVNSTPPARPLLEMKGIAKRFGTFYALQDVDLSIYRGEIHALMGENGAGKSTLMKILAGAYTASAGEILIDGEPFPISSPKDAIKAGITLIYQEIHLSPNLTVAENIFLGCEIKTLFGLDRKTMAEESQKVLDRLGAQFLATQKVSSLTIAEQQQVEIARALYRKSRILVMDEPTAALSSRETERLFALVKKLRDEGMAIIYISHRMAEIYELADRVSVLRDGKYVGSLTRDNLDSATLVQMMVGRPLTDLFNKEKVPVGEEVLRVENLSDGHKLKDASLVVRAGEIVGLSGLVGAGRSELAHLLFGVKRATKGKIYLSGGEISFSSPREAIAHHVALLPENRKEEGLFLDLNILKNVTMATLERDATMLVIDQNKGKQTTQAAIEGLKMRVPSANVNVSGLSGGNQQKVLLSRWAAIEPKLFIMDEPTRGVDVGAKSEIYRMMIEMAKKGVAILMISSELPEIVGMSDRVYVMREGYTVGELEGDDINQERIMAFACGAQS

SEQ ID NO: 38482 - DNA, 1533 bp, Pseudomonas aeruginosa PAO1
  CDS (1)..(1533): transl_table=11
atgtctagcgacgcattgccgctgctgagcatccgcggggtcggcaagacctacgcgcagccggtgctggcggagatcgacctgcaactgttcggcggcgaggtgctggccctgaccggcgagaacggcgccggcaagagcaccctgtcgaagatcgtcggcggcctggagcgtcccggcgccggcagcctggaactcctcggccggccctacgcccccgctagccgccgcgaggccgaggcgctgggcgtgcgcatggtgatgcaggaactgaacctgctgccgaccctgtcggtggcggagaacctgttcctccacgacctgccccggcgcgccggctggatcgaccgtcggcgcctgcgcgcggcggcccgcgaggcgatggcccaggtcggcctggaggcgatcgatcccgacacgctggtcggcgacctcggcatcggccaccagcagatggtcgagatcgcccgcaacctgatcggcgactgccgcttgctgatcctcgacgaacccacggcgatgcttaccgcgcgcgaagtggacatgctcttcgagcaggtcgagcggctgcgcgaacgcggcgtggcgatcgtctacatctcccatcgcctggaagagctggcgcggatttcgcagcgcatcgcggtgttgcgcgatggccgcctggtctgcgtcgagccgatcgagcgctacgacgccgaccaactggtgaccctgatggtcggccgcgacctgggcgagcgcttcgacctgggcccacggcagaccggtgcgccgctgctgcgggtggagcggctgagccggcgcggcaaggtgcatgaggtgtcgttcgaggtgcgcgcgggggagatcttcggcatttccggactgatcggctccgggcgcaccgaattgttgcgcctgatctacggcgccgaccgcgccgacggtgggcaggtcctgctcggcgatccgccgcagcgcctgagcctgcgttcgccggccgactcggtgcgccagggggtggcgctgatcaccgaggaccgcaagggcgagggcctgctgctggaccagtcgatcagcgccaacctcgccctgggcaacctgccggcgctggcgcgccacggggtgatcgaccggcgccgcgaggaagccctggcgcggcgccaggtggaggcgctgcgggtgcgctgcgcggacaccgcgcaggcggtgggcgaactgtccggcggcaaccagcagaaggtggtgatcggccgctggctggaacgcgactgccaggtgctgctgttcgacgagccgacccgtggcatcgacgtcggcgccaagttcgacatctatgccttgctcgccgaactgacccgccggggcaaggcgctggtggtggtgtccagcgacctgcgcgagctgatgctgatctgcgatcgcatcggcgtgctctcggcgggacgtatggtggacaccttcgagcgcgacgcctggacccaggacgcgctgctggcggcggccttcgccggttacaagaaacgcgacgcgctgctggcgacgtcgtga

SEQ ID NO: 38483 - protein, 510 aa, Pseudomonas aeruginosa PAO1
MSSDALPLLSIRGVGKTYAQPVLAEIDLQLFGGEVLALTGENGAGKSTLSKIVGGLERPGAGSLELLGRPYAPASRREAEALGVRMVMQELNLLPTLSVAENLFLHDLPRRAGWIDRRRLRAAAREAMAQVGLEAIDPDTLVGDLGIGHQQMVEIARNLIGDCRLLILDEPTAMLTAREVDMLFEQVERLRERGVAIVYISHRLEELARISQRIAVLRDGRLVCVEPIERYDADQLVTLMVGRDLGERFDLGPRQTGAPLLRVERLSRRGKVHEVSFEVRAGEIFGISGLIGSGRTELLRLIYGADRADGGQVLLGDPPQRLSLRSPADSVRQGVALITEDRKGEGLLLDQSISANLALGNLPALARHGVIDRRREEALARRQVEALRVRCADTAQAVGELSGGNQQKVVIGRWLERDCQVLLFDEPTRGIDVGAKFDIYALLAELTRRGKALVVVSSDLRELMLICDRIGVLSAGRMVDTFERDAWTQDALLAAAFAGYKKRDALLATS

SEQ ID NO: 38484 - DNA, 1479 bp, Lactococcus lactis subsp. lactis Il1403
  CDS (1)..(1479): transl_table=11
ttgaaaatagaaatgaagaacatttctaaatcatttggaacgaataaagttcttgaagcaattgatttaacgattaattcaggagaagttcatgccttaatgggagaaaatggggctggaaaatctactttgatgaatattctaactggtctatttccagcttctggtggggaaattgagattgacagtgaaaagaaaatttttaaaaatcctcaggaagcagaaggatttggaattagttttattcatcaggaaatgaatacttggcctgatttaacagtcttagagaatctttttttaggacgagagataaaaaataaatttggtattttagatacgaaggccatgcgaaaaaaagcaaattttgcttttgaacagttgggagtaaaaattgatttagacaaagaaattggtaatttatcagttggtcagcaacaaatggttgaaatagctaaaagttttttgtctgatttaaaaattttgattatggatgaaccaacagcagcattgaccgaaagagaaacagaaagattgttttcagttattgctggtctaaaaaatcaaggggttggaattatttatatttctcatcgaatggaagaaatttttaaaatcacagattgtataactgtcatgcgtgatggtctagtcatcgatacgcaaaagacgaaagaaaccaacgttgatgaattagttagaaaaatggttggtcggtcaattacagattactatcccccaaaaaatgctgaaattcgagaaattgtatttgaagccgaccatttatcggcagaattttttaaagatatttcattttcagttcgttcaggtgaaattctcggatttgcaggactcatgggagctggtagaactgaggtcatgcgagcaatttttggaattgataagctaaaatcaggcacgataaaaattaatggaaagagtctaactatcaataacccggcacaagcaatcaaagaaggaattggctttttaacagaagaccgaaaagatgaaggacttgttcttgatttctcaataaaagataatattactcttccgagtacaaaggattttattcatcatggcctctttgatgataaaacagcaacaacttttgttaagcaactctctgagcgtcttaatgttaaagcgacagatgaagaacaaatagttgggtctctatctggaggaaatcaacaaaaagttgtccttgccaaatggattggcattgcgccaaaagttttaatcttagatgaaccaacacgaggagtcgacgtgggagccaagcgtgaaatttatcaattaatgaatgaacttgctgaacgtggtgttccaattattatgatttcaagtgatttacccgaaattcttggtgttgcagaccgaattgcagtgatgcatgaaggagaaatagcaggaattttagccaaaaatgaagcaacacaagaaaatgtgatgcagctcgcaacaggaggacaataa

SEQ ID NO: 38485 - protein, 492 aa, Lactococcus lactis subsp. lactis Il1403
MKIEMKNISKSFGTNKVLEAIDLTINSGEVHALMGENGAGKSTLMNILTGLFPASGGEIEIDSEKKIFKNPQEAEGFGISFIHQEMNTWPDLTVLENLFLGREIKNKFGILDTKAMRKKANFAFEQLGVKIDLDKEIGNLSVGQQQMVEIAKSFLSDLKILIMDEPTAALTERETERLFSVIAGLKNQGVGIIYISHRMEEIFKITDCITVMRDGLVIDTQKTKETNVDELVRKMVGRSITDYYPPKNAEIREIVFEADHLSAEFFKDISFSVRSGEILGFAGLMGAGRTEVMRAIFGIDKLKSGTIKINGKSLTINNPAQAIKEGIGFLTEDRKDEGLVLDFSIKDNITLPSTKDFIHHGLFDDKTATTFVKQLSERLNVKATDEEQIVGSLSGGNQQKVVLAKWIGIAPKVLILDEPTRGVDVGAKREIYQLMNELAERGVPIIMISSDLPEILGVADRIAVMHEGEIAGILAKNEATQENVMQLATGGQ

SEQ ID NO: 38486 - DNA, 1521 bp, Escherichia coli O157:H7 EDL933
  CDS (1)..(1521): n means a or g or c or t/u, s means g or c
atggtcagctcaacgactccgtcttccggggaatacttgttggaaatgagcggtatcaacaagtcttttcctggtgttaaggcacttgataacgttaatttaaaagtccggccacattctatccatgcattaatgggggaaaacggcgcaggaaaatcaacattattaaaatgcctgtttggtatttataaaaaagactccggcaccattttattccagggtaaagagatcgatttccattcggccaaagaagcactggaaaatggtatttcgatggtacaccaggagttaaacctggtattacaacgttcggtgatggacaacatgtggcttgggcgataccccaccaaaggcatgtttgtcgatcaggacaaaatgtaccgcgaaaccaaagcgatttttgatgaactggatattgatatcgatccgcgtgcgcgcgtcggcacattatctgtttcgcaaatgcagatgatcgaaatcgccaaagcgttttcctataacgcgaaaattgtgattatggatgaaccgacttcttcgttaaccgaaaaagaggtcaatcatctgttcactattattcgtaaattaaaagagcgcggctgcggtattgtttatatctcgcataaaatggaggaaatcttccagttatgtgatgaagttaccgtattgcgcgacggtcagtggatcgccaccgaaccgctggcagggctgacgatggacaagattatcgccatgatggttgggcgttctcttaaccagcgttttcctgacaaagaaaacaagccgggcgaagtcatcctcgaggtacgtaacctgacgtcactgcgccagccgtcgattcgcgatgtctcgtttgatctgcataaaggggagatcctcggtattgccggtctggtgggggcgaaacgtaccgatattgttgagacgttatttggtattcgcgagaaatcggctggcaccattacgttgcacggcaaaaagatcaataaccataatgccaacgaagccataaaccacggatttgcactggtaactgaggagcgccgctcaacgggaatttatgcctatctggatattggttttaactcgttaatttccaatattcgcaactacaaaaataaagttggtttactggataactcgcggatgaaaagcgatacccagtgggtgattgattcgatgcgggtaaaaacaccggggcatcggacgcaaattggttcgctctcaggtggtaatcagcaaaaggtgattattgggcgctggctgttaacgcaaccagaaatattaatgytcgatgaaccgacgcgcggtattgatgttggggcgaagtttgagatttatcagttaattgccgaactggcgaagaaaggcaaggggattattattatctcctctgaaatgccagagttgttagggataacagaccgtattctggttatgagcaatggcctcgtttccggaattgtcgatacaaaaacaacaacgcaaaacgaaattctacgtcttgcgtctttgcacctttaa

SEQ ID NO: 38487 - protein, 506 aa, Escherichia coli O157:H7 EDL933
  Xaa in the position 430 is unknown
MVSSTTPSSGEYLLEMSGINKSFPGVKALDNVNLKVRPHSIHALMGENGAGKSTLLKCLFGIYKKDSGTILFQGKEIDFHSAKEALENGISMVHQELNLVLQRSVMDNMWLGRYPTKGMFVDQDKMYRETKAIFDELDIDIDPRARVGTLSVSQMQMIEIAKAFSYNAKIVIMDEPTSSLTEKEVNHLFTIIRKLKERGCGIVYISHKMEEIFQLCDEVTVLRDGQWIATEPLAGLTMDKIIAMMVGRSLNQRFPDKENKPGEVILEVRNLTSLRQPSIRDVSFDLHKGEILGIAGLVGAKRTDIVETLFGIREKSAGTITLHGKKINNHNANEAINHGFALVTEERRSTGIYAYLDIGFNSLISNIRNYKNKVGLLDNSRMKSDTQWVIDSMRVKTPGHRTQIGSLSGGNQQKVIIGRWLLTQPEILMXDEPTRGIDVGAKFEIYQLIAELAKKGKGIIIISSEMPELLGITDRILVMSNGLVSGIVDTKTTTQNEILRLASLHL

SEQ ID NO: 38488 - DNA, 1554 bp, Escherichia coli O157:H7 EDL933
  CDS (1)..(1554): n means a or g or c or t/u, s means g or c
gtgctgatatcgacaacctcgcaggagtccaccatgaacagcacgccagttctggagatgcgcaatattgccaaagccttcggcaaattttatgcactcaaaggggtggatttgacggtctaccctggcgagatccatgccctgatgggggaaaacggcgcgggaaaaagcacgctgatgaaggtgctggcgggggcgtataccgccaccagcggcgagattctcatagacggcaagccctttcacattcgcacgccaaaagatgccttaagcgccggtattacgctgatttatcaggagatgcagctggcaccgaatctgtcggtggcagaaaatatttttctcggcagcgagctttcccacggcgggctggtgcagcgtaaagagatgctagtgcaggcgcaaaaagtgatcgaccgcctcggcgcgcagtttaacgccagcgataaggtcatgacgctgaccattgccgagcaacagcaggtcgaaatcgcccgcgcactacatcgcaacagccgcattctggtgatggacgaacccaccgctgccytctcctcccgcgaaactcaccgcctgtttgaactgattatgcggctgcgcgatgaagggatggcgattatctacattagccaccgcatggcggaagtgtatgagctttccgatcgcgtcagcgtgctacgcgacgggcaatacgttggcagcctgacccgcgataacctcaatgccggggagctggtgcggatgatggtcggcaggccactgagcgatctgttcaataaagagcgcgatatcccgctcggtaaagcccgcctgaatgttcaccacctgaccgacggcggcaaagtccagccgagtagcctgctggtgcgttccggcgaaattgttggcctcgccggactggtgggtgccggacgttccgaactggcgcagttgatcttcggcgtgcggaaagcgacaggcggaatgattgaagtcgatggtgaaccggtggtgatccactccccgcgcgaagccatcgatcttggcattggttttctcaccgaaaaccgcaaagaacaaggcttattccttgaaatggcagcagccgaaaacatcaccatggcaaccctggagcgcgatgcccgctggggaatgctcaatcgcaaaaaagcgcaaaccatttccgatgacgccattaagttgctcaacattcgcgtgcctcatgcccaggtacgcgcgggcgggctttccggcggcaatcagcaaaaactgttgatctcccgctgggtggcgattggcccgcgcattttactgctcgatgaacccgcccgcggcgtggacgttggcgccaaaagtgagatctaccggatcatgaacgagatggcgcgcaagggcgtggcgatcctgatgatctccagcgaactgccggagatagtgggaatgagcgatcgcgtctatgtgatgcgcgaaggcagcattgccggtgagttaaacggcaaaaacatcacccaggaaaacattatgaccttagcgactggcgtcaacgacgcccattcccaggcggtaacctcatga

SEQ ID NO: 38489 - protein, 517 aa, Escherichia coli O157:H7 EDL933
  Xaa in the position 184 is unknown
MLISTTSQESTMNSTPVLEMRNIAKAFGKFYALKGVDLTVYPGEIHALMGENGAGKSTLMKVLAGAYTATSGEILIDGKPFHIRTPKDALSAGITLIYQEMQLAPNLSVAENIFLGSELSHGGLVQRKEMLVQAQKVIDRLGAQFNASDKVMTLTIAEQQQVEIARALHRNSRILVMDEPTAAXSSRETHRLFELIMRLRDEGMAIIYISHRMAEVYELSDRVSVLRDGQYVGSLTRDNLNAGELVRMMVGRPLSDLFNKERDIPLGKARLNVHHLTDGGKVQPSSLLVRSGEIVGLAGLVGAGRSELAQLIFGVRKATGGMIEVDGEPVVIHSPREAIDLGIGFLTENRKEQGLFLEMAAAENITMATLERDARWGMLNRKKAQTISDDAIKLLNIRVPHAQVRAGGLSGGNQQKLLISRWVAIGPRILLLDEPARGVDVGAKSEIYRIMNEMARKGVAILMISSELPEIVGMSDRVYVMREGSIAGELNGKNITQENIMTLATGVNDAHSQAVTS

SEQ ID NO: 38490 - DNA, 1566 bp, Deinococcus radiodurans R1
  CDS (1)..(1566): transl_table=11
atgaccgcccccgcacccacgctcgcccatgcccacgcctcgccggtggccctgtcgctgcgcggcatcaccaaacgctttccgctggtgctcgccaacgacgacatttcgctggacgtgaagtggggcagcgtccacgccctgtgcggtgaaaacggcgcgggcaaaagcaccctgatgaaaatcgtctacggcgcccagccgccgaccagcggcgaaatcgtggtggacgggcagccggtgagcttcgccagccccgccgacgcgattgcccagggcatcggcatggtgtttcagcactttcaactcgtggacaccctgaccgtcaccgagaacgtgattctgggcgccgagccgacccagggcacctccatcaactacggcgcggcgcgggcgcgggtggccgaactgatccggcagttcaacttcgacctcaaccccgacgcgcgggtgggcgacctgccggtgggcctccagcagaaggtggagattctcaagacgctctaccggggagcccgcatcctgattctggacgagccgacggcggtgctgaccccttcggaaaccgacgaactgttcgacttcctgaaaaaccagtacgcggcgagcggcaacgcggtgattttcatttcgcacaagctgcacgaggtgctgcacatctccgacaccatttcggtcatccgtgacggcaagatgatcggttctatcccggcggcgggcgcgaccaccgagacactggcgaagatgatggtgggccgcgacgtgtcgctgcgggtggacaagcgccccgcgcagcccggcgaagtcgcactcgacgtgcagaacgtgacggtgcgcggcgaaaacggtgggcatggcggccatgccgaagccgtgcgcgatgtcagttttcaggttcgcgctggggaaatcgtgggcatcgcgggcgtggaaggcaacggccagagcgaactcgtcgaggcgattaccgggctgctgccgtaccagggccgcatcacctacctgggccgcgaagcgcggggcgtgcgcgaggtcgaagcgtcgggcctctcgcacgtccccgaagaccgcaatgagcgtgggctggtgctggaaatgtccaccgccgagaacttcattctgggcgagcaggaccgcgcccccttcgccggaccgctgggcctgctgcggctcgacgtgatcgagcagaatgcccgcgaactctccgagcagtacgacgtgcgcccgcgctccacctcgctgcctgccgggcgctactcgggcggcaacgcgcagaaaatcatcgtcgcccgcgagatgcgcaaagggccaaagattctggtcgccagccagcccacgcgcggggtggacatcggcgccatcgaattcatccacgcccgcatcgtggaggcgcgcgaccagggcctcgcggtgctgcttatttccgccgacctcggcgaagtgatgaacctcgccgaccgcattctggtgatgttcgagggccagattgccggcgaagtcgccgcgagcgaggccaccgaaacgggcctgggcctgctgatgaccgggagcggggcgcgaggctga

SEQ ID NO: 38491 - protein, 521 aa, Deinococcus radiodurans R1
MTAPAPTLAHAHASPVALSLRGITKRFPLVLANDDISLDVKWGSVHALCGENGAGKSTLMKIVYGAQPPTSGEIVVDGQPVSFASPADAIAQGIGMVFQHFQLVDTLTVTENVILGAEPTQGTSINYGAARARVAELIRQFNFDLNPDARVGDLPVGLQQKVEILKTLYRGARILILDEPTAVLTPSETDELFDFLKNQYAASGNAVIFISHKLHEVLHISDTISVIRDGKMIGSIPAAGATTETLAKMMVGRDVSLRVDKRPAQPGEVALDVQNVTVRGENGGHGGHAEAVRDVSFQVRAGEIVGIAGVEGNGQSELVEAITGLLPYQGRITYLGREARGVREVEASGLSHVPEDRNERGLVLEMSTAENFILGEQDRAPFAGPLGLLRLDVIEQNARELSEQYDVRPRSTSLPAGRYSGGNAQKIIVAREMRKGPKILVASQPTRGVDIGAIEFIHARIVEARDQGLAVLLISADLGEVMNLADRILVMFEGQIAGEVAASEATETGLGLLMTGSGARG

SEQ ID NO: 38492 - DNA, 1521 bp, Escherichia coli O157:H7
  CDS (1)..(1521): transl_table=11
atggtcagctcaacgactccgtcttccggggaatacttgttggaaatgagcggtatcaacaagtcttttcctggtgttaaggcacttgataacgttaatttaaaagtccggccacattctatccatgcattaatgggggaaaacggcgcaggaaaatcaacattattaaaatgcctgtttggtatttataaaaaagactccggcaccattttattccagggtaaagagatcgatttccattcggccaaagaagcactggaaaatggtatttcgatggtacaccaggagttaaacctggtattacaacgttcggtgatggacaacatgtggcttgggcgataccccaccaaaggcatgtttgtcgatcaggacaaaatgtaccgcgaaaccaaagcgatttttgatgaactggatattgatatcgatccgcgtgcgcgcgtcggcacattatctgtttcgcaaatgcagatgatcgaaatcgccaaagcgttttcctataacgcgaaaattgtgattatggatgaaccgacttcttcgttaaccgaaaaagaggtcaatcatctgttcactattattcgtaaattaaaagagcgcggctgcggtattgtttatatctcgcataaaatggaggaaatcttccagttatgtgatgaagttaccgtattgcgcgacggtcagtggatcgccaccgaaccgctggcagggctgacgatggacaagattatcgccatgatggttgggcgttctcttaaccagcgttttcctgacaaagaaaacaagccgggcgaagtcatcctcgaggtacgtaacctgacgtcactgcgccagccgtcgattcgcgatgtctcgtttgatctgcataaaggggagatcctcggtattgccggtctggtgggggcgaaacgtaccgatattgttgagacgttatttggtattcgcgagaaatcggctggcaccattacgttgcacggcaaaaagatcaataaccataatgccaacgaagccataaaccacggatttgcactggtaactgaggagcgccgctcaacgggaatttatgcctatctggatattggttttaactcgttaatttccaatattcgcaactacaaaaataaagttggtttactggataactcgcggatgaaaagcgatacccagtgggtgattgattcgatgcgggtaaaaacaccggggcatcggacgcaaattggttcgctctcaggtggtaatcagcaaaaggtgattattgggcgctggctgttaacgcaaccagaaatattaatgctcgatgaaccgacgcgcggtattgatgttggggcgaagtttgagatttatcagttaattgccgaactggcgaagaaaggcaaggggattattattatctcctctgaaatgccagagttgttagggataacagaccgtattctggttatgagcaatggcctcgtttccggaattgtcgatacaaaaacaacaacgcaaaacgaaattctacgtcttgcgtctttgcacctttaa

SEQ ID NO: 38493 - protein, 506 aa, Escherichia coli O157:H7
MVSSTTPSSGEYLLEMSGINKSFPGVKALDNVNLKVRPHSIHALMGENGAGKSTLLKCLFGIYKKDSGTILFQGKEIDFHSAKEALENGISMVHQELNLVLQRSVMDNMWLGRYPTKGMFVDQDKMYRETKAIFDELDIDIDPRARVGTLSVSQMQMIEIAKAFSYNAKIVIMDEPTSSLTEKEVNHLFTIIRKLKERGCGIVYISHKMEEIFQLCDEVTVLRDGQWIATEPLAGLTMDKIIAMMVGRSLNQRFPDKENKPGEVILEVRNLTSLRQPSIRDVSFDLHKGEILGIAGLVGAKRTDIVETLFGIREKSAGTITLHGKKINNHNANEAINHGFALVTEERRSTGIYAYLDIGFNSLISNIRNYKNKVGLLDNSRMKSDTQWVIDSMRVKTPGHRTQIGSLSGGNQQKVIIGRWLLTQPEILMLDEPTRGIDVGAKFEIYQLIAELAKKGKGIIIISSEMPELLGITDRILVMSNGLVSGIVDTKTTTQNEILRLASLHL

SEQ ID NO: 38494 - DNA, 1512 bp, Escherichia coli O157:H7; identical to SEQ ID NO: 27178
  CDS (1)..(1512): transl_table=11

SEQ ID NO: 38495 - protein, 503 aa, Escherichia coli O157:H7; identical to SEQ ID NO: 27179

SEQ ID NO: 38496 - DNA, 1542 bp, Escherichia coli O157:H7
  CDS (1)..(1542): transl_table=11
atgccttatctacttgaaatgaagaacattaccaaaaccttcggcagtgtgaaggcgattgataacgtcagcttgcggttgaatgctggcgaaatcgtctcactctgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcaccaggaattggccctggtgaaagaattgaccgtgctggaaaatatcttcctgggtaacgaaataacccacaatggcattatggattatgacctgatgacgctacgctgtcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcggttttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatactgggtattgccggactcgttggtgccggacgtaccgagaccattcagtgcctgtttggtgtgtggcccggacaatgggaaggaaaaatttatattgatggcaaacaggtagatattcgtaactgtcagcaagccatcgcccaggggattgcgatggtccccgaagacagaaagcgcgacggcatcgttccggtaatggcggttggtaaaaatattaccctcgccgcactcaataaatttaccggtggcattagccagcttgatgacgcggcagagcaaaaatgtattctggaatcaatccagcaactcaaagttaaaacgtcgtcccccgaccttgctattggacgtttgagcggcggcaatcagcaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttctgaattacctgaagtgctcggccttagcgatcgtgtactagtaatgcatgaagggaaactaaaagccaacctgataaatcataacctgactcaggagcaggtgatggaagccgcattgaggagcgaacatcatgtcgaaaagcaatccgtctga

SEQ ID NO: 38497 - protein, 513 aa, Escherichia coli O157:H7
MPYLLEMKNITKTFGSVKAIDNVSLRLNAGEIVSLCGENGSGKSTLMKVLCGIYPHGSYEGEIIFAGEEIQASHIRDTERKGIAIIHQELALVKELTVLENIFLGNEITHNGIMDYDLMTLRCQKLLAQVSLSISPDTRVGDLGLGQQQLVEIAKALNKQVRLLILDEPTASLTEQETSVLLDIIRDLQQHGIACIYISHKLNEVKAISDTICVIRDGQHIGTRDAAGMSEDDIITMMVGRELTALYPNEPHTTGDEILRIEHLTAWHPVNRHIKRVNDVSFSLKRGEILGIAGLVGAGRTETIQCLFGVWPGQWEGKIYIDGKQVDIRNCQQAIAQGIAMVPEDRKRDGIVPVMAVGKNITLAALNKFTGGISQLDDAAEQKCILESIQQLKVKTSSPDLAIGRLSGGNQQKAILARCLLLNPRILILDEPTRGIDIGAKYEIYKLINQLVQQGIAVIVISSELPEVLGLSDRVLVMHEGKLKANLINHNLTQEQVMEAALRSEHHVEKQSV

SEQ ID NO: 38498 - DNA, 1506 bp, Escherichia coli O157:H7
  CDS (1)..(1506): transl_table=11
atggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggcatctatactcgcgatgccggtacgcttttatggctggggaaagaaacgacatttaccgggccgaaatcttcccaggaagccgggattgggattatccatcaggaactgaacctgatcccgcagttaaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatagccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagagttgcgatgacgttaccgtttttcgtgacggacaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcctggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgattttattcgcctgttcaatgtgaaaacgccgtcgatggagcaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 38499 - protein, 501 aa, Escherichia coli O157:H7
MEALLQLKGIDKAFPGVKALSGAALNVYPGRVMALVGENGAGKSTMMKVLTGIYTRDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFESCDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 38500 - DNA, 1521 bp, Escherichia coli O157:H7
  CDS (1)..(1521): transl_table=11
atgaacagcacgccagttctggagatgcgcaatattgccaaagccttcggcaaattttatgcactcaaaggggtggatttgacggtctaccctggcgagatccatgccctgatgggggaaaacggcgcgggaaaaagcacgctgatgaaggtgctggcgggggcgtataccgccaccagcggcgagattctcatagacggcaagccctttcacattcgcacgccaaaagatgccttaagcgccggtattacgctgatttatcaggagatgcagctggcaccgaatctgtcggtggcagaaaatatttttctcggcagcgagctttcccacggcgggctggtgcagcgtaaagagatgctagtgcaggcgcaaaaagtgatcgaccgcctcggcgcgcagtttaacgccagcgataaggtcatgacgctgaccattgccgagcaacagcaggtcgaaatcgcccgcgcactacatcgcaacagccgcattctggtgatggacgaacccaccgctgccctctcctcccgcgaaactcaccgcctgtttgaactgattatgcggctgcgcgatgaagggatggcgattatctacattagccaccgcatggcggaagtgtatgagctttccgatcgcgtcagcgtgctacgcgacgggcaatacgttggcagcctgacccgcgataacctcaatgccggggagctggtgcggatgatggtcggcaggccactgagcgatctgttcaataaagagcgcgatatcccgctcggtaaagcccgcctgaatgttcaccacctgaccgacggcggcaaagtccagccgagtagcctgctggtgcgttccggcgaaattgttggcctcgccggactggtgggtgccggacgttccgaactggcgcagttgatcttcggcgtgcggaaagcgacaggcggaatgattgaagtcgatggtgaaccggtggtgatccactccccgcgcgaagccatcgatcttggcattggttttctcaccgaaaaccgcaaagaacaaggcttattccttgaaatggcagcagccgaaaacatcaccatggcaaccctggagcgcgatgcccgctggggaatgctcaatcgcaaaaaagcgcaaaccatttccgatgacgccattaagttgctcaacattcgcgtgcctcatgcccaggtacgcgcgggcgggctttccggcggcaatcagcaaaaactgttgatctcccgctgggtggcgattggcccgcgcattttactgctcgatgaacccgcccgcggcgtggacgttggcgccaaaagtgagatctaccggatcatgaacgagatggcgcgcaagggcgtggcgatcctgatgatctccagcgaactgccggagatagtgggaatgagcgatcgcgtctatgtgatgcgcgaaggcagcattgccggtgagttaaacggcaaaaacatcacccaggaaaacattatgaccttagcgactggcgtcaacgacgcccattcccaggcggtaacctcatga

SEQ ID NO: 38501 - protein, 506 aa, Escherichia coli O157:H7
MNSTPVLEMRNIAKAFGKFYALKGVDLTVYPGEIHALMGENGAGKSTLMKVLAGAYTATSGEILIDGKPFHIRTPKDALSAGITLIYQEMQLAPNLSVAENIFLGSELSHGGLVQRKEMLVQAQKVIDRLGAQFNASDKVMTLTIAEQQQVEIARALHRNSRILVMDEPTAALSSRETHRLFELIMRLRDEGMAIIYISHRMAEVYELSDRVSVLRDGQYVGSLTRDNLNAGELVRMMVGRPLSDLFNKERDIPLGKARLNVHHLTDGGKVQPSSLLVRSGEIVGLAGLVGAGRSELAQLIFGVRKATGGMIEVDGEPVVIHSPREAIDLGIGFLTENRKEQGLFLEMAAAENITMATLERDARWGMLNRKKAQTISDDAIKLLNIRVPHAQVRAGGLSGGNQQKLLISRWVAIGPRILLLDEPARGVDVGAKSEIYRIMNEMARKGVAILMISSELPEIVGMSDRVYVMREGSIAGELNGKNITQENIMTLATGVNDAHSQAVTS

SEQ ID NO: 38502 - DNA, 1581 bp, Mycoplasma pulmonis UAB CTIP
  CDS (1)..(1581): transl_table=4
atgaacactaacgaagatgtcattcttgagttaaaaaatgttacaaaagtctatcctggtgtagttgctttaaataatgtttcttttaaagttaaaagaaaatccattttatctcttgtaggagaaaatggagctggtaaatcaaccattttaaaggttataagtggcgttattccaaatgataaatttgatggagcaattttttacaacggtattcaaacaaacttttctaatttaaaacaatctgaaaaagctggaattgcaattattcaccaagaacttgctatctcaccacatctttcactttatgaaaatatttttttaggtaactatgaagcaaaacatgggctaattaatcgtaatgaaatgattaaaaaagctaattattatcttcatttagtaggtcttaaaaaaaatccagatactaaagctggaacactttcaattgctgatcaacaacttttggaaatagcaaaagcattggctaaaaaagctaagttattaattttagatgaacccacttcttcattaaatgacaaagatagttatgcacttttagatattatgaaaagacttcgtgatgaagaaggaataacatgtatttttgttagtcataaacttaaagaagttgcatatgtagcagattacataaccatcattagggatggaaaacacatctctgactatagtaattcaaaagaaaaaaccataaatgaagctactttaattaaagacattgttggaagggacttagaatctaaatttcctgaaaaaccagctgagcgaaaaattggaaaaattaaacttgaagttgaaaaattccaagttgaaaatccaaaagttaatggaaaattagatgtcattaatgcttcatttaatgttagagaaggcgaaattgttggaataagtggactagttggttcaggaagaagtgaacttgctatgtcaatttttggaaatgcctatggtattagaaaaaatggtaatatcaaaattgatggcaagatagttaatttaaaaactccgcttcaagctattaaaaatggtctaatgtacgcctctgaggatcgaaaaaatgttggtttaattcaaatgttttcaattcattgaaatatctcctcagctgcctctcacattttttctaacaaatttggaattctaaaaaaagaaaaagaaacacaaaactcttcatatatgagaagcaaagttaacattaaagccccttctgttgactatctagttgagactctttcaggaggaaatcaacaaaaagttttaatagccaaggccttaacaactaattttgatatattaattattgatgaacctactaaaggtattgacgttggatctaaatatgaaatttataaaatattattagatcttgcctcagaaggaaaagccattgttgttatttcctctgaattagaagagcttttaggaattacagatagaatctttgttatgtcacaaggaattatcaaaggagagcttccttcaaaagaggcaactccagaaaaagtaatgcaaattgccattggaacaaaacaaaatgaaaggagtcaagcaaatgtccaataa

SEQ ID NO: 38503 - protein, 526 aa, Mycoplasma pulmonis UAB CTIP
MNTNEDVILELKNVTKVYPGVVALNNVSFKVKRKSILSLVGENGAGKSTILKVISGVIPNDKFDGAIFYNGIQTNFSNLKQSEKAGIAIIHQELAISPHLSLYENIFLGNYEAKHGLINRNEMIKKANYYLHLVGLKKNPDTKAGTLSIADQQLLEIAKALAKKAKLLILDEPTSSLNDKDSYALLDIMKRLRDEEGITCIFVSHKLKEVAYVADYITIIRDGKHISDYSNSKEKTINEATLIKDIVGRDLESKFPEKPAERKIGKIKLEVEKFQVENPKVNGKLDVINASFNVREGEIVGISGLVGSGRSELAMSIFGNAYGIRKNGNIKIDGKIVNLKTPLQAIKNGLMYASEDRKNVGLIQMFSIHWNISSAASHIFSNKFGILKKEKETQNSSYMRSKVNIKAPSVDYLVETLSGGNQQKVLIAKALTTNFDILIIDEPTKGIDVGSKYEIYKILLDLASEGKAIVVISSELEELLGITDRIFVMSQGIIKGELPSKEATPEKVMQIAIGTKQNERSQANVQ

SEQ ID NO: 38504 - DNA, 1545 bp, Clostridium acetobutylicum ATCC 824
  CDS (1)..(1545): transl_table=11
atggataaagtaatcgagatgaaggggattactaaggtctttccgggaaccatagcaaatgacaatgtgaattttgaattaacaaggggagaaactcatgttttactaggtgaaaatggagctggaaaaactacgttaatgaatatattatatggtttgtatcatccagaaaaaggccagattattgttaatggtaaaagtgttcagttcagtggcccaaatgatgcaattaaaagcggtataggaatggtgcatcaacattttatgttggttaataactttactgttgctgaaaacatagttctaggtatggaacctaaaaatggcataagggttgatatgggtaaggctattaataatgtaaaagaactatcagacaaatatggttttgctattgaacctaaggctattatagaggatatatcagtaggccagcaacaaaaggttgaaattttaaaggcgctttacagaggagcagatgttttaattctggacgagcctacagctgttttaacgcctcaagaaatagatgaacttggagatataattgaaaaccttaagaaggaaggaaaatcagttatacttattacccataaattaaaagaagtaatgaagatgagcgatagagttacaataataagaagaggtaaggtcacagggactgttaatacaaaggatacaagtattgatgaactagcagagcttatggtaggaagaaaggttaatcttactattgctaaaaaagaaagcaaagctggaaaagaagttctaagagttgaagaacttaaagttaaggatcatagggatgttttagttgtaaaaggtattaatttagttgttaattcgggagaaatactaggaattgcaggtgttgacggaaatggacaatcagagtttatagaagcgttaactggacttaaaaaagtagaatcaggtaatgtaatacttaatggaaagaatatttcaggaaaatccgcaaaatacataaccaatagtggtgtaggacatattcctgaagataggcataagaggggcttagtacttaagtattcactttatgaaaattctatacttggtatgcatcatagaaagccattttcgagaatgtttaatataaattataaggctgttagaaaacactgtaaaaaacttatagaggaatttgatattagaacgcctaatgatgaggttaatgcggcagctctttcgggcggaaatcaacaaaagctagtagtagcaagagaaatatctagaaatccagatttacttatagcatctcagccgactaggggacttgatgtaggggctatagaatatatacataaaagaattgttgaagagagggataaaggaaaagctgtccttttagtttctcttgagcttgatgaaatattagccttatcagatagaatagcagttatgtatgatggcaaaatagtggatgttttagagagaaaagatgcggatgaaaagaagttaggcatacttatggcgggaggaaacttagataagaaagagagtgtgaatactgttgaagaaagataa

SEQ ID NO: 38505 - protein, 514 aa, Clostridium acetobutylicum ATCC 824
MDKVIEMKGITKVFPGTIANDNVNFELTRGETHVLLGENGAGKTTLMNILYGLYHPEKGQIIVNGKSVQFSGPNDAIKSGIGMVHQHFMLVNNFTVAENIVLGMEPKNGIRVDMGKAINNVKELSDKYGFAIEPKAIIEDISVGQQQKVEILKALYRGADVLILDEPTAVLTPQEIDELGDIIENLKKEGKSVILITHKLKEVMKMSDRVTIIRRGKVTGTVNTKDTSIDELAELMVGRKVNLTIAKKESKAGKEVLRVEELKVKDHRDVLVVKGINLVVNSGEILGIAGVDGNGQSEFIEALTGLKKVESGNVILNGKNISGKSAKYITNSGVGHIPEDRHKRGLVLKYSLYENSILGMHHRKPFSRMFNINYKAVRKHCKKLIEEFDIRTPNDEVNAAALSGGNQQKLVVAREISRNPDLLIASQPTRGLDVGAIEYIHKRIVEERDKGKAVLLVSLELDEILALSDRIAVMYDGKIVDVLERKDADEKKLGILMAGGNLDKKESVNTVEER

SEQ ID NO: 38506 - DNA, 1572 bp, Agrobacterium tumefaciens str. C58
  CDS (1)..(1572): transl_table=11
atgcgcggggcattcattggtttgtctttaggcaattttggacacaaagccgtggtgtatcgccactgcgattacgtccctggaggtcccgtcatgcgcgagccggttctttcgctccgtggcatcagcaaacgctatggtccgctcgaggttctgaagtccgtcgatctcgaggtctatccgggcgaagtggtagcgttgctgggtgaaaatggcgcgggcaagtccacgctgtcaggcatcatcgccggttcccgcgaaccttcagagggtaagatgacctggcttgggcagccgtatcagccggcatcgccgcgcgaggcgatcgacaagggcatcgtcctcatccatcaggaactgaagcttctgccggagctttccatcgctgagaatgtcttcatcggccgctggcccatgaaaaacggcattgtcgaccgcgccgagatggtgcggagagcccagcagcaactggcgcgccttaacctgcatattcccgcaacgcgcaaggtggcaggcctttccaccgccaaccagcagctgattgagatcgccaaggcgctcgcgctcgacgccaaactcctcatcctcgacgagccgacggccgcacttggcggcgccgaaacgcaggcgctgttcgagcaggtgcgcaagctgcgtgccgaaggcgtgggcatcatctacatctcccaccgcatggaagagatcagacagatcaccgaccgtatcgtcgtgttgcgcgacggcgagcgggtgcatgaatttgccgacagtgcgacgccggtgcgcaccattgtcgaaagcatggtcggccgctcgctggagcgcctgttcccggcgctgcctgaaccgcaggagaaggtggtactcgaggtcaaggggctgacgggcgcgaccaatgcctttcgcgacatcagcttcggcgtccgcgccggtgaaattctcggcattgccggcctgatcggcgcgggacgaacggaattggtgcgcgccatctccggtgccgatccgacgagcgcgggtgaagtacgactggatggcgaggtgctttcgctgaaaagcccggcggatgccatcgccaagggcatcgtcatggtgccggaagaccgcaaattgcaggggctggtggtggaacacgagatcggtgaaaacctgatctatgccaatctcgaccgcgtgggcacgggctggatcacgccggctatcaagcgcgctttcacccgggacgccatcgccaaattcggggtgaagggccgtagcgaacagccggcctccgatctctccggcggcaaccagcagaaagtggtcatcgccaaatggcttgcccgcaatccgcgtgtggtggtgctggatgaaccgacgcgcggcatcgatgtcggtgcgcgggcaggcatttacgatatcattgttggcctggcgaaggacggcgtggccgtcatcgtcgtcagttccgatctggaagaggtgctgggcgtttcgaaccgtatcctcgtgctcgcgcagggaaaacaggctggcatccttaaccgcgacgaggcaaacgacgtctcggtcatggaactggcaaccatctga

SEQ ID NO: 38507 - protein, 523 aa, Agrobacterium tumefaciens str. C58
MRGAFIGLSLGNFGHKAVVYRHCDYVPGGPVMREPVLSLRGISKRYGPLEVLKSVDLEVYPGEVVALLGENGAGKSTLSGIIAGSREPSEGKMTWLGQPYQPASPREAIDKGIVLIHQELKLLPELSIAENVFIGRWPMKNGIVDRAEMVRRAQQQLARLNLHIPATRKVAGLSTANQQLIEIAKALALDAKLLILDEPTAALGGAETQALFEQVRKLRAEGVGIIYISHRMEEIRQITDRIVVLRDGERVHEFADSATPVRTIVESMVGRSLERLFPALPEPQEKVVLEVKGLTGATNAFRDISFGVRAGEILGIAGLIGAGRTELVRAISGADPTSAGEVRLDGEVLSLKSPADAIAKGIVMVPEDRKLQGLVVEHEIGENLIYANLDRVGTGWITPAIKRAFTRDAIAKFGVKGRSEQPASDLSGGNQQKVVIAKWLARNPRVVVLDEPTRGIDVGARAGIYDIIVGLAKDGVAVIVVSSDLEEVLGVSNRILVLAQGKQAGILNRDEANDVSVMELATI

SEQ ID NO: 38508 - DNA, 1518 bp, Agrobacterium tumefaciens str. C58
  CDS (1)..(1518): transl_table=11
atgcggaacatcaccaagacgtttccgggcgtgaaagcgcttgagaacgttaacctcaaggtgaaagagggtgagatccacgcactcgtcggtgagaacggcgcggggaagtcgaccttgatgaaggtcctttccggtgtttaccccgccggcacctatgagggcgaaatccactatgaaggcgcagtcaggaattttcgcgccatcaacgacagtgaagatattggtatcatcatcattcaccaggagcttgcactcgtgccgctcctgtcgattgcggaaaacatcttccttggcaacgaagtcgcttcgaacggcgtcatcagctggcagcagaccttcaaccgtacccgcgaactcctgaagaaggtgggtctgaaggaatcgcccgagacgctgatcaccgatatcggcgtcggcaagcagcagctggtcgaaatcgccaaggcactgtcgaagagcgtgaagctgctcatcctcgacgagccgacggcttcgctcaacgaaagcgattccgaggcgctgctcaatctcctgatggaattccgcaatcagggcatgacctcgatcatcattacccacaagctgaacgaagtgcgcaaggtggccgaccagatcaccgtgctgcgcgacggcatgacggtgaagacgctcgactgtcatcaggaagaaatcagcgaggatgtcatcatccgcaacatggtgggacgcgatctggaagatcgttatccgccgcgtgatgtgccgatcggcgagaccattctcgaagtcaaaaactggaacgcctatcaccagcagcatcgcgaccgccaggttctgcacgacatcaacgtcaccgtccgcaagggcgaagtcgtcggcatcgccgggctgatgggggcaggacgcaccgagttcgcgatgagcgtgttcggcaagtcctatggccacaggatcaccggcgacgtgctgatcgacggcaagcctgtcgatgtcagcaccgtgcgcaaggcgatcgacgccggtctcgcttatgtgaccgaagaccgcaaacatctcgggctcgtgctcaacgacaacatcctgcacaataccacgctggcaaatctcgccggcgtgtcgaaggccagcatcatcgacgacatcaaggaaatgaaggtggcgagcgatttccgcacgcgtcttcgcattcggtcatcgggcatcttccaggaaacggtcaatctttcgggcggcaaccagcagaaggttgtgctctccaagtggctgttctccaaccctgatgtgctgatcctcgatgaaccgacacgcggcatcgacgttggcgcaaaatacgaaatctacaccatcatcaaccagctcgctgccgatggtaaaggcgttctgatgatctcatcggaaatgcctgaactgctcggcaattgcgaccgcatctacgtcatgaacgaaggccgcatcgtcgctgaattgccgaagggagaggcgagccaggaaagcatcatgcgcgctatcatgcgctcaggggagaagaactcatga

SEQ ID NO: 38509 - protein, 505 aa, Agrobacterium tumefaciens str. C58
MRNITKTFPGVKALENVNLKVKEGEIHALVGENGAGKSTLMKVLSGVYPAGTYEGEIHYEGAVRNFRAINDSEDIGIIIIHQELALVPLLSIAENIFLGNEVASNGVISWQQTFNRTRELLKKVGLKESPETLITDIGVGKQQLVEIAKALSKSVKLLILDEPTASLNESDSEALLNLLMEFRNQGMTSIIITHKLNEVRKVADQITVLRDGMTVKTLDCHQEEISEDVIIRNMVGRDLEDRYPPRDVPIGETILEVKNWNAYHQQHRDRQVLHDINVTVRKGEVVGIAGLMGAGRTEFAMSVFGKSYGHRITGDVLIDGKPVDVSTVRKAIDAGLAYVTEDRKHLGLVLNDNILHNTTLANLAGVSKASIIDDIKEMKVASDFRTRLRIRSSGIFQETVNLSGGNQQKVVLSKWLFSNPDVLILDEPTRGIDVGAKYEIYTIINQLAADGKGVLMISSEMPELLGNCDRIYVMNEGRIVAELPKGEASQESIMRAIMRSGEKNS

SEQ ID NO: 38510 - DNA, 1566 bp, Agrobacterium tumefaciens str. C58
  CDS (1)..(1566): transl_table=11
atgtcgcagggcgcatcgacaattcggggcgatttttcgcctgaggagatggcgcgtgcggagcgttcggtccttctgcgtctcgagaacatcagcaaggaatttccaggcgtaaaagcgctgtcgaacgttcatttcgatctgcgcagcggcgaagtgcatgccgtctgcggcgagaatggcgcgggaaaatcgacactgatgaagatcatcagcggtgtctaccagccgagtgaaggaacgatcctgcacaaaggcgagaaggtgcaatatgcatcgccgctgcaatccgaagcggccggcatcgccatcatccatcaggaactcaaccttgttccgcatctttccgttgccgagaacatttatctggcgcgtgagccgcgccggggttttctcgtggaccgcaagaaactgcgactcgatgccaaacgctgtctcgaccggctgggggtcgatatcaaccccgaccagctggtccgcagtctttccgtcgcgcaatgtcagatggtggaaatcgccaaggcgctctctcttgatgccgaagtgctgatcatggacgagccgacctcctcgctgaccgagcaggaaacccggcttctgttcaaggttatccgcgatctcaaggcctccggcgtcggtatcgtttatatttcccatcgtctcgatgagatggccgagatcgtcgatcgcgtgacgatcctgcgcgacggacgttatatctcaaccgacgatttcgcctcgatcactgttgatgacattgtcacgcgtatggtcgggcgttcgctggaagacaaattccccgaacgcacctcgcgcccgacggatgatattctcttttccgtcgaagggctgacgcgcaatggcgtgttcagtgacgtcagtttttcactgcggcgtggcgaaatcttaggttttgccggacttatgggcgcgggacgaacggaagttgcgcgggcaatcttcggggccgatccgctcgatgcgggtaagatcgttttcaacgggcgcgaactttcgatcggctcgccgcaggacgctatcgaggaaggcattgcctatctctcggaagatcgcaaaagcgatggcctcgccatcaagatgtcggtggcggccaatacgacgctcgccaatctcggcgaggtttccaaccgtttcgggctgatcgatttcaagaagcatgacgatgtggcgaagcgttacgtcgatctgctgaatatccgcactccctcgatcgatcagaccgtgcggctgctttcgggtggcaaccagcagaaaatcatcatcggcaaatggctgttccggcagtcgcgcgtgctgttcttcgacgagccgacgcgcggcatcgatgttggcgcgaagtttgcgatctacaagatcatggacgaactggccgcgcagggcatcggcgtcattctcatcagttcggaactgccggaaattctgggactgacggatcgtattgcggtgttccatcagggccgtatcaccggcgtgctcgaaaccgccaagaccaatcaagaagaaatcatgcggtatgcgtccggttacggccgggccgcgcagtga

SEQ ID NO: 38511 - protein, 521 aa, Agrobacterium tumefaciens str. C58
MSQGASTIRGDFSPEEMARAERSVLLRLENISKEFPGVKALSNVHFDLRSGEVHAVCGENGAGKSTLMKIISGVYQPSEGTILHKGEKVQYASPLQSEAAGIAIIHQELNLVPHLSVAENIYLAREPRRGFLVDRKKLRLDAKRCLDRLGVDINPDQLVRSLSVAQCQMVEIAKALSLDAEVLIMDEPTSSLTEQETRLLFKVIRDLKASGVGIVYISHRLDEMAEIVDRVTILRDGRYISTDDFASITVDDIVTRMVGRSLEDKFPERTSRPTDDILFSVEGLTRNGVFSDVSFSLRRGEILGFAGLMGAGRTEVARAIFGADPLDAGKIVFNGRELSIGSPQDAIEEGIAYLSEDRKSDGLAIKMSVAANTTLANLGEVSNRFGLIDFKKHDDVAKRYVDLLNIRTPSIDQTVRLLSGGNQQKIIIGKWLFRQSRVLFFDEPTRGIDVGAKFAIYKIMDELAAQGIGVILISSELPEILGLTDRIAVFHQGRITGVLETAKTNQEEIMRYASGYGRAAQ

SEQ ID NO: 38512 - DNA, 1617 bp, Agrobacterium tumefaciens str. C58
  CDS (1)..(1617): transl_table=11
ttgggtcggggtgaccaaagaaaacatggacaagtacgacttctgatccgaaccacggagggaggggcaaccctctctctgtgcaccccgtgttttccagccttgcacgaggccattatgactgaaaatctgatcgagctgcgccacatcggtaagcggtttggtggcgtgaaggcgctcgacgacgtatcgctgagcattcgcccgggcgaaatccattgccttgccggtgaaaacggttccggcaaatccaccgtcatcaaaatcatgtccggggtttacacacccgaggacggtgagatcctgatcgacgggaagcctgtcggcaaactcgatccggtaaaatccgttcaccacggtattcaggtgatctatcaggatttttcgctgtttggtaacctgacggtcgccgagaacctggccatcaatacctttctgatggaaggtcgcaaaacggtcgactggcgacatgtccgtgagctggcccaaaaggcgttggaccgcctcggcgtgagcatcgatcttgatacggatgtcgaaaccctgccgacctctggaaagcagatcgtggcgattgcccgtgccgtcatggccgatgcacgcctgatcatcatggatgagccgacgaccgcgctgacgcgccatgaggttgatgccctcttcaagattgtgcgtgatattcaggcgcagggcatcgccgtgctcttcgtcagccacaaaatgcgcgagatgctcgaaatcagcgagcgcctgacagttttccgcaatggcaagaaggtggccgaagggccgatcgccgaattcgatgagccggcaatcacccgcgcgatgacggggcaggagctgaccgcccacagctacaagtgggcaccgcaggaaggtgccgatacaccggtgctggaagtccgcaacctctcggttccggcttccgtggaaaacaccgacctgacgttaaggccaggcgaaatcgtcggtatttcgggtttgatcggttcggggcgtaccgaacttgcgctggcgctgtttggcatgcgccccgattttaccggttcagtgcgcctcgcaggccgcgaggttcacccaaggaccgttcaggagggtattgcctgcggtgtcgcttatgtgccggaggatcgcctgaccgaggggctattcctgacgcaatcgatcgaacggaatatcattgtcacgtcgattgagaaattcgtccgcggtcttttcatcaatcgcaaaaaggcggacgagacgacccgcgaaatgttctcggccatgcagatcgtggcaccaggaccgcacacgccggtcaaccatttgtccggtggcaacgcacagcgcgtcgttctggctcgctggttgttgactggggccaaagtgctgatcctgaacggcccgaccgtcggcgtcgatgtcggttccaaagcacagatccacaccatcatccgcaagctggccgaaaaggaagggctggccgtgctgatgatttccgacgatgtgccggaactggtgcagaactgcaaccgcgtgctggtcatgcatcgcggccgtttcgttgacgagttgtctggagagagcatgaccgaagacgccgttaacgaccggctcaagatgctgaattga

SEQ ID NO: 38513 - protein, 538 aa, Agrobacterium tumefaciens str. C58
MGRGDQRKHGQVRLLIRTTEGGATLSLCTPCFPALHEAIMTENLIELRHIGKRFGGVKALDDVSLSIRPGEIHCLAGENGSGKSTVIKIMSGVYTPEDGEILIDGKPVGKLDPVKSVHHGIQVIYQDFSLFGNLTVAENLAINTFLMEGRKTVDWRHVRELAQKALDRLGVSIDLDTDVETLPTSGKQIVAIARAVMADARLIIMDEPTTALTRHEVDALFKIVRDIQAQGIAVLFVSHKMREMLEISERLTVFRNGKKVAEGPIAEFDEPAITRAMTGQELTAHSYKWAPQEGADTPVLEVRNLSVPASVENTDLTLRPGEIVGISGLIGSGRTELALALFGMRPDFTGSVRLAGREVHPRTVQEGIACGVAYVPEDRLTEGLFLTQSIERNIIVTSIEKFVRGLFINRKKADETTREMFSAMQIVAPGPHTPVNHLSGGNAQRVVLARWLLTGAKVLILNGPTVGVDVGSKAQIHTIIRKLAEKEGLAVLMISDDVPELVQNCNRVLVMHRGRFVDELSGESMTEDAVNDRLKMLN

SEQ ID NO: 38514 - DNA, 1545 bp, Agrobacterium tumefaciens str. C58
  CDS (1)..(1545): transl_table=11
atgccgagcgccacgtctgcgatgctttcgcggcgaaaggagagatacgccatcatgagcgcagaaccgctcctgtcccttaaaaatgtcaaggtcaccttcggtggcgtacgcgccctgaagggtgtttccttcgaggtcaatccgggtgaagtgcattgccttgccggcgaaaacggctgcggcaaaagcaccgtgatcaaggtcatcaccggtgtctataagccggagagcgatgcggaactctatttcgatggcaaacccatcgctgctatgaccccgacacttgcgcaatcgctgggcattcaggtgatctggcaggatctggcgctgttcgatgagatgacggtggccgaaaatatcggtttccaatatgcggtgaacggcagatttgggctggtcgacaagcgcgctatcaaaaatgccgccgaaaaggcgctggcacggctcggtgtctcgttcgatctcgacaggccgctcaaggaactgccgattgcccaacgccagatcgtggcgattgcccgtgcgctggttggcgaagcccgtctcgtttttatggatgaacccaccgcatctctgacgcagtcggagaccgattacctcatcgatatcgtccgcaacctctcggcgtcaggtgtcgctgtcgtgttcgtttcgcatcgtctggcggaagtgcttgagatatcggatcgcatcaccgttttgcgggatggatcgcttgtcggcgttttcccggtcgaaggcatgacccagtctcgcgtgaccgagttgatgaccggccgcaacttcgatagcgccgtcattgccgccgatcacgacgacaagcccgtggttctctcggtgcgaggcctgacacgggccggcgagttcgaggatgtttccttcgatctgcggcgcggggagacgttggggatcaccggtcttctcggcgcgggccgaaccgaacttgccctgacgctgttcggcatgcaccggccgcaatcgggtgaagtccttatcgatggaaagaaggtggatttccattccaaccgggatgcgatccgggttggtgtcgcctatctctccgaagaccggctgtcgctcggtctgaaccagccgcagtcgattgccgacaatctcgtcatggcctcccttgataagttgttgagtggcggtcttatctccacgtcgaaaaaggcggatgtcgtttcccgctggatttcagcgctcggcgtcaagatcggcctgccggaagatccgatccgcacgctctctggcggcaaccagcagcgcgtggcgattgccaaatggctggcgatcgggccgaaaattctcatcctcgatgcgccgaccgtgggtgtcgacgtcggcgcccgcgccggcatctttgaaatcgtccgcaagctcgccgcagagggcctgtcgatcatcgtcatctccgatgaggcgccggaagtttattttaatacagacagggtcatccacatggtcgaaggccggttccacgccacctatgatccgcgacgcctgtcgctgaccgaactggaggccgccatctatgcgtag

SEQ ID NO: 38515 - protein, 514 aa, Agrobacterium tumefaciens str. C58
MPSATSAMLSRRKERYAIMSAEPLLSLKNVKVTFGGVRALKGVSFEVNPGEVHCLAGENGCGKSTVIKVITGVYKPESDAELYFDGKPIAAMTPTLAQSLGIQVIWQDLALFDEMTVAENIGFQYAVNGRFGLVDKRAIKNAAEKALARLGVSFDLDRPLKELPIAQRQIVAIARALVGEARLVFMDEPTASLTQSETDYLIDIVRNLSASGVAVVFVSHRLAEVLEISDRITVLRDGSLVGVFPVEGMTQSRVTELMTGRNFDSAVIAADHDDKPVVLSVRGLTRAGEFEDVSFDLRRGETLGITGLLGAGRTELALTLFGMHRPQSGEVLIDGKKVDFHSNRDAIRVGVAYLSEDRLSLGLNQPQSIADNLVMASLDKLLSGGLISTSKKADVVSRWISALGVKIGLPEDPIRTLSGGNQQRVAIAKWLAIGPKILILDAPTVGVDVGARAGIFEIVRKLAAEGLSIIVISDEAPEVYFNTDRVIHMVEGRFHATYDPRRLSLTELEAAIYA

SEQ ID NO: 38516 - DNA, 1521 bp, Agrobacterium tumefaciens str. C58
  CDS (1)..(1521): transl_table=11
gtgacaagcattattcggggacatgcgatggcgaacgctctggaagcggccggcataacgaagaattttggcgccgtgcgtgcgctttccgccggcaggctgaccgttggtcgcggtgaaattcacgcgctgctaggcgccaatggctgcggcaagagcacgctttgcaagatcgttgcgggcgcggtggctccgaccagcggcaccatcaggttcaatggcgaagacgtgcgcttcaagagcccgcgggatgccgaaaatgccggtatcgccctgttttatcaggagctgagcctcattccgcagctctccgtcgctgacaatatctttctcggccgcgagccgaagcgcggcatctttgttgatggcaaggcgcttaaggcggaagcagcaagactgatcgcgctgtttgatggtgtggcaggcgagggactggagccggatgcgatcgttggcaatctgccgcccgatcagcgccagctcgtcgaaattctcaaggtcttcgcccagaatgccagcctgatgatcatggatgaggcgacggcggcgctcgatggccgccagtcccagcgctttttcgagatactccgggccaagaaggccgatggtgtctccaccattatgatttcccatcgtctcgacgaggtctttgccgtctgcgaccgcattaccgtgatgcgcaacggtgcgaccatttccgaactcgacaccgctgccaccacccgtgaagccgtggtgcacgatatggtcggtgatgtccgcgccgcacccgcccgcgagcaggggcgggccgccgcagttcccagcctcaaggtaactgacgttgcgggcgacggcgtgcgcggcgtctctctagaagcttatccgggcgaaatcgtcggtctggccggcctgcaggggcagggacaatcggccttgctgagaggcctcttcggcgccagtccgtttgcaaccgggcaagtccggttcgagggccgcgaaatcatcgtcggcaagccttcgcaggcggttcacaacggttttgcttatgtctcgggtgaccgtgggcgcgacgcctcgcttcagggccggtcgatcttcgaaaatctcgtcgccgcgctgatggtgcgcgaaaagatgcggctggttcggccggcaacgctgaagccgcgggtgcagaaggtcgcggatgacatgaagacgaaatttgccggcatggacatgccgatcggcacgctttcgggtggcaaccagcagaagatcttcatttcccgctggctcgccacttcgcccaagctgctgctgctcgatgatccgaccaagggtatcgatctcggcgccaaggccgatctcttcgcgctgatgcggcagcaggccgatgccggtgcgaccattcttctctattcctcggaagatgcggaaatcctcgaatatgccgaccgcattcttgtcttcaacggcggacgcatctctgcggaactgaccggagccgacatgacatccgtcaacatgacccgcgccgcctatggagacgccgcatga

SEQ ID NO: 38517 - protein, 506 aa, Agrobacterium tumefaciens str. C58
MTSIIRGHAMANALEAAGITKNFGAVRALSAGRLTVGRGEIHALLGANGCGKSTLCKIVAGAVAPTSGTIRFNGEDVRFKSPRDAENAGIALFYQELSLIPQLSVADNIFLGREPKRGIFVDGKALKAEAARLIALFDGVAGEGLEPDAIVGNLPPDQRQLVEILKVFAQNASLMIMDEATAALDGRQSQRFFEILRAKKADGVSTIMISHRLDEVFAVCDRITVMRNGATISELDTAATTREAVVHDMVGDVRAAPAREQGRAAAVPSLKVTDVAGDGVRGVSLEAYPGEIVGLAGLQGQGQSALLRGLFGASPFATGQVRFEGREIIVGKPSQAVHNGFAYVSGDRGRDASLQGRSIFENLVAALMVREKMRLVRPATLKPRVQKVADDMKTKFAGMDMPIGTLSGGNQQKIFISRWLATSPKLLLLDDPTKGIDLGAKADLFALMRQQADAGATILLYSSEDAEILEYADRILVFNGGRISAELTGADMTSVNMTRAAYGDAA

SEQ ID NO: 38518 - DNA, 1419 bp, Agrobacterium tumefaciens str. C58
  CDS (1)..(1419): transl_table=11
gtgcatgcgcttctgggcgaaaacggtgccggcaagtcgactttgatgaagatcctatgcggcattttgcagccatcggagggaacgatccgcattgacggcaaggatcgccgcttcgccaattatgacgaagcgattgccgctggcgtcggcatcgtgtttcaggaattcagcctgatcccctatctcaatgccgttgaaaacatgttcctcgcccgcgaaattcgcgggccgctgcgccttttgaacaagggcgcgatgcgcaagcgcgcggccgaaatcatgggccggctggccgtggatgtgccgctcgacgtgccggtgcaccgcctgtcggttgcccagcagcaatttgtcgaaatcgccaaggcattgtcgctggatgcccgcattctcgtgctcgacgagccgaccgcgacgctcacgccctccgagacagagcacctgttcaatgtcatgcgcgagctgcgccgtcagggcgtggcgatcatcttcatttcgcatcacctcgatgaaatattcgagatctgcgaccgcatcaccgttcttcgcgatggcgagttgattggctcctgcctgacgtcggaggtcgataatgaccgtctggtggagatgatggtcggccggcgcatcgaagccagcttcccgccgaagccgcagatcgatccttccgccgcaaaggtgatcgaagtcgaagagctgcaattgaagaagggcggccctgtctcgcgcttttcgctgcgcaagggtgaaatcctcggctttgccgggctcgtcggctcgggccgcacggaaacggtgctggccatgctcggtgcgcattccgcttcgcgccgcaagatcaagcttgatggtgtggatacgcgtttgtccggccccgatgatgcgctgatgcgcggcatcggcctgctgccggaaagccgcaaggaggaggggctgatcaccagcttctcgatcctgcagaatatttcgctgaacaattatcgtaagtaccgcaaggcccactggttcctcgacctcaagaaggaactggagcacacgacgaaggccatggcgcaggtgcaggtcaaggcgcagggcccctatgcccgtgtcgacacgctgtccggcggcaaccagcagaagatcgttatcgcccgctggctgaaccatgacatgcgcgtgctgatcttcgacgagccgacacgcggcatcgacgttggcgccaaggcagaaatctattcgctgatgcgcgaatttgccgccaggggtcattcgatcatcatgatctcctcggagttgccggaagtgatcggcatgtccgacagggtctgcgtcttccgctccggcggcattgtcgccacggtcgagggcgaagacatcaattcagaaacaataatgacaaacgccaccaccgggagagttgaacatgtcgcttga

SEQ ID NO: 38519 - protein, 472 aa, Agrobacterium tumefaciens str. C58
MHALLGENGAGKSTLMKILCGILQPSEGTIRIDGKDRRFANYDEAIAAGVGIVFQEFSLIPYLNAVENMFLAREIRGPLRLLNKGAMRKRAAEIMGRLAVDVPLDVPVHRLSVAQQQFVEIAKALSLDARILVLDEPTATLTPSETEHLFNVMRELRRQGVAIIFISHHLDEIFEICDRITVLRDGELIGSCLTSEVDNDRLVEMMVGRRIEASFPPKPQIDPSAAKVIEVEELQLKKGGPVSRFSLRKGEILGFAGLVGSGRTETVLAMLGAHSASRRKIKLDGVDTRLSGPDDALMRGIGLLPESRKEEGLITSFSILQNISLNNYRKYRKAHWFLDLKKELEHTTKAMAQVQVKAQGPYARVDTLSGGNQQKIVIARWLNHDMRVLIFDEPTRGIDVGAKAEIYSLMREFAARGHSIIMISSELPEVIGMSDRVCVFRSGGIVATVEGEDINSETIMTNATTGRVEHVA

SEQ ID NO: 38520 - DNA, 1518 bp, Agrobacterium tumefaciens str. C58
  CDS (1)..(1518): transl_table=11
atgctctgggaggagaatatgacggcaacggcgagtgcgctgcgcatgcgggggatcagcaagatatttcccggtgtaaaagcgctgtccaacgtcaatttcacagtcgaatacggtcgcatccacgccgtcgtcggtgaaaacggcgctggtaaatcgacgctgatgaaaatcctgagcggcagctatgctcccaccaccggtacgacggaaatcgcgggcgtggaggtgcagatgcgccggccggccgacgcccagaaactcggcatccgcatggtgcatcaggagctgaacctcgttccggaccttaccgttgcggaaaatatctatctcggccgcatgccgcaccgccgcttcctggtcgacaggcaggccatgctgcgcaaggcggctgcggttttgaaagaactggaagcggcgatcgacccgaaggcgcggctcggtgatctgccgatcagccagcagcagctcgtcgagatcgccaaatcctattccgccgatccgcgtatcatcgtcctggacgagccgacatccagcctgagcgagcatgagacaacagccctgttttccatccttcgcaagatgaaaagccagggtatcgccatcatctatatcagccatcggctgaaagaagtgcttgatatcgctgatgacgtgaccatcctgcgcgatggcagcatgatcgacacccgaccggccgccggcatcaccgccgccgaaatgatccgcctcatggtcggtcgcgaagttgccaatgtctttcccaaaacaccatcgaagatcggcccggtggcgttcaaggtcacgggactgagcgacggcgaaaaattccacgacgtcggtttcgatgtgcggtcaggcgaaattctcggcctgaccggcctggtcggcgccggccgcaccgaggtcgcccaggcgattttcggccttgcgccgctggccacgggcaggatcgagataaacggcaaggccgttacgattggttcaccggcagcggccgttaaggcgggcgtcgcctatgttcccgaagatcggaaaggcgatggcatcgtgccgtccatgagcgtgcgcgaaaacatcagcctgccggtgctgcgacgtctgagccgtctcgggcgcatcggcatgagtagggatcggggactggcggcgaaatatacgcgcgatttttccatcgtcccgcccgatccggagcggcgcatcaacctgctttcgggcggcaatcagcagaaggcgatcatttcacgctggctggcggcgggaccgaaggtgttgatcctcgacgaaccgacacgcggcgtcgatgtcggcgcgaaggcggaaatccaccgcatcatcggcgaactcgtggccggtggcatggcggtggttatgatctcgtcggaactgcctgaggtgatgggggtctgcgaccgggtggtggtcatgcgcgatgggcgcgcctcctccccgattgcacgcggagacttgacggaagagcgcatcatggcgcttgcaacaggggaagaaccagcgtga

SEQ ID NO: 38521 - protein, 505 aa, Agrobacterium tumefaciens str. C58
MLWEENMTATASALRMRGISKIFPGVKALSNVNFTVEYGRIHAVVGENGAGKSTLMKILSGSYAPTTGTTEIAGVEVQMRRPADAQKLGIRMVHQELNLVPDLTVAENIYLGRMPHRRFLVDRQAMLRKAAAVLKELEAAIDPKARLGDLPISQQQLVEIAKSYSADPRIIVLDEPTSSLSEHETTALFSILRKMKSQGIAIIYISHRLKEVLDIADDVTILRDGSMIDTRPAAGITAAEMIRLMVGREVANVFPKTPSKIGPVAFKVTGLSDGEKFHDVGFDVRSGEILGLTGLVGAGRTEVAQAIFGLAPLATGRIEINGKAVTIGSPAAAVKAGVAYVPEDRKGDGIVPSMSVRENISLPVLRRLSRLGRIGMSRDRGLAAKYTRDFSIVPPDPERRINLLSGGNQQKAIISRWLAAGPKVLILDEPTRGVDVGAKAEIHRIIGELVAGGMAVVMISSELPEVMGVCDRVVVMRDGRASSPIARGDLTEERIMALATGEEPA

SEQ ID NO: 38522 - DNA, 1536 bp, Agrobacterium tumefaciens str. C58
  CDS (1)..(1536): transl_table=11
atgatgcgtgctgaaacccaaacaataaaaatgaccgaggcttccagccccacgcccgttctggaaatgcgcggcatcagccagatattccccggcgtcaaagcgcttgatggcgtcgatatcgcactataccccggcaaggtcacggcgctgatcggcgagaacggtgcgggtaaatccacgctcgtcaaaatccttaccggcatctaccgcccgaacgagggcgaaatcctgctggatggcaaggccgtccacttccacagcgcacaggatgccatcgatgccggcgtcaccgccattcatcaggaaaccgtgctgttcgacgagctttcggtcggtgagaacatcttcctcggccatgcgccgaagggtcgtttcggcctgattgactggaagaccatcaacgagcgggccagaattctgctggaacagctcgaaagcaccatcgatcctaccatccggttgaaagatctttcgatcgcccagcgccatctggtggccatcgcccgtgcgttgtcagtcgaggcgcgcatcgtcatcatggacgaaccgacagccgcgctttcccgcaaggagatcgacgatctcttccgcatcgtcgagaacctgaagcggcagggcaaggcgatcctcttcatcagccacaagttcgatgaagtgtatgaaatcgccgagaattatgccgtattccgtgacggaaaaatggttggcgccggcacgcttgccaccaccccgcaagatgaaatcgtgcggctgatggttggccgcgacgtgacgaatgccttcccgaagcaggcggtcacccttggtccaacggttctttcggtgcgtgattattcgcaccagaccgaattccgcgatatttccctcgatcttcgcaagggtgaaattctcggcctttacgggctgatcggcgccgggcgctccgaactttgccaatcgctgttcggcatcacccgcccggcttcgggagaggtgacgctggatggccagccgctcaccatccgctcgccggaagatgcgatccgcgccgggatcgtatacgtgccggaagagcgtggccgccacgggctggcactcgatatgccgatctatcagaacatgtcgctgccatccctcacccgcacgtcgcgcaaggggtttctcactgccgccaatgaattcgcgctagcgcgcaaatatgccgcgcggctcgatctgcgcgctgccgcgctttcggtgcccgttggcacgctttcgggcggcaaccagcagaaggtggtgatcggcaagtggctggccacgaagccgaaggtcatcattctcgatgagccgaccaagggcatcgatatcggctccaaggccgccgtgcatggtttcatcagcgagcttgcggcagagggcctgtcgatcatcatgatttcatccgaacttcccgaaatcctcggcatgtccgaccgcgccatcgtcatgcgcgaaggcctgatggcgggccagttcgaacgcgccgaattttctccggaaaagctggtgcgcgctgccaccggcaatgcctga

SEQ ID NO: 38523 - protein, 511 aa, Agrobacterium tumefaciens str. C58
MMRAETQTIKMTEASSPTPVLEMRGISQIFPGVKALDGVDIALYPGKVTALIGENGAGKSTLVKILTGIYRPNEGEILLDGKAVHFHSAQDAIDAGVTAIHQETVLFDELSVGENIFLGHAPKGRFGLIDWKTINERARILLEQLESTIDPTIRLKDLSIAQRHLVAIARALSVEARIVIMDEPTAALSRKEIDDLFRIVENLKRQGKAILFISHKFDEVYEIAENYAVFRDGKMVGAGTLATTPQDEIVRLMVGRDVTNAFPKQAVTLGPTVLSVRDYSHQTEFRDISLDLRKGEILGLYGLIGAGRSELCQSLFGITRPASGEVTLDGQPLTIRSPEDAIRAGIVYVPEERGRHGLALDMPIYQNMSLPSLTRTSRKGFLTAANEFALARKYAARLDLRAAALSVPVGTLSGGNQQKVVIGKWLATKPKVIILDEPTKGIDIGSKAAVHGFISELAAEGLSIIMISSELPEILGMSDRAIVMREGLMAGQFERAEFSPEKLVRAATGNA

SEQ ID NO: 38524 - DNA, 1587 bp, Agrobacterium tumefaciens str. C58
  CDS (1)..(1587): transl_table=11
atggcgagcctgtcgccggtatttttgtctattgtggaggatgagatggtcgtcagtccatcgacaatggccgccgtgcgcgccagcggagccgtgccgaatgcggaatttcttctcgcggcggatggcatacgcaaggaatttccaggcgttgtggcgctcgacgatgtgcagttccacctcaagcgcggtaccgtgcatgcgctgatgggtgagaatggcgccggcaaatcgacgcttatgaagattctcgccggcatctaccagccggataacggagaaatccgcctgaagggcgcgccgatacgtctcgattccccgctcgacgcgctggaaaacggcattgccatgatccatcaggaactgaacctgatggcttatatgacggtagccgaaaatatctggattcgccgcgagccgaaaaaccggctgggcttcatcgatcatggcgaaatgtatcgccgcacggaaacgctgctggaacggttgggcatcgatctcgatccggaaacgcgtgtcggcgagctttccgtcgccagccgtcagatggtcgaaatcgccaaggcggtttcctacaattcagacgttctcatcatggatgagccgacatcggctttgacggagcgcgaggtcgagcatctcttccgcatcatccgcgatctgagggaacgaggtatcggcatcgtttacatcactcacaagatgaacgagctgttcgagatcgccgacgagttctccgttttccgcgacggcaaatatatcggcacccacgcgtccaccgatgtgacgcgtgacgacatcatccgcatgatggtaggccgagaaatcacccagatgttcccgaaggaagaggttccgatcggtgacgtagtgctgtcggtcaagaacctgaatctggacggtgtcttccatgacgtctctttcgatgtccgcgccggtgaaattctcggcgtcgcgggcctcgtcggctccggacgctccaatgtggcggaaacggtatttggcgtgacgcccgcttcctcgggtacgatttcgatcgacggcaagccggtttcgatcgacagcccgacaacggctatcagtcaccgcatggcgttcctgacggaggaccgcaaggataccgggtgcctgctcatcctcaatattctcgagaatatgcagatcgcggtgctgcaggacaaatatgtcgccaacggcttcgtgcaggaaaacgcgctgtcggaagcctgcgaagaaatgtgccgcaagctccgcgtcaagacgccgcatctttacgagcgcatcgagaacctgtcaggcggcaaccagcagaaggtactgatcggacgctggatgctgaccaagccgcgcattctcattctcgatgaaccgacgcgcggcattgatgtcggggccaaggcggaaattcacaagctggtttgcgagatggcgcgccagggcgtcgccgtcattatgatttcctccgaaatgccggaggttctgggtatgagcgaccgtgtcatggtcatgcatgaaggtcgggtgacgggtttccttgctagaagtgaagccacgcaggtgaaggtgatggatctcgcatcgcggtga

SEQ ID NO: 38525 - protein, 528 aa, Agrobacterium tumefaciens str. C58
MASLSPVFLSIVEDEMVVSPSTMAAVRASGAVPNAEFLLAADGIRKEFPGVVALDDVQFHLKRGTVHALMGENGAGKSTLMKILAGIYQPDNGEIRLKGAPIRLDSPLDALENGIAMIHQELNLMAYMTVAENIWIRREPKNRLGFIDHGEMYRRTETLLERLGIDLDPETRVGELSVASRQMVEIAKAVSYNSDVLIMDEPTSALTEREVEHLFRIIRDLRERGIGIVYITHKMNELFEIADEFSVFRDGKYIGTHASTDVTRDDIIRMMVGREITQMFPKEEVPIGDVVLSVKNLNLDGVFHDVSFDVRAGEILGVAGLVGSGRSNVAETVFGVTPASSGTISIDGKPVSIDSPTTAISHRMAFLTEDRKDTGCLLILNILENMQIAVLQDKYVANGFVQENALSEACEEMCRKLRVKTPHLYERIENLSGGNQQKVLIGRWMLTKPRILILDEPTRGIDVGAKAEIHKLVCEMARQGVAVIMISSEMPEVLGMSDRVMVMHEGRVTGFLARSEATQVKVMDLASR

SEQ ID NO: 38526 - DNA, 1554 bp, Sinorhizobium meliloti 1021
  CDS (1)..(1554): transl_table=11
atgatagggcttcaagaggtcagccatcgccatgacgaacaggtgagggcggcgggcggccgtccggttccgaagggcgcacccatcctggaactccgcagcctgcagaaaaactatggcgcggtcgaggctctgaagcccgcgacgatgaccttcctatccggcgaaatccacgcgatcgtcggcgagaacggtgccggcaaatcgacgctgatcaagctcctgaccggggtcattgcccgcagtgccggagaaatccgctggtgcggcgaaactgtcgacctcgccacgcccaacgaagcgatcgcccgcggcatcaatgcggttcaccaggaggtggtgctttgcccgcatctgagcgttgcggcgaacatgttcctgggcgacgagatgaaccgccgcgggctgatgcgcaagcgcgcgatgaccggcgcggcccagggcgtgcttgacgatctcggcttcaatctgcccgccaatgccgaactcggcagcctgacgatcggccagcagcagctggtcgccactgctcgggcggccatgcgcggcacgcagttcctcatcttcgacgagcccacggcctatctcacgcgacaggaatcggcacagcttttccgcctgatccgccggctgcagggcgagggcgtcacgatcgtctatatcagccacaggctggaggaggtgttcgagctcgcggaccgcgtctcggtgcttcgcgacggcacgcatgtcggcacgcgcgcgatttccgagacgaacgaggccgaactcatcactttgatgatcaaccgcacgatcgaacagatctaccacaaggaacgtttcgaacagggcgagatgatcgtcgagacgcgcgggctctccggtccaggtttccgcgacatatcgctctcggtcagggcgggcgagatcgtcgggctctacggtctgatcggcgccggccgcagcgagttcgcgctcggcctttacgggcgcaatccggtgagcgccggagagatcttctggcagggccgcaaggtcgcgataggcaatgagcggaaggccatggacctcgggatcgcgctcgcgccggagagccgccgcgatcagggcctgtgcctcaacctgccgatcggcgtcaatatcaacctgcctgttttcaaaaggctgacgcgcggcttgacgatcaaccgcgcgcaggaggcctccaatgccgaacgtcagatcagggatctgaacatcaagacgccgtcgcggcgggtgcttgcttccgccatgtccggcggcaaccagcagaaaatcgttatcggcagatggctgagccacggagcgaagctcttcatcttcgacgagccgaccgtgggcgtcgatgtcggcaccaaggcggaaatctaccggctgtttgcgcggcttctggagaagggggcagggatcatcctgatctcctcctacctgccggaggtctatgaactggccgatcgcctgcatgtgttccggcaggggcggcttgtggcaagccacgactaccgggccgcaagccatgaggaagtgctggcgcaggcgatcaatgcctga

SEQ ID NO: 38527 - protein, 517 aa, Sinorhizobium meliloti 1021
MIGLQEVSHRHDEQVRAAGGRPVPKGAPILELRSLQKNYGAVEALKPATMTFLSGEIHAIVGENGAGKSTLIKLLTGVIARSAGEIRWCGETVDLATPNEAIARGINAVHQEVVLCPHLSVAANMFLGDEMNRRGLMRKRAMTGAAQGVLDDLGFNLPANAELGSLTIGQQQLVATARAAMRGTQFLIFDEPTAYLTRQESAQLFRLIRRLQGEGVTIVYISHRLEEVFELADRVSVLRDGTHVGTRAISETNEAELITLMINRTIEQIYHKERFEQGEMIVETRGLSGPGFRDISLSVRAGEIVGLYGLIGAGRSEFALGLYGRNPVSAGEIFWQGRKVAIGNERKAMDLGIALAPESRRDQGLCLNLPIGVNINLPVFKRLTRGLTINRAQEASNAERQIRDLNIKTPSRRVLASAMSGGNQQKIVIGRWLSHGAKLFIFDEPTVGVDVGTKAEIYRLFARLLEKGAGIILISSYLPEVYELADRLHVFRQGRLVASHDYRAASHEEVLAQAINA

SEQ ID NO: 38528 - DNA, 1512 bp, Sinorhizobium meliloti 1021
  CDS (1)..(1512): transl_table=11
atgaagcccgccattgcgcttgaaggcatatcgaagtcctttccgggcgtgcgcgctctttccgatgtctcgctcgctctctatcccggctcggtgacggcgctcgtcggcgaaaacggcgccggcaagtcgacgctcgtcaagatactgaccggcatctatcagcctgatgcgggcaccatccggctcggcgacacggagaccacctttccgaccgcccttgcggcgtcccgcgccggggtcacggcgattcatcaggagacggtgctcttcgacgagctctccgtcgcggaaaacatctttctcggccacgcaccgcgcaaccgcttcggcctcatcgactggaagcagctcaacgccgacgctcaggccctgttaggccgcgcgggcgccgatttcgacccgacgatccgcctgcgcgatctcggcatcgccaagaagcatctggtcgcgatcgcccgggcgctctcggtcgatgcgcgcgtcgtcatcatggacgagccgacggccgcgctgtcgcacaaggaaattcacgagctctacgatctgatcgaacggctcaaggccgacggcaaggctgtcctgttcatcagccacaaattcgatgagatcttccgcatcgcagaccgctataccgtctttcgcgacggggcgatgatcggcgaagggctgatcgccgacgtcagccaggacgatctcgtccgcatgatggtcggccgcgccgtcggctccgtctatccgaagaaggaggtgaccatcggtcagccggtgcttaccgtttccggttatcgccacccgaccgaattcgaggacatcaacttcgaactcaggcgcggcgagatcctgggtttctatggcctggtcggcgccgggcgttcggaattcatgcagtcgctgatcggcatcacccggccgtccgccggtgccgtgaagctcgatggcgaggtgctggtcatccgcagcccggcggaggcgatccgcgcaggcatcgtctatgtgccggaagagcgcggacggcagggggcgatcatcggcatgccgatcttccagaatgtgacgctgccctcgctttcacacacctcgcgctcgggcttcctgcggcttgccgaggaattcgcgctggcgcgcgaatacacctcccgcctcgatctgcgggccgccgcgctcgatcaggacgtcggcacgctttccggcggcaaccagcagaaggtggtcatcgccaagtggctcgcgacccggccgaaggtcatcatcctcgacgagccgaccaagggcatcgacatcggctccaaggccgccgttcatgccttcatgagcgagcttgcggcgcaaggcttgagcgtcatcatggtgtcctcggaaattcccgagatcatggggatgtctgaccgcgtcatcgtcatgcgcgaggggcgcgtcgccggaagatacgagcggtctgaactgaccgctgagaagctggtgcgggccgccgcaggcatcgaaacgcaagccgatgggagggccgcatga

SEQ ID NO: 38529 - protein, 503 aa, Sinorhizobium meliloti 1021
MKPAIALEGISKSFPGVRALSDVSLALYPGSVTALVGENGAGKSTLVKILTGIYQPDAGTIRLGDTETTFPTALAASRAGVTAIHQETVLFDELSVAENIFLGHAPRNRFGLIDWKQLNADAQALLGRAGADFDPTIRLRDLGIAKKHLVAIARALSVDARVVIMDEPTAALSHKEIHELYDLIERLKADGKAVLFISHKFDEIFRIADRYTVFRDGAMIGEGLIADVSQDDLVRMMVGRAVGSVYPKKEVTIGQPVLTVSGYRHPTEFEDINFELRRGEILGFYGLVGAGRSEFMQSLIGITRPSAGAVKLDGEVLVIRSPAEAIRAGIVYVPEERGRQGAIIGMPIFQNVTLPSLSHTSRSGFLRLAEEFALAREYTSRLDLRAAALDQDVGTLSGGNQQKVVIAKWLATRPKVIILDEPTKGIDIGSKAAVHAFMSELAAQGLSVIMVSSEIPEIMGMSDRVIVMREGRVAGRYERSELTAEKLVRAAAGIETQADGRAA

SEQ ID NO: 38530 - DNA, 1485 bp, Sinorhizobium meliloti 1021
  CDS (1)..(1485): transl_table=11
atggaccagcacgaaatccttctgaagctcgagaatatcgagaagcgctttcccggtgtcgtggcgttgaagtcgatctcgctagaggtgcgcgcgggcgaggtgcaggtgcttctcggcgaaaacggcgcgggcaagtcgacgctgatgaagattctcgccggcgaacatgcgccgacgggcggggaaatcgtggtgggtggccgcaaggtttcggcgctgacgccgacgcttgccaccgaactcggcatcggcctcgtgcatcaggaactgagtcttgtcccggcgctcagcgtcgccgaaaacatcctgatcggccggatgccgcgcaatgcgttcggcaggataaactggggcaaggcctacgaggacgcgcgccgcgctctcgaggcgctcggcgtttccatcgatccgacagccgaagtgcgcacgctcgaagtggccgagcagcaattgatcgagattacccgcgtcctggagcgcggcccgcgcatccttctgctcgatgagcccacctcggcagtctcggataatgagcgcagccggctcttcgatgtcattcgtcgcctgaaacagcgcggccacggcatcatctacatttcccatcacctctcggaaattccgatgatcgccgatcgcgtcacggtgctgcgcgacggcctcgtcgtggagacgctgcctgccgacgaggcggacgaggcgacggtgatcaggctgatggtcggccgcaggctggaggaacagtttcccaaggaaacggtggaactcggggcgcccgtgcttgccgtcgaaaacctcgcctccggccgcacgctcaaggatctttccttcaccctccgccgtggcgaaatcctcggcatctacggcctgatgggcgcgggacaggccgagatcgccaacgccctgttcggcctgcaggcggtcaagaccggttcgatcgaggtcgggggcaagcgcgcggatttccggcattcctcggatgcgatcgcggcggggctcggtctgatctcccgcgaccgccggcagagcctcgtgccgatgcagccggtcggtcccaatctcagcctctcctggctttccgggaagtcgcttctgtcgcggctcgatcttacgcgcgagcgcgaggagggcagccgctacatttccgatctgcgcatccgtccggcttccaccacgcacaagctgttcttcttcagcggcggcaaccagcagaaggtcattctggcgcggtggatgtcgagcggcgcgcggatcctgattttcgacgagccgacccgcggcatcgatgtcggcgccaaggcagaagtgttcgcggtgatgagccggctggtgtcggaaggcgcgtcaattctgatgatctcctcggagctcaacgaactgatcggcatggcggaccgcgtgctcgtcatgcggagcggacgcctctcggcggagctgccgagggaagagatatcgcagcagaacctgctgcgatatgcaagctag

SEQ ID NO: 38531 - protein, 494 aa, Sinorhizobium meliloti 1021
MDQHEILLKLENIEKRFPGVVALKSISLEVRAGEVQVLLGENGAGKSTLMKILAGEHAPTGGEIVVGGRKVSALTPTLATELGIGLVHQELSLVPALSVAENILIGRMPRNAFGRINWGKAYEDARRALEALGVSIDPTAEVRTLEVAEQQLIEITRVLERGPRILLLDEPTSAVSDNERSRLFDVIRRLKQRGHGIIYISHHLSEIPMIADRVTVLRDGLVVETLPADEADEATVIRLMVGRRLEEQFPKETVELGAPVLAVENLASGRTLKDLSFTLRRGEILGIYGLMGAGQAEIANALFGLQAVKTGSIEVGGKRADFRHSSDAIAAGLGLISRDRRQSLVPMQPVGPNLSLSWLSGKSLLSRLDLTREREEGSRYISDLRIRPASTTHKLFFFSGGNQQKVILARWMSSGARILIFDEPTRGIDVGAKAEVFAVMSRLVSEGASILMISSELNELIGMADRVLVMRSGRLSAELPREEISQQNLLRYAS

SEQ ID NO: 38532 - DNA, 1506 bp, Sinorhizobium meliloti 1021
  CDS (1)..(1506): transl_table=11
atgaccgtacttgtcagtctgtccggcatcagcaagaactttagcggagtacaggccctgaagggcgtcgacttcgacctgagggccggcgaagtccatgcgctggtcggtgagaacggcgcgggaaaatccacactgatgcgcgtgcttgccggcgaaatgaagccgacctccgggaccgtcagcattcacggcgagacgatgcagcactccggcccgcggggcgccgccggccggggtatttcggttatccatcaggaactggcgctggcgcccgacctgaccgtcgcggagaacatctttctcgggcgcctgccgcgcatcgtcaatcaccgccggctgcgcaaggcagccagcgaaatcctcgaacgtctcggcttcgacatcgaccccgccatccacgccggacgcctgacagtcgcccaccagcaggtcgtggagatcgccaaggcactctccaaccgggcgcgcatcatcgtcttcgacgagccgaccgcggtgcttgccaacaccgatgccgagcgcctgctcgcgatcatccgcgagttgcgcgcgggcggtaccggcgccgtctacatctcccaccgtctgaacgaggtcttcgacctttcagaccgcatcaccgtcatgaaggacggctcgcatgtggaaacgctggagacctccgcaacggatgtcgacgcggtgatcgcacgcatggtcgggcggcagatgtccgcgctttttccatccaaggccgggcgtgtgccgggcgaggtggtcgtccgcgtgcgcaacgtttcgcgcggccgcaaggtccgcgacgtcagtttctcggtccgtgccggcgaggtcgtcggcctcgggggtctcgtcggttccggccgtaccgaagtcgcccgcctcgtcttcggcgccgacaagatggattcgggcactgtggaactcaacggcaaaccgctccatctctcctcaccgcgcgaggccgtgcgcgcccgcatcggcctcgttccggaagaccgcaagcagcagggcgtcatcctcgatgcgccgatccggatcaacacgacgcttgccaagatccgcagcatatcccgtctcggcttcctcgacgcgggcaaggagcggcaggtcgccgtggcgcttggcgccgagatgcgcctcaaggcgtcgagcgtcgacgcgccggtttcgagtctttccggcggcaaccagcagaaagtggcgcttgccaaatggtttcacgccgattgcgacctgctcatactcgacgaaccgacgcgcggcgtcgacgtcggagcgaaaggcgaaatctacaatctgatcaatgacctcgccaaagcggggaaagcaatcctcgttatttcgtccgagcatcaggaactgttcggcatctgcgaccgcgttctcgtgatggcggaaggggctatcgtcggcgaactcaccgaaagcaagttcaccgagcagcaattgctgacgctggcaatgacccggtcggccagggaaagggatgagacaagccaatga

SEQ ID NO: 38533 - protein, 501 aa, Sinorhizobium meliloti 1021
MTVLVSLSGISKNFSGVQALKGVDFDLRAGEVHALVGENGAGKSTLMRVLAGEMKPTSGTVSIHGETMQHSGPRGAAGRGISVIHQELALAPDLTVAENIFLGRLPRIVNHRRLRKAASEILERLGFDIDPAIHAGRLTVAHQQVVEIAKALSNRARIIVFDEPTAVLANTDAERLLAIIRELRAGGTGAVYISHRLNEVFDLSDRITVMKDGSHVETLETSATDVDAVIARMVGRQMSALFPSKAGRVPGEVVVRVRNVSRGRKVRDVSFSVRAGEVVGLGGLVGSGRTEVARLVFGADKMDSGTVELNGKPLHLSSPREAVRARIGLVPEDRKQQGVILDAPIRINTTLAKIRSISRLGFLDAGKERQVAVALGAEMRLKASSVDAPVSSLSGGNQQKVALAKWFHADCDLLILDEPTRGVDVGAKGEIYNLINDLAKAGKAILVISSEHQELFGICDRVLVMAEGAIVGELTESKFTEQQLLTLAMTRSARERDETSQ

SEQ ID NO: 38534 - DNA, 1533 bp, Bacillus subtilis subsp. subtilis str. 168
  CDS (1)..(1533): transl_table=11
atggaatatgtcattgaaatgctcaatatccgcaaggcgtttccaggtatcgtcgccaatgacaatatcaatcttcaagtcaaaaaaggcgaaatacacgcgttgctcggtgaaaacggagcggggaaatcaacattgatgaatgtccttttcgggctgtatcagccggagcggggtgaaattcgggtgcgcggcgagaaggtgcacatcaacagcccgaacaaagcgaatgaccttggaattggaatggtgcaccagcactttatgcttgttgacacctttacagttgctgaaaatattattctcgggaaggagccaaagaagtttggcagaattgaccggaagcgtgctggccaagaggtgcaggacatttccgatcgatacggcctgcagatccatcctgaagcaaaagcagctgacatatcagtcggtatgcagcagcgcgcagaaatattaaaaaccctctaccgcggtgccgacattctgatttttgatgaaccgacggctgttttgacgcctcatgaaattaaggaactgatgcaaattatgaagaacctggtcaaagaagggaagtccatcatcttaatcacccataagctgaaagagattatggagatttgtgaccgcgttacggttatccgtaaaggaaaaggcatcaaaacccttgatgtccgtgatacaaaccaagacgaactcgccagtctaatggtcggccgtgaggtatcgttcaaaactgaaaagagagctgctcagccgggagcggaagtgcttgcgattgacggcataactgtaaaggatacccgcggaatagagacagtcagagatttgtctctttctgtcaaagcgggagaaatagtcggcatagcaggcgtcgacggaaacgggcaatctgagctgatcgaagcggtgacaggactccgcaaaacagattcaggaacaatcaccttaaacggaaaacagatccaaaacctgacgccaagaaaaatcactgaatccgggatcgggcatattcctcaggatcgccataaacacggtctcgtccttgattttccaatcggagagaatatcctgctgcaaagctattacaaaaagccgtattcagcattgggcgttttacataaaggcgaaatgtacaaaaaagcacgcagcctgatcactgagtacgatgtcagaacgccggatgaatatacacacgctcgggcattgtcaggcggaaaccagcaaaaagcgattatcgggcgggaaatagaccgaaatcctgatttattaattgccgcccagccgactcgcggccttgatgtcggagcgattgaatttgtccataaaaagctcattgagcagcgtgatgccgggaaagccgttcttctcctctcgtttgagcttgaagaaattatgaatctcagtgacagaatcgccgttatttttgaaggacgcattatcgccagcgttaatccgcaggaaaccactgaacaggagcttggtctcttgatggcaggaagcacgcaaaaggaagcggggaaagcaaatggttaa

SEQ ID NO: 38535 - protein, 510 aa, Bacillus subtilis subsp. subtilis str. 168
MEYVIEMLNIRKAFPGIVANDNINLQVKKGEIHALLGENGAGKSTLMNVLFGLYQPERGEIRVRGEKVHINSPNKANDLGIGMVHQHFMLVDTFTVAENIILGKEPKKFGRIDRKRAGQEVQDISDRYGLQIHPEAKAADISVGMQQRAEILKTLYRGADILIFDEPTAVLTPHEIKELMQIMKNLVKEGKSIILITHKLKEIMEICDRVTVIRKGKGIKTLDVRDTNQDELASLMVGREVSFKTEKRAAQPGAEVLAIDGITVKDTRGIETVRDLSLSVKAGEIVGIAGVDGNGQSELIEAVTGLRKTDSGTITLNGKQIQNLTPRKITESGIGHIPQDRHKHGLVLDFPIGENILLQSYYKKPYSALGVLHKGEMYKKARSLITEYDVRTPDEYTHARALSGGNQQKAIIGREIDRNPDLLIAAQPTRGLDVGAIEFVHKKLIEQRDAGKAVLLLSFELEEIMNLSDRIAVIFEGRIIASVNPQETTEQELGLLMAGSTQKEAGKANG

SEQ ID NO: 38536 - DNA, 1509 bp, Yersinia pestis CO92
  CDS (1)..(1509): transl_table=11
atgatccgtaacgagatactggcaaaaaaaccggactatctattagaagcgacgggactaaaaaaatcctttggcgatgtgatcgcgctaaacaatgctgaattctgtttaaaacggggttctatccatgcgctttgcggtgggaacggtgccggtaaatcaacatttcttggcctattaatgggatttattcagcctgatgatggggcgtttttcatcaacgggcaatactgcgaattcgactcaccgggacaagccctagccgcagggattaccattgttcaacaagagctcagtggggtacaggatctgtctgtggccgaaaatatttatctgggttctgagccaaggcgctttggtattgtcgattttcgtgcgcttaaccgccaggccgatgtgttattacacgagctgggtttcgccatttcacccaaagccaaaatgcgcagcctgagcgtagcagagcaacaacgggtggaaattgccaaagcgctgtcacatacccatgccgatatcatcattatggatgaacccacctccgcattaggtgaagaggatgcgcaaaaactgtttcagaccataaaaaaactggcctctctgggaaaaggggttatttatgtctcccaccgcttgtcagaaatatttcaaattgcagacagctacacggtatttcgagatggttgttatatttgtgaaggagagacgagtcacatcactcgcgaacaactgattgagcatattattggtggcgagattgatggtgagttctccaaatacaatactccaaccaatgtgccactctttaaagcctctggcatatgttggaaatcgaaagtgaatgatgtcagcctgacattacattgcggtgaaattttagggatttatggcttagtaggatcggggcgcagtgagtttcttaatctgctgtttggtcttgagcgtgctgatcacgggagcatccatatcggtgatgagatattactgaaacacacaccagaaaaagcaatcaacgccggtatcgcctatgtgaccgaagatcgtcaagagacaggattagtattgaaccattcggtatcggaaaatattaatatctcctcattaaacgtcattagtcgtatgagtatcattaatgaaaatgatattcagcgccgtgctgaccacacgatccgtatctttaatattaagacaccgagtcgccaacaacgagtggctaatttaagcggtggtaatcaacaaaaggtggtgttaggccgctgggcactgttagaccctaaagttttattattagatgagccaaccaggggaattgacattggggcaaaaaaagaaatttatcgctttatgtcggattttgccctcaaaggaaaaggcattgttatggtctcctccgagctttctgaaattattggcatgagcgacagaatcttggtttttaaaaaagggaaaatagtcggtgaaattacgggcactgaggcaacacaggccaaattaatgtcgatggcggtataa

SEQ ID NO: 38537 - protein, 502 aa, Yersinia pestis CO92
MIRNEILAKKPDYLLEATGLKKSFGDVIALNNAEFCLKRGSIHALCGGNGAGKSTFLGLLMGFIQPDDGAFFINGQYCEFDSPGQALAAGITIVQQELSGVQDLSVAENIYLGSEPRRFGIVDFRALNRQADVLLHELGFAISPKAKMRSLSVAEQQRVEIAKALSHTHADIIIMDEPTSALGEEDAQKLFQTIKKLASLGKGVIYVSHRLSEIFQIADSYTVFRDGCYICEGETSHITREQLIEHIIGGEIDGEFSKYNTPTNVPLFKASGICWKSKVNDVSLTLHCGEILGIYGLVGSGRSEFLNLLFGLERADHGSIHIGDEILLKHTPEKAINAGIAYVTEDRQETGLVLNHSVSENINISSLNVISRMSIINENDIQRRADHTIRIFNIKTPSRQQRVANLSGGNQQKVVLGRWALLDPKVLLLDEPTRGIDIGAKKEIYRFMSDFALKGKGIVMVSSELSEIIGMSDRILVFKKGKIVGEITGTEATQAKLMSMAV

SEQ ID NO: 38538 - DNA, 1548 bp, Yersinia pestis CO92
  CDS (1)..(1548): transl_table=11
atgtcgcaacctttattgaaaatcaccgatatggcgaaaagcttctctggtgtctgggcgctcagtaacgtacagctcaccctagagcagggtgaaatacatgcactcttgggtgagaacggcgcaggtaaatcaacactcttgaaagcactctcgggtgctcaaccccagactcacggcgaaatctggtttaacggtgaaatgctggcattggacgactcgccagtggaacgccagaacaaaggcattatcaccatctatcaagaagttaacctactgcccaacatgacggtggcagaaaacatgtttcttggtcgtgaaccgcgccgccgtcaggtatttgtcgacgaaaaagccgtcaatcaggaagcccaagcgatcctcgattacctgcaacttaacgtgtcacccaccacggcggtggcgcgcttgagtatcgcgcagcaacagatggtagagatcgcccgggcgctgaccttgaacgcgaagctcattgtcatggatgagccttcggcagcactcagcgacagcgaagtcgaaagcctgcatcgcgtggtacgggaactgaaaggccgtggtgtgagcattatctatgtcacccaccgcttgcacgaagtgttccaactctgtgaccgtttcacggtgtttcaggatgggcgttacaccggttctgatgaggttgcaggcaccaacgttgagaagattatccgcctgatggtggggcgagacgtcgtatttaaccgccgccccgccagtgagacccatcaccaagaccagcccattcgcctatctgtgcaagggctgtgtcgtgaaaaacccccgctcgacccacatggtgtggcgctaaaagacatcagctttcatgtccacgccggggaagtcttgggtatcgccgggttggtaggggcagggcgtaccgaagtggcacgttgtctgtttggggcaggggctttcacctctggcaattttgagatagacggtgtgccctatcagccacgggatccaatgttcgcgctggaacaggggatagcactggtgccggaagaccgtaaaaaagagggggcagtgcaagggctttctattcgcgacaatctgacactttcgagcctggccgggctgttacagtggcgttttttcgtcaatacccgcaaagaagatcaactgattgagacctaccgtttagcactgcaaatcaagatggtgaacagcgaacaggcggtgcgtaagctctctggctgtaaccagcagaaggtgatcttggcccgctgcatggcgctcaatccacggatcctgatcgtcgatgaaccgacacggggcattgatgtgggcacgaaatcggaagtgcatcaggtgttgtttgatatggctaaacagggcgtggcagtgatcgtcatctcctcggatttaccggaagttctcgcggtttctgaccggatcatcacgctaagcgaagggcgagtcactggagagattcacggtgatgacgccagcgaagaacggctgatgaccatgatgaccatcaatcataacgccttaaatgccgcctaa

SEQ ID NO: 38539 - protein, 515 aa, Yersinia pestis CO92
MSQPLLKITDMAKSFSGVWALSNVQLTLEQGEIHALLGENGAGKSTLLKALSGAQPQTHGEIWFNGEMLALDDSPVERQNKGIITIYQEVNLLPNMTVAENMFLGREPRRRQVFVDEKAVNQEAQAILDYLQLNVSPTTAVARLSIAQQQMVEIARALTLNAKLIVMDEPSAALSDSEVESLHRVVRELKGRGVSIIYVTHRLHEVFQLCDRFTVFQDGRYTGSDEVAGTNVEKIIRLMVGRDVVFNRRPASETHHQDQPIRLSVQGLCREKPPLDPHGVALKDISFHVHAGEVLGIAGLVGAGRTEVARCLFGAGAFTSGNFEIDGVPYQPRDPMFALEQGIALVPEDRKKEGAVQGLSIRDNLTLSSLAGLLQWRFFVNTRKEDQLIETYRLALQIKMVNSEQAVRKLSGCNQQKVILARCMALNPRILIVDEPTRGIDVGTKSEVHQVLFDMAKQGVAVIVISSDLPEVLAVSDRIITLSEGRVTGEIHGDDASEERLMTMMTINHNALNAA

SEQ ID NO: 38540 - DNA, 1515 bp, Yersinia pestis CO92; identical to SEQ ID NO: 27194
  CDS (1)..(1515): transl_table=11

SEQ ID NO: 38541 - protein, 504 aa, Yersinia pestis CO92; identical to SEQ ID NO: 27195

SEQ ID NO: 38542 - DNA, 1548 bp, Caulobacter crescentus CB15
  CDS (1)..(1548): transl_table=11
atgaccctcctggacgtcagccaggtcagcaagagctttcccggcgtgcgcgcgctcgaccaggtggacctcgtcgtcggtgtcggcgaggttcatgcgctgctgggcgagaacggggccggcaagtccaccctgatcaagatcctgtcggccgcccacgccgccgacgccggaaccgtgaccttcgccggccaggtcctggacccgcgggatgcgccgctgcgccgccagcagctcggcatcgccacgatctaccaggaattcaacctgttcccggaactgagcgtggccgagaacatgtatctgggccgcgagccgcgccgcctgggtctggtcgactggtcgcggctgcgcgccgacgcccaggccctgctgaacgatctgggcctgccgctaaatcctgacgcgccggtgcgcggcctgaccgtcgccgagcagcagatggtcgagatcgccaaggccatgaccctgaacgcgcggctgatcatcatggacgagccgaccgccgcgctcagcggccgcgaggtcgaccgcctgcacgccatcatcgccggcctgaaggcgcggtcggtgtcggtgatctacgtctcgcaccgcctgggcgaggtgaaggcgatgtgcgaccgctacaccgtcatgcgcgacggccgcttcgtggccagcggcgacgtcgccgacgtcgaggtcgccgacatggtccggctgatggtcgggcggcatgtcgagttcgagcggcgcaagcgtcggcgtccccccggcgcggtggtgctgaaggtcgagggcgtgaccccggccgcgccccgactgtcggcgcccggctatctgcgccaggtgtcgttcgcggcgaggggcggcgagatcgtcggtctggccggcttggtcggcgcgggccgcacggacctggcccggctgatcttcggcgccgatccgatcgccgccggacgcgtcctggtcgacgacaagcccctgcgcctgcgctcgccccgcgacgctatccaggccgggatcatgctggtgcccgaggaccgcaagcagcagggctgcttcctggaccactcgatccgccgcaatctgagcctgcccagcctcaaggcgctgagcgcgctgggccagtgggtcgacgagcgggccgagcgcgacctcgtcgagacctatcgccagaagctgcgcatcaagatggccgacgccgagaccgcgatcggcaagctgtcgggcggcaaccagcagaaggtcctgctgggccgggcgatggcgctgacgcccaaggtgctgatcgtcgacgagcccacgcgcgggatcgacatcggcgccaaggccgaggttcaccaggtgctcagcgacctggccgacctgggcgtagcggtcgtcgtgatctcgtcggaactggccgaggtcatggccgtcagcgatcgcatcgtcgttttccgcgagggcgtcatcgtcgccgatctcgacgcgcagaccgccaccgaagagggcctgatggcctatatggcgaccggcacggaccgggtcgccgcccctgacatggaacgcctgaccgcatga

SEQ ID NO: 38543 - protein, 515 aa, Caulobacter crescentus CB15
MTLLDVSQVSKSFPGVRALDQVDLVVGVGEVHALLGENGAGKSTLIKILSAAHAADAGTVTFAGQVLDPRDAPLRRQQLGIATIYQEFNLFPELSVAENMYLGREPRRLGLVDWSRLRADAQALLNDLGLPLNPDAPVRGLTVAEQQMVEIAKAMTLNARLIIMDEPTAALSGREVDRLHAIIAGLKARSVSVIYVSHRLGEVKAMCDRYTVMRDGRFVASGDVADVEVADMVRLMVGRHVEFERRKRRRPPGAVVLKVEGVTPAAPRLSAPGYLRQVSFAARGGEIVGLAGLVGAGRTDLARLIFGADPIAAGRVLVDDKPLRLRSPRDAIQAGIMLVPEDRKQQGCFLDHSIRRNLSLPSLKALSALGQWVDERAERDLVETYRQKLRIKMADAETAIGKLSGGNQQKVLLGRAMALTPKVLIVDEPTRGIDIGAKAEVHQVLSDLADLGVAVVVISSELAEVMAVSDRIVVFREGVIVADLDAQTATEEGLMAYMATGTDRVAAPDMERLTA

SEQ ID NO: 38544 - DNA, 1593 bp, Sinorhizobium meliloti 1021
  CDS (1)..(1593): transl_table=11
atgaacgcggctctgccttccaatgcggtcgcgccgccgccaaaccgtgctgttgccgcactcgcggcagagggccttggcaaagcctacggcccgattaccgtcctttcggacgtcacgcttgaggttcatgctggagaggttcacgccattatcggtgagaacggcgccggaaaatcgacgctgatgaagctcctttccggccatgtcgtcccaacggcgggccacttgctcctggagggcaagtcggtagagttccgaaatgcggtggaggcggagaacgccggcatcgtactcgtgcaccaggaaatcctgctcgcttcggacctcaccgttgcggaaaacctgtatttgggtcgcgaggtcggccgcggtctgctggtcaatgacaaggcgatgaacagtcgtgccgccgaactcctcgcacgggtcggttcagcggcgcggccgcgcgaccgtgtgggtgagctgccgctcgcccagcgccagctcgtgcagatcgcgcgtgcccttctcgacgagcgaaaggtcatcatcttcgacgagcctactgcggttctcgcaaacgacgaagtggcggcgctgctcgacatcgttcgcagcttgcgcgatcacggggttgcggtgctctacatctcccatcgtctcgatgaggttcaggctcttgccgaccggatcaccgtgcttcgtgacggccgcatgatcggaacctggcccgcggcaggcctcggccagcgggaaatggcggaactgatggtcgggcgagagctggacatgctctatccgcataagcggtcagccacgaccgctgctccgatcctgtcagtcaccaaccttgccatcgaccacggctcgcagaccgtctcctttagcgtcagccccggcgaagtgctgggtatcggcggcatggtcggggcgggtcgtaccgaactgatcgagggcctgatgggccttcgtccgtcagaggctgaaagcatcgtcctgaacggccgggagatcgggagccgctccgtccgtaccctaatggacgccggactggtttacctgaccgaggaccgcaagggcaaaggcctgctcctggaggagaagctcggtcctaacctcaccctgcaggcgctggatacgatcaatccgggtgtttttctggacaagcaaggtgagctttcccgccttcgaaaggcggtggctgattacgacattcgcgtgcgctcgatgcgccttgaagccagccagctttcgggcgggaaccagcagaagctacttcttgccaaggtcatgatggccgatccgtcggtgatcatcatcgacgagccgactcgcgggatcgatatcggcaacaagagccagatctatgacttcatcgacgggatggtgcgcgccggcaaagcctgcatcgtcatctcgtcggaaatgccggaactcgtaggtcttgccgaccgtgtgctggtgatgcgtgccgggaggatcgtcgctgagctacgcggcgatgaaatcaatgaggaaaatgtcgtctacgccgccacgaccggtgggtgcgcggacgtcggggaggagaaacatgaccgtagcgacagcaacactcgcaccaactaa

SEQ ID NO: 38545 - protein, 530 aa, Sinorhizobium meliloti 1021
MNAALPSNAVAPPPNRAVAALAAEGLGKAYGPITVLSDVTLEVHAGEVHAIIGENGAGKSTLMKLLSGHVVPTAGHLLLEGKSVEFRNAVEAENAGIVLVHQEILLASDLTVAENLYLGREVGRGLLVNDKAMNSRAAELLARVGSAARPRDRVGELPLAQRQLVQIARALLDERKVIIFDEPTAVLANDEVAALLDIVRSLRDHGVAVLYISHRLDEVQALADRITVLRDGRMIGTWPAAGLGQREMAELMVGRELDMLYPHKRSATTAAPILSVTNLAIDHGSQTVSFSVSPGEVLGIGGMVGAGRTELIEGLMGLRPSEAESIVLNGREIGSRSVRTLMDAGLVYLTEDRKGKGLLLEEKLGPNLTLQALDTINPGVFLDKQGELSRLRKAVADYDIRVRSMRLEASQLSGGNQQKLLLAKVMMADPSVIIIDEPTRGIDIGNKSQIYDFIDGMVRAGKACIVISSEMPELVGLADRVLVMRAGRIVAELRGDEINEENVVYAATTGGCADVGEEKHDRSDSNTRTN

SEQ ID NO: 38546 - DNA, 1512 bp, Sinorhizobium meliloti 1021
  CDS (1)..(1512): transl_table=11
atgtacgagctgaagtccctcgacaagaagtttcccggcgttcatgcgctcaaggcgatcgacttccatatcaagcgcggcgagatcgtcgggctggtgggagagaacggcgcgggaaaatccaccctcatgaaggtgatctatggcgcctaccagcccgatggcgggcagatcctcatcaacggcgatgccgtgcgcttcgcgaacccccgccaggcgatggaaaaggggatcgggatggtgtttcaggagcagtccctcatcccgaacctcacggtgatggagaacatttttctcggctacgagcagcagttcgtccgcctcggcgtcatcaactggaaggagatggccaaggccgcgaaagcacagcttgcgaaggtcaagctggacatcgatccttcgacggtcacatcgaaactgtccttcgctcagcgtcagctggtcgaactcgccaaggtcctcacactcgaagagcgggtcgacggcgatctcgtcatcctcctcgacgagcccacctcggtcctgtcgaaggacgaagtcgagcttctgttcaagctcgtgcgcgagctcgtgacccgtgcctccttcatattcgtctcgcaccgaatggacgaagtcatggagctgtcggatcggatctacgtgatgaaggacggacaggtggtcgacgtcgtcgagcggggcgggggcggagccgatgccgaatcgatccagcacaagatggtcgggcggaacgtcgacaagcaatattatcgggagcagcttcaaaagccctacgatccctcgagagtcctcgtcgaaatgtccggcatcgacctgccaggccgcacgaaggatatctcgctcaggcttcacgccggtgaggtcctgtgcctcgtcggaaccgaaggctcgggccgtgaagcgatcctgcgcgcaatctacggcatgctcagccccaccggcggacgcctgaagatcaagggacgggaggtgaggacatattcgccgcgtcaatcggtcggcctcggcgtcggatatgttccgcgcgagcgcaagatcgagggcatcgtggcgggcatgaatgtctacgagaacatgaccctctcgcagttgaagaagcattcgacggcgagcgttctgcaggtcggaaaggagcgcgcgcttgcgcgggagtggatcaggaagctctccatcaaggcccattccgagctcgccgactgcggcaacctttcaggcggcaaccagcagaaggtcgttctcgccaaatggcgctccgcgggcgccgatatcatgctcctcgatcacccgacgcgcggtctcgacatcggggcgaaggaggacgtctacgaaatgatccgcgccatgagcgatgcgggcgtcgggatcgtcctggtggccgacacgctcgaggaagcgatcggactctcccatacgatcgtcgtcgtcaaggatggcaggatccagaaacggttcgattgcgtgcctggcgcgaagccctccctctatgacctcctgcattacatgatctga

SEQ ID NO: 38547 - protein, 503 aa, Sinorhizobium meliloti 1021
MYELKSLDKKFPGVHALKAIDFHIKRGEIVGLVGENGAGKSTLMKVIYGAYQPDGGQILINGDAVRFANPRQAMEKGIGMVFQEQSLIPNLTVMENIFLGYEQQFVRLGVINWKEMAKAAKAQLAKVKLDIDPSTVTSKLSFAQRQLVELAKVLTLEERVDGDLVILLDEPTSVLSKDEVELLFKLVRELVTRASFIFVSHRMDEVMELSDRIYVMKDGQVVDVVERGGGGADAESIQHKMVGRNVDKQYYREQLQKPYDPSRVLVEMSGIDLPGRTKDISLRLHAGEVLCLVGTEGSGREAILRAIYGMLSPTGGRLKIKGREVRTYSPRQSVGLGVGYVPRERKIEGIVAGMNVYENMTLSQLKKHSTASVLQVGKERALAREWIRKLSIKAHSELADCGNLSGGNQQKVVLAKWRSAGADIMLLDHPTRGLDIGAKEDVYEMIRAMSDAGVGIVLVADTLEEAIGLSHTIVVVKDGRIQKRFDCVPGAKPSLYDLLHYMI

SEQ ID NO: 38548 - DNA, 1551 bp, Sinorhizobium meliloti 1021
  CDS (1)..(1551): transl_table=11
atgccctccgcaggggcgcggagcgatacgatgcccttcctggaagttcgcgacctggagaagcgcttcggcggtgttcgcgcgctcaagggggtgagcttcacgatcgagcgcggccgtacctaccatctgatgggcgagaacggatgcggcaagagcacgcttatcaagatcatttccggcgcccaaccggcagatggcggtgagcttacgatcaacggcaaaaaggtcgaggggctgacgccgatcggcgccctggcagccggcatcgagacggtttatcaggacctgtcgcttcttcccaatctgagcgtcgaagagaatgtcgcgctgacgcagcagctggttgcctcgaacgggagcctcgcgcggcgtctcgacctcaagggcctgcgggagacggccgtccgtgcattgaaggacgtcggactgccgacggagcccgcctttctgtcgacccccgtcgaagaactccccatcgcaacgcgccagctcatcgccattgctcgcgcgatcgcttcggatgccggtctggtcatcatggatgagccgacgaccgcactgacgcggcgcgaagtggacaacctcattcgcgtcgttcacggcctacacgccaagggcgtgtctgtccttttcgtcacgcacaagctcgacgaatgcaaggcgatcggcgggcaggcgatcatcatgcgcgacggcctgaaggttgccgaatgcgacgtcgccacccagtcgaagaccgaactcggcttctggatgacgggcaagaacctcgacgacacgcgttatcgcgtcgatacccatggtgacgagacgctgctctcggtggagcggctcgggggtgccggcttcgacgatgtcagcttcacggtttccaagggcgagatattcgggattacgggacttctcgattccgggcggaacgagcttgcgctttcgctggccggcgtggaatcggcgcggcggggctcggtcctgctcgcaggcagacgggccgatctgtcgtcacccgcctcggcgatcgaggccggcatcggctatgttccggaggaccgtctatccgaagggcttttccttggaaaatccatccgcgagaatatcgtcatggcggtcctcgaccgactgcggggagctttcggcctgctcgacagccgccgggcgaaggctctggcacagaaaaccgtcgacgatctgcaggtggcgactccggatatcgacaaccccgtcatgtccctttcaggcggcaaccagcagagggtcctgatcggccgctggctgacgatcgagccgagcctgctcatcctgcacggcccgaccgtcggcgtcgacgtcggatcgaaggacacgatattccgcatcattcagcgccttgcaggagacggcatgagcgtcgtcatcatcagcgacgacctgcccgagcttctgcagaactgcgaccgcgtgatggtgatgcgtaaaggccgggtcgccgatatctttccggccgaagggctcgaggaggacgcaatctacaagtcgatgatggccgaagacggccagggagttcaataa

SEQ ID NO: 38549 - protein, 516 aa, Sinorhizobium meliloti 1021
MPSAGARSDTMPFLEVRDLEKRFGGVRALKGVSFTIERGRTYHLMGENGCGKSTLIKIISGAQPADGGELTINGKKVEGLTPIGALAAGIETVYQDLSLLPNLSVEENVALTQQLVASNGSLARRLDLKGLRETAVRALKDVGLPTEPAFLSTPVEELPIATRQLIAIARAIASDAGLVIMDEPTTALTRREVDNLIRVVHGLHAKGVSVLFVTHKLDECKAIGGQAIIMRDGLKVAECDVATQSKTELGFWMTGKNLDDTRYRVDTHGDETLLSVERLGGAGFDDVSFTVSKGEIFGITGLLDSGRNELALSLAGVESARRGSVLLAGRRADLSSPASAIEAGIGYVPEDRLSEGLFLGKSIRENIVMAVLDRLRGAFGLLDSRRAKALAQKTVDDLQVATPDIDNPVMSLSGGNQQRVLIGRWLTIEPSLLILHGPTVGVDVGSKDTIFRIIQRLAGDGMSVVIISDDLPELLQNCDRVMVMRKGRVADIFPAEGLEEDAIYKSMMAEDGQGVQ

SEQ ID NO: 38550 - DNA, 1551 bp, Sinorhizobium meliloti 1021
  CDS (1)..(1551): transl_table=11
atgatcatgcacccagctgacgacgatgactgcgtcctgcgcctcgaagacgtgacgaaggtctattcgggtataattgcggtgcgccatgcgaacctttcgctccggcgcggcgccgtgaatgtgctcgtgggggaaaacggtgccggcaagtcgaccctgatgcggatcatcgccggcgtcgagaagccgtcactcggccgcatcctgctcgacggccagcaggtggagttccattcgccggccgacgcgcagcgccacggcatcggcatggtcttccaggagctgaatctgttcggcaatctctcggttgccgagaacatcttcgcgacgcgggagctgacccgaggcattcgcggcatcgatcatcgcgcgcaggtcgagagggctaccgggttcctcgacaggctcgatgccgggatcgatgccgagacgctcgtcgaagacctgccgatcggccagcagcagctggtggagatcgccaaggcgatctcgctcgatacccgcatccttattctggacgagccgacatcggccctttcggcggcggaggtggacgtccttttcaaggtcatccgggagctgaaggcgcaaggggtggcgatcgtctacatttctcaccggctcgaggagctgatgcggatcggcgactacatcaccgtgctcagggatggacagatcaccggccacgccatggtcaaggacatcgataccaagtggatcgtccggtcgatgatcggctcggatgcgaaggacttcgccaaatcggtcgaccaccgcctcggagaggaggcgttccgcgccgaggagatctgcctgccgcgccggaccggcgggctcgcggtcgatcatgtctcgatctcggtacgtgccggcgaggtgttgggcatctacgggctgatgggggccggccgaagcgaattcttcgaatgcgtcatgggccagcacccgcattcctcggggcgggtcttcgtcggcgggacggaggtcgacgccagcgacacgtcgggcaggatcagcgcaggattggcgctcataccggaagatcgccagcgcgagggtctcgtccaggcgctttcgatcgccagcaacctgacgcttgcgagcctcgaccgcttcgtccgcttcggcttccatattgtcggcgcgcgggagcaagcctcgatcgcggcggccatccgcgatctttccatcaaggcgcccaacccggacttcgaggtgacctcgatgtccggcggcaaccagcagaaggtcgtcatcggcaaggccctgatgacgaaaccgaaggtgctgctgatggacgaacccagccgcggaatagatgtcggcgccaaggcggatgtcttccgcaccatgcgccggcttgccggcgaggggctcgccatcctcttttccacctccgacctcgaagaggtcatggcgctctccgaccgcatcgccgtcatgagcaacggacggctggtcacggtcatcgaccgcgcggacgcgacggaagagatgatcataaaggcttcggccgagggtcataaaacgacaagggaacacgcctga

SEQ ID NO: 38551 - protein, 516 aa, Sinorhizobium meliloti 1021
MIMHPADDDDCVLRLEDVTKVYSGIIAVRHANLSLRRGAVNVLVGENGAGKSTLMRIIAGVEKPSLGRILLDGQQVEFHSPADAQRHGIGMVFQELNLFGNLSVAENIFATRELTRGIRGIDHRAQVERATGFLDRLDAGIDAETLVEDLPIGQQQLVEIAKAISLDTRILILDEPTSALSAAEVDVLFKVIRELKAQGVAIVYISHRLEELMRIGDYITVLRDGQITGHAMVKDIDTKWIVRSMIGSDAKDFAKSVDHRLGEEAFRAEEICLPRRTGGLAVDHVSISVRAGEVLGIYGLMGAGRSEFFECVMGQHPHSSGRVFVGGTEVDASDTSGRISAGLALIPEDRQREGLVQALSIASNLTLASLDRFVRFGFHIVGAREQASIAAAIRDLSIKAPNPDFEVTSMSGGNQQKVVIGKALMTKPKVLLMDEPSRGIDVGAKADVFRTMRRLAGEGLAILFSTSDLEEVMALSDRIAVMSNGRLVTVIDRADATEEMIIKASAEGHKTTREHA

SEQ ID NO: 38552 - DNA, 1530 bp, Sinorhizobium meliloti 1021
  CDS (1)..(1530): transl_table=11
atgggcctcgacagcatgcaccagtcggcaagcgcggcgagcacggacaagccgcttctgtctcttcgcaacatcaacatgaccttcggcggcgttaaagcactgaagaatgtgagcttcgaggtgcagccgggcgaggtccattgcctcgccggagagaacggctgcggcaagagcacgctcatcaaggtgatcacgggtgtctatcgccccgcggagggggcggtgatcgaatatgacggcgaaacctatccgcatatgtcgccggttacggcacaggaccgcggcattcaggtcatctggcaggatcttgcgcttttcccggaaatgaccgtcgcggaaaacatcgccttccacgaggtgctcggcggccggccgcggctggtggattacggccgtatgcgtaggatcgcggtggatgcgctgggccgcctcggcatcacgttggacgtcgacctaccgctcaaggaatatgcgatcgcccagcgtcagatcgtggcgattgcccgggcgctcgtcggtgaggcgaagctggtcttcatggacgagccgaccgcatcgctgacgcagtcggagacggaccatctgctcgaaatcgtccgcagcctctccgcctccggcgtcgcggtcgtcttcgtcagccatcggcttgccgaggtgctggagatttcaagccggatcacagtcttgcgcgacggcgcgctggtcggggtttatccggccgccggcatgacgcagtcgaaaatcaccgaactcatgaccggcaagaccttcgatcagcacgttcgcgcacgtcccagggacgatcagccggtcgtgctcgacgttcgcgggctcaccaggccaggccagtttgaggatatttcgtttaccgttcgccgcggcgaaacggtcggcataaccggcctgctcggggcagggcggaccgaagtggcgctcgccctcttcggcatgctcaagcccgcaaccgggacgatcagtatcgatggccgggaggtccgcttcggctcgaaccgcgaggcgatcagggccggcgtcgcatatctgtcggaggaccgattgtcactcggactcatccagccgcagccgatcgccgacaatctcgttatcgcctcgctgcgcaagattctctcagggggtcttctttccgaagaccgcaaacgaagtctcgtctcccggtggatcgccgatctcggcgtcaagatcggccatcaggctgacgcgatatcgacgctttccggcggcaaccagcagcgcgtggcgatcgccaaatggcttgccaccgatcccaaactgttgatcctcgattcacccacagtcggcgtcgacgtcggggcacgggccgggatctttgacatcgtcgccaagctcgctgagagcgggcttgcgattatcctgatctcggacgaggtgccggaagtctatttcaacgccgaccgtgtcctgcacatggcgcagggccgcatcgtcggaacctatgatccgcgccagtcgcggctggaagagatcgaggcggcagtttatgcgtag

SEQ ID NO: 38553 - protein, 509 aa, Sinorhizobium meliloti 1021
MGLDSMHQSASAASTDKPLLSLRNINMTFGGVKALKNVSFEVQPGEVHCLAGENGCGKSTLIKVITGVYRPAEGAVIEYDGETYPHMSPVTAQDRGIQVIWQDLALFPEMTVAENIAFHEVLGGRPRLVDYGRMRRIAVDALGRLGITLDVDLPLKEYAIAQRQIVAIARALVGEAKLVFMDEPTASLTQSETDHLLEIVRSLSASGVAVVFVSHRLAEVLEISSRITVLRDGALVGVYPAAGMTQSKITELMTGKTFDQHVRARPRDDQPVVLDVRGLTRPGQFEDISFTVRRGETVGITGLLGAGRTEVALALFGMLKPATGTISIDGREVRFGSNREAIRAGVAYLSEDRLSLGLIQPQPIADNLVIASLRKILSGGLLSEDRKRSLVSRWIADLGVKIGHQADAISTLSGGNQQRVAIAKWLATDPKLLILDSPTVGVDVGARAGIFDIVAKLAESGLAIILISDEVPEVYFNADRVLHMAQGRIVGTYDPRQSRLEEIEAAVYA

SEQ ID NO: 38554 - DNA, 1539 bp, Sinorhizobium meliloti 1021
  CDS (1)..(1539): transl_table=11
atgacgtcagagaccgtgctggagatccgcaatgtcagcaagcatttcggcgccgtcaaggcgttgacagccgtagactttcggctcgcacggggcgaagttcacgcgctttgcggcgagaacggcgccggcaagtcgacactgatgaacgtcattgccggcgtgctgcagccgtcggaaggggaagtcctcatcgaaggcgcccccgtgaagatcgcctcgcccgcggtcgcacagtcgctcggcatcgccctcgtgcatcaggagatcgcactctgccctgacgcgacgatcgcggaaaacatgttcatggcggcgacgaaccgccgtcgctcggctctgatgaactacgcccagctggagcgcgacgcgcaggccgtgatgaatcgtctggccccgatcgacgtcagccagaaggtcggcgacctgccgatctccagtcagcagctcgtcgagatcgccaaggcactgacgctcgattgccgagtgctaatcttcgacgagccgacggcggcgctgacagagaccgaagcgcaggtgctcttcggcatcatccgcgatctcaaggcgcgcggcatctcgatcatctatattagccaccgcatggcagaggtgttcagcctctgcgaccgggtgaccgtcttccgcgacgggcgctatgtcgcgacggaaatggtctcggacgtcactcctgacgatgtggtccggctgatggtcggccgcgagatcagccagctttatcccgacaagcagccttcctccgaacgcctaggcgagccgattctttcggtccgcgatctcggcggcgaacgcttccgcgacgtcagcttcgagctccgctacggcgagattctcggcgtcggtggcctgatcggctccggacggacggaaattgccgagggtatctgcgcgctgcgaccggtgacgcaaggcgaaatccggctgcatgacaaggtgcttcgtctacggcgctattccgacgcggccaaggccggcgtcgtctatctttcggaggaccggaaaggatccggcgttttcctcgatctctcgatcgcccagaacattgccgcactcgatctgaaggcattgacctctcttggcctgctcaactcccgcgaggaaagagcgctcgccgaagacctgacccgcaggcttggcgtgcggatgggcggcgtcgatatgccggtctcttcgctgtcgggcggcaatcagcagaaggtggcgatcgccaagcaattggcggtcgatccaaaggtgatcctgatggacgagccgacgcggggcatcgatgtcggcgccaaatcggaaatccaccgcctgctgcgcgagcttgcccgtgccggcatcggcattctggtgatctcgtccgaactgccggagctgatcggcctctgcgaccgcgtcctggtggtgcgcgagggccggatcgcaggcgaggtatcgggcaacgaaatgaccgaggaggtgatcatgcggcttgcatccggcatcggcccggcaaccgaaacgaacttgaaggcatccgggcatgctgcctga

SEQ ID NO: 38555 - protein, 512 aa, Sinorhizobium meliloti 1021
MTSETVLEIRNVSKHFGAVKALTAVDFRLARGEVHALCGENGAGKSTLMNVIAGVLQPSEGEVLIEGAPVKIASPAVAQSLGIALVHQEIALCPDATIAENMFMAATNRRRSALMNYAQLERDAQAVMNRLAPIDVSQKVGDLPISSQQLVEIAKALTLDCRVLIFDEPTAALTETEAQVLFGIIRDLKARGISIIYISHRMAEVFSLCDRVTVFRDGRYVATEMVSDVTPDDVVRLMVGREISQLYPDKQPSSERLGEPILSVRDLGGERFRDVSFELRYGEILGVGGLIGSGRTEIAEGICALRPVTQGEIRLHDKVLRLRRYSDAAKAGVVYLSEDRKGSGVFLDLSIAQNIAALDLKALTSLGLLNSREERALAEDLTRRLGVRMGGVDMPVSSLSGGNQQKVAIAKQLAVDPKVILMDEPTRGIDVGAKSEIHRLLRELARAGIGILVISSELPELIGLCDRVLVVREGRIAGEVSGNEMTEEVIMRLASGIGPATETNLKASGHAA

SEQ ID NO: 38556 - DNA, 1527 bp, Sinorhizobium meliloti 1021
  CDS (1)..(1527): transl_table=11
atgcaggactttctggaattccaatcgatttcaaagggctatcccggcgtccaggcgctgtcggaagtctccttctctgtccgaaagggcgccgttcacgggctgatgggcgaaaacggagcgggaaagtccaccttgatacgggtgctctccggagaccaggcggccgacaccggcgagatccgcataaacggcgagccgcagcactatcgttccgtacgcgatgccttcaacgcaggcgtcatcgtcatccatcaggaactgcagctcgtaccggagctgacggtggccgaaaacctctggctcggccgtttccccggcaaggccggcgtcatcgaccgtcgacaattgatccgcgtcgtctccgacagactcgccgaaatcggtatcgacgtcgatcctgaggcaaaggttgcgtccctgtcgatcggcgagcggcagatggtcgagatcgccaaagcggtgatgaccgacgctcgcgtgattgccttggacgagccgacctcttcgctctcatcgcgagaaagcgaaatcctcttcgccctgatcgacagattgcggtcgaatggtacggtcatcctctatgtctcgcatcggctggacgagatcttccgtctgtgcaacagcctgactgtgctgagagacggccggcttgcagcccatcatccggacatctcgaaagtcggccgcgaacagattatcgctgaaatggtcgggcgcgaaatttcgaatatctggggttggcgcgcccggacgctcggagccgcgaggcttacggtcgaacgcgtttccggcgccaacctgccccagccgatcagctttaccgtccgcgccggcgagattctcggcttctttggcctcatcggcgcgggccgcagcgaaatggcccgtttggtctatggtgccgatcgccgccggcagggcaaggttctggtggacggccttgccgtgccggcggacagcccgcggctgtcgatccgtgccggcgtcgttctgtgcccggaagacaggaagttcgatggcatcgtccaagggcgctccatcgaggagaacatggcgatctcctcccgccgtcatttctcgccattcggggttgtcgacaagggtaaggaggcggagcttgccgagcgtttcatcgcgaagctgcgggtgcgcacgccctcgcgtcaccaggacatcgtcaatctttccggcggaaaccagcagaaggtgatccttggacgctggctgtcggaagagggcgtcaaggtgcttctgatcgacgagccgacccgcggcatcgacgtcggcgcgaaatcggaaatctacgaaattctttacgagcttgcggctcaaggcatggcgatcgtcgttatctctagcgaattgccggaggttatggggattgcggaccgcattctcgtgatgtgcgagggccggatcgcggccgaaatcgaccggagcgattttgacgaacaccggattctcgcagcagcacttccggatgcctcagccacgacggccacccttcccgaacaggtaagctga

SEQ ID NO: 38557 - protein, 508 aa, Sinorhizobium meliloti 1021
MQDFLEFQSISKGYPGVQALSEVSFSVRKGAVHGLMGENGAGKSTLIRVLSGDQAADTGEIRINGEPQHYRSVRDAFNAGVIVIHQELQLVPELTVAENLWLGRFPGKAGVIDRRQLIRVVSDRLAEIGIDVDPEAKVASLSIGERQMVEIAKAVMTDARVIALDEPTSSLSSRESEILFALIDRLRSNGTVILYVSHRLDEIFRLCNSLTVLRDGRLAAHHPDISKVGREQIIAEMVGREISNIWGWRARTLGAARLTVERVSGANLPQPISFTVRAGEILGFFGLIGAGRSEMARLVYGADRRRQGKVLVDGLAVPADSPRLSIRAGVVLCPEDRKFDGIVQGRSIEENMAISSRRHFSPFGVVDKGKEAELAERFIAKLRVRTPSRHQDIVNLSGGNQQKVILGRWLSEEGVKVLLIDEPTRGIDVGAKSEIYEILYELAAQGMAIVVISSELPEVMGIADRILVMCEGRIAAEIDRSDFDEHRILAAALPDASATTATLPEQVS

SEQ ID NO: 38558 - DNA, 1494 bp, Sinorhizobium meliloti 1021
  CDS (1)..(1494): transl_table=11
atgcttctgtccatgcagggcatctgcaaatcgttcaacggcattccggcgcttcgtgcggcttctctcgaagtcggggaagccgaggtgatggcactcgtcggtcagaacggcgcgggcaagtcgaccctcatcaagatattgaccggcgcgtaccggcgcgacgagggtgcggtcgtctttgcgggagagggcgtatccttcagcatgccggcggagagccaggcccgcggcatcgcgacgatctaccaggagatcaacctcgccccccagcgctccgtcgccgagaacatctatctgtcgcgcgaaccccgccgcttcggcttgatcgaccggcgcgcgatgcgcgatggcgccgccgccgtcctgcgggccttcaatctggaaatcgacgtcgatcaacctgtcgccggcttcagcgccgctacccggcagatggtcgctatcgcgcgcgccgtgacgcagaaggcacgcctcgtcatcatggacgaaccgacctcttccctcgacgagcgggaagtcggcattcttttcgacaccataaggacgctcaagcgcggcggcgtttccgtcgtcttcatcggccatcgtctcgaggagctctaccggatttgcgacagggtcaccatcatgcgtgacggcaagaccgtggcgaccgccgcaatggcggacatgccgaagctcgcattggtgcgccatatgctgggcaaagaactcgcggccttcgaagcgatcgccaaggacgcggacgagggcgcgcagcgaccggtccggctatcggtccggaatgcgggcgctggcgttcgcgtccgggatgtgagccttacggtgcgcgaaggcgagatctccgggcttgccggcctgctcggctccgggcgaaccgaaacggccaacctgatttttggcgcggaccggctgcagcgcggcgaaattcgctacaatggcgaagcccgcgcctatcgccagcccgcggacgccattgccgacggtatcgggctcgtcgccgaggaccggaaggtcgacggtatcattcccgatatgagcatccgcgaaaacatgacgctcgcgcttctgccgaagctcgcccgcgccggcatcgtcgatcgcgcccgccaggatgaaatcgtcgagcgctacatcacggcgctcgccatcaaatgcacctcgcccgaccagcctatcaaggaactttccggcggcaatcagcagaaagtcctgctcgggcgttggctctgtaccgatcccaagcttctgattgtcgacgagccgacccgcggtatcgatatcggcgccaaatccgaaatcctgcgcctcctgcgccggctcgcagacgaaggcctcggcgtgctgatgatttcgtccgaactggaggaattgctggcggcggccgaccgggtgaccgtgctcagcgacggaacctcggttgccgtgctgccgcgcaaggaattgagcgaggccgccctctttgccgccatggcacatcaggtggaatag

SEQ ID NO: 38559 - protein, 497 aa, Sinorhizobium meliloti 1021
MLLSMQGICKSFNGIPALRAASLEVGEAEVMALVGQNGAGKSTLIKILTGAYRRDEGAVVFAGEGVSFSMPAESQARGIATIYQEINLAPQRSVAENIYLSREPRRFGLIDRRAMRDGAAAVLRAFNLEIDVDQPVAGFSAATRQMVAIARAVTQKARLVIMDEPTSSLDEREVGILFDTIRTLKRGGVSVVFIGHRLEELYRICDRVTIMRDGKTVATAAMADMPKLALVRHMLGKELAAFEAIAKDADEGAQRPVRLSVRNAGAGVRVRDVSLTVREGEISGLAGLLGSGRTETANLIFGADRLQRGEIRYNGEARAYRQPADAIADGIGLVAEDRKVDGIIPDMSIRENMTLALLPKLARAGIVDRARQDEIVERYITALAIKCTSPDQPIKELSGGNQQKVLLGRWLCTDPKLLIVDEPTRGIDIGAKSEILRLLRRLADEGLGVLMISSELEELLAAADRVTVLSDGTSVAVLPRKELSEAALFAAMAHQVE

SEQ ID NO: 38560 - DNA, 1512 bp, Sinorhizobium meliloti 1021
  CDS (1)..(1512): transl_table=11
atgcatggttccgctgcggataccattctcaagatcaccgatgtcaccaaatccttcgggcaggtcgccgccctcaaggggatgcggctcgaagtccggcgcggccgggttcatacgctgctcggcgaaaacggcgccggcaaatcgacattgatgaagattctcgccggcgtgcacggggcaacgtcaggagagatcgttctcgacgggcaggcctaccggcccgccaacccgcaggaggccgcctcgctcgggctggcgatcgtcttccaggaattgagcctctgcaacaatctgacggtcgctgagaatatcctcgccacgcgcgagccgcgccgtttcggcttcatcaacgacaaggcgctcgtcgcgaaggcgcaccggatcgtagccgacctcagacttcccatcgacgtgacggagaaggtcggcaatctctcgattgcccagcgacagctcgtcgagatcgccaaaggcctgagccatgatgccaaggtcgtcattctggacgagccgacttcctcactcagcgacagcgaggccgagatcctcttcgagatcatcggccggctgaggcagcgcggcgccgcgatcatctatatttcgcaccgcatggaagagatcatgcggctcagcgacgacatcaccgtcatcagagacggcgaatatgtctcgacgcatgcgcgcgacgaggtcaccatcgagacgctcatcgcgttgatggtcgggcgccgcatggacgaaatctacccaccgccggtgcaccatgtggcggcggacagggccccggtccttgcagtcgaccggctgacgcgcgaaggcgagtttcaggacgtgtccttcgacgtgcgcgccggtgagatcctcggcttcttcgggcttgtcggttcgggccgctcggaggtgatgaacgcgcttttcggcatgaagagcgccgcaggcacggtgcgcctcgatggcgaggtcgtgcggttccgttccccggaccaggccatcgcccgcggcgtcggtttcgtgacggagaaccggaaggaagagggcctcgtcctcggccatagcgtcgagtggaacatatccatggcggctctcgcagacttcgccggagggttgggcttcatccgcaacggcgcggaacgggccgcggcatccgaacaggtcgggaagctctcgatcaagacgaactcgctggaaacgccggcgggggcgctcagcggcggcaaccagcagaagatcgtgctcgccaagtggctgctcacgcgacccaaggtgctgatcctcgacgagccgacccgcggcgtcgacgtcggcgcgaaattcgaaatctacaagatcatccgcgagctggcggccgagggaacggcaattctgctgatctcctccgacctgcccgaagtcctgggaatgagcgaccgcgtggtcgtcatgcatgagggcgcgcccggcgccacgctcgaaggctctgccctcactccagagacgatcatggctcacgcgacaggttttcaatcatga

SEQ ID NO: 38561 - protein, 503 aa, Sinorhizobium meliloti 1021
MHGSAADTILKITDVTKSFGQVAALKGMRLEVRRGRVHTLLGENGAGKSTLMKILAGVHGATSGEIVLDGQAYRPANPQEAASLGLAIVFQELSLCNNLTVAENILATREPRRFGFINDKALVAKAHRIVADLRLPIDVTEKVGNLSIAQRQLVEIAKGLSHDAKVVILDEPTSSLSDSEAEILFEIIGRLRQRGAAIIYISHRMEEIMRLSDDITVIRDGEYVSTHARDEVTIETLIALMVGRRMDEIYPPPVHHVAADRAPVLAVDRLTREGEFQDVSFDVRAGEILGFFGLVGSGRSEVMNALFGMKSAAGTVRLDGEVVRFRSPDQAIARGVGFVTENRKEEGLVLGHSVEWNISMAALADFAGGLGFIRNGAERAAASEQVGKLSIKTNSLETPAGALSGGNQQKIVLAKWLLTRPKVLILDEPTRGVDVGAKFEIYKIIRELAAEGTAILLISSDLPEVLGMSDRVVVMHEGAPGATLEGSALTPETIMAHATGFQS

SEQ ID NO: 38562 - DNA, 1518 bp, Sinorhizobium meliloti 1021
  CDS (1)..(1518): transl_table=11
atgcagaccagcagtgacaatatcctttcggccacaaggatcgaaaagggctttcccggcacgaaggcgctcgacagggtagattttcacctgcggcgcggcgaggttcacgcgctcctcggggagaatggcgccggcaaatcgacgcttatcaaatgcctgacgggcgcctatcgccgggatggcggcagcatgctgctcgacggagccgaggccgacccgcgcgacacgttcgatgcccagaggctgggcatcgggaccgtttaccaggaagtcaacctgctgccgaaccttaccgttgccgagaacctctttctcggacggcagccccgccgcttcggcatggtggacacgcgcaccatgaatcgcaaggcgcgggaattgctcgcggaatacgaactcgatatcgacgtcacccgtgatctcgcgagctactccgtggcgattcagcaggtcgtggccatcgcccgggccgtggatctttccggcaaggtcctgattctggacgagccgaccgcaagcctcgacgcgcacgaggtggagatgctcttccgcatcgtacgccgcctcaaggaacgcgggctcggcatcatcttcatcacccacttcctggaacaggtctacgccatctccgatcgcatcaccgttctgcggaacgggcagttggtcggcacgcgcaacgcggccgatctcgaccggcgcgagctgatcgcaatgatgatcggtcgggaactggcgacggagatccattccgcccattccgacgcggtcgcgggtgagccacgctaccgtttccgaaactttggccgccgcggaaagatcgaccccttcgatctcgatgtccgcgccggcgaggtcgtcggcatggcaggcctgctcggctcggggcggacggaaaccgccgaaatcctcttcggcgcccatcgcgccgatagcggtacggccgagatcgacggccggagcgtcgatctttcctcgccgcgtgccgcaatccggcagaagttcggcttctgccccgaggaccgcaagactgccggcatcgtcggcgacctgtccgtgcgcgagaacatcgtgctcgcccttcaggcaaggcgcggctggacccgcccgatcccgcgcgcggagcagaaccggctcgcggaccactacatccgggcactcgatatccgcacggcggaccgcgagaaaccgatcaggctgctttccggcggcaatcagcaaaaggccattctggcgcgctggctcgcgactgaaccggaactgctcatcctcgacgagccgacgcgcggcatcgacgtcggggcgcatgccgaaatcatcaggctcatcgagagcctgcgcgagaagggcatgtcgctcatcgtcatctcctcggaaatagaagaactcgtcgcctacagcacgcgggtggtcgtccttcgcgaccacgcccacgtcgccgaactcgatggcgctcaattgactgcacatcggatcgtcgaagcgatcgctgcgaccaacgggagggaagcgccttga

SEQ ID NO: 38563 - protein, 505 aa, Sinorhizobium meliloti 1021
MQTSSDNILSATRIEKGFPGTKALDRVDFHLRRGEVHALLGENGAGKSTLIKCLTGAYRRDGGSMLLDGAEADPRDTFDAQRLGIGTVYQEVNLLPNLTVAENLFLGRQPRRFGMVDTRTMNRKARELLAEYELDIDVTRDLASYSVAIQQVVAIARAVDLSGKVLILDEPTASLDAHEVEMLFRIVRRLKERGLGIIFITHFLEQVYAISDRITVLRNGQLVGTRNAADLDRRELIAMMIGRELATEIHSAHSDAVAGEPRYRFRNFGRRGKIDPFDLDVRAGEVVGMAGLLGSGRTETAEILFGAHRADSGTAEIDGRSVDLSSPRAAIRQKFGFCPEDRKTAGIVGDLSVRENIVLALQARRGWTRPIPRAEQNRLADHYIRALDIRTADREKPIRLLSGGNQQKAILARWLATEPELLILDEPTRGIDVGAHAEIIRLIESLREKGMSLIVISSEIEELVAYSTRVVVLRDHAHVAELDGAQLTAHRIVEAIAATNGREAP

SEQ ID NO: 38564 - DNA, 1515 bp, Sinorhizobium meliloti 1021
  CDS (1)..(1515): transl_table=11
atggtgaccgaacttgccaatctgaaatcaatttccaagtccttcgggggcattcacgcgcttcggtccgtgaatttcgacgtgcggccgggggaggttcatgcccttctcggcgagaacggtgctggaaaatccacccttatgcgcgttctgggcggcgagattatccccagccagggagaggtcgtcattaatggaaagcggaccgagcttcgcgatcctcgagacgcacgcgcacttggcatcgtcgtgatccaccaggagcttgcccttgcccctgatctcagcgtggcagaaaacatttttctcggagagctaccgacccttatttcccgattcagcctgcgaagacgcgcaaaacagctgatcgaccgtctgggtttcgatatcgatcccgggcgccttgtcggcaccctgtccgtcgcccaccagcaggtggtcgagatcgccaaggctctttcgcaggacatcaagatcatcgtcttcgacgaaccgaccgcagtgctcggtgctcaggatgcgatgaaactgcaccagatcatccggggcctgcgcgatcgtggagtcggcatcgtctatatttcgcatcgcctcgatgaagtgttcgatatcgcggatcgaatgacagtaatgaaggatggggagacggtcggaacagtcgcgacgacggacgtcaagatcgacgatatcattcgcatgatggtcggccggccaatcgccaacatgttcccggagcgctcgcagcgcaccatcggcgccgaactgctcaacgtgaaaaaactcaatgcgggccggatggttcgcgatgtcagcttttctgtccgcgccggcgagatcgtcgggcttggaggcctgatcggatcaggccgcacggaagtcgcacgcgcgattttcggcgctgatccgctggacagcggcacgatcagcctcaaagggaaggccctcaaactcaaatcgcccagagacgcggtgaaggccggtatcgggctcgtcccggaagaccgcaaggagcacggcgtcgtcatcgacaagccgatccgcgtcaatgcaacgatggccaggatgtcgtcggtcgtgaatgccttgggcttcctcaagccagccttggagcgcaccgacgtcaccgcacttggcaagagcttgcggctcaaggcttccagtatcgatgcaccggtttccagtctgtcgggcggcaatcagcagaaggtcgtgctggcgaaatggtttcacgccggtggcgacgttatcattctggacgaacccacacgcggcgtcgatgtcggcgcgaaggccgaaatctatgctctgatcaacaagctcgccgaagacggcaaggcagttctggtgatttcctcagaacatcaggaactctttggtctttgcgatcgcgttctggcaatgggccaggggcagatccgaggcgaactgacacccagcaactactcggaagaaaatctgcttggcctgtcgatgatgggcggagccagagcgagcaaccaaggcagccaggtatga

SEQ ID NO: 38565 - protein, 504 aa, Sinorhizobium meliloti 1021
MVTELANLKSISKSFGGIHALRSVNFDVRPGEVHALLGENGAGKSTLMRVLGGEIIPSQGEVVINGKRTELRDPRDARALGIVVIHQELALAPDLSVAENIFLGELPTLISRFSLRRRAKQLIDRLGFDIDPGRLVGTLSVAHQQVVEIAKALSQDIKIIVFDEPTAVLGAQDAMKLHQIIRGLRDRGVGIVYISHRLDEVFDIADRMTVMKDGETVGTVATTDVKIDDIIRMMVGRPIANMFPERSQRTIGAELLNVKKLNAGRMVRDVSFSVRAGEIVGLGGLIGSGRTEVARAIFGADPLDSGTISLKGKALKLKSPRDAVKAGIGLVPEDRKEHGVVIDKPIRVNATMARMSSVVNALGFLKPALERTDVTALGKSLRLKASSIDAPVSSLSGGNQQKVVLAKWFHAGGDVIILDEPTRGVDVGAKAEIYALINKLAEDGKAVLVISSEHQELFGLCDRVLAMGQGQIRGELTPSNYSEENLLGLSMMGGARASNQGSQV

SEQ ID NO: 38566 - DNA, 1521 bp, Sinorhizobium meliloti 1021
  CDS (1)..(1521): transl_table=11
ttgaaatgcggggcattacgaagacgtttccgggcgtcaaggccctggacaatgtctcgttcaaggtccgcgaaggcgagatccacgcgcttgtcggggaaaacggcgccggccaagtcgaccttgatgaaggtgctgagcggagtctatccggccggcacctatgagggcgagatccattacgacggcgagcttcgccagttcagcacgatctcggacagcgaagagctcggcatcatcatcatccatcaggaactggcgctcgttccgctgctttcgatcgccgagaacatctttctcggcaacgaggtggccgaaaagggcgtgatccactggccgcagacctttgcccgcacccaggagctcctgaagaaagtgggcctgaacgagtcccccgcgacgctgatcaccgacatcggcgtcggcaagcagcagctggtggagattgccaaggcgctttcgaagaaagtccgcctgctgatcctcgacgagccgaccgcatccctcaacgaaaacgactccgacgcgcttttgaagctgctcatggagttccgcagccagggcatgacgtcaatcatcatctctcacaagctcaacgagattaagaaggttgccgaccagatcaccatcctgcgcgatggcggaacggtagagacgctcgactgtcacaaggaagacatcagcgaggaccggatcatcaacggcatggtcggccgggccatggaagaccgctatccgccgcgtgaaccgaagatcggtgacacgctgctcgaggtgaagaactggaacgtctaccatcagcatcaccgcgaccggcagttcctgcatgacgtcagcttcaaggttcgcgccggcgaggtcgtcggcatcgccgggctgatgggcgccggccgcaccgagacggcgatgagcgttttcggcaagtcctggggccacaagatcaccggcgaggtgacgatgcatggccggccggtggacgtgagcacgattcccaaggccatcaaggcaggtcttgcctatgtaacggaggaccgcaagcagctcggcctcgtgctgatcaacaacatcatgcacaacaccacgctcgccaatctgcatgcggtcgcatcgaacggcgtcatcgacgagcgcaaggaacggaaggtcgccgccgaatatcgctcgaagctccgcatccgttcccattcgatctatcaggagacggtcaacctctctggcgggaaccagcagaaggtcgtcctgtccaagtggctgttcaccaatcccgaagtcctcatactcgatgagccgacgcgcggtatcgacatcggcgcgaagtatgagatctacaccatcatcaaccagctcgcggccgagggcaaaggcatcctgatgatctcgtcggagatgccggagctgctcgggacctgcgatcgcatctatgtcatgaacgaggggcgcatggtggccgagctttccaaggaggaagcaagccaggaatcgatcatgcgcgccatcatgcgttcaggggagaaacactaa

SEQ ID NO: 38567 - protein, 506 aa, Sinorhizobium meliloti 1021
MKCGALRRRFRASRPWTMSRSRSAKARSTRLSGKTAPAKSTLMKVLSGVYPAGTYEGEIHYDGELRQFSTISDSEELGIIIIHQELALVPLLSIAENIFLGNEVAEKGVIHWPQTFARTQELLKKVGLNESPATLITDIGVGKQQLVEIAKALSKKVRLLILDEPTASLNENDSDALLKLLMEFRSQGMTSIIISHKLNEIKKVADQITILRDGGTVETLDCHKEDISEDRIINGMVGRAMEDRYPPREPKIGDTLLEVKNWNVYHQHHRDRQFLHDVSFKVRAGEVVGIAGLMGAGRTETAMSVFGKSWGHKITGEVTMHGRPVDVSTIPKAIKAGLAYVTEDRKQLGLVLINNIMHNTTLANLHAVASNGVIDERKERKVAAEYRSKLRIRSHSIYQETVNLSGGNQQKVVLSKWLFTNPEVLILDEPTRGIDIGAKYEIYTIINQLAAEGKGILMISSEMPELLGTCDRIYVMNEGRMVAELSKEEASQESIMRAIMRSGEKH

SEQ ID NO: 38568 - DNA, 1497 bp, Sinorhizobium meliloti 1021
  CDS (1)..(1497): transl_table=11
atgacggcggatttcctcgccgtacgcggcatcaggaaatcgttcggccagatcgaggttctccatggcgtggacctcgatctgccggcaggaacgattaccgcccttctgggggagaacggggccggcaagtccacattcgtgcggatcctggccggagaccacatgcccgacggcggcacgatctctgtggacggcgccgttgcctcctttcgcggtgtgggagatgcgcgcgcggcgggaatccgtttgatcgcccaggagatcgccgatgcgccgacgctctcggtggcggagaacattctgctcggtgcatggccgacgcgtgccgggctcgtcgattaccggtccatgcgcgaactggcacgacaggcgctggaaatgcttggcaccgaacttccactggaggcgaaggtcgcctctctgcggttgggcgaacggcagatcatcgagatcgcccgctccacgataggcgcctcgaaatgcatcattttcgacgaggcgaccgcggccctctcggacgcggaggcacgcaaactcttccagttgattcggcgtcttgcgggacgcggcgtcgccattctctacatcacccaccggctcgacgaagtgttcgcgcttgccgaccgggtgtgtgtcctgcgcgacggccgcgtttcccttgatagcgcggcgggcgacgtcactcaggaccaggtcatagaggcgatggtgggccgcgcggtcgcttatgcgcgacatgccgtaccgccatcgaccgacgctcctccggtgctgaaagcaaccggcctggggtctgcttccttctcagacgtttcctttgcgttacgcccgggcgagatcctgggcgtctacggtaaggtcggctcgggcgttcaggaattgtcgagttcgctggtcggtgcgcgcgcattcgacgaaggaacactgtatgtggaaggctcgccgaggcacttccggcacccggcggacgcgattgcggctggcataggccatctatcggcggatcgcgcggccgacggcctgcttcgcacgatgacgcttgcggaaaatctttcagctcccagctggggccgcctggccaggcgcggcttcgtgaaccgccgcaagctgcgccaggcctattgccgctggcatcgcacgttgcacatcaaggccgccgcttccggcgaacaactgatcacggaactgtccggcggcaaccagcagaaggttctgctaggccggtggcttgaagccggttcgaaaatcctcgtgctgagcgaaccgacacgcggcgtcgacgtcggcgcccgccaggaaatttaccgcgtgctcgccggactggctgccaagggccacgccatcgtcgtcgccacctcggattacgaggacatcacggccgttgccagccgcgcgctggtcatggtgcgcggacggatggtcgctgagatcccgtacgagcgcatttcgactgaagccctgactgaagccgcaggaggcggtgtccatgcctga

SEQ ID NO: 38569 - protein, 498 aa, Sinorhizobium meliloti 1021
MTADFLAVRGIRKSFGQIEVLHGVDLDLPAGTITALLGENGAGKSTFVRILAGDHMPDGGTISVDGAVASFRGVGDARAAGIRLIAQEIADAPTLSVAENILLGAWPTRAGLVDYRSMRELARQALEMLGTELPLEAKVASLRLGERQIIEIARSTIGASKCIIFDEATAALSDAEARKLFQLIRRLAGRGVAILYITHRLDEVFALADRVCVLRDGRVSLDSAAGDVTQDQVIEAMVGRAVAYARHAVPPSTDAPPVLKATGLGSASFSDVSFALRPGEILGVYGKVGSGVQELSSSLVGARAFDEGTLYVEGSPRHFRHPADAIAAGIGHLSADRAADGLLRTMTLAENLSAPSWGRLARRGFVNRRKLRQAYCRWHRTLHIKAAASGEQLITELSGGNQQKVLLGRWLEAGSKILVLSEPTRGVDVGARQEIYRVLAGLAAKGHAIVVATSDYEDITAVASRALVMVRGRMVAEIPYERISTEALTEAAGGGVHA

SEQ ID NO: 38570 - DNA, 1521 bp, Sinorhizobium meliloti 1021
  CDS (1)..(1521): transl_table=11
atggcagccgtgcgcgccagcggcgccgttccgaaatccgaataccttctgactgccgagggcgttcgcaaggagtttccgggtgtcgttgcgctcgacgacgtggagttcaagctgaagcgcggcaccgtgcatgcgctcatgggcgagaacggagccggcaagtcgaccttgatgaagatcctcgccgggatctattatcccgaccagggcgaggtgaaactcaggggcgccggcatccggctgaagtcgccactcgacgcactcgagaacggcatcgccatgatccatcaggaactgaacctgatgcctttcatgaccgtcgccgagaacatctggatccgccgggaacccaagaaccgtttcggtttcgtcgatcatggcgaaatgcgccgcatgacggcaaagctcttcgagcggctcaagatcgatctcgatccggagatcgaggtccgtcacctctcggtcgccaaccgccagatggtcgagatcgccaaggcggtctcctacgagtccgacgtgctgatcatggacgagcccacctcggcgctcaccgagcgcgaggtcgcgcatttattcgagatcatccgtgacctgcgctcgcagggtatcggcatcgtctacatcacccacaagatgaacgagctgttcgagatcgccgacgagttctcggtgttccgcgacggcaaatatatcggcacccacctctcgaacgaggtcacccgcgacgacatcatccgcatgatggtcggacgtgaaatcacccagatgttcccgaaggaggaggtgccgatcggcgacgtggtgctgtcggtgaagaacctgacgctcaacggcgtcttccgcgacgtctccttcgatgtacgcgccggcgagatcctcggcgttgctggcctcgtcggatccggccgctccaacgtcgccgagacgctcttcggggtcacgccggcgagctcgggcacgatcgcgatcgacgggaaagaggtcgtgatcgacagcgccaacaaggcgatccgtcaccggatggcgtttctcaccgaggatcgcaaggacaccggctgcctgctcatcctcgacattctcgaaaacatgcagatcgccgtgctgcaggacaaattcgtcaagcgcggcttcgtcagcgagagggaagtcactgccgcctgcgaggagatgagccgcaagcttcgggtcaagacgccgaacctgcaggagcgcgtcgagaatctctcgggcggcaaccagcagaaggtactgatcggccgctggctgctcaccaatccgcgcatcctgatcctcgacgagccgacgcgcggcatcgatgttggcgccaaggccgaaatccaccgcctggtgaccgaacttgcccgcaacggtgtcgcggtcatcatgatctcgtcggaaatgccggaagtgctcgggatgagcgaccggatcatggtgatgcacgagggccgggtcaccggcattctcgacagggcggaagccacccaaatcaaggtcatggagcttgcggcgcgatag

SEQ ID NO: 38571 - protein, 506 aa, Sinorhizobium meliloti 1021
MAAVRASGAVPKSEYLLTAEGVRKEFPGVVALDDVEFKLKRGTVHALMGENGAGKSTLMKILAGIYYPDQGEVKLRGAGIRLKSPLDALENGIAMIHQELNLMPFMTVAENIWIRREPKNRFGFVDHGEMRRMTAKLFERLKIDLDPEIEVRHLSVANRQMVEIAKAVSYESDVLIMDEPTSALTEREVAHLFEIIRDLRSQGIGIVYITHKMNELFEIADEFSVFRDGKYIGTHLSNEVTRDDIIRMMVGREITQMFPKEEVPIGDVVLSVKNLTLNGVFRDVSFDVRAGEILGVAGLVGSGRSNVAETLFGVTPASSGTIAIDGKEVVIDSANKAIRHRMAFLTEDRKDTGCLLILDILENMQIAVLQDKFVKRGFVSEREVTAACEEMSRKLRVKTPNLQERVENLSGGNQQKVLIGRWLLTNPRILILDEPTRGIDVGAKAEIHRLVTELARNGVAVIMISSEMPEVLGMSDRIMVMHEGRVTGILDRAEATQIKVMELAAR

SEQ ID NO: 38572 - DNA, 1527 bp, Sinorhizobium meliloti 1021
  CDS (1)..(1527): transl_table=11
atgaatccggagacggtcgacgccgcgcgcgtcgtgctggaggcacggcggatcagcaagtcgttcagcggcgtgcaggtgctcttcagtgtcaatttcgagcttcgcgccggcgaaatccacgccctgatgggcgagaacggcgccggaaagtcgacgctcgtcaagattctctcaggtttcgagcagccgtcctcgggcgaggtcctgctcgacggccagccggtaacgcttcctgctaacggtgcggccgaagcgctgggcatcgtcatcatccaccaggaattcaatcttgccgaacacctgactgttgccgaaagcctgtttctcggtcgcgaggtgacgcgtttcggcgtgctcgaccgcaagtatatgcgcgcggagacgcgccgggttctcgatctgcttggctgtcatgtggacgcgaacgcgctgatcggcagtctttccattgccgaaaagcagatggtcgagatcgccaaggccatcagccgcgacgcgcggatcgtcttcatggatgagcccacggccgttctatcccgcgaggagaccaacttccttttccggcaggtccgcaagctgcgcgaccggggcacgagcttcgtcttcgtgtcgcacaagctcgacgaagtcatcgaactgaccgaccgcgtgacggtactgcgcgacgggcagtgggtgaagactgccgcgacttcgatgctcgacggcgagtcgatcgcgcagctcatggtcggccgcgaaatgtcgagcctctttcccgccaagaaagagccgaacgtcgacgaagaggtcgtgctgcgtgtcgacgccgtctcgaccgactatgtccaggacgcccgcttcgaggtgcgcaaaggcgaaatccttggcttttcgggtatgatcggctccggccgcaccgaactcatggaggcggtcgccggcctcaggccccgcctgtcgggcgaggtgacgatccgtggagagaccgtgccctccggcgacgtgcacgcggccaaccggcgcggtcttgcctacatgaccaaggaccgcaaggcgaagggcctgctgctcaattccggcatgaccgcgaacctgaccttgcagtcgctcggccggcatgcccgcatcggctatctcagcccggcgagcgaggcggctgcgctcaaaagagcccgccgccgcttcgacatccgcgtgcgcgacggcaacgtcgtcgccaggcgcatgtccggcggcaaccagcagaagctgctgctcgccaaggtgatggaaacggaaccggacatcatcatcatcgacgagccgacacgcggcatcgacgtcggcaccaagcagcagatctatcatttcatctcggcgctcgcgcgcgacggccgctcgatcatcgtcgtctcttccgaaatgcctgaggtcatcgggctttgcaccagggtcgcggtgatgcgcgagggacgcatcgtcggcatgctcgaaggagacgagatctccgagcaggagatcatgcgctacgcagccgggctgaagaaaatggctgcggcctga

SEQ ID NO: 38573 - protein, 508 aa, Sinorhizobium meliloti 1021
MNPETVDAARVVLEARRISKSFSGVQVLFSVNFELRAGEIHALMGENGAGKSTLVKILSGFEQPSSGEVLLDGQPVTLPANGAAEALGIVIIHQEFNLAEHLTVAESLFLGREVTRFGVLDRKYMRAETRRVLDLLGCHVDANALIGSLSIAEKQMVEIAKAISRDARIVFMDEPTAVLSREETNFLFRQVRKLRDRGTSFVFVSHKLDEVIELTDRVTVLRDGQWVKTAATSMLDGESIAQLMVGREMSSLFPAKKEPNVDEEVVLRVDAVSTDYVQDARFEVRKGEILGFSGMIGSGRTELMEAVAGLRPRLSGEVTIRGETVPSGDVHAANRRGLAYMTKDRKAKGLLLNSGMTANLTLQSLGRHARIGYLSPASEAAALKRARRRFDIRVRDGNVVARRMSGGNQQKLLLAKVMETEPDIIIIDEPTRGIDVGTKQQIYHFISALARDGRSIIVVSSEMPEVIGLCTRVAVMREGRIVGMLEGDEISEQEIMRYAAGLKKMAAA

SEQ ID NO: 38574 - DNA, 1506 bp, Salmonella typhimurium LT2
  CDS (1)..(1506): transl_table=11
atggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcgggatcgttgttatggctgggtaaagagaccacctttaatgggcctaaatcgtctcaggaagccgggatcggcattattcatcaggaactgaacctgatcccgcagttgaccattgcggaaaacatcttcctgggccgtgagtttgtgaatcgctttggcaaaatcgactggaaaaagatgtatgccgaagccgaccacctcttagccaaactcaatctgcgttttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgactctctgttccgcgttatccgcgaattaaaatcgcaggggcgcggcattgtctatatctcccaccgtatgaaagagatcttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctcaaggtcgataatctgtgcggaccgggcgtgaatgatgtctcttttgtgctgcgaaaaggcgagattcttggcatctccggcctgatgggcgccggtcgcaccgagctgatgaaagtattgtacggcgcgatgccgcgaaccagcggttatgtgacgctcgatggacacgaagtggtgacgcgctctccgcaggacgggctggccaatggcatcgtttatatctctgaagaccgtaagcgcgatggactggtgctcggcatgtcagttaaagagaatatgtcgctgacggcgctggactatttcagccgcgctggcggaagcctgaaacacaaagatgagcagcaggcggtgggggattttatccgtctgttcaacgtcaagacgccttcaatggaacaggcgataggcctgctttccggtggtaatcagcaaaaagtggcgattgcccgcgggttgatgacgcgcccgaaagtgctcattctcgacgagccgacccgcggcgtggacgtcggcgccaagaaagagatttaccagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 38575 - protein, 501 aa, Salmonella typhimurium LT2
MDALLQLKGIDKAFPGVKALSGAALNVYPGRVMALVGENGAGKSTMMKVLTGIYTRDAGSLLWLGKETTFNGPKSSQEAGIGIIHQELNLIPQLTIAENIFLGREFVNRFGKIDWKKMYAEADHLLAKLNLRFKSDKLVGELSIGDQQMVEIAKVLSFESKVIIMDEPTDALTDTETDSLFRVIRELKSQGRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGAGRTELMKVLYGAMPRTSGYVTLDGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 38576 - DNA, 1536 bp, Salmonella typhimurium LT2; identical to SEQ ID NO: 27210
  CDS (1)..(1536): transl_table=11

SEQ ID NO: 38577 - protein, 511 aa, Salmonella typhimurium LT2; identical to SEQ ID NO: 27211

SEQ ID NO: 38578 - DNA, 1572 bp, Ralstonia solanacearum GMI1000
  CDS (1)..(1572): transl_table=11
atgaccaccgtccctgcaccgcgcacaccgctgctgcgggcgtccgccctcagcaagcactacgccgcgcctgtgctgcgcgatgtcgatctcgacgtctacgcgggcgaggtgctggccttgaccggcgagaacggcgcgggcaagagcaccctgtccaagatcctgtgcggactggagacgccggcctccgggtcgatgtcgctggccgggcgcctgttcgcgcccgcctcgcgctgcgacgccgagaccctcggcgtgcgcatggtgctgcaagagctgaacatggtgcccacgctgacggtggccgagaacctcttcctcggcaacctgccgcgccgccggggctggatcgaccgccccgcgctgcagcgccaggcggaacaggcgctggcgcggatcggactcgacctagacccccgcctgcccgtgcaccggctcggcatcgggcaccggcagatgatcgagatcgcccgcgcgctggccagcgcctgccgggtcctggtgctcgacgagccgactgccatgctcagcgcgcacgagagcgcgaccctgttcgcccgcatcgatgcgctgcgccgcgacggcgtggccgtcgtctacatctcgcaccggctcgacgagctggcgcgcatcgccgaccgcatcgtcgtgctgcgcgacggccggctgatcaccgatgcgcccgccgccacgctcacgcaggacgcgctgatccgggccatggtcggacgcgagctggccgcggacaccggcgcagagcgcccggcccgcgcgccgcgaccgcccgataccgcgccgaccctgcgcgtgaccggcctgacccgggcacccgcggtgcacgatgtgtcgtttgccgtggcgccgggcgagatcttcggcattgccgggctggtcggcgccggacgcaccgagctgctgcggctcatcttcggggcggaccgtgcggacgccggcaccatcgagaccggaacgccgctggcgccacggcgcatccgcgcgccgggcgatgcggtgcgccatggcatcggcctgctcaccgaagaccgcaaggacgaaggcctgctgctcggcctgccgatcgccgccaacatcgccctgggcaacatgaccggcgcagcacggcgcggctggctgcagccggcgcgcgagcgggcgcaggcgcggcgccacatcgaggcgctgcgcatccgctgcgcggggccggagcaggcggtcggcgagctgtccggcggcaaccagcagaaggtggcgatcgcccgctggctggagcgcgacgccccggtgctgctgttcgacgagcccacgcgcggcgtcgacgtgggcgccaaattcgacatctacgccctgctcgaagggctggccgcgcagggcaaggccctggtggtggtctccagcgacctgcgcgagctgatgcaggtctgcgaccgcatcggcgtgatgcgcgcggggcggctgacgcagatcttccgccgcgacagctggagccgggatgccctgcttgccgccgccttcggcgaatgtcccccgccgtcctccacgtccgccccggagaccgccgatgcgttctga

SEQ ID NO: 38579 - protein, 523 aa, Ralstonia solanacearum GMI1000
MTTVPAPRTPLLRASALSKHYAAPVLRDVDLDVYAGEVLALTGENGAGKSTLSKILCGLETPASGSMSLAGRLFAPASRCDAETLGVRMVLQELNMVPTLTVAENLFLGNLPRRRGWIDRPALQRQAEQALARIGLDLDPRLPVHRLGIGHRQMIEIARALASACRVLVLDEPTAMLSAHESATLFARIDALRRDGVAVVYISHRLDELARIADRIVVLRDGRLITDAPAATLTQDALIRAMVGRELAADTGAERPARAPRPPDTAPTLRVTGLTRAPAVHDVSFAVAPGEIFGIAGLVGAGRTELLRLIFGADRADAGTIETGTPLAPRRIRAPGDAVRHGIGLLTEDRKDEGLLLGLPIAANIALGNMTGAARRGWLQPARERAQARRHIEALRIRCAGPEQAVGELSGGNQQKVAIARWLERDAPVLLFDEPTRGVDVGAKFDIYALLEGLAAQGKALVVVSSDLRELMQVCDRIGVMRAGRLTQIFRRDSWSRDALLAAAFGECPPPSSTSAPETADAF

SEQ ID NO: 38580 - DNA, 1557 bp, Ralstonia solanacearum GMI1000
  CDS (1)..(1557): transl_table=11
atgtccatagccgtgttggatcggccgatgtcccgccaggacacgccgtctgcttcgtcagtcccgtccgcctgcgactgcatgctggaagttcgtggcgtcggcaaatcctttcccggcgtggtcgcgctcgacgacgtgcggctgcgcgtgcggcgcggcaccgttcatgcgctgatgggcgagaacggtgccggcaagtccacgctgatgaagatcattgccggcgtgcatgcgccggacaggggcgagatccgcctcaagggcgagccggtcgtgctgcacggcccgctcgacgcgctcaatcgcggcattgcgatgatccatcaggaactgaacctgatgccgtacatgaccgtggccgagaacatctggattcggcgcgagcccaggaaccgctgcggcctggtcgatcacgccgaactgcgccggcgcacgcaggcgctgttcgcgcggctggcgatcgacatcgacccggaggccgaagtgcgcacgctgacggtggcaagccgccagatggtcgagatcgcgaaggccgtgtcgttcgactccgaggtgctcatcatggatgagccgacgtcggcgctgagcgatgtcgaagtccaccatctgttccgcatcattcgccagctgcgcgagcagggcaagggcatcgtctacatcacgcacaaaatggacgagctgttcgagatcgccgacgagttctcggtgttccgcgacggcaagtccatcggcacgcatgcggcgagcgacgtcacgcgcgacgacatcatccgcatgatggtcgggcgcgagatcacgcagatgtttcccaaggcggatgtgccgatcggcgacgtcgtgctgtcggtgaagaacctgtgcctccacggcgtgttccgcgacgtgagcttcgatttgcgcgcgggcgagattcttggcgtcgcgggcctggtcggctcggggcgctcgaacgtggcggaggcgctgttcggcgtcgtgccggccagcagcggcgagatccggctcgacggcgagcgggtcagcatccgcacgcccgcgcaggcgatgcggtacggcatggccttcctgaccgaagaccgcaaggacacgggctgcttcctgaacctcgacctgctcgccaacatggaagccgcggtgctgcagcgccactacatgacatgcggcttcgtgcggcgtggcgcgctgaagcaggattgcgaggccatgagccgcacgctgcgggtgaagtcgccggggctgcacgaagaaatccagaacctgtcggggggcaaccagcagaaggtgctgatcggccgctggctgctgacccacccgcggatcctgatcctggacgagccgacgcgcggcatcgatgtcggcgcgaaagccgagatccaccgtctcgtgagcgcgctggcgggcgagggcgtggcggtgctgatgatctcgtcggagatgccggaagtgctgggcatgagcgaccggatcatggtcatgcacgaaggccgcgtgaccggcatcgtcgatcgcaaggacgcgagccaggtccgggtcatggaactggcttcccgctga

SEQ ID NO: 38581 - protein, 518 aa, Ralstonia solanacearum GMI1000
MSIAVLDRPMSRQDTPSASSVPSACDCMLEVRGVGKSFPGVVALDDVRLRVRRGTVHALMGENGAGKSTLMKIIAGVHAPDRGEIRLKGEPVVLHGPLDALNRGIAMIHQELNLMPYMTVAENIWIRREPRNRCGLVDHAELRRRTQALFARLAIDIDPEAEVRTLTVASRQMVEIAKAVSFDSEVLIMDEPTSALSDVEVHHLFRIIRQLREQGKGIVYITHKMDELFEIADEFSVFRDGKSIGTHAASDVTRDDIIRMMVGREITQMFPKADVPIGDVVLSVKNLCLHGVFRDVSFDLRAGEILGVAGLVGSGRSNVAEALFGVVPASSGEIRLDGERVSIRTPAQAMRYGMAFLTEDRKDTGCFLNLDLLANMEAAVLQRHYMTCGFVRRGALKQDCEAMSRTLRVKSPGLHEEIQNLSGGNQQKVLIGRWLLTHPRILILDEPTRGIDVGAKAEIHRLVSALAGEGVAVLMISSEMPEVLGMSDRIMVMHEGRVTGIVDRKDASQVRVMELASR

SEQ ID NO: 38582 - DNA, 1536 bp, Ralstonia solanacearum GMI1000
  CDS (1)..(1536): transl_table=11
atgtcggcctttcttgagtttcgcggtatcagcaaggtgtttcccggcgtgcgcgcgctgtcggaggtgtcgttcggcatcgaatgcggccgcgtgcacggcctgctgggcgagaacggcgcgggcaagtcgacgctgctgaagatcctcggcggcgactaccagcccgatggcgggcagatcgccgtcgagggccggcccgtggcgttcccgaacgcgcgggcggcgctggcggcgggcatcgccgtcatccaccaggagctgcagacggtgcccgagctgacggtgatggacaacctgctgctcggccacctgcccagccgcggcggcttcatccgccagggcgaggcgatggcgtggacgcgcgcgcagctggcgcgcatcggcgtcgatctcgacccgaaggccaggctgaagcacctgtcgatcgggcagcgccagatggtggagatctgcaaggcgatcctgcgcgatgcgcgcgtgatcgcgctcgatgagcccaccagctcgctgtcggtgcgcgagacggacatcctgttccggctggtgaaggacctgcgcgcgcagggccgggcgctgatctacatctcgcaccgcctcgacgagatcttcgcgttatgcgacggctgcaccatcttccgcgacggtcgcaaggtggcggatttccggtcgatggccgacgtcacgcgcgagcagctcgtcgcccagatggtcggccgtcagatcgacgacatcttcggctaccggccgcgcgcgccgggcgacgtccggctgcgggtggagggcctgatgggcccgaagctggccgagccggcgagcttcgcggtgcggcgcggcgagatcgtcgggctgttcggcctggtgggcgcggggcgctcggagctggcgcggctggtgtacggcgccgaccgcaagaccgccggcaccgtcgtgcttgacggcgagccgatccgcatccgcgccgtggccgacgcgattcgccagggcatcgtgctgtgcccggaggaccgcaaggaggaaggcatcatcggctgccgctcggtgtcggagaacatcaacatcagctgccggcgcaaccggcgcccgggttggggcgggttcaacctgttcgtcgatgaccggcaggaagcgaagaccgccgaccactacatcgcccggctgcgcatcaagacgccgcatcgcgaccagcccatccgcctgctctcgggcggtaatcagcagaaggccatcctggcgcgctggctggccgaggacggcatgcgcgtgctgatcatcgacgagccgacgcgcggcatcgatgtcggcgccaagaacgagatctaccaggtgctgtacgagctggccgagcgcggtgtggcggtgctgatgatctccagcgaactgccggagatcctgggcgtggccgaccgcgtgctggtgatgagcgaaggccgcatcgccggcgagctgccgcgcgcgcaggccaccgaacacgccgtgctgaacctggccttgcggccgcggcgcgacccatgcgttgcggcccaggccgcttga

SEQ ID NO: 38583 - protein, 511 aa, Ralstonia solanacearum GMI1000
MSAFLEFRGISKVFPGVRALSEVSFGIECGRVHGLLGENGAGKSTLLKILGGDYQPDGGQIAVEGRPVAFPNARAALAAGIAVIHQELQTVPELTVMDNLLLGHLPSRGGFIRQGEAMAWTRAQLARIGVDLDPKARLKHLSIGQRQMVEICKAILRDARVIALDEPTSSLSVRETDILFRLVKDLRAQGRALIYISHRLDEIFALCDGCTIFRDGRKVADFRSMADVTREQLVAQMVGRQIDDIFGYRPRAPGDVRLRVEGLMGPKLAEPASFAVRRGEIVGLFGLVGAGRSELARLVYGADRKTAGTVVLDGEPIRIRAVADAIRQGIVLCPEDRKEEGIIGCRSVSENINISCRRNRRPGWGGFNLFVDDRQEAKTADHYIARLRIKTPHRDQPIRLLSGGNQQKAILARWLAEDGMRVLIIDEPTRGIDVGAKNEIYQVLYELAERGVAVLMISSELPEILGVADRVLVMSEGRIAGELPRAQATEHAVLNLALRPRRDPCVAAQAA

SEQ ID NO: 38584 - DNA, 1545 bp, Ralstonia solanacearum GMI1000
  CDS (1)..(1545): transl_table=11
atggacaaccgcaccctgttcgagatgcgcagcatcgtcaaggcattctccggcgtgcgcgcgctcgacggcgtcagcctggccgtgcggccgggcgagtgcgtcggcctgtgcggcgagaacggcgccggcaaatcgaccctgatgaaggtgctgtccggggtctacccctacggcacctacgagggcgagatcctgtgggacggcgccccgctgcgcgcgcattcggtgcgcgacagcgagcacgcgggcatcgtcatcatccaccaggagctgatgctggtgcagcagctctcggtggcggagaacatcttcctcggcaacgagatcaccaagccgggcgggcgcatggactacgacgccatgcaccgcaaggccgaagaactgctcgcccgcctgcgcctgaccgacgtgaacgtggccgccccggtgatgaactacggcagcggccaccagcagctgttcgagatcgccaaggcactggccaagaacgcgcgcctgctgatcctcgatgagccgacgtcgtcgctgtcggccaaggagatcgaggtgctgctgtccatcatcgaagacctcaagcgcggcggcgtggcgtgcgtctacatctcgcacaagctcgacgaggtcaagcgcgtgtgcgacaccatcaccgtcatccgcgacggcaagcacatcggcacgcgcccggccgccgagctggacatcaacggcatcatcacgatgatggtcggccgcgagatgacctcgctgttccccaaggtcgagcacaccgtgggcgacgtggtgctggaagcgcgcaacgtcacctgctgggacgtcaccaaccccaaccgcaagcgcgtcgacgacgtgagcttctcggtgcgccgcggcgagatcctcggcgtggccgggctggtgggtgcgggacgcacggagatggtgtccgcgctgttcggcgcctaccccggccgctcctccgcgcaggtgctggtcgaaggcaagcccgtcaaggtgcattcgcccgcccaggccatcgcgcacggcatctgcctggtgcccgaagaccgcaagcgccacggcatcgtgccgctgatgggcgtgggcgagaacatcacgctggccacgctggcccagtacgcgcgcgggctgcgcgtcgacaagggcgcggagctgatgaccgtcgatcgcgaaatcaagcgcctgcgcatcaagaccgccagccccgcgctgtcgatcgccagcctctcgggcggcaaccagcagaaggcggtgctgaccaagatggtgctggcgtgccccaaggtgctgatcctcgacgagcccacgcgcggcgtggacgtcggctccaagtacgacatctaccagatgatcgccgacctggccgccagcggcgtggcgatcatcatggtctcttccgaactgccggagatcctgggcatgagcgatcgtgtcctggtgatcggcgaaggcgagttgcgcggcgacttcgccaaccagggcctgacccaggaacgcatcctggctgccgccatccatgctgaaccgcggcttcgcgctgcctga

SEQ ID NO: 38585 - protein, 514 aa, Ralstonia solanacearum GMI1000
MDNRTLFEMRSIVKAFSGVRALDGVSLAVRPGECVGLCGENGAGKSTLMKVLSGVYPYGTYEGEILWDGAPLRAHSVRDSEHAGIVIIHQELMLVQQLSVAENIFLGNEITKPGGRMDYDAMHRKAEELLARLRLTDVNVAAPVMNYGSGHQQLFEIAKALAKNARLLILDEPTSSLSAKEIEVLLSIIEDLKRGGVACVYISHKLDEVKRVCDTITVIRDGKHIGTRPAAELDINGIITMMVGREMTSLFPKVEHTVGDVVLEARNVTCWDVTNPNRKRVDDVSFSVRRGEILGVAGLVGAGRTEMVSALFGAYPGRSSAQVLVEGKPVKVHSPAQAIAHGICLVPEDRKRHGIVPLMGVGENITLATLAQYARGLRVDKGAELMTVDREIKRLRIKTASPALSIASLSGGNQQKAVLTKMVLACPKVLILDEPTRGVDVGSKYDIYQMIADLAASGVAIIMVSSELPEILGMSDRVLVIGEGELRGDFANQGLTQERILAAAIHAEPRLRAA

SEQ ID NO: 38586 - DNA, 1479 bp, Agrobacterium tumefaciens str. C58
  CDS (1)..(1479): transl_table=11
atgcgcgagccggttctttcgctccgtggcatcagcaaacgctatggtccgctcgaggttctgaagtccgtcgatctcgaggtctatccgggcgaagtggtagcgttgctgggtgaaaatggcgcgggcaagtccacgctgtcaggcatcatcgccggttcccgcgaaccttcagagggtaagatgacctggcttgggcagccgtatcagccggcatcgccgcgcgaggcgatcgacaagggcatcgtcctcatccatcaggaactgaagcttctgccggagctttccatcgctgagaatgtcttcatcggccgctggcccatgaaaaacggcattgtcgaccgcgccgagatggtgcggagagcccagcagcaactggcgcgccttaacctgcatattcccgcaacgcgcaaggtggcaggcctttccaccgccaaccagcagctgattgagatcgccaaggcgctcgcgctcgacgccaaactcctcatcctcgacgagccgacggccgcacttggcggcgccgaaacgcaggcgctgttcgagcaggtgcgcaagctgcgtgccgaaggcgtgggcatcatctacatctcccaccgcatggaagagatcagacagatcaccgaccgtatcgtcgtgttgcgcgacggcgagcgggtgcatgaatttgccgacagtgcgacgccggtgcgcaccattgtcgaaagcatggtcggccgctcgctggagcgcctgttcccggcgctgcctgaaccgcaggagaaggtggtactcgaggtcaaggggctgacgggcgcgaccaatgcctttcgcgacatcagcttcggcgtccgcgccggtgaaattctcggcattgccggcctgatcggcgcgggacgaacggaattggtgcgcgccatctccggtgccgatccgacgagcgcgggtgaagtacgactggatggcgaggtgctttcgctgaaaagcccggcggatgccatcgccaagggcatcgtcatggtgccggaagaccgcaaattgcaggggctggtggtggaacacgagatcggtgaaaacctgatctatgccaatctcgaccgcgtgggcacgggctggatcacgccggctatcaagcgcgctttcacccgggacgccatcgccaaattcggggtgaagggccgtagcgaacagccggcctccgatctctccggcggcaaccagcagaaagtggtcatcgccaaatggcttgcccgcaatccgcgtgtggtggtgctggatgaaccgacgcgcggcatcgatgtcggtgcgcgggcaggcatttacgatatcattgttggcctggcgaaggacggcgtggccgtcatcgtcgtcagttccgatctggaagaggtgctgggcgtttcgaaccgtatcctcgtgctcgcgcagggaaaacaggctggcatccttaaccgcgacgaggcaaacgacgtctcggtcatggaactggcaaccatctga

SEQ ID NO: 38587 - protein, 492 aa, Agrobacterium tumefaciens str. C58
MREPVLSLRGISKRYGPLEVLKSVDLEVYPGEVVALLGENGAGKSTLSGIIAGSREPSEGKMTWLGQPYQPASPREAIDKGIVLIHQELKLLPELSIAENVFIGRWPMKNGIVDRAEMVRRAQQQLARLNLHIPATRKVAGLSTANQQLIEIAKALALDAKLLILDEPTAALGGAETQALFEQVRKLRAEGVGIIYISHRMEEIRQITDRIVVLRDGERVHEFADSATPVRTIVESMVGRSLERLFPALPEPQEKVVLEVKGLTGATNAFRDISFGVRAGEILGIAGLIGAGRTELVRAISGADPTSAGEVRLDGEVLSLKSPADAIAKGIVMVPEDRKLQGLVVEHEIGENLIYANLDRVGTGWITPAIKRAFTRDAIAKFGVKGRSEQPASDLSGGNQQKVVIAKWLARNPRVVVLDEPTRGIDVGARAGIYDIIVGLAKDGVAVIVVSSDLEEVLGVSNRILVLAQGKQAGILNRDEANDVSVMELATI

SEQ ID NO: 38588 - DNA, 1539 bp, Agrobacterium tumefaciens str. C58
  CDS (1)..(1539): transl_table=11
atggccaataccattctcgaaatgcggaacatcaccaagacgtttccgggcgtgaaagcgcttgagaacgttaacctcaaggtgaaagagggtgagatccacgcactcgtcggtgagaacggcgcggggaagtcgaccttgatgaaggtcctttccggtgtttaccccgccggcacctatgagggcgaaatccactatgaaggcgcagtcaggaattttcgcgccatcaacgacagtgaagatattggtatcatcatcattcaccaggagcttgcactcgtgccgctcctgtcgattgcggaaaacatcttccttggcaacgaagtcgcttcgaacggcgtcatcagctggcagcagaccttcaaccgtacccgcgaactcctgaagaaggtgggtctgaaggaatcgcccgagacgctgatcaccgatatcggcgtcggcaagcagcagctggtcgaaatcgccaaggcactgtcgaagagcgtgaagctgctcatcctcgacgagccgacggcttcgctcaacgaaagcgattccgaggcgctgctcaatctcctgatggaattccgcaatcagggcatgacctcgatcatcattacccacaagctgaacgaagtgcgcaaggtggccgaccagatcaccgtgctgcgcgacggcatgacggtgaagacgctcgactgtcatcaggaagaaatcagcgaggatgtcatcatccgcaacatggtgggacgcgatctggaagatcgttatccgccgcgtgatgtgccgatcggcgagaccattctcgaagtcaaaaactggaacgcctatcaccagcagcatcgcgaccgccaggttctgcacgacatcaacgtcaccgtccgcaagggcgaagtcgtcggcatcgccgggctgatgggggcaggacgcaccgagttcgcgatgagcgtgttcggcaagtcctatggccacaggatcaccggcgacgtgctgatcgacggcaagcctgtcgatgtcagcaccgtgcgcaaggcgatcgacgccggtctcgcttatgtgaccgaagaccgcaaacatctcgggctcgtgctcaacgacaacatcctgcacaataccacgctggcaaatctcgccggcgtgtcgaaggccagcatcatcgacgacatcaaggaaatgaaggtggcgagcgatttccgcacgcgtcttcgcattcggtcatcgggcatcttccaggaaacggtcaatctttcgggcggcaaccagcagaaggttgtgctctccaagtggctgttctccaaccctgatgtgctgatcctcgatgaaccgacacgcggcatcgacgttggcgcaaaatacgaaatctacaccatcatcaaccagctcgctgccgatggtaaaggcgttctgatgatctcatcggaaatgcctgaactgctcggcaattgcgaccgcatctacgtcatgaacgaaggccgcatcgtcgctgaattgccgaagggagaggcgagccaggaaagcatcatgcgcgctatcatgcgctcaggggagaagaactcatga

SEQ ID NO: 38589 - protein, 512 aa, Agrobacterium tumefaciens str. C58
MANTILEMRNITKTFPGVKALENVNLKVKEGEIHALVGENGAGKSTLMKVLSGVYPAGTYEGEIHYEGAVRNFRAINDSEDIGIIIIHQELALVPLLSIAENIFLGNEVASNGVISWQQTFNRTRELLKKVGLKESPETLITDIGVGKQQLVEIAKALSKSVKLLILDEPTASLNESDSEALLNLLMEFRNQGMTSIIITHKLNEVRKVADQITVLRDGMTVKTLDCHQEEISEDVIIRNMVGRDLEDRYPPRDVPIGETILEVKNWNAYHQQHRDRQVLHDINVTVRKGEVVGIAGLMGAGRTEFAMSVFGKSYGHRITGDVLIDGKPVDVSTVRKAIDAGLAYVTEDRKHLGLVLNDNILHNTTLANLAGVSKASIIDDIKEMKVASDFRTRLRIRSSGIFQETVNLSGGNQQKVVLSKWLFSNPDVLILDEPTRGIDVGAKYEIYTIINQLAADGKGVLMISSEMPELLGNCDRIYVMNEGRIVAELPKGEASQESIMRAIMRSGEKNS

SEQ ID NO: 38590 - DNA, 1518 bp, Agrobacterium tumefaciens str. C58
  CDS (1)..(1518): transl_table=11
atggcgcgtgcggagcgttcggtccttctgcgtctcgagaacatcagcaaggaatttccaggcgtaaaagcgctgtcgaacgttcatttcgatctgcgcagcggcgaagtgcatgccgtctgcggcgagaatggcgcgggaaaatcgacactgatgaagatcatcagcggtgtctaccagccgagtgaaggaacgatcctgcacaaaggcgagaaggtgcaatatgcatcgccgctgcaatccgaagcggccggcatcgccatcatccatcaggaactcaaccttgttccgcatctttccgttgccgagaacatttatctggcgcgtgagccgcgccggggttttctcgtggaccgcaagaaactgcgactcgatgccaaacgctgtctcgaccggctgggggtcgatatcaaccccgaccagctggtccgcagtctttccgtcgcgcaatgtcagatggtggaaatcgccaaggcgctctctcttgatgccgaagtgctgatcatggacgagccgacctcctcgctgaccgagcaggaaacccggcttctgttcaaggttatccgcgatctcaaggcctccggcgtcggtatcgtttatatttcccatcgtctcgatgagatggccgagatcgtcgatcgcgtgacgatcctgcgcgacggacgttatatctcaaccgacgatttcgcctcgatcactgttgatgacattgtcacgcgtatggtcgggcgttcgctggaagacaaattccccgaacgcacctcgcgcccgacggatgatattctcttttccgtcgaagggctgacgcgcaatggcgtgttcagtgacgtcagtttttcactgcggcgtggcgaaatcttaggttttgccggacttatgggcgcgggacgaacggaagttgcgcgggcaatcttcggggccgatccgctcgatgcgggtaagatcgttttcaacgggcgcgaactttcgatcggctcgccgcaggacgctatcgaggaaggcattgcctatctctcggaagatcgcaaaagcgatggcctcgccatcaagatgtcggtggcggccaatacgacgctcgccaatctcggcgaggtttccaaccgtttcgggctgatcgatttcaagaagcatgacgatgtggcgaagcgttacgtcgatctgctgaatatccgcactccctcgatcgatcagaccgtgcggctgctttcgggtggcaaccagcagaaaatcatcatcggcaaatggctgttccggcagtcgcgcgtgctgttcttcgacgagccgacgcgcggcatcgatgttggcgcgaagtttgcgatctacaagatcatggacgaactggccgcgcagggcatcggcgtcattctcatcagttcggaactgccggaaattctgggactgacggatcgtattgcggtgttccatcagggccgtatcaccggcgtgctcgaaaccgccaagaccaatcaagaagaaatcatgcggtatgcgtccggttacggccgggccgcgcagtga

SEQ ID NO: 38591 - protein, 505 aa, Agrobacterium tumefaciens str. C58
MARAERSVLLRLENISKEFPGVKALSNVHFDLRSGEVHAVCGENGAGKSTLMKIISGVYQPSEGTILHKGEKVQYASPLQSEAAGIAIIHQELNLVPHLSVAENIYLAREPRRGFLVDRKKLRLDAKRCLDRLGVDINPDQLVRSLSVAQCQMVEIAKALSLDAEVLIMDEPTSSLTEQETRLLFKVIRDLKASGVGIVYISHRLDEMAEIVDRVTILRDGRYISTDDFASITVDDIVTRMVGRSLEDKFPERTSRPTDDILFSVEGLTRNGVFSDVSFSLRRGEILGFAGLMGAGRTEVARAIFGADPLDAGKIVFNGRELSIGSPQDAIEEGIAYLSEDRKSDGLAIKMSVAANTTLANLGEVSNRFGLIDFKKHDDVAKRYVDLLNIRTPSIDQTVRLLSGGNQQKIIIGKWLFRQSRVLFFDEPTRGIDVGAKFAIYKIMDELAAQGIGVILISSELPEILGLTDRIAVFHQGRITGVLETAKTNQEEIMRYASGYGRAAQ

SEQ ID NO: 38592 - DNA, 1524 bp, Agrobacterium tumefaciens str. C58
  CDS (1)..(1524): transl_table=11
atggcttttgctgacgaatctccagacccgggcctgatccggacggttgggctgtcgaagtctttcggtccggtacaggtcctgaaggatatcgagattgtggtgcgggccggcgaggtccacgcgatcatcggtgagaacggtgccggcaagtcgacgctgatgaagcttctggccggcaacgagaagccgtcgggcggggaaatccgcatcgatggcgaggccgttgcgctgagtggaccggtggacgccgaacatcgcggcatcgtcctcgtgcatcaggaaatattgctggcgccggatctgacggtggcccagaacatctatctcggccgcgaattgcgccggggcccgatgatggacgaccgggccatgcgggcgggagcgcgcaaggcgatagccgatctcggcggtacgatcgatcccgatgccatcgtcggcagtctttcgattgcccagcggcaactggtacagattgcccgtgttctgctcgtgccgcatcgcgtcgtcattttcgatgagccgaccgctagcctcacgcccatcgaaaccgatgcgctgctgaacgtcatcagggacatcagggccaagggcgtggccgtgctttatatttcgcaccgcctgcctgaagtgaaggagatcgccgaccgggtgactgtccttcgtgatggccggctggtggcttcgcacacggcatcggagttgcagccggccgatatggcgcggctgatggtggggcgcgatgttgccaagctctatccggaccggcatgccggcggcgagcgcgaaccggttctgcaggtggagcatttcaccgttcccggttatgcgcaggatgccggcttcagcctgcgcaagggagaaatcctcggttttgcgggcctggtgggggcggggagaacggagctgatggaaggtgtcctcggcctgcgggccgggcgcggaaatgtccgccatctgggtcgacaggtgcatttcgcaaaagcggaagacagtctgaaggccggcatcgtttatctgagcgaagaccgcaagggcaaaggattgctgctgaccaaggatctgcgggtcaatctcacgctcgcttcgctcaacaagttcagccggctgtttcagatcgatatccgccgggaggcgcaggcgctcgacgatgcggtgcgcgatttcgacatccgcaccggccgcaaggacctgctggcgggccagctgtccggcggcaaccagcagaagctgctgctcgccaagatgatgctgctcgatccgtccatcgtcatcatcgatgagccgacgcgcggtatcgatatcggcaccaaggaacagatttaccgtttcattgccagccttgcggatgaggggcggtcgatcatcgtcgtttcctctgaaatgccggagctgatcggcatctgcgaccgtattctggtgatgcgctcgggccggatcgtcggcgaggtggcgggcgagcagatgaccgaaaacgacatcgtggcgctggcgacgggcgttcatacgcaggaattcgcctga

SEQ ID NO: 38593 - protein, 507 aa, Agrobacterium tumefaciens str. C58
MAFADESPDPGLIRTVGLSKSFGPVQVLKDIEIVVRAGEVHAIIGENGAGKSTLMKLLAGNEKPSGGEIRIDGEAVALSGPVDAEHRGIVLVHQEILLAPDLTVAQNIYLGRELRRGPMMDDRAMRAGARKAIADLGGTIDPDAIVGSLSIAQRQLVQIARVLLVPHRVVIFDEPTASLTPIETDALLNVIRDIRAKGVAVLYISHRLPEVKEIADRVTVLRDGRLVASHTASELQPADMARLMVGRDVAKLYPDRHAGGEREPVLQVEHFTVPGYAQDAGFSLRKGEILGFAGLVGAGRTELMEGVLGLRAGRGNVRHLGRQVHFAKAEDSLKAGIVYLSEDRKGKGLLLTKDLRVNLTLASLNKFSRLFQIDIRREAQALDDAVRDFDIRTGRKDLLAGQLSGGNQQKLLLAKMMLLDPSIVIIDEPTRGIDIGTKEQIYRFIASLADEGRSIIVVSSEMPELIGICDRILVMRSGRIVGEVAGEQMTENDIVALATGVHTQEFA

SEQ ID NO: 38594 - DNA, 1524 bp, Agrobacterium tumefaciens str. C58; identical to SEQ ID NO: 27214
  CDS (1)..(1524): transl_table=11

SEQ ID NO: 38595 - protein, 507 aa, Agrobacterium tumefaciens str. C58; identical to SEQ ID NO: 27215

SEQ ID NO: 38596 - DNA, 1542 bp, Agrobacterium tumefaciens str. C58
  CDS (1)..(1542): transl_table=11
atggtcgtcagtccatcgacaatggccgccgtgcgcgccagcggagccgtgccgaatgcggaatttcttctcgcggcggatggcatacgcaaggaatttccaggcgttgtggcgctcgacgatgtgcagttccacctcaagcgcggtaccgtgcatgcgctgatgggtgagaatggcgccggcaaatcgacgcttatgaagattctcgccggcatctaccagccggataacggagaaatccgcctgaagggcgcgccgatacgtctcgattccccgctcgacgcgctggaaaacggcattgccatgatccatcaggaactgaacctgatggcttatatgacggtagccgaaaatatctggattcgccgcgagccgaaaaaccggctgggcttcatcgatcatggcgaaatgtatcgccgcacggaaacgctgctggaacggttgggcatcgatctcgatccggaaacgcgtgtcggcgagctttccgtcgccagccgtcagatggtcgaaatcgccaaggcggtttcctacaattcagacgttctcatcatggatgagccgacatcggctttgacggagcgcgaggtcgagcatctcttccgcatcatccgcgatctgagggaacgaggtatcggcatcgtttacatcactcacaagatgaacgagctgttcgagatcgccgacgagttctccgttttccgcgacggcaaatatatcggcacccacgcgtccaccgatgtgacgcgtgacgacatcatccgcatgatggtaggccgagaaatcacccagatgttcccgaaggaagaggttccgatcggtgacgtagtgctgtcggtcaagaacctgaatctggacggtgtcttccatgacgtctctttcgatgtccgcgccggtgaaattctcggcgtcgcgggcctcgtcggctccggacgctccaatgtggcggaaacggtatttggcgtgacgcccgcttcctcgggtacgatttcgatcgacggcaagccggtttcgatcgacagcccgacaacggctatcagtcaccgcatggcgttcctgacggaggaccgcaaggataccgggtgcctgctcatcctcaatattctcgagaatatgcagatcgcggtgctgcaggacaaatatgtcgccaacggcttcgtgcaggaaaacgcgctgtcggaagcctgcgaagaaatgtgccgcaagctccgcgtcaagacgccgcatctttacgagcgcatcgagaacctgtcaggcggcaaccagcagaaggtactgatcggacgctggatgctgaccaagccgcgcattctcattctcgatgaaccgacgcgcggcattgatgtcggggccaaggcggaaattcacaagctggtttgcgagatggcgcgccagggcgtcgccgtcattatgatttcctccgaaatgccggaggttctgggtatgagcgaccgtgtcatggtcatgcatgaaggtcgggtgacgggtttccttgctagaagtgaagccacgcaggtgaaggtgatggatctcgcatcgcggtga

SEQ ID NO: 38597 - protein, 513 aa, Agrobacterium tumefaciens str. C58
MVVSPSTMAAVRASGAVPNAEFLLAADGIRKEFPGVVALDDVQFHLKRGTVHALMGENGAGKSTLMKILAGIYQPDNGEIRLKGAPIRLDSPLDALENGIAMIHQELNLMAYMTVAENIWIRREPKNRLGFIDHGEMYRRTETLLERLGIDLDPETRVGELSVASRQMVEIAKAVSYNSDVLIMDEPTSALTEREVEHLFRIIRDLRERGIGIVYITHKMNELFEIADEFSVFRDGKYIGTHASTDVTRDDIIRMMVGREITQMFPKEEVPIGDVVLSVKNLNLDGVFHDVSFDVRAGEILGVAGLVGSGRSNVAETVFGVTPASSGTISIDGKPVSIDSPTTAISHRMAFLTEDRKDTGCLLILNILENMQIAVLQDKYVANGFVQENALSEACEEMCRKLRVKTPHLYERIENLSGGNQQKVLIGRWMLTKPRILILDEPTRGIDVGAKAEIHKLVCEMARQGVAVIMISSEMPEVLGMSDRVMVMHEGRVTGFLARSEATQVKVMDLASR

SEQ ID NO: 38598 - DNA, 1533 bp, Agrobacterium tumefaciens str. C58
  CDS (1)..(1533): transl_table=11
atgcgtgctgaaacccaaacaataaaaatgaccgaggcttccagccccacgcccgttctggaaatgcgcggcatcagccagatattccccggcgtcaaagcgcttgatggcgtcgatatcgcactataccccggcaaggtcacggcgctgatcggcgagaacggtgcgggtaaatccacgctcgtcaaaatccttaccggcatctaccgcccgaacgagggcgaaatcctgctggatggcaaggccgtccacttccacagcgcacaggatgccatcgatgccggcgtcaccgccattcatcaggaaaccgtgctgttcgacgagctttcggtcggtgagaacatcttcctcggccatgcgccgaagggtcgtttcggcctgattgactggaagaccatcaacgagcgggccagaattctgctggaacagctcgaaagcaccatcgatcctaccatccggttgaaagatctttcgatcgcccagcgccatctggtggccatcgcccgtgcgttgtcagtcgaggcgcgcatcgtcatcatggacgaaccgacagccgcgctttcccgcaaggagatcgacgatctcttccgcatcgtcgagaacctgaagcggcagggcaaggcgatcctcttcatcagccacaagttcgatgaagtgtatgaaatcgccgagaattatgccgtattccgtgacggaaaaatggttggcgccggcacgcttgccaccaccccgcaagatgaaatcgtgcggctgatggttggccgcgacgtgacgaatgccttcccgaagcaggcggtcacccttggtccaacggttctttcggtgcgtgattattcgcaccagaccgaattccgcgatatttccctcgatcttcgcaagggtgaaattctcggcctttacgggctgatcggcgccgggcgctccgaactttgccaatcgctgttcggcatcacccgcccggcttcgggagaggtgacgctggatggccagccgctcaccatccgctcgccggaagatgcgatccgcgccgggatcgtatacgtgccggaagagcgtggccgccacgggctggcactcgatatgccgatctatcagaacatgtcgctgccatccctcacccgcacgtcgcgcaaggggtttctcactgccgccaatgaattcgcgctagcgcgcaaatatgccgcgcggctcgatctgcgcgctgccgcgctttcggtgcccgttggcacgctttcgggcggcaaccagcagaaggtggtgatcggcaagtggctggccacgaagccgaaggtcatcattctcgatgagccgaccaagggcatcgatatcggctccaaggccgccgtgcatggtttcatcagcgagcttgcggcagagggcctgtcgatcatcatgatttcatccgaacttcccgaaatcctcggcatgtccgaccgcgccatcgtcatgcgcgaaggcctgatggcgggccagttcgaacgcgccgaattttctccggaaaagctggtgcgcgctgccaccggcaatgcctga

SEQ ID NO: 38599 - protein, 510 aa, Agrobacterium tumefaciens str. C58
MRAETQTIKMTEASSPTPVLEMRGISQIFPGVKALDGVDIALYPGKVTALIGENGAGKSTLVKILTGIYRPNEGEILLDGKAVHFHSAQDAIDAGVTAIHQETVLFDELSVGENIFLGHAPKGRFGLIDWKTINERARILLEQLESTIDPTIRLKDLSIAQRHLVAIARALSVEARIVIMDEPTAALSRKEIDDLFRIVENLKRQGKAILFISHKFDEVYEIAENYAVFRDGKMVGAGTLATTPQDEIVRLMVGRDVTNAFPKQAVTLGPTVLSVRDYSHQTEFRDISLDLRKGEILGLYGLIGAGRSELCQSLFGITRPASGEVTLDGQPLTIRSPEDAIRAGIVYVPEERGRHGLALDMPIYQNMSLPSLTRTSRKGFLTAANEFALARKYAARLDLRAAALSVPVGTLSGGNQQKVVIGKWLATKPKVIILDEPTKGIDIGSKAAVHGFISELAAEGLSIIMISSELPEILGMSDRAIVMREGLMAGQFERAEFSPEKLVRAATGNA

SEQ ID NO: 38600 - DNA, 1542 bp, Agrobacterium tumefaciens str. C58
  CDS (1)..(1542): transl_table=11
atggacaagcaacccgtttttcaggcacgaaacgtcgaaaaagtatttccaggcgttcgggcgctcaagggcgtcaatctttcgctgcaacccggctcgatccacgccctgcttggggaaaacggtgccggcaaatcgaccctgatcaaggtcgtcacgggtgtccatcaccaaagcagcggccagatccttgttgatgggcaggccgtgcgtttcagcaatccgcgcgaggcgattgcccgcggcattggtgtcgtccatcaggaacgcaacctcattccgcgcttttcgattgccgagaatatccacatggaaaagctcggggcgcattatctcaaacccatcgactacgccgcgctgaaccgcgatgcgcgccgctggcttgaggcgctcaatctggaaatcgatccggcaacgccagtatcggagctttccgtcgcgcagatgcagctcgtggaaatcgccaaggcgctttccctgcaaagccgtgtgctgctcctcgacgagccgacgacatccttgacgccgagcgaaacggacaatctcttccgcattctacggcgcctgcgcgatgacggcgcaagccttgtcttcgtcagccacaagctggaagaggttctggatatctgcgaccgggtcacggttctgcgggacggcgaaaacgcctgtgaaagtcggtcgatggaaggtctcggacgtcaggatctcgtgcgcctgatgatcggacgcgccgaaagcggcggcggctggcgcaaacgcgcggtcgaacacaatccgatggtgctggaacttgagggcgtatcgaccgcgatcggtcatggcgatgtcagtctgtccgtgcgcaagggcgagatcgtcggcctttacgggctggtcggcgccgggcgcaccgaacttgcaaaatcgatcatgggcaaattcgcggtcacctctggcaacgtgcgtgtttcgggccggcccgcccgcatccgctccgttgccgaagcgatccacgactacggcgtgggttatgtcagcgaagaccgcaagggcgatggcctcattctccagcactcggttcttgccaatgcgggcgttcccatctggcgcaaactctcgaatacgttcggcgtgctttcggatgggcgcatccgggcggcggtaacgcctttcctgaaaaagctggaggtgaagacaccaagcctcagccagacggtcggcaatctgtccggcggcaaccagcaaaaaatcagtgtcgccaaatggctcgccgccgatgtcaaactgctgatcgtcgacgaaccctccgtcggcatcgacatcaagaccaaggcctatctgcatgatctgctgcgcgagctggcagataacggcaccgccattctcgtcattaccagcgacatgccggaaatggtggcgctggccgatcgcatcgtcgtgatggaccaatacagagtgaaaggcatcgtggaaaacaatggcgtctatgccgatatgagccacgacatcatgactctcatccatcactctgaagagagcgaagcccgcctccaccaggcatag

SEQ ID NO: 38601 - protein, 513 aa, Agrobacterium tumefaciens str. C58
MDKQPVFQARNVEKVFPGVRALKGVNLSLQPGSIHALLGENGAGKSTLIKVVTGVHHQSSGQILVDGQAVRFSNPREAIARGIGVVHQERNLIPRFSIAENIHMEKLGAHYLKPIDYAALNRDARRWLEALNLEIDPATPVSELSVAQMQLVEIAKALSLQSRVLLLDEPTTSLTPSETDNLFRILRRLRDDGASLVFVSHKLEEVLDICDRVTVLRDGENACESRSMEGLGRQDLVRLMIGRAESGGGWRKRAVEHNPMVLELEGVSTAIGHGDVSLSVRKGEIVGLYGLVGAGRTELAKSIMGKFAVTSGNVRVSGRPARIRSVAEAIHDYGVGYVSEDRKGDGLILQHSVLANAGVPIWRKLSNTFGVLSDGRIRAAVTPFLKKLEVKTPSLSQTVGNLSGGNQQKISVAKWLAADVKLLIVDEPSVGIDIKTKAYLHDLLRELADNGTAILVITSDMPEMVALADRIVVMDQYRVKGIVENNGVYADMSHDIMTLIHHSEESEARLHQA

SEQ ID NO: 38602 - DNA, 1521 bp, Agrobacterium tumefaciens str. C58
  CDS (1)..(1521): transl_table=11
atgggtgaggtcattctcagcatgacgaatattcacaaggcgttcgggcctgtgcgggcattgcggagtgccgcacttgaactgcagcgcggcgaaatccacgcgctcgccggtgaaaacggtgcgggcaagtcgacgctgatgcacattatcgacggcattctgcagccggatggcggtgaaatcctgctggatggcaaaccggttcgcatatcttcgccgaatgcggcgaacaggctgggcatcggtttcgtgcatcaggagatcgcgctctgcccggagatttcggtcgctgaaaacatgtacatgtcggagaccggccagagccgctcctggttcatgaattatcgcgatctggaaaaacgggcggcaacggtgctgcgggagatcggcgatatcgatcccacccaccgcgccggcgacctgtcgatttcgcagcagcagatcgtcgagatcgccaaggcgctgacgctcgattgccgtatcctgatcctcgatgagccgacggcggcgctgaccgagaccgaggcccagacacttttcaagatcatgcgtcggctggcggcgcgcggcatcgccatcatctatatctcccaccgtatggcggagattttcgaacattgcgaccgcatcacagtcatgcgcgacggttgccatatcaggacggaaaatattgccgacatttccccggaagaggtcgtcaacagcatggtgggccgggtgctcgacaagctctatccaccgaaactggcggatgacgaaaaatccaatgaggtcattctttcggttcggggactgaacgaaggaaagcgtgttttcgacgtggatttcgatctgcgtcgcggcgaaatcctagggtttgccgggctgatcggcgcgggccgcagcgagattgcgcgggccgtctgccggctggaaggaaaaccgaaaggcgaggttgtgctgcgcggccggtcgctgaagctcagggattatcgcgacagcatccgcgaggggatcgtttatctctccgaggaccgcaagggcgacggattgttcctcaacatgtccatcgccaccaatgtctcggcgctcgatattggcaggatatcgaacggcatgggtttcatccagcggcgcaaggaaatgaagcgtgccgatgagttgggacgccggctgaaactgcgggcgaacagcgtcggtgacgcggtatcgaccttgagcggcggcaaccagcagaaggtggcgctggccaagatgctgtcggtggaacccgaggtcatctttctggatgagccaacccgcggggtggatgtgggcgccaaggcggaaatccaccgtcagatccgggagctggcgcgtcaaggggttggcgtggttgtcatctcctcggagctgccggaactcatcggtgtcagcgatcgtgtgcttgtcgtgcgcgaggggcgcatcaccggcgaggtcgagggggacgacatgacggaggaaaagatcatgcagctcgcatcgatcactatcatgcagaatgcggcggaagcctga

SEQ ID NO: 38603 - protein, 506 aa, Agrobacterium tumefaciens str. C58
MGEVILSMTNIHKAFGPVRALRSAALELQRGEIHALAGENGAGKSTLMHIIDGILQPDGGEILLDGKPVRISSPNAANRLGIGFVHQEIALCPEISVAENMYMSETGQSRSWFMNYRDLEKRAATVLREIGDIDPTHRAGDLSISQQQIVEIAKALTLDCRILILDEPTAALTETEAQTLFKIMRRLAARGIAIIYISHRMAEIFEHCDRITVMRDGCHIRTENIADISPEEVVNSMVGRVLDKLYPPKLADDEKSNEVILSVRGLNEGKRVFDVDFDLRRGEILGFAGLIGAGRSEIARAVCRLEGKPKGEVVLRGRSLKLRDYRDSIREGIVYLSEDRKGDGLFLNMSIATNVSALDIGRISNGMGFIQRRKEMKRADELGRRLKLRANSVGDAVSTLSGGNQQKVALAKMLSVEPEVIFLDEPTRGVDVGAKAEIHRQIRELARQGVGVVVISSELPELIGVSDRVLVVREGRITGEVEGDDMTEEKIMQLASITIMQNAAEA

SEQ ID NO: 38604 - DNA, 1503 bp, Agrobacterium tumefaciens str. C58
  CDS (1)..(1503): transl_table=11
atgctggaactgaatgcaataagaaaaagctttggcaagatcgaagtcctgcacggcgtcgaccttgaggcgcgcgccggtgaggtgcatgcgcttctgggcgaaaacggtgccggcaagtcgactttgatgaagatcctatgcggcattttgcagccatcggagggaacgatccgcattgacggcaaggatcgccgcttcgccaattatgacgaagcgattgccgctggcgtcggcatcgtgtttcaggaattcagcctgatcccctatctcaatgccgttgaaaacatgttcctcgcccgcgaaattcgcgggccgctgcgccttttgaacaagggcgcgatgcgcaagcgcgcggccgaaatcatgggccggctggccgtggatgtgccgctcgacgtgccggtgcaccgcctgtcggttgcccagcagcaatttgtcgaaatcgccaaggcattgtcgctggatgcccgcattctcgtgctcgacgagccgaccgcgacgctcacgccctccgagacagagcacctgttcaatgtcatgcgcgagctgcgccgtcagggcgtggcgatcatcttcatttcgcatcacctcgatgaaatattcgagatctgcgaccgcatcaccgttcttcgcgatggcgagttgattggctcctgcctgacgtcggaggtcgataatgaccgtctggtggagatgatggtcggccggcgcatcgaagccagcttcccgccgaagccgcagatcgatccttccgccgcaaaggtgatcgaagtcgaagagctgcaattgaagaagggcggccctgtctcgcgcttttcgctgcgcaagggtgaaatcctcggctttgccgggctcgtcggctcgggccgcacggaaacggtgctggccatgctcggtgcgcattccgcttcgcgccgcaagatcaagcttgatggtgtggatacgcgtttgtccggccccgatgatgcgctgatgcgcggcatcggcctgctgccggaaagccgcaaggaggaggggctgatcaccagcttctcgatcctgcagaatatttcgctgaacaattatcgtaagtaccgcaaggcccactggttcctcgacctcaagaaggaactggagcacacgacgaaggccatggcgcaggtgcaggtcaaggcgcagggcccctatgcccgtgtcgacacgctgtccggcggcaaccagcagaagatcgttatcgcccgctggctgaaccatgacatgcgcgtgctgatcttcgacgagccgacacgcggcatcgacgttggcgccaaggcagaaatctattcgctgatgcgcgaatttgccgccaggggtcattcgatcatcatgatctcctcggagttgccggaagtgatcggcatgtccgacagggtctgcgtcttccgctccggcggcattgtcgccacggtcgagggcgaagacatcaattcagaaacaataatgacaaacgccaccaccgggagagttgaacatgtcgcttga

SEQ ID NO: 38605 - protein, 500 aa, Agrobacterium tumefaciens str. C58
MLELNAIRKSFGKIEVLHGVDLEARAGEVHALLGENGAGKSTLMKILCGILQPSEGTIRIDGKDRRFANYDEAIAAGVGIVFQEFSLIPYLNAVENMFLAREIRGPLRLLNKGAMRKRAAEIMGRLAVDVPLDVPVHRLSVAQQQFVEIAKALSLDARILVLDEPTATLTPSETEHLFNVMRELRRQGVAIIFISHHLDEIFEICDRITVLRDGELIGSCLTSEVDNDRLVEMMVGRRIEASFPPKPQIDPSAAKVIEVEELQLKKGGPVSRFSLRKGEILGFAGLVGSGRTETVLAMLGAHSASRRKIKLDGVDTRLSGPDDALMRGIGLLPESRKEEGLITSFSILQNISLNNYRKYRKAHWFLDLKKELEHTTKAMAQVQVKAQGPYARVDTLSGGNQQKIVIARWLNHDMRVLIFDEPTRGIDVGAKAEIYSLMREFAARGHSIIMISSELPEVIGMSDRVCVFRSGGIVATVEGEDINSETIMTNATTGRVEHVA

SEQ ID NO: 38606 - DNA, 1491 bp, Agrobacterium tumefaciens str. C58
  CDS (1)..(1491): transl_table=11
atgagcgcagaaccgctcctgtcccttaaaaatgtcaaggtcaccttcggtggcgtacgcgccctgaagggtgtttccttcgaggtcaatccgggtgaagtgcattgccttgccggcgaaaacggctgcggcaaaagcaccgtgatcaaggtcatcaccggtgtctataagccggagagcgatgcggaactctatttcgatggcaaacccatcgctgctatgaccccgacacttgcgcaatcgctgggcattcaggtgatctggcaggatctggcgctgttcgatgagatgacggtggccgaaaatatcggtttccaatatgcggtgaacggcagatttgggctggtcgacaagcgcgctatcaaaaatgccgccgaaaaggcgctggcacggctcggtgtctcgttcgatctcgacaggccgctcaaggaactgccgattgcccaacgccagatcgtggcgattgcccgtgcgctggttggcgaagcccgtctcgtttttatggatgaacccaccgcatctctgacgcagtcggagaccgattacctcatcgatatcgtccgcaacctctcggcgtcaggtgtcgctgtcgtgttcgtttcgcatcgtctggcggaagtgcttgagatatcggatcgcatcaccgttttgcgggatggatcgcttgtcggcgttttcccggtcgaaggcatgacccagtctcgcgtgaccgagttgatgaccggccgcaacttcgatagcgccgtcattgccgccgatcacgacgacaagcccgtggttctctcggtgcgaggcctgacacgggccggcgagttcgaggatgtttccttcgatctgcggcgcggggagacgttggggatcaccggtcttctcggcgcgggccgaaccgaacttgccctgacgctgttcggcatgcaccggccgcaatcgggtgaagtccttatcgatggaaagaaggtggatttccattccaaccgggatgcgatccgggttggtgtcgcctatctctccgaagaccggctgtcgctcggtctgaaccagccgcagtcgattgccgacaatctcgtcatggcctcccttgataagttgttgagtggcggtcttatctccacgtcgaaaaaggcggatgtcgtttcccgctggatttcagcgctcggcgtcaagatcggcctgccggaagatccgatccgcacgctctctggcggcaaccagcagcgcgtggcgattgccaaatggctggcgatcgggccgaaaattctcatcctcgatgcgccgaccgtgggtgtcgacgtcggcgcccgcgccggcatctttgaaatcgtccgcaagctcgccgcagagggcctgtcgatcatcgtcatctccgatgaggcgccggaagtttattttaatacagacagggtcatccacatggtcgaaggccggttccacgccacctatgatccgcgacgcctgtcgctgaccgaactggaggccgccatctatgcgtag

SEQ ID NO: 38607 - protein, 496 aa, Agrobacterium tumefaciens str. C58
MSAEPLLSLKNVKVTFGGVRALKGVSFEVNPGEVHCLAGENGCGKSTVIKVITGVYKPESDAELYFDGKPIAAMTPTLAQSLGIQVIWQDLALFDEMTVAENIGFQYAVNGRFGLVDKRAIKNAAEKALARLGVSFDLDRPLKELPIAQRQIVAIARALVGEARLVFMDEPTASLTQSETDYLIDIVRNLSASGVAVVFVSHRLAEVLEISDRITVLRDGSLVGVFPVEGMTQSRVTELMTGRNFDSAVIAADHDDKPVVLSVRGLTRAGEFEDVSFDLRRGETLGITGLLGAGRTELALTLFGMHRPQSGEVLIDGKKVDFHSNRDAIRVGVAYLSEDRLSLGLNQPQSIADNLVMASLDKLLSGGLISTSKKADVVSRWISALGVKIGLPEDPIRTLSGGNQQRVAIAKWLAIGPKILILDAPTVGVDVGARAGIFEIVRKLAAEGLSIIVISDEAPEVYFNTDRVIHMVEGRFHATYDPRRLSLTELEAAIYA

SEQ ID NO: 38608 - DNA, 1500 bp, Agrobacterium tumefaciens str. C58
  CDS (1)..(1500): transl_table=11
atgactgaaaatctgatcgagctgcgccacatcggtaagcggtttggtggcgtgaaggcgctcgacgacgtatcgctgagcattcgcccgggcgaaatccattgccttgccggtgaaaacggttccggcaaatccaccgtcatcaaaatcatgtccggggtttacacacccgaggacggtgagatcctgatcgacgggaagcctgtcggcaaactcgatccggtaaaatccgttcaccacggtattcaggtgatctatcaggatttttcgctgtttggtaacctgacggtcgccgagaacctggccatcaatacctttctgatggaaggtcgcaaaacggtcgactggcgacatgtccgtgagctggcccaaaaggcgttggaccgcctcggcgtgagcatcgatcttgatacggatgtcgaaaccctgccgacctctggaaagcagatcgtggcgattgcccgtgccgtcatggccgatgcacgcctgatcatcatggatgagccgacgaccgcgctgacgcgccatgaggttgatgccctcttcaagattgtgcgtgatattcaggcgcagggcatcgccgtgctcttcgtcagccacaaaatgcgcgagatgctcgaaatcagcgagcgcctgacagttttccgcaatggcaagaaggtggccgaagggccgatcgccgaattcgatgagccggcaatcacccgcgcgatgacggggcaggagctgaccgcccacagctacaagtgggcaccgcaggaaggtgccgatacaccggtgctggaagtccgcaacctctcggttccggcttccgtggaaaacaccgacctgacgttaaggccaggcgaaatcgtcggtatttcgggtttgatcggttcggggcgtaccgaacttgcgctggcgctgtttggcatgcgccccgattttaccggttcagtgcgcctcgcaggccgcgaggttcacccaaggaccgttcaggagggtattgcctgcggtgtcgcttatgtgccggaggatcgcctgaccgaggggctattcctgacgcaatcgatcgaacggaatatcattgtcacgtcgattgagaaattcgtccgcggtcttttcatcaatcgcaaaaaggcggacgagacgacccgcgaaatgttctcggccatgcagatcgtggcaccaggaccgcacacgccggtcaaccatttgtccggtggcaacgcacagcgcgtcgttctggctcgctggttgttgactggggccaaagtgctgatcctgaacggcccgaccgtcggcgtcgatgtcggttccaaagcacagatccacaccatcatccgcaagctggccgaaaaggaagggctggccgtgctgatgatttccgacgatgtgccggaactggtgcagaactgcaaccgcgtgctggtcatgcatcgcggccgtttcgttgacgagttgtctggagagagcatgaccgaagacgccgttaacgaccggctcaagatgctgaattga

SEQ ID NO: 38609 - protein, 499 aa, Agrobacterium tumefaciens str. C58
MTENLIELRHIGKRFGGVKALDDVSLSIRPGEIHCLAGENGSGKSTVIKIMSGVYTPEDGEILIDGKPVGKLDPVKSVHHGIQVIYQDFSLFGNLTVAENLAINTFLMEGRKTVDWRHVRELAQKALDRLGVSIDLDTDVETLPTSGKQIVAIARAVMADARLIIMDEPTTALTRHEVDALFKIVRDIQAQGIAVLFVSHKMREMLEISERLTVFRNGKKVAEGPIAEFDEPAITRAMTGQELTAHSYKWAPQEGADTPVLEVRNLSVPASVENTDLTLRPGEIVGISGLIGSGRTELALALFGMRPDFTGSVRLAGREVHPRTVQEGIACGVAYVPEDRLTEGLFLTQSIERNIIVTSIEKFVRGLFINRKKADETTREMFSAMQIVAPGPHTPVNHLSGGNAQRVVLARWLLTGAKVLILNGPTVGVDVGSKAQIHTIIRKLAEKEGLAVLMISDDVPELVQNCNRVLVMHRGRFVDELSGESMTEDAVNDRLKMLN

SEQ ID NO: 38610 - DNA, 1530 bp, Brucella melitensis 16M
  CDS (1)..(1530): transl_table=11
ttgactgttgaaatcggcggcagcgcgaactgccgccagtggaggagatacattggaatttctgctcgatgtggagggctcaggaagtcctttggcggtgttgctgccttgcgggatgggcggctgcaattgcgtaccggctcggtacatgcgctgtgcggcggcaatggcgcgggcaaatccacgtttttgaaaatcctgatgggcattcatgcccgcgatggtggacatatccgccggcgtggaaaagaggttacgtattccagccccgccgaagcgttgcaggcgggtattgcgatcatcgaacaggagctaagccccgttccccatatgaccgtggcggagaatatctatttgggcagggagccgcttcgccgtttcggtggcatcgatttcaagacgatgaacctcaatgcccagaagcttttggaccagcttgagttcaagattcgcgccaaccagttcatgatgaacctgtctgtcgcgcaggtgcagcttgtggaaatagccaaggcgctcagtcacgacgctgaagtcattttcatggacgaaccgacatcggccattggtgaaaaagaagcacagcagctttttgcagcgatagagcgtttgaaagcgagcggaaaaggcattgtctatgtctcccatcgcctgtcggaaatttttcagattgccgatagctataccgtgtttcgcgacggcagttatatcgatagcggcgatctcggtggcatcacccgtgcggaactgatccatatgatcgtcgggcgggaactgggtgaggaatatatcaagacgaatgcgcctacggaaataccgggcgtcgaggtttccggcctcagcgcgcccggcaagataaccgacatttcctttaccgcgcataagggcgagatttttggcatttacgggttgatggggtcaggccgctcggaaatattcaactgtcttttcggattggagaaagcctcccaaggaacaattcggcttgaaggcgaacccgtcaccgtccggcgccccgcggacgccatggctctggggctggcttttgtgacggaagatcgcaagctgaccggcctcaatctcggcgacagcgttcgcaacaatatatgccttgccagccttcccgagatgagtccgcatttttcaatgaatcggcgtgcggaatcggccgccagcagggagatgatcgagcgtttcaggatcaaggttgcgcacgacacgatggccgtttcgggcctttccggcggcaaccagcagaaggtcgtgctcggaaaatggttcctgcgaaagccacgcgttctgctgctcgatgaacccactcgcggtgtcgatgtgggtgcaaaacaggaaatttatcgcatcatttgcgaatttgccgcccaaggcgggaccgtcgtcatggtttcttccgagattgatgaagtcctcggcatgtctgaccgcatcatggtcatgcgtggcggacaatcggtcggcatctaccgcagggcggaaacggacgcgcagtcattggtgcatctttcgacatga

SEQ ID NO: 38611 - protein, 509 aa, Brucella melitensis 16M
MTVEIGGSANCRQWRRYIGISARCGGLRKSFGGVAALRDGRLQLRTGSVHALCGGNGAGKSTFLKILMGIHARDGGHIRRRGKEVTYSSPAEALQAGIAIIEQELSPVPHMTVAENIYLGREPLRRFGGIDFKTMNLNAQKLLDQLEFKIRANQFMMNLSVAQVQLVEIAKALSHDAEVIFMDEPTSAIGEKEAQQLFAAIERLKASGKGIVYVSHRLSEIFQIADSYTVFRDGSYIDSGDLGGITRAELIHMIVGRELGEEYIKTNAPTEIPGVEVSGLSAPGKITDISFTAHKGEIFGIYGLMGSGRSEIFNCLFGLEKASQGTIRLEGEPVTVRRPADAMALGLAFVTEDRKLTGLNLGDSVRNNICLASLPEMSPHFSMNRRAESAASREMIERFRIKVAHDTMAVSGLSGGNQQKVVLGKWFLRKPRVLLLDEPTRGVDVGAKQEIYRIICEFAAQGGTVVMVSSEIDEVLGMSDRIMVMRGGQSVGIYRRAETDAQSLVHLST

SEQ ID NO: 38612 - DNA, 1569 bp, Brucella melitensis 16M
  CDS (1)..(1569): transl_table=11
atgtggccatgcgtgcgttgccggtgcaggcgcatgactgcgccgcgtcaggctggcgagcctgctcttctggaagccgtttctctgtccaaatcctttgggccggtgcaggttctggaaaatataaatctgcgcgtcaacggtggtgaaattcacgcgatcattggtgaaaatggcgcgggtaaatccacgctcatgaaaattctggccggtaacgaacgccagacgggcggagaaatccgtattgatggcaagccggtttccttttccagcccggcagcagcagaggcacgaggcatcgtgctggtgcatcaggaaatcctgcttgcaccagacctgacagttgcgcagaacatatatctcggtcgtgaacttgggggtaagcggggacgcggactactggtcgatgatcggtcgatgcgcgagggcgcgcgcagggctatccgtgatctcggcgctgaaatagacccggatgccgtggttgcgacgctatcaattgcccaacgccagcttgtgcagattgcacgggtgctgttggtgccgcatcgcctcgtgatcttcgatgagccgacggcttcgctcacgcctttcgagacggaagcccttctgaaagtcatccgtgatattcgagccaagggcgttgcggttctctatatttcgcatcggctgccggaagtgaaggagatagccgaccgtgtgactgttctgcgtgacggcaagctggtttccagccatttggcatcctctttgcagccggctgatatggcgcggctgatggttgggcgcgatgtcgccaagctctatcccgatcgcgcaagccggtatgacagcgccgctattctggaagtagaaaacttcagtgtgccgggcttcgtgcgcaatgcaagtttttgtctgaaccgtggcgagatacttggctttgccggtctggttggtgcgggccgaacggagcttatggaaggaatcgtcggtttgcgcccagccaagggagaattgcgccatgatggtaggctggtgcacttcaacaatgcacatgacagccagcaggcgggcatcgtttatctgagcgaagaccgtaaaggcaaagggctgctcctgtcgaaagatctcggcaccaatctcaccctggcttcacttgacaggttcgtgcgcggcctccagatcgaccgcaaccgcgaacgtgcggcgttggatgaggcgatccgtgcattcgacatacgcacgggccgtaaggatatcctggccggtcagctttcaggcggcaaccagcagaaactgcttcttgccaaaatgatgatgcttaccccgtccatcatcatcatagacgagccgacgcgaggcatcgatgtcggcacgaaggagcagatttatcagttcattgccaacctggcggatgaaggaaaatccatcattgttgtatcgtccgaaatgccggaactgatcggtatttgcgaccgtatcgtggtgatgcgggaggggcaaattgccggggaggtgagcggcgcaggcatgacggaacatgaaattgtggcgctcgccaccggcgttggcgccaacgaggctgcatga

SEQ ID NO: 38613 - protein, 522 aa, Brucella melitensis 16M
MWPCVRCRCRRMTAPRQAGEPALLEAVSLSKSFGPVQVLENINLRVNGGEIHAIIGENGAGKSTLMKILAGNERQTGGEIRIDGKPVSFSSPAAAEARGIVLVHQEILLAPDLTVAQNIYLGRELGGKRGRGLLVDDRSMREGARRAIRDLGAEIDPDAVVATLSIAQRQLVQIARVLLVPHRLVIFDEPTASLTPFETEALLKVIRDIRAKGVAVLYISHRLPEVKEIADRVTVLRDGKLVSSHLASSLQPADMARLMVGRDVAKLYPDRASRYDSAAILEVENFSVPGFVRNASFCLNRGEILGFAGLVGAGRTELMEGIVGLRPAKGELRHDGRLVHFNNAHDSQQAGIVYLSEDRKGKGLLLSKDLGTNLTLASLDRFVRGLQIDRNRERAALDEAIRAFDIRTGRKDILAGQLSGGNQQKLLLAKMMMLTPSIIIIDEPTRGIDVGTKEQIYQFIANLADEGKSIIVVSSEMPELIGICDRIVVMREGQIAGEVSGAGMTEHEIVALATGVGANEAA

SEQ ID NO: 38614 - DNA, 1539 bp, Brucella melitensis 16M
  CDS (1)..(1539): transl_table=11
ttgatgtccgaatatcttttggaaatgcgaaacatcggtaaagagttcaacggcgtcaaggcgctggatggcatttacctgaaagtgcgcgcgggagaatgtgtcgggctgtgcggtgaaaacggggcgggcaagtacaccctgatgaaagtgctgtcgggtgtttatccccatggcacatggactggtgaaattttctgggaaggcaaagaacttaaagccagtggcattcgcgataccgaagctgcgggtattgtcatcatccatcaggaactgatgatggtgccacacctgtcggtcgcggagaatatcttccttggttgcgagccaaccacaggcggtttcattgattatgaccagatgaatgcacgggcagccgaactgctcgctcggctcaagataaacgatatcaatgtcgcattgccggtttatcattactcaggcggcaagcagcagttgatcgagattgcaaaggcaatcaacaaaaatgccaagcttctgatccttgacgagccaacctcggccctgaccgcttcagaaacccgggttctcatcgacctgatcaaggacttcaaaaagcagggcatggcttgcgtttacatctctcacaaactcgatgaagtggcggaaatctccgacacggtaacggttattcgtgatggcgcgcatatcgcgacacgtccgatgtccgaactgacaacgcccgatatcatcacgatgatggtcgggcgtgagatgaagaacctcttcccgcgtgaaccccatgacattggcgaggtgatgtttgaagcccgcaatataagttgctgggatgtgaccaatcctgaccgcaaggtggtcgacgatgtttcgtttgcgctaaggcgcggtgagattttgggcattgcgggccttgtgggtgccgggcgtacagaactcgtatcgagcttgtttggtgtctggccgggcgcctgtcaggggcaggtttttctggaaggcaaggaaatcaaaatccgcacgccgcgcgatgcggtgcgccaaggcatttgcatggtgccggaagatcgcaaacgcgatggcatcctgccgatcatgccagttggccacaatatgacgatctccgtgcttgatcgcttttcgctacgaggcctcatcgataaagacgcggaactcgtggcgatccagcgtgagattttgagactcaaggtcaagaccgccgatccgatgcttgccattgcctcgctatctggcggcaatcagcagaaggccgtgctttcaaagatgatgctgcctgatccgaaagtgctcattcttgatgagcccacacgcggcgtcgatgtcggcgcgaaatatgaaatttacaagctgatattcgcgctcgccaggcagggcgtatcgattttgatggtttcgtcggaaatgccggaagtccttgggatcagtgatcgtgttctcgtcattggcgagggcaaattgcgcggcgatttcccgaatgaaaatcttacacaggagaaggttcttgccgctgcaattggcaagcctgcaaccaacgcggcctag

SEQ ID NO: 38615 - protein, 512 aa, Brucella melitensis 16M
MMSEYLLEMRNIGKEFNGVKALDGIYLKVRAGECVGLCGENGAGKYTLMKVLSGVYPHGTWTGEIFWEGKELKASGIRDTEAAGIVIIHQELMMVPHLSVAENIFLGCEPTTGGFIDYDQMNARAAELLARLKINDINVALPVYHYSGGKQQLIEIAKAINKNAKLLILDEPTSALTASETRVLIDLIKDFKKQGMACVYISHKLDEVAEISDTVTVIRDGAHIATRPMSELTTPDIITMMVGREMKNLFPREPHDIGEVMFEARNISCWDVTNPDRKVVDDVSFALRRGEILGIAGLVGAGRTELVSSLFGVWPGACQGQVFLEGKEIKIRTPRDAVRQGICMVPEDRKRDGILPIMPVGHNMTISVLDRFSLRGLIDKDAELVAIQREILRLKVKTADPMLAIASLSGGNQQKAVLSKMMLPDPKVLILDEPTRGVDVGAKYEIYKLIFALARQGVSILMVSSEMPEVLGISDRVLVIGEGKLRGDFPNENLTQEKVLAAAIGKPATNAA

SEQ ID NO: 38616 - DNA, 1755 bp, Brucella melitensis 16M
  CDS (1)..(1755): transl_table=11
atgcagcccaactggcttggtgcattctccgtctatgcagccgtacaggcccttgaaggcaaggatattccaaagtcgatcaaggttccgcttcctgtcatcgatgccagcaatgtcgatacttatcttgcgccgcgcggacaagtttcctgccgacggttatgtctattcggactacgaccgggccctgttcgacaagttgctggggcagcaagcgcccccatgcaggtttcatccaggcctgtcgtggacgcgccggctccgtggctcgaagcgcgcaacgtgttcaaggggtttttcggcaacccggtgctgaagggggtcagcatcgccttgcggcccggccgcgtgcacgcactgcttggagaaaacggtgcgggcaagtccacactcatcaatctgctgtccggcgccttgccgccggacagcgggaatattgtgctggaaggtgcagctctttccagattgaacccggcgcaagcgcggaaagcgggcattgctgtcattcagcaggaacttagtctgacgccggaattgtcgattgcagaaaatatcgggcttggcgcctatccgcgccgtttcggcctgatcgactacaaggcccttcacggggaagccttggccgtttgtaaacgtgtcggcctgaccgaaccgctcgaaactccggtcggcacactgtcgctcgggcgcaggcagatggtcgagattgccaaggcgcttttccgcaaaccgcgggtgctcatccttgatgagccgacatcatcgctatctgcgcatgaggcgggcgtattatcatcgctggttctcaaattgcgcgatgagggcgtcgcacttctctatatctctcacaggctcaacgaaattcgctcgctctgttctcatgtgaccgtgctcaaagacggtgtcgtgaccgcagatcagtcattatcaaattcggacccggaggagctagttcgcctgatggtcgggcgtgatactggcgaccttttccccgcttggcgaaccagtgccaccggcgaaaaacggattcatattcgcggcatgagcgcgggtatggcgcagaatgtcgatatggatgccaatgcgggcgagatcatcggtatcggcggtctggttgggcaaggacaggaagattttctgctgggtctctatggtgcgctgccgaccgcagcccgtgaagcgatagtgtgcggaaataacggcctgttcaaatcggttggcgcggcaaacgcggctggccttgcctatgtcccggcggatcggaagcgggaagggctcgtgctgccgcattccattgcgtcaaacctgctcctgccgtcacttgatcgatatacgcggcacggtttgcgcaacacggcaaacgagcagcgtgtcgttgccaaacttgccgaacggctgacgatcaggggagatactgcgcgcccggttcaggcgctgtccggcggcaatcagcaaaaggttgcgcttgccaaatggcttccgctggaacctacaatcctgttgctgaacgatccaacccgcggcgtcgatatcgaaaccaagcgtgaaatctacctgatgctgcgccggtttgccgatgaaggaaagctcgttgtcctgctgagttccgacacgccggagcttgtgcatttgtgtgaccgcgtcatggttttccgcgagggccgcatggtcgcgaccctgaaacacggggatctgtcggaagaggcaattgtaggggctgccatgggcctgaaatcgtcgagaaaggcagcctga

SEQ ID NO: 38617 - protein, 584 aa, Brucella melitensis 16M
MQPNWLGAFSVYAAVQALEGKDIPKSIKVPLPVIDASNVDTYLAPRGQVSCRRLCLFGLRPGPVRQVAGAASAPMQVSSRPVVDAPAPWLEARNVFKGFFGNPVLKGVSIALRPGRVHALLGENGAGKSTLINLLSGALPPDSGNIVLEGAALSRLNPAQARKAGIAVIQQELSLTPELSIAENIGLGAYPRRFGLIDYKALHGEALAVCKRVGLTEPLETPVGTLSLGRRQMVEIAKALFRKPRVLILDEPTSSLSAHEAGVLSSLVLKLRDEGVALLYISHRLNEIRSLCSHVTVLKDGVVTADQSLSNSDPEELVRLMVGRDTGDLFPAWRTSATGEKRIHIRGMSAGMAQNVDMDANAGEIIGIGGLVGQGQEDFLLGLYGALPTAAREAIVCGNNGLFKSVGAANAAGLAYVPADRKREGLVLPHSIASNLLLPSLDRYTRHGLRNTANEQRVVAKLAERLTIRGDTARPVQALSGGNQQKVALAKWLPLEPTILLLNDPTRGVDIETKREIYLMLRRFADEGKLVVLLSSDTPELVHLCDRVMVFREGRMVATLKHGDLSEEAIVGAAMGLKSSRKAA

SEQ ID NO: 38618 - DNA, 1590 bp, Brucella melitensis 16M
  CDS (1)..(1590): transl_table=11
atgaacctagccaatcctgtctcgctggacgagcgtggggcactgccggatactttcggaaagcctcttcttgaaatgcgtgggatcaacaagtccttcggtgtcgtgaaggcgctgagcgatgtgaacttcaccgtcatgccgggcgaaatacatgcctttgtgggtgaaaacggcgcgggaaaatccacgctgatgaaggtgctttcgggtgtttatccccatggaagctatgaaggcgcgatctattacgacggggaagagcggcagtttcgggatattaacgattccgaggcgctcggcatcgtcatcattcatcaggaattggccctcattccgctgatgtcgattgccgagaatatttttctcgtcaatcctccggcaagccggggtgtcatcgaccgctccgccgtgcacaagcggacgcgggagctattgaaaaaggtcggtctggcggaaacgcccgatacgctcatcaccgatatcggcattggcaagcagcagcttgttgaaatcgccaaggcgctttccaagcgtgtgcggctgttgatcctcgatgaaccaacagcaagcctcaacgaaaatgacagtgcggcgcttctggcgctgctgcgcgagtttcgcgcgcagggcatcacctcgatcctcatttcgcacaagctcaatgaaatccgcgaagtggccgacaagattaccgttctgcgcgacggcaaggcggttgcgacacttgattgccatgcgggcgaagtggaggaagacgatatcatccgcaagatggtggaccgcgatctggagagccgttatcccaagcgcgatcccaagatcggcaatgtcatcttcgaggtcgataactggtcggtctatcatccgctgcatcccgatcggcattcggtcaagaacgtgtcattcaaggtgcgggcgggcgagatcgtcggcattgccggattgatgggagcggggcgcacggaattcgccatgagcctgtttggccgttcatggggcacgaatatcactggcgaggcgcgcatcaatggcaagacggtggatatttccaccgtggcgcgggcaatcaaggcgggccttgcctatgttaccgaggatcgcaagaagcttggcctggttcttggccagaatatttcgcgcaatatctcgctggcgcacttacgcggcgtgagcccgaaaggcattatcgacgatatccgggaaatgaagatcgcgaattcctatcgcgaccagatgcgtattcgctgtcacaatgtctatcaggaaaccggcacgctttcgggcggcaaccagcagaaggtggtgctgtcgaaatggcttttcactggccccgacgtgctgatcctggacgagccgacacgcggtatcgatgttggcgcgaaatatgacatttacacaatcatcaattcactggcggaaagcggcaagggcgttgtcgtcatttcttcggaaatgccggagctgatcggcatttgcgaccgcatcgtcgtcatgcatgagggcgccttcgtcggcgaagtggcaggcgaggaagcaacgcaggaaaacatcatgcgcgccatcatgcgaaacacgggaaaagggtaa

SEQ ID NO: 38619 - protein, 529 aa, Brucella melitensis 16M
MNLANPVSLDERGALPDTFGKPLLEMRGINKSFGVVKALSDVNFTVMPGEIHAFVGENGAGKSTLMKVLSGVYPHGSYEGAIYYDGEERQFRDINDSEALGIVIIHQELALIPLMSIAENIFLVNPPASRGVIDRSAVHKRTRELLKKVGLAETPDTLITDIGIGKQQLVEIAKALSKRVRLLILDEPTASLNENDSAALLALLREFRAQGITSILISHKLNEIREVADKITVLRDGKAVATLDCHAGEVEEDDIIRKMVDRDLESRYPKRDPKIGNVIFEVDNWSVYHPLHPDRHSVKNVSFKVRAGEIVGIAGLMGAGRTEFAMSLFGRSWGTNITGEARINGKTVDISTVARAIKAGLAYVTEDRKKLGLVLGQNISRNISLAHLRGVSPKGIIDDIREMKIANSYRDQMRIRCHNVYQETGTLSGGNQQKVVLSKWLFTGPDVLILDEPTRGIDVGAKYDIYTIINSLAESGKGVVVISSEMPELIGICDRIVVMHEGAFVGEVAGEEATQENIMRAIMRNTGKG

SEQ ID NO: 38620 - DNA, 1545 bp, Brucella melitensis 16M
  CDS (1)..(1545): transl_table=11
atgagcctggctgcgaaaatcgaaggcaaaaacggcgatgtcgttcttgccgcgcagaatgtggccaagtcctatggccgcatccatgcgctgaaaggcgtgaatttcgagattcgccgggggcaggtcacgacgcttttcggtgaaaacggtgcgggcaagtccacgctgatgaaagtgctttccggcgtgatccagccgactttgggcacgatcatcctcgatggcaagccggtgacgttcaattcatccaccgaagcgcgcgaccatggcatctcgatcatccatcaggaattaagcctcgcgcccaacatgaatgtgcgcgacaacatcttcatggggcgcgaaatccgcaccgccaccggcgtcgattttgccgaggaagagcggctgacgcgcgaactcatgaaggaactggaagaagatatcgatccgctgacgccggttgaggaattgcgtctcggccagcagcaggtcgttgagatcgcccgtgcgctttcggtcaattcgcgcattctcatcatggatgagccgacttcggcgctcagtgcttcggaagtcgaggttctgttcaaggtgatccgcgacctgacggcgcgcggtgtcgccatcgtctatatttcgcatcatctggaagaggcgctccagatcaccaatcatgcggtggtgctgcgcgacggcaccatgacggcctgtgcgccgcgtgaggaaatcgatctggaatggatcgtgcgcaatatggtcggtgaaaacttcgacctcggttctcctcccactggctatgaatggggcgatgtcgcgctttcggtcgaagacctgaccgttcccgaccccagtggcagtggcttctcgctggtggaccgcatgtcgctcaatgtgcgggcgggcgaaatcgtctgcatctatggtctcatgggtgcgggccgcacggaattgctggaatcggttgccggtcgcttgaaatcgagaggcgggcgtattctcctcaaagggcaggatatttccggcctcaccatcgctgagcgcatcgaaaagggccttgtgctggtgccggaagatcgccagcgcgacggtctcgtccagacgatgacggtcggcaagaacctgtcgcttgccagcattgcggaaatgaccagggggatattcacctcgcgcaagcgcgaaaagcggatcgtcgatcagtcgatcaggaatgtgcacatcaagaccgatggcggcgaggcggcaatcggttcgctttcgggcggcaatcagcagaaagtcgtaattggcaagatgctggcgaccgaaccggatgtgatcctgctcgatgagccgagccgcggcatcgacatcggcgcaaaggcggaagtgttcaagcttctggccgaaaaggcgaagcaggggctggccgtggtctacaccacctcggaagtcggcgaatgcctcagcatcgcgcaccgcatcatcgtcatgcaccgtggacgcatctccgccgaattcggatcggacgtgtccaaggaaaagatcatgaccgcctcgggcgaagccatggtcggtcattaa

SEQ ID NO: 38621 - protein, 514 aa, Brucella melitensis 16M
MSLAAKIEGKNGDVVLAAQNVAKSYGRIHALKGVNFEIRRGQVTTLFGENGAGKSTLMKVLSGVIQPTLGTIILDGKPVTFNSSTEARDHGISIIHQELSLAPNMNVRDNIFMGREIRTATGVDFAEEERLTRELMKELEEDIDPLTPVEELRLGQQQVVEIARALSVNSRILIMDEPTSALSASEVEVLFKVIRDLTARGVAIVYISHHLEEALQITNHAVVLRDGTMTACAPREEIDLEWIVRNMVGENFDLGSPPTGYEWGDVALSVEDLTVPDPSGSGFSLVDRMSLNVRAGEIVCIYGLMGAGRTELLESVAGRLKSRGGRILLKGQDISGLTIAERIEKGLVLVPEDRQRDGLVQTMTVGKNLSLASIAEMTRGIFTSRKREKRIVDQSIRNVHIKTDGGEAAIGSLSGGNQQKVVIGKMLATEPDVILLDEPSRGIDIGAKAEVFKLLAEKAKQGLAVVYTTSEVGECLSIAHRIIVMHRGRISAEFGSDVSKEKIMTASGEAMVGH

SEQ ID NO: 38622 - DNA, 1548 bp, Clostridium perfringens str. 13
  CDS (1)..(1548): transl_table=11
atgaaagactcttcaaacctgttagaaatgagaaatatctctaaagaattcccaggggttaaagctttagataatgtaacattaaaagtaaaaaaaggttctgtacatgctttaatgggagaaaatggtgctggtaaatcaaccttaatgaaatgtctatttggtatatatcaccctaattcaggagaaatttttatttctggccaaaaggtacaatttaaaaattcaaaacatgccctagataatggagtatctatggttcaccaagagttaaatcaagttagagaaagaaatgttatggataatctttggcttggtagatatcctaaaaaagggctttttatagatgaaaagaaaatgtatgatgaaacagaaaaaatctttaaggatctagatataaatgttaatcctcgtgataaggtttctacactatctgtttctcaaatgcaaatggttgaaatagcaaaggctgtttcgtataactctaaaataatagtaatggacgagcctacttcctctttaacagaaaaagaagtaagtcacctatttaaaataataaataaacttagaaagcaaggaataagtataatttatatctctcataagatggaagaaatcttagagatctctgatgaagttaccataatgagagatggtaaatggattgctactgaaaaagcttcagatcttactatggatttaataataaaacttatggttggacgtgaacttactgatagattccctaaaaaggatcatattcctaaagaaactactttagaagtaaataatcttagtgatgcaaaaaatgaattaaagaatgtttcctttaaacttagaaagggagaaattttaggaattgcaggtcttgttggtgctaaaagaactgaaaccttagaaaccttatttggccttagagaaaagggctctggagatattattttacatggcaaaaaagttgataacagtaagccttttaaggctatgcaaaatggttttgcccttgttactgaagaaagaagacaaactggaatctttggaaaattacctatagattttaattctataatagctaatatagatagttataaaacatcaacaggtcttttagcaaatgaaagaatctctaaagatactcaatgggttatagattcaatgaaagtaaaaactccaagtcaaaaaactctaatcggtagcctatctggtggtaatcaacaaaagatagtaattggaaaatggcttcttagaaaacctgaaatactacttctagatgagcctactagaggtatagatgttggtgctaaattcgaaatataccaacttataaatgaacttgctaaagaagacaaaggaataattatggtttcttctgaaatgcctgaacttttaggtgtatgtgacagaatactagtcatgagtaatggtagggtttctggcatagttaatgctaatgagactacccaagaggaaattatgcatctatctgcaaaatatctatcagtaacaggaggagttaacaatgcaaaccaaatcaaagaaaaagtttaa

SEQ ID NO: 38623 - protein, 515 aa, Clostridium perfringens str. 13
MKDSSNLLEMRNISKEFPGVKALDNVTLKVKKGSVHALMGENGAGKSTLMKCLFGIYHPNSGEIFISGQKVQFKNSKHALDNGVSMVHQELNQVRERNVMDNLWLGRYPKKGLFIDEKKMYDETEKIFKDLDINVNPRDKVSTLSVSQMQMVEIAKAVSYNSKIIVMDEPTSSLTEKEVSHLFKIINKLRKQGISIIYISHKMEEILEISDEVTIMRDGKWIATEKASDLTMDLIIKLMVGRELTDRFPKKDHIPKETTLEVNNLSDAKNELKNVSFKLRKGEILGIAGLVGAKRTETLETLFGLREKGSGDIILHGKKVDNSKPFKAMQNGFALVTEERRQTGIFGKLPIDFNSIIANIDSYKTSTGLLANERISKDTQWVIDSMKVKTPSQKTLIGSLSGGNQQKIVIGKWLLRKPEILLLDEPTRGIDVGAKFEIYQLINELAKEDKGIIMVSSEMPELLGVCDRILVMSNGRVSGIVNANETTQEEIMHLSAKYLSVTGGVNNANQIKEKV

SEQ ID NO: 38624 - DNA, 1506 bp, Clostridium perfringens str. 13
  CDS (1)..(1506): transl_table=11
atgggtgaaagaacaccaatgctaaaaatggtaggtgtatcaaaatcctttccaggagtcaaagctttagataatgttagcttaatggcttatggtggagaagttactgctttaatgggagaaaatggagcagggaaatcaactttaatgaaaatactaagtggagtatataaaaaagatgaaggtaagatattcattgaaggaagggaagtagaagtaaagggaattaaatcagcagaagaagctggtataacaataattcaccaagaacttagtgttttaaataacttaactatttcagaaaatatatttttaggtaatgaaaaacatagtaaatttacaggaagaataaataaaaaattattagatgaaagaagcaaaatgttcttagaacaaattggttgtgatatagatccaaatagattagttagtactcttaatgtaggtgaaaagcaaatgatagaaatagcaaaagccttaactaagaatgcgagaataattattatggacgagcctactacagccttaactgatgtagagactgaaaacctttttaaagtaatagagaatttaagaaaaaagggaatagcaataatatacatatcacatagaatggaagaaatatttaaaatatgtcatagagtagaagtattaagagatggtaaatatgcaggaagtgcagaaataaaagacatagataatgataagcttatagcaatgatggttggaagaaccatagaggatcaatttccatacagagatgttaaaaaaggagatttagctttagaagttaaaaatcttagctgtaaggaaggagttaaaggagcttcatttactctgagaaagggagaaatattaggaattgcaggtcttatgggatcaggcagaacagagcttgcaaaaacaatatttggagaatataaaagaacaagtggtgaaatttctttaaatggaagtcctattaatataaattgcataagtgacgcaataaataatggtatatgttatctttcagaggatagaaaaaaagaaggctgtattttaggaatgtctgttggagaaaatatgaccttatgtaacttaaagaaatatgagaataagtttaaatctcttgataaaaaagaagaagcaaaggatatagagtactatattaagaagataaacataaaaactccaaataaggagcagtttattaagaatttaagtggaggtaatcaacagaaggttatacttgctaaatggcttatgctatctccagaagtattaataattgacgagccaactagaggaatagacgtaggtgcaaagaaagaaatttatgaacttttaaatgaacttaaagctagtggaaaagccataataatgatttcttcagacttaccagaggttttaggaattagtgatagaattatggttatgagtgaaggaagaatctctggagaattaaatagagatgaagcaaatcaagaaagtataatgaaattagccgttggaataaacaattag

SEQ ID NO: 38625 - protein, 501 aa, Clostridium perfringens str. 13
MGERTPMLKMVGVSKSFPGVKALDNVSLMAYGGEVTALMGENGAGKSTLMKILSGVYKKDEGKIFIEGREVEVKGIKSAEEAGITIIHQELSVLNNLTISENIFLGNEKHSKFTGRINKKLLDERSKMFLEQIGCDIDPNRLVSTLNVGEKQMIEIAKALTKNARIIIMDEPTTALTDVETENLFKVIENLRKKGIAIIYISHRMEEIFKICHRVEVLRDGKYAGSAEIKDIDNDKLIAMMVGRTIEDQFPYRDVKKGDLALEVKNLSCKEGVKGASFTLRKGEILGIAGLMGSGRTELAKTIFGEYKRTSGEISLNGSPININCISDAINNGICYLSEDRKKEGCILGMSVGENMTLCNLKKYENKFKSLDKKEEAKDIEYYIKKINIKTPNKEQFIKNLSGGNQQKVILAKWLMLSPEVLIIDEPTRGIDVGAKKEIYELLNELKASGKAIIMISSDLPEVLGISDRIMVMSEGRISGELNRDEANQESIMKLAVGINN

SEQ ID NO: 38626 - DNA, 1575 bp, Corynebacterium glutamicum ATCC 13032
  CDS (1)..(1575): transl_table=11
atggtgaactctgaacaagcgcttcatcagcatgatcctgcaccaatccttcagttggataaagtctccaagtcgtttggcccagtcaacgtcattaatcaagtgagcatcgatgttcgccctggcagggtgcttgcgctgttgggtgaaaatggtgcgggtaaatctacgctgatcaagatgatgtcgggtgtgtatcagcctgatggcgggcagattttggtggatggaaagcccacgactttgcctgatacgaaaactgctgagtcttttggcatcgctacgattcaccaggaattgaatctggtgcccacgatgacggtggcggaaaacgtcatgctgggccgcactcctcggaagtggggtttggtcaatttcaaacatttgcgcaggcaggcacaggcggcgctggatctcatcggcgtggatgtggatctgaatgctcaggtgggttctttaggaatcgctaggcagcagatggtggagatcgccaaggcgttgtccatgaatgcgcggatattgattttggatgagcccactgcagcgttgactggtcgtgaaattgatcagttattcaaagtggtggatcagctgaaagaaaaaggcgtggccatggtgtttatttcgcaccacttggatgagatcgcgcgcatcggcgataccgtctctgtgctgcgtgatggccagttcatcgcggagctgccagcggatactgatgaagatgagctggtgcggctgatggtgggtcgtagcattgaaaaccagtatccgcgtagtgcgccagagatcgggcagccactgttggaggtgaaaaacctcaacgcggagggccggttcacggatatttccttgactgttcgcgctggtgaagtcgtaggccttgccggtcttgtgggtgctggtcgcacggaagtggttcgctcgattgctggcgtggacaaagttgattccggtgaggtgatcgttgctggcaagaaattgcgcggcggcgatatttccgaggctattaaaaacggcatcgggcacattccggaagatcgaaaagcccagggcctggtgctggggtcgtctgtggaggacaacctgggattggcgactttggcgtcgacagcccgcgcaggtttggtcgatcgatcaggacagcacaaacgagccgccgaggtcgcggaaaaactccgcatccggatggcaagcctcaaacaaccgattagcgatttatcgggcggcaatcagcaaaaggccgtgttcggccgctgggtgcttgccgggtcaaacgtgctgcttctcgacgaaccgacccgtggcgttgacgtcggcgcgaaggtggaaatttacaacatcattaatgagatgacggaaaaaggtggcgctgtgctcatggtgtcatcggagcttcccgaagtcttgggcatggctgatcgcattttggtcatgtctggtggacgcatcgcaggcgaactgccagcgaagggaacaacccaggacgatgtcatggctctagctgtttcccaggtggatgattccatcaccgaggaagctgctgcagaaatcgaaaacacaaaggaggaccgttga

SEQ ID NO: 38627 - protein, 524 aa, Corynebacterium glutamicum ATCC 13032
MVNSEQALHQHDPAPILQLDKVSKSFGPVNVINQVSIDVRPGRVLALLGENGAGKSTLIKMMSGVYQPDGGQILVDGKPTTLPDTKTAESFGIATIHQELNLVPTMTVAENVMLGRTPRKWGLVNFKHLRRQAQAALDLIGVDVDLNAQVGSLGIARQQMVEIAKALSMNARILILDEPTAALTGREIDQLFKVVDQLKEKGVAMVFISHHLDEIARIGDTVSVLRDGQFIAELPADTDEDELVRLMVGRSIENQYPRSAPEIGQPLLEVKNLNAEGRFTDISLTVRAGEVVGLAGLVGAGRTEVVRSIAGVDKVDSGEVIVAGKKLRGGDISEAIKNGIGHIPEDRKAQGLVLGSSVEDNLGLATLASTARAGLVDRSGQHKRAAEVAEKLRIRMASLKQPISDLSGGNQQKAVFGRWVLAGSNVLLLDEPTRGVDVGAKVEIYNIINEMTEKGGAVLMVSSELPEVLGMADRILVMSGGRIAGELPAKGTTQDDVMALAVSQVDDSITEEAAAEIENTKEDR

SEQ ID NO: 38628 - DNA, 1503 bp, Fusobacterium nucleatum subsp. nucleatum ATCC 25586
  CDS (1)..(1503): transl_table=11
atggaaaatctaaaatatgtattagaaatggaaaatatttccaaagagtttcctggagtaaaagcactagatgatgttcaattaaaactaaaacctggaactgtccatgctctaatgggagaaaatggagctggaaaatcaacattaatgaaatgtttatttggaatttatgaaaaaaatagtgggaaaattttattagatggagtagaagttaatttcaaatctacaaaagaagccttagaaaatggtgtttctatggttcaccaagaattaaaccaagttttacaaagaaatgtacttgataatatttggcttggtagatatccaatgaaaggattttttgtagatgaaaagaaaatgtataatgatacaattaacatctttaaagatttagatattaaagtagatcctagaaaaaaagtggctgatttacctattgctgaaagacaaatgatagaaatagctaaagcagtatcatataaatcaaaagtaatagttatggacgaacctacttcttcgttaacagaaaaggaagttgatcatttatttagaattatcaaaaaattaaaagaaagtggagttgggattatttatatttctcataaaatggaagaaataaaaatgatttctgatgaaattactattttaagagatggtaaatggatatcaactaatgatgtttcaaaaatttcaactgaacaaattataagtatgatggtaggtagagatttaactgaacgtttccctaaaaaagataataaagctaaggaaatgatattagaagttaagaatttaactgctttaaatcaaccttctatacaagatgtaagttttgaactttataaaggagaaatcttaggaatagctggacttgttggttctaaaagaacagaaatagttgaaactatttttggaatgagaccaaaaaaacatggtgaaattattttaaatggtaaaactgtaaaaaataaaagtccagaagatgctataaaaaatggttttgccttagtaacagaagaacgtagaagtacaggaatattttcaatgttagatgtagcatttaactctgttatctctaacttagatagatataaaaataaatttagacttcttaaaaataaagatatagagaaagatacaaaatggatagtagatagtatgagagtaaaaactccttcatactctaccaaaatcggaagtctttctggtggaaatcaacaaaaagtaattattggaagatggctactaactgaaccagaagttcttatgcttgatgaacctactagaggtattgatgttttagcaaaatatgaaatttatcaattaatgatagatcttgctaaaaaagataaaggaattataatgatttcttctgaaatgcctgaacttttaggagtaacagatagaatacttgttatgagtaatggtagagttgcaggaattgttaaaacatctgaaactaatcaagaagaaataatggaactatcagctaaatatctataa

SEQ ID NO: 38629 - protein, 500 aa, Fusobacterium nucleatum subsp. nucleatum ATCC 25586
MENLKYVLEMENISKEFPGVKALDDVQLKLKPGTVHALMGENGAGKSTLMKCLFGIYEKNSGKILLDGVEVNFKSTKEALENGVSMVHQELNQVLQRNVLDNIWLGRYPMKGFFVDEKKMYNDTINIFKDLDIKVDPRKKVADLPIAERQMIEIAKAVSYKSKVIVMDEPTSSLTEKEVDHLFRIIKKLKESGVGIIYISHKMEEIKMISDEITILRDGKWISTNDVSKISTEQIISMMVGRDLTERFPKKDNKAKEMILEVKNLTALNQPSIQDVSFELYKGEILGIAGLVGSKRTEIVETIFGMRPKKHGEIILNGKTVKNKSPEDAIKNGFALVTEERRSTGIFSMLDVAFNSVISNLDRYKNKFRLLKNKDIEKDTKWIVDSMRVKTPSYSTKIGSLSGGNQQKVIIGRWLLTEPEVLMLDEPTRGIDVLAKYEIYQLMIDLAKKDKGIIMISSEMPELLGVTDRILVMSNGRVAGIVKTSETNQEEIMELSAKYL

SEQ ID NO: 38630 - DNA, 1491 bp, Thermoanaerobacter tengcongensis MB4
  CDS (1)..(1491): transl_table=11
ttggaacctattttacagatgaaaggtattagtaagaaatttggcaatgtcaaagtattggataatgttgatttaactttatatagaggtcgcgtattagcactattaggtgagaatggtgctggaaaatcaacactaatgaaaattttgtgcggaatttatgaaaaagatgagggaagcatttatttaaaagggaaaaaagtgaatatacgaaatgttagagatgcagaaaaatatggaattgcgatgattcatcaagaacttaatttagttccttctttaagtgttgctgaaaatattttcttagggagagagtatgtgagaacttttaattctattgattggaagaaaataaaacaagaaagtgctaagatccttcatgaattagggatggatctaaatgtggataggttggttaaacacctaagcgttggcgaacaacaaatggtagaaatagcaaggagccttttaatgaatgcagagatattagtgatggatgaacctactgctgcattaacagaaggagagacgagaagattatttgaggtaataaaaaggcttagaaaagaagggaagtctatcatttatatttctcataggatgaatgaaatttttgagatttgcgatgactatattgttttaagagatgggtgccttatttctcaaggggaaattagtgaagttacacgtgatgatttagtaaagatgatggtgggtagggagttaaaagagcattttccttacgagtgttcttctccaggagaagaaatattacgcgtagaaaatttgactgtaaaaggtatgtttgaaaaagtttcttttgttgtgaaaaagggagaagtagttggttttgcggggctaataggtgcaggcagaacggaggtagcaaagacaatttttggcttttataaaaaaacatcgggtaaaatttatttgggaggagaagaagtaaaaataaacagccctagggatgctattgaaaaagggataatgtatttatcagaagacagaagaaatgaaggattaattataaagcatactttgaaagagaatatgactctttcggctttgaaaaaaatttctgactatataggaactattaatttttcaaaagagaggtctatagtaaatgaaatgattcaaaaattgaatataaaatcgttttctcctaatcaaaaaatatttagattaagtggtgggaatcaacaaaaagtagcgattgctaaatgcttgttgacaaatcccaagttaattattctcgatgaaccaacgcgaggtatcgatgtaggagcaaaaaatgaaatatataaattaatcaatgatttaaaaagacagggcattggtataattttaatatcttcggaattacctgaagttttaaatataagtgatagaattatagtaatgcatgaagggaaaataacaggagaaatttctcgcgaagaagctacagaagaaaaagttatgttaaaagctgtaggaggggaataa

SEQ ID NO: 38631 - protein, 496 aa, Thermoanaerobacter tengcongensis MB4
MEPILQMKGISKKFGNVKVLDNVDLTLYRGRVLALLGENGAGKSTLMKILCGIYEKDEGSIYLKGKKVNIRNVRDAEKYGIAMIHQELNLVPSLSVAENIFLGREYVRTFNSIDWKKIKQESAKILHELGMDLNVDRLVKHLSVGEQQMVEIARSLLMNAEILVMDEPTAALTEGETRRLFEVIKRLRKEGKSIIYISHRMNEIFEICDDYIVLRDGCLISQGEISEVTRDDLVKMMVGRELKEHFPYECSSPGEEILRVENLTVKGMFEKVSFVVKKGEVVGFAGLIGAGRTEVAKTIFGFYKKTSGKIYLGGEEVKINSPRDAIEKGIMYLSEDRRNEGLIIKHTLKENMTLSALKKISDYIGTINFSKERSIVNEMIQKLNIKSFSPNQKIFRLSGGNQQKVAIAKCLLTNPKLIILDEPTRGIDVGAKNEIYKLINDLKRQGIGIILISSELPEVLNISDRIIVMHEGKITGEISREEATEEKVMLKAVGGE

SEQ ID NO: 38632 - DNA, 1524 bp, Thermoanaerobacter tengcongensis MB4; identical to SEQ ID NO: 27224
  CDS (1)..(1524): transl_table=11

SEQ ID NO: 38633 - protein, 507 aa, Thermoanaerobacter tengcongensis MB4; identical to SEQ ID NO: 27225

SEQ ID NO: 38634 - DNA, 1506 bp, Thermoanaerobacter tengcongensis MB4
  CDS (1)..(1506): transl_table=11
atgggagaagtattgattaggatggaaaatataagcaaagaatttccaggcgttaaagcattaaaaaatgtaaattttgaaattaaaaaaggagaagtacatgctttagtaggagaaaatggcgccggtaaatcaactttaattaaaattttgtcaggtgtttattcaaaagattctggtaagatatattttgatggacgagaggttgaaatcaattccccaaaagaagcgcagcaactaggtatcagtgtgattcaccaagagttaaatttgtgtttacatttaacagtagcccagaatatattcttgggaagggagttcgtaaaaaatggtgtaatagatgaaaaaaagcaaaatgaagaggcaaaaaaaatattggaaaaattaaatgtaaatatagatccagctgagtatgtaaaaaatctttccgtttcgcgacaacaaatggtagaaatagccaaagcaatttctatggaagcaaaagttattataatggatgaaccgacatctgctatttcagaaaaagaaactgaagaactatttaaagtgattggagaactgaaaaagcaagggaaatctataatatatatttctcatcgccttgaggagctcaataggattgtagatagagttacagttctgcgagatggcgaacatataataacagctaatttccgggatttaacgatagatgatattatacgctatatggtaggaagaaaactagaagaaaaatatcctagagtatatgtaaatcgaggtaaaaaaatactagaggttcatggcctatcacaggggactcgattaaaagatatttcttttgatttatatgaaggagaaattttggggtttgctgggttggtgggagcaggaagaacagaggtggctagggcaatttttggagctgataaatttgataaaggtgagatattaattaatggcaaaaaagtagagattaattcacctatagatgcaataaaaaacggattagcctatgttccagaagatagaaagttgacaggacttgctttgaatctttctgtattagctaatattaccttagctaccatggataatgtagtaaatatgcttagcgtgataaattctgttaaagaaagaaagataggagaaaaaataatacgcgatttaaaaataaaaacaccgtctctttttcaaagagttcaaaatttaagtggagggaaccaacaaaaggttattgttggtagatggttgttaagagaaccgcaaatctacatttttgatgagccaacgagggggattgatgtaggtgcaaagattgaaatttataatattttgaataatttaaagcaagaaggaaaaggaattatagttatatcttccgaattaccagaaataatgggaattacagatagggtagtagtaatgtgcgagggaagaataactgcaattcttgaaactagtaaaactacacaagaggaaataatgtattatgcgacactatataaaaaagaaaggagtaattaa

SEQ ID NO: 38635 - protein, 501 aa, Thermoanaerobacter tengcongensis MB4
MGEVLIRMENISKEFPGVKALKNVNFEIKKGEVHALVGENGAGKSTLIKILSGVYSKDSGKIYFDGREVEINSPKEAQQLGISVIHQELNLCLHLTVAQNIFLGREFVKNGVIDEKKQNEEAKKILEKLNVNIDPAEYVKNLSVSRQQMVEIAKAISMEAKVIIMDEPTSAISEKETEELFKVIGELKKQGKSIIYISHRLEELNRIVDRVTVLRDGEHIITANFRDLTIDDIIRYMVGRKLEEKYPRVYVNRGKKILEVHGLSQGTRLKDISFDLYEGEILGFAGLVGAGRTEVARAIFGADKFDKGEILINGKKVEINSPIDAIKNGLAYVPEDRKLTGLALNLSVLANITLATMDNVVNMLSVINSVKERKIGEKIIRDLKIKTPSLFQRVQNLSGGNQQKVIVGRWLLREPQIYIFDEPTRGIDVGAKIEIYNILNNLKQEGKGIIVISSELPEIMGITDRVVVMCEGRITAILETSKTTQEEIMYYATLYKKERSN

SEQ ID NO: 38636 - DNA, 1578 bp, Streptomyces coelicolor A3(2)
  CDS (1)..(1578): transl_table=11
atggcgggacccgtcctggaaatgcgctcgatcgtcaagacctttcccggtgtcaaagcgctgtcggacgtcacgctcaccgttcgccagggcgaggtccacgccatctgcggggagaacggcgccggcaagtcgaccctgatgaaggtcctctccggagtccacccgcacggcagttacgagggagacgtcctcttcgagggcgagacctgccggttcaaggacatccgggcgagcgagcagcacggcatcgtgatcatccaccaggagctggccctggtgccgtacctgtcgatcgcggagaacatcttcctcggcaacgagcacgccaagcacggactgatcaactggaacgacaccctcaggcacgccaccgaactgctgcgccgggtcggtctcgacgagcacccggagacccgcgtcgccgacatcggcgtgggcaagcagcagctggtggagatcgccaaggcgctgtcgaagaaggtgaagctgctcatcctcgacgagcccacggcggcgctcaacgacgaggacagcggcaaactcctcgacctgatccttcagttgaaggagcagggcatcacctcgatcatcatctcgcacaagctgaacgagatccgccgggtcgccgactcggtcacgatcatccgcgacgggcgctccatcgagacgctcgacgtgaaggcggcggagacgaccgaggaccggatcatcagcgggatggtcggccgcgacctggagaaccgcttcccggagcggaccccgcaccagcccgaggagggcacggccccggccctggagatccgcaactggaccgtgcaccaccccatcgaccagcagcgcaaggtcgtcgacgacgtctcgatcgaggtgcggcgcggcgagatcgtcggcatcgccggactcatgggcgccgggcgcaccgagctggcgatgagcgtcttcggccgcacctacggccggcacgcgggcggcacggtcctcagggacggccacgagatccgcacgaagaccgtcccggaggcggtcgggcacgggatcgcctacgtcaccgaggaccgcaagcactacggcctcaacctcatcgacaccatcaaccggaacatctcgctcaccgcgctgggcaaggtctccaagcggggcgtggtcgacgagcacggtgagcggcaggtcgccgaggactaccgcaagtcgatgaacatcaaggcgccgaccgtcttcgagccggtcggcaagctgtccggcggcaaccagcagaaggtcgtcctgagcaagtggatcttcgcgggtcccgaggtgctgatcctggacgagcccacccgcggcatcgacgtgggcgccaagtacgagatctacacggtcatcgaccgcctggcggccgagggcaaggcggtcgtgttcatctcctccgagctgccggaactgctcggcatgtgcgaccgcatctacacgatggccgcgggtcggctgacgggtgagttctcgcgggccgaggcttcgcaggaagcgctgatgcggcagatgacgaaggacaagcaggaccagaagtcccggaaggacgaagaggtaagccgatga

SEQ ID NO: 38637 - protein, 525 aa, Streptomyces coelicolor A3(2)
MAGPVLEMRSIVKTFPGVKALSDVTLTVRQGEVHAICGENGAGKSTLMKVLSGVHPHGSYEGDVLFEGETCRFKDIRASEQHGIVIIHQELALVPYLSIAENIFLGNEHAKHGLINWNDTLRHATELLRRVGLDEHPETRVADIGVGKQQLVEIAKALSKKVKLLILDEPTAALNDEDSGKLLDLILQLKEQGITSIIISHKLNEIRRVADSVTIIRDGRSIETLDVKAAETTEDRIISGMVGRDLENRFPERTPHQPEEGTAPALEIRNWTVHHPIDQQRKVVDDVSIEVRRGEIVGIAGLMGAGRTELAMSVFGRTYGRHAGGTVLRDGHEIRTKTVPEAVGHGIAYVTEDRKHYGLNLIDTINRNISLTALGKVSKRGVVDEHGERQVAEDYRKSMNIKAPTVFEPVGKLSGGNQQKVVLSKWIFAGPEVLILDEPTRGIDVGAKYEIYTVIDRLAAEGKAVVFISSELPELLGMCDRIYTMAAGRLTGEFSRAEASQEALMRQMTKDKQDQKSRKDEEVSR

SEQ ID NO: 38638 - DNA, 1554 bp, Streptomyces coelicolor A3(2)
  CDS (1)..(1554): transl_table=11
gtgagcagccgcagtccggacgagttgctgcgcatcgagggcatccgcaagaccttccccggcgtggtcgcgctcgacagcgtcgacttcgacctgcgccggggcgaggtgcacgtgctcctcggtgagaacggcgcgggcaagagcaccctcatcaagatgctctccggcgcctacacgcccgacgccgggcggatcctggccggtggcgaggaggtgcgcatccacggtgcgcaggactccgagcgcctcgggatcgccaccatctaccaggagttcaacctggtccccgacctgacggtggccgagaacatcttcctggggcgccagccccgccggctcggcatgatcgaccggaagcggatggacgccgacgcggaggtgctgctgaagcgggtgggggtcaacgtgtctccccgtgcgcgggtgcgtgaactcggcatcgcgcggctccagatggtcgagatcgccaaggcgctcagcctcgacgcgcgcgtgctcatcatggacgagccgaccgccgtactgacctccgaggaggtcgacaagctgttcgccatcgtgcggcggctgcgcgaggacggcgtcgggatcgtcttcatcacccaccacctggaggagatcgccgcgctcggcgaccgggtcaccgtcatccgggacggccggagcgtcgggcaggtgcccgcctccacgcccgaggacgagctggtccggctcatggtggggcggtcgatcgagcagcagtacccgcgcgagcggaccgacgccggtgaggcgctgctcaaggtggaggggctgacgagggacggtgtcttccacgacgtcggcttcgaggtgcgggccggtgaggtcgtcggcatcgcggggctggtcggggccgggcggacggaggtggtgcgggcggtgttcggcgccgatccgtacgacgccgggaccgtgcacgtcgccggtgcgccgctgcggcggcacgacgtgaacgccgccatggccgccgggatcgggctggtgcccgaggaccgcaaggggcaggggctcgtcctcgacgcctccgtcgaggagaacctcgggctcgtcacgctccggtccaccgcccgcgccgggctcgtcgacctcaaggggcagcacacggcggccgagcggatcgccggacagctcggcgtgcggatggccgggctcggccagcacgtgcgcacgctgtccggcggcaaccagcagaaggtcgtcatcggcaagtggctgctggcgaacaccaaggtgctgatcctcgacgagccgacgcgcggcatcgacgtcggcgccaaggtcgagatctaccagctcatcaacgaactgacggccgccggtgccgccgtgctcatgatctccagcgatctgccggaggtgctcggcatgagcgaccgcgtggtcgtcatggcgcaggggcgcgtcgcgggtgaactcaccgccgaacaggccacccaggacgccgtgatggcgctcgccgtcagtacgcacaccggcaactccccgcacagcggcggaacggatggaacggaggcctcccgtggccactga

SEQ ID NO: 38639 - protein, 517 aa, Streptomyces coelicolor A3(2)
MSSRSPDELLRIEGIRKTFPGVVALDSVDFDLRRGEVHVLLGENGAGKSTLIKMLSGAYTPDAGRILAGGEEVRIHGAQDSERLGIATIYQEFNLVPDLTVAENIFLGRQPRRLGMIDRKRMDADAEVLLKRVGVNVSPRARVRELGIARLQMVEIAKALSLDARVLIMDEPTAVLTSEEVDKLFAIVRRLREDGVGIVFITHHLEEIAALGDRVTVIRDGRSVGQVPASTPEDELVRLMVGRSIEQQYPRERTDAGEALLKVEGLTRDGVFHDVGFEVRAGEVVGIAGLVGAGRTEVVRAVFGADPYDAGTVHVAGAPLRRHDVNAAMAAGIGLVPEDRKGQGLVLDASVEENLGLVTLRSTARAGLVDLKGQHTAAERIAGQLGVRMAGLGQHVRTLSGGNQQKVVIGKWLLANTKVLILDEPTRGIDVGAKVEIYQLINELTAAGAAVLMISSDLPEVLGMSDRVVVMAQGRVAGELTAEQATQDAVMALAVSTHTGNSPHSGGTDGTEASRGH

SEQ ID NO: 38640 - DNA, 1518 bp, Streptomyces coelicolor A3(2)
  CDS (1)..(1518): transl_table=11
atggcaccagaaccaccgctgctcagcatgtccggcatcaccaagtcgttccccggagtccgggccctcgacggcgtcgacctcgacgtccaggccggtgaggtgcactgcctcctcggccagaacggcgccggaaagtccaccctcatcaaggtgctggccggcgcccaccagcccgacaccggcaccatccgctggcgcggcgaggaggtcaccctgcgctcgcccatcgcggccatgcgtctgggcatcgccaccatctaccaggaactcgacctggtcgagcacctgtcggtcgccgagaacgtccacctcggtcacgagccgaccgccgccggcttcgtcgtacggggcagggcggccaaggcgtccacggccgcgctgctcaagcggctcgggcaccccgaggtcgacccggggcggctggtcggggagctgtcggcggcgcagcagcagatcgtgtccatggcacgggcgctgtcgcacgacgtacggctgatcgtgatggacgagccgtccgccgcgctcgatccggacgaggtcgacaacctcttccgcatcgtcgccgacctcaccgccgacggagtcgccgtcgtctacatctcgcaccgcctggaggagatccgccgcatcggcgaccgggtcaccgtcctcaaggacggccgcgcggtggccggcgggctgcccgccgagtcgacgccgaccagcgaggtggtggcgctgatgaccggccgcaacgtcgagtacgtcttcccggagaggcccgccgcaccgcccacgggcgaacccgtactgagcgtcaagggactgtcccgggccggggagttcgaccggctcgacctggaggtgcgccccggggagatcgtcggcctcgcggggctggtcggctccggccgctccgagatcctggagacggtctacggcgcccggaaggcgagcaccggtcaggtcctcgtcgacgggcggccgctcaggcccggcagcgtgcgcgccgcggtccgcgccgggctggggctcgcccccgaggaacgcaaggcccaggccctgctgatgctggagtccgtcacccgcaacgtgtcggtctccgccatgtcccgcttctcgcgcggcggctggatcgaccgcggcgccgaactcggcgcggcgcacaaggcgacccgcgagctgtcgctgcggcccgacaatcccgccgtgcccgtgcgcaccctgtccggcggcaaccagcagaaggcggtcctcgcccgctggctgctccgcggctgccgggtcctgctgctcgacgaacccacccgcggcgtcgacgtcggcgcccgcgccgagctgtacgccgtcatccggcgcctcgccgacgagggcctcgccgtcctgctggtctccagcgaggtgcccgaggtgctgggcctcgccgaccgcgtactggtgctgcgcgagggccgcgtcgtgcacgaggcccccgcccgcgaactcgacgaacaccgcgtactcgacctcgtgatggaaggaagcccggcgtcatga

SEQ ID NO: 38641 - protein, 505 aa, Streptomyces coelicolor A3(2)
MAPEPPLLSMSGITKSFPGVRALDGVDLDVQAGEVHCLLGQNGAGKSTLIKVLAGAHQPDTGTIRWRGEEVTLRSPIAAMRLGIATIYQELDLVEHLSVAENVHLGHEPTAAGFVVRGRAAKASTAALLKRLGHPEVDPGRLVGELSAAQQQIVSMARALSHDVRLIVMDEPSAALDPDEVDNLFRIVADLTADGVAVVYISHRLEEIRRIGDRVTVLKDGRAVAGGLPAESTPTSEVVALMTGRNVEYVFPERPAAPPTGEPVLSVKGLSRAGEFDRLDLEVRPGEIVGLAGLVGSGRSEILETVYGARKASTGQVLVDGRPLRPGSVRAAVRAGLGLAPEERKAQALLMLESVTRNVSVSAMSRFSRGGWIDRGAELGAAHKATRELSLRPDNPAVPVRTLSGGNQQKAVLARWLLRGCRVLLLDEPTRGVDVGARAELYAVIRRLADEGLAVLLVSSEVPEVLGLADRVLVLREGRVVHEAPARELDEHRVLDLVMEGSPAS

SEQ ID NO: 38642 - DNA, 1530 bp, Rhizobium etli
  CDS (1)..(1530): transl_table=11
atgagcacgcttgtcgagatggtcggcatcaacaaatcgtttggtttcacgaaagtcctttcggacgttcgcttttccctggaacgtggctccgtgcacgctctgatgggggaaaacggcgcggggaagtccaccctgatgcgtattctggcgggggtatatcagccgggcgcaggaagtgttcggctccgcggggaggaagtcaatttccgttcccctaaggaggcacggttggcgggagtgtcgacggtgtttcaggagtttaccctgatccccaatctcaccgttgctgagaacatgttcctgggccacgaacctcgtcgcattgacggttcgatcgatagcgtcgaggtagtgaaacgcgctcgcgctttgctggctgacgtatttccacagctcgacgcaaccgcgatcgtcgagacactgactgtcgcgcagcagcaggcagtagagatcgcgaagggacttacgtcgaacgcggacgtattcatcttcgacgagccaacggcggcgttgaactcgaccgatgtcgcgcatcttttcaaggttatccgcgaccttaaggctcaacataaggctgtcgtctacatctctcatcgcatgaatgaagtcttcgaactatgcgacaccatcaccgtcatgaaagatggcgcttgggtaaggactgcaagagcgcaggacttcaacttgcaaacgctggtagcgacaatggttggtcgcgaacttcagaacttctttccgccgcgctcgcaggccaccggagcggcaatgctggaggtttcggacttgcgcctcgacgacagcagctcgacagtcactttcgttgtcagaaaaggtgaaatcatcgggctggcagggctcgaaggacagggccagcgagagataatgcgtgccattgtgggcgttgaatcgccaaaggccatcgccgtgtggcgtgccggccccgacaacagcatgcacgtggtgaatgtagggtcagggttcgctcgcgcggtcgcatcaggaatcggttttatccctgaggacaggaagcaggaagggctgttcctgcgcctgcctatctacgacaacatcgcgctgggaaaacagctcaatcggaatatggcaagcgttgcgtggcgatcggtgtcgagggtccgcgaggtgatcaagtcgttacgagttgcggccgccgatcccaatgcgcccgtaggtaaactctcgggcgggaatcagcagaaggtgctgctgggccgctggttgctctccggagtggacatcctcgttattgaggagcccacgcgcggcgtcgacgtcggtgcaaaggcagagatttacagattgctgcgggacttcagtgatcgtggcggtgcggtcgtggtttcgtcgcgcgagcacgctgagcttatagggctctgcgacagcattttggtcgttcatgacaggaagatcgtcgggcagatgtccgcagagggggcgaccgaggaaagaatcctcgagactgcgctgggggcgagtgcgtcaccggatccccgtgctgcggtgcattga

SEQ ID NO: 38643 - protein, 509 aa, Rhizobium etli
MSTLVEMVGINKSFGFTKVLSDVRFSLERGSVHALMGENGAGKSTLMRILAGVYQPGAGSVRLRGEEVNFRSPKEARLAGVSTVFQEFTLIPNLTVAENMFLGHEPRRIDGSIDSVEVVKRARALLADVFPQLDATAIVETLTVAQQQAVEIAKGLTSNADVFIFDEPTAALNSTDVAHLFKVIRDLKAQHKAVVYISHRMNEVFELCDTITVMKDGAWVRTARAQDFNLQTLVATMVGRELQNFFPPRSQATGAAMLEVSDLRLDDSSSTVTFVVRKGEIIGLAGLEGQGQREIMRAIVGVESPKAIAVWRAGPDNSMHVVNVGSGFARAVASGIGFIPEDRKQEGLFLRLPIYDNIALGKQLNRNMASVAWRSVSRVREVIKSLRVAAADPNAPVGKLSGGNQQKVLLGRWLLSGVDILVIEEPTRGVDVGAKAEIYRLLRDFSDRGGAVVVSSREHAELIGLCDSILVVHDRKIVGQMSAEGATEERILETALGASASPDPRAAVH

SEQ ID NO: 38644 - DNA, 1491 bp, Yersinia pestis KIM
  CDS (1)..(1491): transl_table=11
atggaaatattgttagaagtccgtggcttatctgttgagtttcctggtgttaaggcattggactccgtagatttttctctgcaacgcggtgaggttgttgcgttattaggagagaatggcgcaggaaaatcgacattaataaaagcattaaccggggtttataaacgatccgctggtgaggtgctgttggacggcaaggctgtgtgccccattgataccgcagatgcccaactcatggggattggtactgtctatcaagaggtcaacttactgccgaacatatctgttgctgcgaatttatttattggccgtgagccgctacgttgggggctaattgatcacaataaaatgaaccagcaagcagcaaaattgctgacgggttatggtttaacgttagatgttcagcagcctttggctaatttctctattgcaatacaacagattgtagcaatcgcccgcgccgttgacctttccgcgaaggtgctgattctggatgagcctacagcaagtttagatgctaaagaagtcagtatgttactggatatcttgtgccagctacgggaccagggtatcggtatggtttttgtgacccattttctcgatcaggtttatcgaatcagtgatcgcattacagttttgcgaaatggcaagctcgtcggtaccaaaactgtggcagaacttccccggattgagctagtgcaaatgatgctggggcatagttttgatgaacaattactgaaacgtggtgaacacagtattacgaataagaatccattggttgagtttaaaaactatggccgacggggtgtggtagagaattttgatttgtctgtatctcccggtgaaattgtcgggttggccgggttattaggttcaggacggactgaaacagcacagctaatttttggcataacgacacctgatacgggggaagccaaaatacaaggcaaaccggttaaaattagaacaccacgtaaggcatcaaaatttggttttggctactgcccagaagatcgcaaaacagagggtattgttggtgcggcaaccgtaagggaaaacatcattttagccttacaagcgcagcgtgggtggctgaggcccctttctatgcgtgagcagacacaaattgcagacgattttatccagcaactgggtattcgtaccccaagccctgaacagcaaattcaatatctctccggtggaaaccaacaaaaagtattacttgcccgctggcttgccacgaaaccccgatttttaattttagatgaaccgactcgtggtatcgatgtaggtgctcacgccgaaattattcggttgatcgaaaagttgtgtgatgaagggttggcgctgttaattatctcttccgaattagaagaattggcgggttacgctgatcggatcatcgttcttcgtgatcgtcggcatgttgctcaactcgaccacgatgaaatttccgttcctgccattatgcaggcgatcgcggtgcaataa

SEQ ID NO: 38645 - protein, 496 aa, Yersinia pestis KIM
MEILLEVRGLSVEFPGVKALDSVDFSLQRGEVVALLGENGAGKSTLIKALTGVYKRSAGEVLLDGKAVCPIDTADAQLMGIGTVYQEVNLLPNISVAANLFIGREPLRWGLIDHNKMNQQAAKLLTGYGLTLDVQQPLANFSIAIQQIVAIARAVDLSAKVLILDEPTASLDAKEVSMLLDILCQLRDQGIGMVFVTHFLDQVYRISDRITVLRNGKLVGTKTVAELPRIELVQMMLGHSFDEQLLKRGEHSITNKNPLVEFKNYGRRGVVENFDLSVSPGEIVGLAGLLGSGRTETAQLIFGITTPDTGEAKIQGKPVKIRTPRKASKFGFGYCPEDRKTEGIVGAATVRENIILALQAQRGWLRPLSMREQTQIADDFIQQLGIRTPSPEQQIQYLSGGNQQKVLLARWLATKPRFLILDEPTRGIDVGAHAEIIRLIEKLCDEGLALLIISSELEELAGYADRIIVLRDRRHVAQLDHDEISVPAIMQAIAVQ

SEQ ID NO: 38646 - DNA, 1515 bp, Yersinia pestis KIM; identical to SEQ ID NO: 27230
  CDS (1)..(1515): transl_table=11

SEQ ID NO: 38647 - protein, 504 aa, Yersinia pestis KIM; identical to SEQ ID NO: 27231

SEQ ID NO: 38648 - DNA, 1524 bp, Yersinia pestis KIM
  CDS (1)..(1524): transl_table=11
atgaaccacagacctgacattgtcatgcgtgctgaggacatttcaatgcgttttcctggcacattggcgctcgatagcgtcaattacactgtttatcgcggcaaagttaacgtcattattggcgaaaacggggccggtaaatcaacgctgatgaaaattctggccggggtgcagcagcaaacctccgggcaaatttacctaaacgggcagaaggtcagcattgccaatactcgtgaggcggcagcgctgggcattggcatggtgcatcaggaactgaatttatcggaaaacctcaatgtggcggaaaatatttttcttggccgcgaaatccagcacggcttgaaaccgatcaatcaggcagcgcaggaacgggttactgaacaactgatggtgcgtcttgatcaggtcatttcaccacaagagaaggtgtcaaacctgaaagtgggccaacaacagttgattgaaattgccaaggcactggcggagcaggccgatatcctgattctggatgagccgacctcggccctcagtaaaacggaggtggatgttctgttccgtgtgatccgtgaactcactcggcaaggggtttccatcgtttatatttctcaccgattggaagagttaatggcgattggcgactacatcactattttacgcgatgggcgctttcaggctgaagccgcagtaaaagacattgatgtgccgtggattgtgcgtgaaatgctgggtagcgatccggtttccagcttccttcgtccggggcgtacctttggtgaaccaatgatggaggtggaagatgtcaccctcatcaatgaatccggtaataccgtggttaatcatgtctcattgcacgtccgggcaggcgagattgtcggtatttatggcctgatgggggcgggccgtaccgaattgttcgaatgtttactgggcacgcaacaaaactatcttggcaccgttcgcctcaatggcacggtcatgaatgccaaaacctccaccgcagagcgtatccgctttgggatgagcctggtgccggaagatcgtaaaaaagccgggattttccctgcttcatcggtcgcctgtaatttgaccatctccagcttatggcgtcggctgaaacaccgttttgctatctggcaggagagtgaagtgcaagtggtggcagcgactatcggtgagctgtcgatcaaagtttcttcacctgatgtcgaaattcaggcactcagcgggggcaatcaacaaaaagtggtcattggccgctcgttactgacccgcccgaacattttgctactggatgaaccgacgcgtggcattgatgttggcgcaaaagcggatgtgtttgaaatgatggtgaaactctctgagcaggggatcggcattctgttttccacctccgacctaaaagaaattatggcggtatccgaccgcattctggtgatgtcgaacggcaaactgacggcaaatttatcccgtcaatcggccagtgaatcggcattggttacagcaagcgcacaagggtttgaatga

SEQ ID NO: 38649 - protein, 507 aa, Yersinia pestis KIM
MNHRPDIVMRAEDISMRFPGTLALDSVNYTVYRGKVNVIIGENGAGKSTLMKILAGVQQQTSGQIYLNGQKVSIANTREAAALGIGMVHQELNLSENLNVAENIFLGREIQHGLKPINQAAQERVTEQLMVRLDQVISPQEKVSNLKVGQQQLIEIAKALAEQADILILDEPTSALSKTEVDVLFRVIRELTRQGVSIVYISHRLEELMAIGDYITILRDGRFQAEAAVKDIDVPWIVREMLGSDPVSSFLRPGRTFGEPMMEVEDVTLINESGNTVVNHVSLHVRAGEIVGIYGLMGAGRTELFECLLGTQQNYLGTVRLNGTVMNAKTSTAERIRFGMSLVPEDRKKAGIFPASSVACNLTISSLWRRLKHRFAIWQESEVQVVAATIGELSIKVSSPDVEIQALSGGNQQKVVIGRSLLTRPNILLLDEPTRGIDVGAKADVFEMMVKLSEQGIGILFSTSDLKEIMAVSDRILVMSNGKLTANLSRQSASESALVTASAQGFE

SEQ ID NO: 38650 - DNA, 1491 bp, Yersinia pestis KIM
  CDS (1)..(1491): transl_table=11
atgacgcctttattagagttaaagcagataaaaaaatcttttccgggtgttaaagcactggatggaattgatctcaccattcaacgcggagaggttcatgcgttgctgggggagaatggggcaggcaaatctacactggttaaaataatgtgtggtatttatcagccagattctggggggatttttctggaaggtcaacgctgtcgctttgcgaattatcgtgatgccattgatgcgggtattgggattatttttcaagagttctccctgatcccctatatgaatacgattgataatatttttcttaatcgagaaataaagaatcgttgggggttattagatcgccgtgaaatgcggcgcaaggcccgcgctattttcaagcgcctgacggtggatattgatcttgattgccccgtggaacaactcagtgtggcgcaacagcagtttgtcgagatagccaaagctctgtcgttggatgcgcgcattctggtcttggacgaacccacggcgacgctgacaccgggtgaagccgaacatttattcagcatcatgcacgatctgaaattgctcggtgtcggtatggtgtttatttcgcatcatctggacgaaattttcacgatttgtgaccagatcacggtgctgcgtgatggcgcttatattcagacactgccggctgccgagactaatgtcgaagagctggttaagctgatggtcgggcgcaaaatcgagaataccttcccggtgaaatcgcatccggtagacacctcggtgcgggtgctggaggcgacggttcagcacacaaaacatgtgatggaaaacagcttccatctgtataaaggcgaaatattggggtttgccgggttggtggggtcaggccgtactgagctgatgtccgcactgatcggtgcgcgctcctgctatcaaaagagtgtcagcctcaatggtcagcccaccgtgctacgtaatccagcgcaggcgttggatcacggtattggtctgttaccggaaagccgtaaaaccgaagggctggtcttgccgttttccgtcgcccaaaacattacgcttaatcggcatgaaaaacgcggcaaaatcttcgttaatgcaggtaaagagcacgatatcgtgcagcgattaattcgcgcggttggcgtaaagacaccggatgccgatacggctgtgagtaccttgagcggtggcaatcaacaaaaagtggtaattgcccgctggcttaacaacgattgcgacattcttattttcgatgaacctacacggggtatcgacgtgggggccaagtctgaaatttatcaattaatgcaacaactgacgcagaaaggcatatctatcatcatgatttcatccgaattaccggaaattattggcgtttgtgatcgcgtcctggttttccgtggtgggcacattgttgccgaactggcgggtgatgaaattgaatctaataacatcatgcttcacgcaacagggagtgcattatga

SEQ ID NO: 38651 - protein, 496 aa, Yersinia pestis KIM
MTPLLELKQIKKSFPGVKALDGIDLTIQRGEVHALLGENGAGKSTLVKIMCGIYQPDSGGIFLEGQRCRFANYRDAIDAGIGIIFQEFSLIPYMNTIDNIFLNREIKNRWGLLDRREMRRKARAIFKRLTVDIDLDCPVEQLSVAQQQFVEIAKALSLDARILVLDEPTATLTPGEAEHLFSIMHDLKLLGVGMVFISHHLDEIFTICDQITVLRDGAYIQTLPAAETNVEELVKLMVGRKIENTFPVKSHPVDTSVRVLEATVQHTKHVMENSFHLYKGEILGFAGLVGSGRTELMSALIGARSCYQKSVSLNGQPTVLRNPAQALDHGIGLLPESRKTEGLVLPFSVAQNITLNRHEKRGKIFVNAGKEHDIVQRLIRAVGVKTPDADTAVSTLSGGNQQKVVIARWLNNDCDILIFDEPTRGIDVGAKSEIYQLMQQLTQKGISIIMISSELPEIIGVCDRVLVFRGGHIVAELAGDEIESNNIMLHATGSAL

SEQ ID NO: 38652 - DNA, 1539 bp, Yersinia pestis KIM
  CDS (1)..(1539): transl_table=11
ttgtttttggttcgttcatatgaggcattcatgatccgtaacgagatactggcaaaaaaaccggactatctattagaagcgacgggactaaaaaaatcctttggcgatgtgatcgcgctaaacaatgctgaattctgtttaaaacggggttctatccatgcgctttgcggtgggaacggtgccggtaaatcaacatttcttggcctattaatgggatttattcagcctgatgatggggcgtttttcatcaacgggcaatactgcgaattcgactcaccgggacaagccctagccgcagggattaccattgttcaacaagagctcagtggggtacaggatctgtctgtggccgaaaatatttatctgggttctgagccaaggcgctttggtattgtcgattttcgtgcgcttaaccgccaggccgatgtgttattacacgagctgggtttcgccatttcacccaaagccaaaatgcgcagcctgagcgtagcagagcaacaacgggtggaaattgccaaagcgctgtcacatacccatgccgatatcatcattatggatgaacccacctccgcattaggtgaagaggatgcgcaaaaactgtttcagaccataaaaaaactggcctctctgggaaaaggggttatttatgtctcccaccgcttgtcagaaatatttcaaattgcagacagctacacggtatttcgagatggttgttatatttgtgaaggagagacgagtcacatcactcgcgaacaactgattgagcatattattggtggcgagattgatggtgagttctccaaatacaatactccaaccaatgtgccactctttaaagcctctggcatatgttggaaatcgaaagtgaatgatgtcagcctgacattacattgcggtgaaattttagggatttatggcttagtaggatcggggcgcagtgagtttcttaatctgctgtttggtcttgagcgtgctgatcacgggagcatccatatcggtgatgagatattactgaaacacacaccagaaaaagcaatcaacgccggtatcgcctatgtgaccgaagatcgtcaagagacaggattagtattgaaccattcggtatcggaaaatattaatatatcctcattaaacgtcattagtcgtatgagtatcattaatgaaaatgatattcagcgccgtgctgaccacacgatccgtatctttaatattaagacaccgagtcgccaacaacgagtggctaatttaagcggtggtaatcaacaaaaggtggtgttaggccgctgggcactgttagaccctaaagttttattattagatgagccaaccaggggaattgacattggggcaaaaaaagaaatttatcgctttatgtcggattttgccctcaaaggaaaaggcattgttatggtctcctccgagctttctgaaattattggcatgagcgacagaatcttggtttttaaaaaagggaaaatagtcggtgaaattacgggcactgaggcaacacaggccaaattaatgtcgatggcggtataa

SEQ ID NO: 38653 - protein, 512 aa, Yersinia pestis KIM
MFLVRSYEAFMIRNEILAKKPDYLLEATGLKKSFGDVIALNNAEFCLKRGSIHALCGGNGAGKSTFLGLLMGFIQPDDGAFFINGQYCEFDSPGQALAAGITIVQQELSGVQDLSVAENIYLGSEPRRFGIVDFRALNRQADVLLHELGFAISPKAKMRSLSVAEQQRVEIAKALSHTHADIIIMDEPTSALGEEDAQKLFQTIKKLASLGKGVIYVSHRLSEIFQIADSYTVFRDGCYICEGETSHITREQLIEHIIGGEIDGEFSKYNTPTNVPLFKASGICWKSKVNDVSLTLHCGEILGIYGLVGSGRSEFLNLLFGLERADHGSIHIGDEILLKHTPEKAINAGIAYVTEDRQETGLVLNHSVSENINISSLNVISRMSIINENDIQRRADHTIRIFNIKTPSRQQRVANLSGGNQQKVVLGRWALLDPKVLLLDEPTRGIDIGAKKEIYRFMSDFALKGKGIVMVSSELSEIIGMSDRILVFKKGKIVGEITGTEATQAKLMSMAV

SEQ ID NO: 38654 - DNA, 1500 bp, Yersinia pestis KIM
  CDS (1)..(1500): transl_table=11
gtggatcagtacgctattgaagtcatacaggtgacgaaaagcttcggggggattcacgcgctgaagtcaattaatctgcaaattcgcaccggtagcattcatgccattatcggcgagaatggtgccgggaaatcgacattaatgaagatcctgtcggggatttacaccaaagacagcgggcgcattatgatccacggagaggagaaaaattttacttcaccgatccacagtaaagaaagccgtattggcattatttatcaggaactggcgttatcgccggatctgacggtagcagagaatatttttctcgacgatcttggttttggcaccggcatgatcaactggaagcgtttgaatgaaaaagccagcctcatcctgaatgaactgggatttcaaatcgatccccgcgccagagtgggggatctgagcgttgcctatcaacagatggtcgaaatcgctaagtcgctggccaaagatgtcaacattctgatccttgatgaaccttcagcagtactgtcaggtaaagaggtcgcgatattgtttacccagctacgcaagttaaaggcacgcggggtgaccatcatttatatttcacatcggctggaggaattgatggttattgctgatgtgatcaccgtcattaaagatggcgagaccgtcaagaccttagatccccagtcctgtagcgaagacgaaattatcaccagcatggtagggcgcaaactggaaagcctctatcccgagaaaaatgtgccaggtaatgaggtggtcttggaggtcaaagccctctcaacccgtgcgctgctgcatggtattaatctgacattgcataaaggcgagatcgtcggtttagcgggcttggtcggggcagggcgtagcgaggtcgcacgttgtctctttggcattgacaagatagcggggggaacggtgtccaaggccggtacgcctattcagattaatcacccgtcacaggcgatgtcccatgggattggtctggtgcctgaaagccgtaaggagcagggggcgattttggtacgcccaatccgcgaaaatatgacgttatcgaatctgaaggcggttagcggctggatgggttttattcgtcgtcgtcaggagcgagagaccagccagaagctacaacaaaaactggccatcaaactggggtcggttgaggatcccatcgccagcttaagtggtggtaatcagcaaaaagtggtcatcgctaaatggttgaacacggattgccatattttgatcttggatgaacctacccgcggtgttgatgtgggagccaaggctgaaatttataacatcattcaccaattggccgaacgcggttattccattttagtgatctcatcggagatggttgaagtgattaatctttgtcatcgcatttatgtgatgagtgaagggcgcattaccaaagagctgcaacacgatgagatttcagaagaaaatatcatgcgctatgccattcccaagcgcgagacaatatga

SEQ ID NO: 38655 - protein, 499 aa, Yersinia pestis KIM
MDQYAIEVIQVTKSFGGIHALKSINLQIRTGSIHAIIGENGAGKSTLMKILSGIYTKDSGRIMIHGEEKNFTSPIHSKESRIGIIYQELALSPDLTVAENIFLDDLGFGTGMINWKRLNEKASLILNELGFQIDPRARVGDLSVAYQQMVEIAKSLAKDVNILILDEPSAVLSGKEVAILFTQLRKLKARGVTIIYISHRLEELMVIADVITVIKDGETVKTLDPQSCSEDEIITSMVGRKLESLYPEKNVPGNEVVLEVKALSTRALLHGINLTLHKGEIVGLAGLVGAGRSEVARCLFGIDKIAGGTVSKAGTPIQINHPSQAMSHGIGLVPESRKEQGAILVRPIRENMTLSNLKAVSGWMGFIRRRQERETSQKLQQKLAIKLGSVEDPIASLSGGNQQKVVIAKWLNTDCHILILDEPTRGVDVGAKAEIYNIIHQLAERGYSILVISSEMVEVINLCHRIYVMSEGRITKELQHDEISEENIMRYAIPKRETI

SEQ ID NO: 38656 - DNA, 1524 bp, Yersinia pestis KIM
  CDS (1)..(1524): transl_table=11
atgaataaagtccccctcttggagatgcgtaatattaccaagtcgtttggcaaatttcaggcgcttaaaggtgtcgatttgacggtgttttccggcgagatccacgcgctgatgggcgaaaacggggcggggaaaagtaccctgatgaagatcctcgctggcgcatataccaccaccagcggcgagatccttattgagggtaggccttggtccatcaaaggcccaaaagatgcgctgaatgcaggtattagtttgatttaccaagagatgcagcttgcgcctaatctgaccgttgcggaaaacattttccttggcagcgagctttcccggggagggctggtgcagcgtaaagagatggtgatgcaaactcaggcggttatcgaccgcctcggcgctcagtttaaagccagcgatttagtgatggggcttactatcgccgaacaacagcaggtcgagattgctcgtgcacttcatcgtaacagccgcattttagtgatggatgaacccacagcggcgctttctactcgtgaaacgcatcgcctattcgaacttattttgcggctgcgcgatgaggggatggccattatctacatcagccatcgtatggcggaagtgtatgaactttctgaccgtgtgagcgtactgcgcgacgggcaatacgtcggcagcctgatgcgcgccaacctcaacgccaacgaactggtgcgcatgatggtggggcgtccgcttagcgatctgttcaataaagaacgggatattccactcggtcatttacgccttaaggttcatcacctgacggatggtgccaaagtgcaggcggtgagtttacaggtccgttccggtgaaatcgttgggttagcggggctggtgggtgcagggcgttcggagctggcgcaactgatttttggcgtgcgcaaagccaccggaggaacgatagagatagatggcgtaccgttggtcattcactcccctcgtgaagccattcgccacggtattggttttctgaccgagaaccgcaaagagcaagggctgtttttggaactggccgcgcaggacaacatcactatggcaaccctggagcgggacgcctgttacggcctgctcgatcgcaaaaaagcccgtgccatttcagacgacgccatcaatcggttgaacatacgtgtacctcatgcgcaggtgcgtgccggaggcttgtccgggggtaaccagcaaaagctgctgatttcccgttgggtagcgattagcccacgcattcttatccttgatgagccaacacgtggagtggacgtcggcgctaaaagcgagatttaccgcatcatgagccagatggcgcgcgagggggtggcgattttgatgatttccagtgagttgcccgaggtggtagggatgagcgaccgggtgtacgtgatgcatgaaggacgtattgcaggggaactacatcaccctgatatcacgcaggaaaatattatgacgctggcaactggcgtgaccgaggaccataaaaaagaggtttaccatgactaa

SEQ ID NO: 38657 - protein, 507 aa, Yersinia pestis KIM
MNKVPLLEMRNITKSFGKFQALKGVDLTVFSGEIHALMGENGAGKSTLMKILAGAYTTTSGEILIEGRPWSIKGPKDALNAGISLIYQEMQLAPNLTVAENIFLGSELSRGGLVQRKEMVMQTQAVIDRLGAQFKASDLVMGLTIAEQQQVEIARALHRNSRILVMDEPTAALSTRETHRLFELILRLRDEGMAIIYISHRMAEVYELSDRVSVLRDGQYVGSLMRANLNANELVRMMVGRPLSDLFNKERDIPLGHLRLKVHHLTDGAKVQAVSLQVRSGEIVGLAGLVGAGRSELAQLIFGVRKATGGTIEIDGVPLVIHSPREAIRHGIGFLTENRKEQGLFLELAAQDNITMATLERDACYGLLDRKKARAISDDAINRLNIRVPHAQVRAGGLSGGNQQKLLISRWVAISPRILILDEPTRGVDVGAKSEIYRIMSQMAREGVAILMISSELPEVVGMSDRVYVMHEGRIAGELHHPDITQENIMTLATGVTEDHKKEVYHD

SEQ ID NO: 38658 - DNA, 1479 bp, Streptococcus agalactiae 2603V/R
  CDS (1)..(1479): transl_table=11
atgaaaattgacatgaggaatatctccaaatccttcggtactaataaagttctagaaaagattgatttggaattacaatctggtcaaatacacgcgcttatgggtgaaaatggtgcgggtaaatcaaccttaatgaacattctaacaggactttttccagcaagtacaggaactatttatattgatggcgaggaacgaactttttcaaaccctcaagaagcagaggaatttggtattagttttattcaccaagagatgaatacttggccggaaatgactgtcttggaaaatctctttcttggacgtgaaatcaagacaacttttggcttactcaatcaaaaattaatgagacaaaaagcacttgaaacttttaaaagattaggtgtgactattcccctagacatcccgattggtaacttgtctgttggacaacaacaaatgattgaaatcgccaaaagtctcctaaaccaactctctattttggtaatggatgaaccgactgctgctttaacagatcgtgaaactgaaaatcttttccgagttatccgaggtttgaaacaagaaggagtgggcgttgtctatatctcccatcgaatggaggaaatttttaaaatcactgacttcgtaaccgtcatgagagatggtgtcattgtagatacaaaagaaacatcactcacaaattctgacgaattggttaaaaaaatggttggccgaaaattggaagattactatcctgaaaaacattctgaaattgggcctgttgcttttgaagttagtaacctctgtggagataatttcgaggacgtttccttttatgtccgtaaaggcgagattcttggattttctggattaatgggagctgggcgtactgaagttatgcgaactatctttggaattgataaaaagaagtctggtaaggtgaaaattgatgaccaagaaatcactattactaccccaagccaagctatcaagcagggcattggttttttgaccgaaaatagaaaagatgaaggtctcatcctagacttcaatatcaaggacaatatgactctccctagcactaaagattttagcaaacatggtttctttgatgaaaaaacaagcacaacatttgtgcaacaattgattaatcgtctctacattaaatcagggagaccagatttagaggttggaaatctttctggaggtaaccaacaaaaggtcgttctcgctaaatggattggtattgctcctaaagtcttaattcttgatgagccaacgcgtggtgttgatgtcggtgctaaacgagagatttaccaattaatgaatgaactagcagacagaggtgttccaattgtcatggtatcatcagacttacctgaaattctaggtgttagtgaccgcatcatggtaatgcacgaaggtcgaatcagtggagaactcagtcgaaaagaagctgaccaagaaaaagttatgcaactagccacaggaggtaagtaa

SEQ ID NO: 38659 - protein, 492 aa, Streptococcus agalactiae 2603V/R
MKIDMRNISKSFGTNKVLEKIDLELQSGQIHALMGENGAGKSTLMNILTGLFPASTGTIYIDGEERTFSNPQEAEEFGISFIHQEMNTWPEMTVLENLFLGREIKTTFGLLNQKLMRQKALETFKRLGVTIPLDIPIGNLSVGQQQMIEIAKSLLNQLSILVMDEPTAALTDRETENLFRVIRGLKQEGVGVVYISHRMEEIFKITDFVTVMRDGVIVDTKETSLTNSDELVKKMVGRKLEDYYPEKHSEIGPVAFEVSNLCGDNFEDVSFYVRKGEILGFSGLMGAGRTEVMRTIFGIDKKKSGKVKIDDQEITITTPSQAIKQGIGFLTENRKDEGLILDFNIKDNMTLPSTKDFSKHGFFDEKTSTTFVQQLINRLYIKSGRPDLEVGNLSGGNQQKVVLAKWIGIAPKVLILDEPTRGVDVGAKREIYQLMNELADRGVPIVMVSSDLPEILGVSDRIMVMHEGRISGELSRKEADQEKVMQLATGGK

SEQ ID NO: 38660 - DNA, 1491 bp, Oceanobacillus iheyensis HTE831
  CDS (1)..(1491): transl_table=11
atgaagattgtcatggaaaatattcataaatcttttggctccaataacgtgcttgaaggtgtagatttttcacttgaaccaggagagattcatgcattaatgggggagaacggtgccggaaagtctacattaatgaatattcttactggtctattcccttcaaatcaaggttcaataacgatagatggcgtaaaaactcaatataaagattctaaggaatcggagcaagcaggaattgcatttattcgacaagagttaaatattttgccacagatgacagtattagagaatttatttattggtaaagaaatgactaattcatttggatttttacgagaaaaagtaatgaaggaaaaagctgaagaggtatttagtagattagacttttcaattccatttgacaaagaagcaggcgaatgctctgttggggaacaacaactaattgaaattgcaaaagcgctgatgttagatgccaaaattattatcatggatgaaccaactgctgctctaacggatagagaaatcgataagttatttgaaattatgaaagagcttacacaacaaggtgttgcattggtttatatttcgcatcgtatggaagaaatttttgcgatttgtgatcgaattacagtaatgcgagatgggatatcggtcaagacttcgtggattaaagatacaaattataacgagattgtaaaacaaatggtaggaagagaattggatgaacgttacccagaacgaacgccaacatttggtaagcccgtattacaagtaaacaattttagtcgtaaaggttattttaacgatataaaattctccgtaagagaaggagaaatacttggtgtatccggactgatgggtgctggccgtacagagattatgcgagccatatttggaatagatgaagtagatcaaggagaaatactgcttgatggaaagaaacttaccattaaagatccgacagatgcgatgaaagcaggattggcatttattacagaaaatcggaaagatgaaggacttgttttagacttttcgattagagagaatattggattgtcgaatttaaacagtttctctaataagggatttatcaaaggtaaagacgaaaaagattttgttgagcttatgataaagcggttacaaattaaaacacagacccaagagctgcctgtaggaaacttatctggaggaaatcagcaaaaggttgttatagcaaaatgggtaggcacatctcctagagtattgatcatggacgagcctaccagaggaatagatgttggtgcaaagcgagaaatttatcagttaatgaatgaattaacagagagaggcttagctatcataatgatttcttctgatttgcctgaagtactcggaatgagtgaccgaataatggttatccacgaaggagagatttcaggagaattagttagagaagaggcgacgcaagaaaaaataatgacatatgctacaggagggaatggacatgaataa

SEQ ID NO: 38661 - protein, 496 aa, Oceanobacillus iheyensis HTE831
MKIVMENIHKSFGSNNVLEGVDFSLEPGEIHALMGENGAGKSTLMNILTGLFPSNQGSITIDGVKTQYKDSKESEQAGIAFIRQELNILPQMTVLENLFIGKEMTNSFGFLREKVMKEKAEEVFSRLDFSIPFDKEAGECSVGEQQLIEIAKALMLDAKIIIMDEPTAALTDREIDKLFEIMKELTQQGVALVYISHRMEEIFAICDRITVMRDGISVKTSWIKDTNYNEIVKQMVGRELDERYPERTPTFGKPVLQVNNFSRKGYFNDIKFSVREGEILGVSGLMGAGRTEIMRAIFGIDEVDQGEILLDGKKLTIKDPTDAMKAGLAFITENRKDEGLVLDFSIRENIGLSNLNSFSNKGFIKGKDEKDFVELMIKRLQIKTQTQELPVGNLSGGNQQKVVIAKWVGTSPRVLIMDEPTRGIDVGAKREIYQLMNELTERGLAIIMISSDLPEVLGMSDRIMVIHEGEISGELVREEATQEKIMTYATGGNGHE

SEQ ID NO: 38662 - DNA, 1542 bp, Bifidobacterium longum NCC2705; identical to SEQ ID NO: 27234
  CDS (1)..(1542): transl_table=11

SEQ ID NO: 38663 - protein, 513 aa, Bifidobacterium longum NCC2705; identical to SEQ ID NO: 27235

SEQ ID NO: 38664 - DNA, 1554 bp, Bifidobacterium longum NCC2705
  CDS (1)..(1554): transl_table=11
atgtcatcaaatgacaccatcttgacgatggaaaacatcacgaagacgttcggtccggtcaaagccctcaccgatgtgaatctttccgtcgatcgcggcgagatccacgccatctgcggcgagaacggtgcaggcaaatcgaccctgatgaacgtgctttcgggtgtgtacccatacggtagctattccggcaaaatcacctttgatggcaaggaatgcaaataccatactattaatgattccgaggccgacggcatcgtaatcattcatcaggaactggcgttgagcccgttcctgtccattgcggagaacctcttcatcggcaacgagcaggccaagggtggcgtgatcgactgggacaagacccgcgccgaggcgaagaagctgctcgatcgtgtgggacttcccgaagacccggataccagggttatggacatcggcgtcggcaagcagcagctcgtcgaaatcgccaaggcattgtccaaggacgtgaagctgctcatcctcgatgagccgaccgctgcactgaacgatgaggattccgcccacctgcttgacctggttcgtcagctacgtgacgagcagggcgtgaccagcatcatcatcactcataaactcaacgaggtcgccgccatcgccgacaatgtcaccatcattcgagacggttcgaccgtcggtgtgatgtacgtgacgccggagacgccgctcgaccaggaagaactcatccgcaagatggtgggtcgtccgctgcacaacctgtacccgaaccacccctccaataccccgggcgaggaatacctgcgcgtcgaggattggaccgtgcatcatccgctcgacgcggagcgcgtgatcgtagaccatgcgaacatcaacgtgcacgccggcgagatcgtcggtctggcgggtctgatgggtgcgggtcgtaccgaaatggccatgtccatcttcggccactcttacggttccaacatctccggcaaggtgttcgtcaagggcaaggaagtcaagatgcccaacgtgcagtccgcgattgacgcaggtctcgcctacgccaccgaggatcgtaagggcaacggtctgaacctgctgcagaacatccgagagaacgcatccctggcctccctgaccaagatcagcaagggcggggttgtggacgacaaccttgagcgcaaggaagtcgaacagtaccgcaaggacttcaacatcaagtgtcatgacatcgatgtgaatgtctccaccctctccggtggtaaccagcagaaagtgctgctcgccaagtgggttatctcgcagccggacatcctcatcctcgatgagccgacccgaggcatcgacgtcggcgccaagtatgagatctacgaaatcatcgataagcttgccgatgcaggcaaggccgtcatcgtgatttcctccgagctgcctgagctcatcggtatctgcgaccgcatttacacggtgtcctacggtgtcgtcaccgacaatgtcgagaagaatggatttacccaggaatacctgatgaagggtatgaccaaggaaagggaggtggcagcctga

SEQ ID NO: 38665 - protein, 517 aa, Bifidobacterium longum NCC2705
MSSNDTILTMENITKTFGPVKALTDVNLSVDRGEIHAICGENGAGKSTLMNVLSGVYPYGSYSGKITFDGKECKYHTINDSEADGIVIIHQELALSPFLSIAENLFIGNEQAKGGVIDWDKTRAEAKKLLDRVGLPEDPDTRVMDIGVGKQQLVEIAKALSKDVKLLILDEPTAALNDEDSAHLLDLVRQLRDEQGVTSIIITHKLNEVAAIADNVTIIRDGSTVGVMYVTPETPLDQEELIRKMVGRPLHNLYPNHPSNTPGEEYLRVEDWTVHHPLDAERVIVDHANINVHAGEIVGLAGLMGAGRTEMAMSIFGHSYGSNISGKVFVKGKEVKMPNVQSAIDAGLAYATEDRKGNGLNLLQNIRENASLASLTKISKGGVVDDNLERKEVEQYRKDFNIKCHDIDVNVSTLSGGNQQKVLLAKWVISQPDILILDEPTRGIDVGAKYEIYEIIDKLADAGKAVIVISSELPELIGICDRIYTVSYGVVTDNVEKNGFTQEYLMKGMTKEREVAA

SEQ ID NO: 38666 - DNA, 1536 bp, Brucella suis 1330
  CDS (1)..(1536): transl_table=11
atgactgcgccgcgtcaggctggcgagcctgctcttctggaagccgtttctctgtccaaatcctttgggccggtgcaggttctggaaaatataaatctgcgcgtcaacggtggtgaaattcacgcgatcattggtgaaaatggcgcgggtaaatccacgctcatgaaaattctggccggtaacgaacgccagacgggcagagaaatccgtattgatggcaagccggtttccttttccagcccggcagcagcagaggcacgaggcatcgtgctggtgcatcaggaaatcctgcttgcaccagacctgacagttgcgcagaacatatatctcggtcgtgaacttgggggtaagcggggacgcggactactggtcgatgatcggtcgatgcgcgagggcgcgcgcagggctatccgtgatctcggcgctgaaatagacccggatgccgtggttgcgacgctatcaattgcccaacgccagcttgtgcagattgcacgggtgctgttggtgccgcatcgcctcgtgatcttcgatgagccgacggcttcgctcacgcctttcgagacggaagcccttctgaaagtcatccgtgatattcgagccaagggcgttgcggttctctatatttcgcatcggctgccggaagtgaaggagatagccgaccgtgtgactgttctgcgtgacggcaagctggtttccagccatttggcatcctctttgcagccggctgatatggcgcggctgatggttgggcgcgatgtcgccaagctctatcccgatcgcgcaagccggtatgacagcgccgctattctggaagtagaaaacttcagtgtgccgggcttcgtgcgcaatgcaagtttttgtctgaaccgtggcgagatacttggctttgccggtctggttggtgcgggccgaacggagcttatggaaggaatcgtcggtttgcgcccagccaagggagaattgcgccatgatggtaggctggtgcacttcaacaatgcacatgacagccagcaggcgggcatcgtttatctgagcgaagaccgtaaaggcaaagggctgctcctgtcgaaagatctcggcaccaatctcaccctggcttcacttgacaggttcgtgcgcggcctccagatcgaccgcaaccgcgaacgtgcggcgttggatgaggcgatccgtgcattcgacatacgcacgggccgtaaggatatcctggccggtcagctttcaggcggcaaccagcagaaactgcttcttgccaaaatgatgatgcttaccccgtccatcatcatcatagacgagccgacgcgaggcatccatgtcggcacgaaggagcagatttatcagttcattgccaacctggcggatgaaggaaaatccatcattgttgtatcgtccgaaatgccggaactgatcggtatttgcgaccgtatcgtggtgatgcgggaggggcaaattgccggggaggtgagcggcgcaggcatgacggaacatgaaattgtggcgctcgccaccggcgttggcgccaacgaggctgcatga

SEQ ID NO: 38667 - protein, 511 aa, Brucella suis 1330
MTAPRQAGEPALLEAVSLSKSFGPVQVLENINLRVNGGEIHAIIGENGAGKSTLMKILAGNERQTGREIRIDGKPVSFSSPAAAEARGIVLVHQEILLAPDLTVAQNIYLGRELGGKRGRGLLVDDRSMREGARRAIRDLGAEIDPDAVVATLSIAQRQLVQIARVLLVPHRLVIFDEPTASLTPFETEALLKVIRDIRAKGVAVLYISHRLPEVKEIADRVTVLRDGKLVSSHLASSLQPADMARLMVGRDVAKLYPDRASRYDSAAILEVENFSVPGFVRNASFCLNRGEILGFAGLVGAGRTELMEGIVGLRPAKGELRHDGRLVHFNNAHDSQQAGIVYLSEDRKGKGLLLSKDLGTNLTLASLDRFVRGLQIDRNRERAALDEAIRAFDIRTGRKDILAGQLSGGNQQKLLLAKMMMLTPSIIIIDEPTRGIHVGTKEQIYQFIANLADEGKSIIVVSSEMPELIGICDRIVVMREGQIAGEVSGAGMTEHEIVALATGVGANEAA

SEQ ID NO: 38668 - DNA, 1461 bp, Brucella suis 1330
  CDS (1)..(1461): transl_table=11
gtggaggggctcaagaagtcctttggcggtgttgctgccttgcgggatgggcggctgcaattgcgtaccggctcggtacatgcgctgtgcggcggcaatggcgcgggcaaatccacgtttttgaaaatcctgatgggcattcatgcccgcgatggtggacatatccgccggcgtggaaaagaggttacgtattccagccccgccgaagcgttgcaggcgggtatcgcgatcatcgaacaggagctaagccccgttccccatatgaccgtggcggagaatatctatttgggcagggagccgcttcgccgtttcggtggcatcgatttcaagacgatgaacctcaatgcccagaagcttttggaccagcttgagttcaagattcgcgccaaccagttcatgatgaacctgtctgtcgcgcaggtgcagcttgtggaaatagccaaggcgctcagtcacgacgctgaagtcattttcatggacgaaccgacatcggccattggtgaaaaagaagcacagcagctttttgcagcgatagagcgtttgaaagcgagcggaaaaggcattgtctatgtctcccatcgcctgtcggaaattttccagattgccgatagctataccgtgtttcgcgacggcagttatatcgatagcggcgatctcggtggcatcacccgtgcggaactgatccatatgatcgtcgggcgggaactgggtgaggaatatatcaagacgaatgcgcctacggaaataccgggcgtcgaggtttccggcctcagcgcgcccggcaagataaccgacatttcctttaccgcgcataagggcgagatttttggcatttacgggttgatggggtcaggccgctcggaaatattcaactgtcttttcggattggagaaagcctcccaaggaacaattcggcttgaaggcgaacccgtcaccgtccggcgccccgcggacgccgtggctctggggctggcttttgtgacggaagatcgcaagctgaccggcctcaatctcggcgacagcgttcgcaacaatatatgccttgccagccttcccgagatgagtccgcatttttcaatgaatcggcgtgcggaatcggccgccagcagggagatgatcgagcgtttcaggatcaaggttgcgcacgacacgatggccgtttcgggcctttccggcggcaaccagcagaaggtcgtgctcggaaaatggttcctgcgaaagccacgcgttctgctgctcgatgaacccactcgcggtgtcgatgtgggtgcaaaacaggaaatttatcgcatcatttgcgaatttgccgcccaaggcgggaccgtcgtcatggtttcttccgagattgatgaagtcctcggcatgtctgaccgcatcatggtcatgcgtggcggacaatcggtcggcatctaccgcagggcggaaacggacgcgcagtcattggtgcatctttcgacatga

SEQ ID NO: 38669 - protein, 486 aa, Brucella suis 1330
MEGLKKSFGGVAALRDGRLQLRTGSVHALCGGNGAGKSTFLKILMGIHARDGGHIRRRGKEVTYSSPAEALQAGIAIIEQELSPVPHMTVAENIYLGREPLRRFGGIDFKTMNLNAQKLLDQLEFKIRANQFMMNLSVAQVQLVEIAKALSHDAEVIFMDEPTSAIGEKEAQQLFAAIERLKASGKGIVYVSHRLSEIFQIADSYTVFRDGSYIDSGDLGGITRAELIHMIVGRELGEEYIKTNAPTEIPGVEVSGLSAPGKITDISFTAHKGEIFGIYGLMGSGRSEIFNCLFGLEKASQGTIRLEGEPVTVRRPADAVALGLAFVTEDRKLTGLNLGDSVRNNICLASLPEMSPHFSMNRRAESAASREMIERFRIKVAHDTMAVSGLSGGNQQKVVLGKWFLRKPRVLLLDEPTRGVDVGAKQEIYRIICEFAAQGGTVVMVSSEIDEVLGMSDRIMVMRGGQSVGIYRRAETDAQSLVHLST

SEQ ID NO: 38670 - DNA, 1545 bp, Brucella suis 1330
  CDS (1)..(1545): transl_table=11
atgagcctggctgcgaaaatcgaaggcaaaaacggcgatgtcgttcttgccgcgcagaatgtggccaagtcctatggccgcatccatgcgctaaaaggcgtgaatttcgagattcgccgggggcaggtcacgacgcttttcggtgaaaacggtgcgggcaagtccacgctgatgaaagtgctttccggcgtgatccagccgactttgggcacgatcatcctcgatggcaagccggtgacgttcaattcatccaccgaagcgcgcgaccatggcatctcgatcatccatcaggaattaagcctcgcgcccaacatgaatgtgcgcgacaacatcttcatggggcgcgaaatccgcaccgccaccggcgtcgattttgccgaggaagagcggctgacgcgcgaactcatgaaggaactggaagaagatatcgatccgctgacgccggttgaggaattgcgtctcggccagcagcaggtcgttgagatcgcccgtgcgctttcggtcaattcgcgcattctcatcatggatgagccgacttcggcgctcagtgcttcggaagtcgaggttctgttcaaggtgatccgcgatctgacggcgcgcggtgtcgccatcgtctatatttcgcatcatctggaagaggcgctccagatcaccaatcatgcggtggtgctgcgcgacggcaccatgacggcctatgcgccgcgtgaggaaatcgatctggaatggatcgtgcgcaatatggtcggtgaaaacttcgacctcggttctcctcccactggttatgaatggggcgatgtcgcgctttcggtcgaagacctgaccgttcccgaccccagcggcagtggcttctcgctggtggaccgcatgtcgctcaatgtgcgggcgggcgaaatcgtctgcatctatggtctcatgggtgcgggccgcacggaattgctggaatcggttgccggtcgcttgaaatcgagcggcgggcgtattctcctcaaagggcaggatatttccggcctcaccatcgctgagcgcatcgaaaagggccttgtgctggtgccggaagatcgccagcgcgacggtctcgtccagacgatgacggtcggcaagaacctgtcgcttgccagcattgcggaaatgaccagggggatattcacctcgcgcaagcgcgaaaagcagatcgtcgatcagtcgatcaggaatgtgcacatcaagaccgatggcggcgaggcggcaatcggttcgctttcgggcggcaatcagcagaaagtcgtaattggcaagatgctggcgaccgaaccggatgtgatcctgctcgatgagccgagccgcggcatcgacatcggcgcaaaggcggaagtgttcaagcttctggccgaaaaggcgaagcaggggctggccgtggtctacaccacctcggaagtcggcgaatgcctcagcatcgcgcaccgcatcatcgtcatgcaccgtggacgcatctccgccgaattcggatcagacgtgtccaaggaaaagatcatggccgcctcgggcgaagccatggtcggtcattaa

SEQ ID NO: 38671 - protein, 514 aa, Brucella suis 1330
MSLAAKIEGKNGDVVLAAQNVAKSYGRIHALKGVNFEIRRGQVTTLFGENGAGKSTLMKVLSGVIQPTLGTIILDGKPVTFNSSTEARDHGISIIHQELSLAPNMNVRDNIFMGREIRTATGVDFAEEERLTRELMKELEEDIDPLTPVEELRLGQQQVVEIARALSVNSRILIMDEPTSALSASEVEVLFKVIRDLTARGVAIVYISHHLEEALQITNHAVVLRDGTMTAYAPREEIDLEWIVRNMVGENFDLGSPPTGYEWGDVALSVEDLTVPDPSGSGFSLVDRMSLNVRAGEIVCIYGLMGAGRTELLESVAGRLKSSGGRILLKGQDISGLTIAERIEKGLVLVPEDRQRDGLVQTMTVGKNLSLASIAEMTRGIFTSRKREKQIVDQSIRNVHIKTDGGEAAIGSLSGGNQQKVVIGKMLATEPDVILLDEPSRGIDIGAKAEVFKLLAEKAKQGLAVVYTTSEVGECLSIAHRIIVMHRGRISAEFGSDVSKEKIMAASGEAMVGH

SEQ ID NO: 38672 - DNA, 1509 bp, Brucella suis 1330
  CDS (1)..(1509): transl_table=11
gtggacgcgccggctccgctgctcgaagcgcgcaacgtgttcaaggggtttttcggcaacccggtgctgaagggggtcagcatcgccttgcggcccggccgcgtgcacgcactgcttggagaaaacggtgcgggcaagtccacactcatcaatctgctgtccggcgccttgccgccggacagcgggaatattgtgctggaaggtgcagctctttccagattgaacccggcgcaagcgcggaaagcgggcattgctgtcattcagcaggaacttagtctgacgccggaattgtcgattgcagaaaatatcgggcttggcgcctatccgcgccgtttcggcctgatcgactacaaggcccttcacggggaagccttggccgtttgtaaacgtgtcggcctgaccgaaccgctcgaaactccggtcggcacactgtcgctcgggcgcaggcagatggtcgagattgccaaggcgcttttccgcaaaccgcgggtgctcatccttgatgagccgacatcatcgctatctgcgcatgaggcgggcgtattatcatcgctggttctcaaattgcgcgatgagggcgtcgcacttctctatatctctcacaggctcaacgaaattcgctcgctctgttctcatgtgaccgtgctcaaagacggtgtcgtgaccgcagatcagtcattatcaaattcggacccggaggagctagttcgcctgatggtcgggcgtgatactggcgaccttttccccgcttggcgaaccagtgccaccggcgaaaaacggattcatattcgcggcatgagcgcgggtatggtgcagaatgtcgatatggatgccaatgcgggcgagatcatcggtatcggcggtctggttgggcaaggacaggaagattttctgctgggtctctatggtgcgctgccgaccgcagcccgtgaagcgatagtgtgcggaaataacggcctgttcaaatcggttggcgcggcaaacgcggctggccttgcctatgtcccggcggatcggaagcgggaagggctcgtgctgccgcattccattgcgtcaaacctgctcctgccgtcacttgatcgatatacgcggcacggtttgcgcaacacggcaaacgagcagcgtgtcgttgccaaacttgccgaacggctgacgatcaggggagatactgcgcgcccggttcaggcgctgtccggcggcaatcagcaaaaggttgcgcttgccaaatggcttccgctggaacctacaatcctgttgctgaacgatccaacccgcggcgtcgatatcgaaaccaagcgtgaaatctacctgatgctgcgccggtttgccgatgaaggaaagctcgttgtcctgctgagttccgacacgccggagcttgtgcatttgtgtgaccgcgtcatggttttccgcgagggccgcatggtcgcgaccctgaaacacggggatctgtcggaagaggcaattgtaggggctgccatgggcctgaaatcgtcgagaaaggcagcctga

SEQ ID NO: 38673 - protein, 502 aa, Brucella suis 1330
MDAPAPLLEARNVFKGFFGNPVLKGVSIALRPGRVHALLGENGAGKSTLINLLSGALPPDSGNIVLEGAALSRLNPAQARKAGIAVIQQELSLTPELSIAENIGLGAYPRRFGLIDYKALHGEALAVCKRVGLTEPLETPVGTLSLGRRQMVEIAKALFRKPRVLILDEPTSSLSAHEAGVLSSLVLKLRDEGVALLYISHRLNEIRSLCSHVTVLKDGVVTADQSLSNSDPEELVRLMVGRDTGDLFPAWRTSATGEKRIHIRGMSAGMVQNVDMDANAGEIIGIGGLVGQGQEDFLLGLYGALPTAAREAIVCGNNGLFKSVGAANAAGLAYVPADRKREGLVLPHSIASNLLLPSLDRYTRHGLRNTANEQRVVAKLAERLTIRGDTARPVQALSGGNQQKVALAKWLPLEPTILLLNDPTRGVDIETKREIYLMLRRFADEGKLVVLLSSDTPELVHLCDRVMVFREGRMVATLKHGDLSEEAIVGAAMGLKSSRKAA

SEQ ID NO: 38674 - DNA, 1536 bp, Brucella suis 1330
  CDS (1)..(1536): transl_table=11
atgtccgaatatcttttggaaatgcgaaacatcggtaaagagttcaacggcgtcaaggcgctggatggcatttacctgaaagtgcgcgcgggagaatgtgtcgagctgtgcggtgaaaacggggcgggcaagtccaccctgatgaaagtgccgtcgggtgtttatccccatggcacatggactggtgaaattttctgggaaggcaaagaacttaaagccagtggcattcgcgataccgaagctgcgggtattgtcatcatccatcaggaactgatgatggtgccacacctgtcggtcgcggagaatatcttccttggttgcgagccaaccacaggcggtttcattgattatgaccagatgaatgcacgggcagccgaactgctcgctcggctcaagataaacgatatcaatgtcgcattgccggtttatcattactcaggcggcaagcagcagttgatcgagattgcaaaggcaatcaacaaaaatgccaagcttctgatccttgacgagccaacctcggccctgaccgcttcagaaacccgggttctcatcgacctgatcaaggacttcaaaaagcagggcatggcttgcgtttacatctctcacaaactcgatgaagtggcggaaatctccgacacggtaacggttattcgtgatggcgcgcatatcgcgacacgtccgatgtccgaactgacaacgcccgatatcatcacgatgatggtcgggcgtgagatgaagaacctcttcccgcgtgaaccccatgacattggcgaggtgatgtttgaagcccgcaatataagttgctgggatgtgaccaatcctggccgcaaggtggtcgacgatgtttcgtttgcgctaaggcgcggtgagattttgggcattgcgggccttgtgggtgccgggcgtacagaactcgtatcgagcttgtttggtgtctggccgggcgcctgtcaggggcaggtttttctggaaggcaaggaaatcaaaatccgcacgccgcgcgatgcggtgcgccaaggcatttgcatggtgccggaagatcacaaacgcgatggcatcctgccgatcatgccagttggccacaatatgacgatctccgtgcttgatcgcttttcgctacgaggcctcatcgataaagacgcggaactcgtggcgatccagcgtgagattttgagactcaaggtcaagaccgccgatccgatgcttgccattgcctcgctatctggcggcaatcagcagaaggccgtgctttcaaagatgatgctgcctgatccgaaagtgctcattcttgatgagcccacacgcggcgtcgatgtcggcgcgaaatatgaaatttacaagctgatattcgcgctcgccaggcagggcgtatcgattttgatggtttcgtcggaaatgccggaagtccttgggatcagtgatcgtgttctcgtcattggcgagggcaaattgcgcggcgatttcccgaatgaaaatcttacacaggagaaggttcttgccgctgcaattggcaagcctgcaaccaacgcggcctag

SEQ ID NO: 38675 - protein, 511 aa, Brucella suis 1330
MSEYLLEMRNIGKEFNGVKALDGIYLKVRAGECVELCGENGAGKSTLMKVPSGVYPHGTWTGEIFWEGKELKASGIRDTEAAGIVIIHQELMMVPHLSVAENIFLGCEPTTGGFIDYDQMNARAAELLARLKINDINVALPVYHYSGGKQQLIEIAKAINKNAKLLILDEPTSALTASETRVLIDLIKDFKKQGMACVYISHKLDEVAEISDTVTVIRDGAHIATRPMSELTTPDIITMMVGREMKNLFPREPHDIGEVMFEARNISCWDVTNPGRKVVDDVSFALRRGEILGIAGLVGAGRTELVSSLFGVWPGACQGQVFLEGKEIKIRTPRDAVRQGICMVPEDHKRDGILPIMPVGHNMTISVLDRFSLRGLIDKDAELVAIQREILRLKVKTADPMLAIASLSGGNQQKAVLSKMMLPDPKVLILDEPTRGVDVGAKYEIYKLIFALARQGVSILMVSSEMPEVLGISDRVLVIGEGKLRGDFPNENLTQEKVLAAAIGKPATNAA

SEQ ID NO: 38676 - DNA, 1512 bp, Shigella flexneri 2a str. 301; identical to SEQ ID NO: 27240
  CDS (1)..(1512): transl_table=11

SEQ ID NO: 38677 - protein, 503 aa, Shigella flexneri 2a str. 301; identical to SEQ ID NO: 27241

SEQ ID NO: 38678 - DNA, 1542 bp, Shigella flexneri 2a str. 301
  CDS (1)..(1542): transl_table=11
atgccttatctacttgaaatgaagaacattaccaaaaccttcggcagtgtgaaggcgattgataacgtcagcttgcggttgaatgctggcgaaatcgtctcactctgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcaccaggaattggccctggtgaaagaattgaccgtgctggaaaatatcttcctgggtaacgaaataacccacaatggcattatggattatgacctgatgacgctacgctatcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcggttttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgagcgagagttaaccgcgatttaccctaatgaaccacataccaccggagatgaaatattacgtattgaacatctgacggcatggcatccggtcaatcgtcatattaaacgagttaatgatgtctcgttttccctgaaacgtggcgaaatactgggtattgccggactcgttggtgccggacgtaccgagaccattcagtgcctgtttggcgtgtggcccggacaatgggaaggaaaaatttatattgatggcaaacaggtagatattcgtaactgtcagcaagccatcacccaggggattgcgatggtacccgaagacagaaagcgcgacggcatcgttccggtaatggcggttggtaaaaatattaccctcgccgcactcaataaatttaccggtggcattagccagcttgatgacgcggcagagcaaaaatgtattctggaatcaattcagcaactcaaagttaaaacgtcgtcccccgaccttgctattggacgtttgagcggcggcaatcagcaaaaagcgatcctcgcccgctgtctgttacttaacccgcgcatcctcattcttgatgaacctaccaggggtattgatattggcgcgaaatatgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctga

SEQ ID NO: 38679 - protein, 513 aa, Shigella flexneri 2a str. 301
MPYLLEMKNITKTFGSVKAIDNVSLRLNAGEIVSLCGENGSGKSTLMKVLCGIYPHGSYEGEIIFAGEEIQASHIRDTERKGIAIIHQELALVKELTVLENIFLGNEITHNGIMDYDLMTLRYQKLLAQVSLSISPDTRVGDLGLGQQQLVEIAKALNKQVRLLILDEPTASLTEQETSVLLDIIRDLQQHGIACIYISHKLNEVKAISDTICVIRDGQHIGTRDAAGMSEDDIITMMVERELTAIYPNEPHTTGDEILRIEHLTAWHPVNRHIKRVNDVSFSLKRGEILGIAGLVGAGRTETIQCLFGVWPGQWEGKIYIDGKQVDIRNCQQAITQGIAMVPEDRKRDGIVPVMAVGKNITLAALNKFTGGISQLDDAAEQKCILESIQQLKVKTSSPDLAIGRLSGGNQQKAILARCLLLNPRILILDEPTRGIDIGAKYEIYKLINQLVQQGIAVIVISSELPEVLGLSDRVLVMHEGKLKANLINHNLTQEQVMEAALRSEHHVEKQSV

SEQ ID NO: 38680 - DNA, 1503 bp, Shigella flexneri 2a str. 301
  CDS (1)..(1503): transl_table=11
atgacgaccgaccaacaccaggagatcctccgcaccgaaggattaagtaaatttttccccggcgtcaaagcgttagacaacgttgatttcagcctgcgccgtggcgaaatcatggcgctgcttggtgaaaacggggcgggaaaatcaacgctaatcaaagcattaactggtgtataccacgccgatcgcggcaccatctggctggaaggccagactatctcaccgaaaaataccgcccatgcacaacaactcggtatcggcaccgtctatcaggaagtcaacctgctacccaatatgtcggttgctgataatctattcataggtcgcgaacccaaacgtttcggccttctacgccgtaaagagatggaaaagcgcgccaccgaactgatggcatcttacggtttctccctcgacgtgcgcgaaccgcttaaccgtttttcggtggcgatgcagcaaatcgtcgccatttgccgggctatcgatctctccgccaaagtgctgatcctcgatgaacccaccgccagcctcgacacccaggaaatggagctattatttggcctgatgcgtcagttgcgcgatcgcggcgtcagcctgatctttgtcactcactttctcgatcaggtctatcaggtcagcgatcggatcaccgtcttacgcaacggcagtttcgtaggctgtcgggaaacgcgcgagctaccgcagatcgaactggtaaaaatgatgctggggcgcgagctggatacccacgcgctacagcgtgccgggcgaacattgttgagcgacaaacccgttgccgcgttcaaaaattacggcaaaaaaggaacgatagcaccgtttgatctcgaagtgcgccccggcgagatcgtcggtctggctggcttgctgggatccggacgtaccgaaaccgccgaagtgatcttcggtatcaaacctgctgacagcggcacggcgttgatcaaaggcaaaccgcaaaccctgcgatcgccacatcaggcttcagtactgggcatcggattctgcccggaagacaggaaaaccgatggcatcatcgccgccgcctcggtgcgggaaaatatcatcctcgctctccaggcccagcgcggctggctacgacccatttcccgcaaagagcagcaagagattgccgaacgctttatccgccagcttggcattcgcacaccttcaactgaacaaccgattgaatttctctccggtggcaatcagcaaaaagtgctgctttcacgttggctactgacccgaccgcaatttctgatccttgatgagctaacccgtggcattgatgttggtgcccacgccgagatcatccgcctgattgaaacgctgtgtgctgacggtctggcgctgctggtgatctcctccgaactggaagagctggtgggctatgccgaccgggtgatcatcatgcgcgatcgcaaacaggtggcggagatcccgctggcacagctttccgttccggcgatcatgaacgccattgcggcgtaa

SEQ ID NO: 38681 - protein, 500 aa, Shigella flexneri 2a str. 301
MTTDQHQEILRTEGLSKFFPGVKALDNVDFSLRRGEIMALLGENGAGKSTLIKALTGVYHADRGTIWLEGQTISPKNTAHAQQLGIGTVYQEVNLLPNMSVADNLFIGREPKRFGLLRRKEMEKRATELMASYGFSLDVREPLNRFSVAMQQIVAICRAIDLSAKVLILDEPTASLDTQEMELLFGLMRQLRDRGVSLIFVTHFLDQVYQVSDRITVLRNGSFVGCRETRELPQIELVKMMLGRELDTHALQRAGRTLLSDKPVAAFKNYGKKGTIAPFDLEVRPGEIVGLAGLLGSGRTETAEVIFGIKPADSGTALIKGKPQTLRSPHQASVLGIGFCPEDRKTDGIIAAASVRENIILALQAQRGWLRPISRKEQQEIAERFIRQLGIRTPSTEQPIEFLSGGNQQKVLLSRWLLTRPQFLILDELTRGIDVGAHAEIIRLIETLCADGLALLVISSELEELVGYADRVIIMRDRKQVAEIPLAQLSVPAIMNAIAA

SEQ ID NO: 38682 - DNA, 1518 bp, Streptomyces coelicolor A3(2)
  CDS (1)..(1518): transl_table=11
atgacccacccgtccgacacgggttcggccccggttctggcgctcagggacgtctccaagtccttcggcgcggtccgtgcgctgcgggacgtctccctggagctgttccccggcgaggtgcacgccctcgccggtgagaacggcgccggaaagtcgaccctcatcaagacgctggccggagtgcaccggccggacgccggccacgtgctgctcgacggcgcaccggtcgtgttccacggtcccggcgacgcccgcgacgccggcatcgccgtgatctaccaggagcccaccctcttccccgacctgtcgatcgccgagaacatcttcatgggccgccagccgcgccgcgccctcggccgcatcgaccacaaggcgacccacgacgccaccgccgcactcatgctgcgcctcggcgtcgaactcgaccccgaccggcccgcgcgcggtctgtccatcgcggaccagcagatcgtggagatcgccaaggccctctccttcgacgcccgcgtcctgatcatggacgagccgaccgccgccctcaccggcagcgaggtggcccggctcttcggcgtggtgcgcaccctgcgcgaccagggcgccgcggtgctgttcatctcccaccgcctggaggagatcttccacatctgcgcgcgggtgaccaccctgcgcgacggcgcctggatcgccagcgagcccctggagggcatgaccgaggacgacctggtgcgccgcatggtcggccgcgacctcgacgagctgtaccccaagcaggaggtcacccccggcgagagggccctcagcgtgcgcaggctgacccgcgagggcgtcttcaccgacgtctccttcgaggtgcggcgcggtgagatcgtcgcgctggccggactggtcggcgccgggcgcaccgaggtcgcccgcgccgtcttcggcgtcgaccgctgggacgcgggcgaagtggaggtggacgggaagccgctcgtcaacggcgcgccctccaccgcgatggccgccggtctcgccctcgtcccggaggaccgccgcgcccaggggctggtgatggacatgtccatcgaacgcaacatcgggctcaccggcctgcggacgaccgtgaaggccggcctcgtggaccgcggcgccgagcgcagccgttccctggactgggcggtcaagctccaggtcaagtacgcccgcatcgccgacaccgtcgccaccctgtccggcggcaaccagcagaaggtcgtcctcgccaagtggctggccaccggccccaaggtgctgatcgtggacgagcccacccgcggcatcgacgtcggcaccaaggcggaggtgcaccggctcctctcgcagctcgccgccgacggcgtggccgtcctgatgatctcctccgacctgcccgaggtgctcggcatggccgaccgcgtcctggtgatgcacgagggccgactgaccgccgagatatcccgcaccgacgccaccgaggagaccgtgatggccgcagcgacggggagggccgccgcatga

SEQ ID NO: 38683 - protein, 505 aa, Streptomyces coelicolor A3(2)
MTHPSDTGSAPVLALRDVSKSFGAVRALRDVSLELFPGEVHALAGENGAGKSTLIKTLAGVHRPDAGHVLLDGAPVVFHGPGDARDAGIAVIYQEPTLFPDLSIAENIFMGRQPRRALGRIDHKATHDATAALMLRLGVELDPDRPARGLSIADQQIVEIAKALSFDARVLIMDEPTAALTGSEVARLFGVVRTLRDQGAAVLFISHRLEEIFHICARVTTLRDGAWIASEPLEGMTEDDLVRRMVGRDLDELYPKQEVTPGERALSVRRLTREGVFTDVSFEVRRGEIVALAGLVGAGRTEVARAVFGVDRWDAGEVEVDGKPLVNGAPSTAMAAGLALVPEDRRAQGLVMDMSIERNIGLTGLRTTVKAGLVDRGAERSRSLDWAVKLQVKYARIADTVATLSGGNQQKVVLAKWLATGPKVLIVDEPTRGIDVGTKAEVHRLLSQLAADGVAVLMISSDLPEVLGMADRVLVMHEGRLTAEISRTDATEETVMAAATGRAAA

SEQ ID NO: 38684 - DNA, 1479 bp, Streptococcus agalactiae NEM316
  CDS (1)..(1479): transl_table=11
atgaaaattgacatgaggaatatctccaaatccttcggtactaataaagttctagagaagattgatttggaattacaatctggtcaaatacacgcgcttatgggtgaaaatggtgcgggtaaatcaaccttaatgaacattctaacaggactttttccagcaagtacaggaactatttatattgatggcgaggaacgaactttttcaaaccctcaagaagcagaggaatttggcattagttttattcaccaagagatgaatacttggccggaaatgactgtcttggaaaatctctttcttggacgtgaaatcaagacaacttttggcttactcaatcaaaaattaatgagacaaaaagcacttgaagcttttaaaagattaggtgtgactattcccctagacatcccgattggtaacttgtctgttggacaacaacaaatgattgaaatcgccaaaagtctcctaaaccaactctctattttggtaatggatgaaccgactgctgctttaacagatcgtgaaactgaaaatcttttccgagttatccgaagtttaaaacaagaaggagtgggcattgtctatatctcccatcgaatggaggaaatttttaaaatcactgacttcgtaaccgtcatgagagatggtgtcattgtagatacaaaagaaacatcactcacaaattctgacgaattggttaaaaaaatggttggccgaaaattggaagattactatcctgaaaaacattctgaaattgggcctgttgcttttgaagttagtaacctctgtggagataatttcgaggacgtttccttttatgtccgtaaaggcgagattcttggattttctggattaatgggagctgggcgtactgaagttatgcgaactatctttggaattgataaaaagaagtctggtaaggtgaaaattgataaccaagaaatcactattactagcccaagtcaagctatcaagcagggcattggttttttgaccgaaaatagaaaagatgaaggtctcatcctagacttcaatatcaaggacaatatgactctccctagcactaaagattttagcaaacatggtttctttgatgaaaaaacaagaacaacatttgtgcaacaattgattaatcgcctctacattaaatcagggagaccagatttagaggttggaaatctttctggaggtaaccaacaaaaggtcgttctcgctaaatggattggtattgctcctaaagtcttaattcttgatgagccaacacgtggtgttgatgtcggagctaaacgagagatttaccaattaatgaatgaactagcagacagaggtgttccaattgtcatggtatcatcagacttacctgaaattctaggtgttagtgaccgcatcatggtaatgcacgaaggtcgaatcagtggagaactcagtcgaaaagaagctgaccaagaaaaagttatgcaactagccacaggaggtaagtaa

SEQ ID NO: 38685 - protein, 492 aa, Streptococcus agalactiae NEM316
MKIDMRNISKSFGTNKVLEKIDLELQSGQIHALMGENGAGKSTLMNILTGLFPASTGTIYIDGEERTFSNPQEAEEFGISFIHQEMNTWPEMTVLENLFLGREIKTTFGLLNQKLMRQKALEAFKRLGVTIPLDIPIGNLSVGQQQMIEIAKSLLNQLSILVMDEPTAALTDRETENLFRVIRSLKQEGVGIVYISHRMEEIFKITDFVTVMRDGVIVDTKETSLTNSDELVKKMVGRKLEDYYPEKHSEIGPVAFEVSNLCGDNFEDVSFYVRKGEILGFSGLMGAGRTEVMRTIFGIDKKKSGKVKIDNQEITITSPSQAIKQGIGFLTENRKDEGLILDFNIKDNMTLPSTKDFSKHGFFDEKTRTTFVQQLINRLYIKSGRPDLEVGNLSGGNQQKVVLAKWIGIAPKVLILDEPTRGVDVGAKREIYQLMNELADRGVPIVMVSSDLPEILGVSDRIMVMHEGRISGELSRKEADQEKVMQLATGGK

SEQ ID NO: 38686 - DNA, 1575 bp, Pseudomonas putida KT2440
  CDS (1)..(1575): transl_table=11
atgctgccaggagaatcggccatgcctgcattggccaatgaagtggtgcttgccgccagcggcctgggcaagacctatgcccagcccgtactcggcgaggtcagcctgagcctgcgcgcgggcgaagtgctggccctgaccggcgagaacggcgcaggcaagagtacgttgtccaagcttatcagcggcctggaggtgcccaccaccggtcacatgacctaccgcggccaggcctacgcgcccggcagccgcggcgaggccgaacgccttggggtgcgcatggtcatgcaggagctgaacctgctgccgacgctgaccgtggcggaaaacctgtttctcgacaacctgcccagccgcttcggctggatcagccacaagcgtttgcgccagctggcaacggctgccatggctcgggtcgggctcgacgccattgacccggacacccctgtcggcgaactgggcatcggccatcagcaaatggtcgagattgcccgcaacctgatcggtgactgccatgtgctgatcctggacgagcccactgccatgctcactgcgcgcgaggtggcgttgctgttcacccagatcgagcgcctgcgcgcccgcggcgtggccatcgtctatatctcgcatcgcctggaagagttgcagcgcgtggcccaacgcatcgttgtgctgcgcgatggcaagctggtgtgcgacgagccgatccagcgctacagcagcgccgagctggtcaacctgatggtcggccgcgagctgggcgagcatatcgacctgggtcgacggcagttgggtgcaccgctgctcaaggtcgacaaactgtgccgtggcgacaaggtgcgcgaggtgtcgttcgaagtcagggcaggggagatttttggcatctccggcctgatcggcgccggccgtaccgagctgctgcgcctgatctacggtgccgatcgcgccgacagcggcggtatcgcgctcggccagccgccacaggcggtcagcatcgactcgcccaaggctgcagtgcgtgccggtatcgcgctgataaccgaagaccgcaaaggcgagggcctgctgttgacgcagtcgatcagcgccaacattgcgttgggcaacctgggcgcggtatcgcgcgccggtgtgctcgatagcgaagcggaaaaggccttggccgaacgccagatccaggccatgcgcattcgcagtgctggcgcgcagcaagtggtgggcgagctgtctggcggtaaccagcagaaggtggtgatcggccgctggctggagcgcgattgccaggtgctgctgttcgacgaacccacgcgtggcatcgatgtgggcgccaagttcgacatttatggcctgctggccgagctggcgcgccaaggcaaggccttggtggtggtgtccagtgacctgcgcgaactgatgctgatttgcgaccgcatcgccgtgctgtccgctggccgcctgatcgacaccttcgcgcgtgatcattggagccaggaccagttgcttgccgccgccttcgccggttatcagaaacgtgacgcgctgctgcatgatgcagcccccaggatggatgcatga

SEQ ID NO: 38687 - protein, 524 aa, Pseudomonas putida KT2440
MLPGESAMPALANEVVLAASGLGKTYAQPVLGEVSLSLRAGEVLALTGENGAGKSTLSKLISGLEVPTTGHMTYRGQAYAPGSRGEAERLGVRMVMQELNLLPTLTVAENLFLDNLPSRFGWISHKRLRQLATAAMARVGLDAIDPDTPVGELGIGHQQMVEIARNLIGDCHVLILDEPTAMLTAREVALLFTQIERLRARGVAIVYISHRLEELQRVAQRIVVLRDGKLVCDEPIQRYSSAELVNLMVGRELGEHIDLGRRQLGAPLLKVDKLCRGDKVREVSFEVRAGEIFGISGLIGAGRTELLRLIYGADRADSGGIALGQPPQAVSIDSPKAAVRAGIALITEDRKGEGLLLTQSISANIALGNLGAVSRAGVLDSEAEKALAERQIQAMRIRSAGAQQVVGELSGGNQQKVVIGRWLERDCQVLLFDEPTRGIDVGAKFDIYGLLAELARQGKALVVVSSDLRELMLICDRIAVLSAGRLIDTFARDHWSQDQLLAAAFAGYQKRDALLHDAAPRMDA

SEQ ID NO: 38688 - DNA, 1539 bp, Pseudomonas putida KT2440
  CDS (1)..(1539): transl_table=11
atgagtacgccggtgctggagctgcgtggcattgtcaagaccttcggtgccacccgggcgctcgacggcgccagcctgcgggtggcggcgggcagcgtgcacggtctggtgggcgagaacggcgccggcaagtctacgctgatcaaggtgctggccggcatccaccgcccggacgccggcagcctgctgctcgacggccagccgcacgggcatttcagcccgcgccaggtggagcgcctgggcattggcttcatccaccaggaacgcttgttgccggcccgtttcaccgtgggtgaagccttgttcttcggccatgaacggcgattcgggcccttgctcgatcgccgctctcagcagcgcgaggccgcgcgtctgctggacgactacttcggcctgcgactgccggcgaatgcgctgatcggtgaactgagcagcgccgagcaacagatggtgcagatcgtccgcgcgctgctgatcaaaccgcgtgtgctggtgttcgacgaacccagcgtggccctggtgcagcgtgaggtggagcgtttgctgcggatcgtccagcgcctgcgtgacgatggcctggcgatcgtctacatctcccattacctgcaggaaatcgaggccctgtgcgaccgcgtgacggtactgcgcaacggtcgcgatgtcgctgaagtctccccgcgcaacacgtcgctggagcagatcacccgcctgatggtcaaccgcgaagtcggcgagctgtaccccaaggtagcggtgcctgccggtgcgctgttgctcgacgtgcgcgggctggggcgggcacgggcctaccagggcatcgacctgcaggtgcgccgtggcgagatcgtcggcctcaccgggctggtgggctcgggcgccaaggagttgctacgcagcctgttcggcctggcgccaccggacagcggcgaggtgcgcctggacgggcaaccgttgtccttgcgcagtccgcgcgaggctgtcgcccagggcgtcgcgctgatgcccgaggagcgccgtcggcaaggcgtggcgcttgatctgagcgtgcaggagaacaccaccctggcggcactgtcgcgcttcgtccgcctggggctgctgtcgccggcgcgcgagcggcataccaccctggagctgatcgagcgcctgaggatcaaggcccatggcgcgcatgccaaggtgcgtcagctcagcggcggcaatcagcaaaaggtggcgctggccaagtggttcgcgcggtgttccagcctgtacctgctggacgagcccagcgttggcatcgatgttggcgccaaggtggagatctatcggctgatcggtgaactggtgaaggagggcgccggggtgctgatcctctcgtccgacctgccggagttgatcggcctctgcgaccgcattcatgtcatgcaccgcggcgccatcgccgcacgtttcgccgctggcgaggcgaacagtgaccgcctgctggcggtggctaccggcgcgcaacgcgcgcagaacgaggaacgacctttctatgcctatgccattgctatctga

SEQ ID NO: 38689 - protein, 512 aa, Pseudomonas putida KT2440
MSTPVLELRGIVKTFGATRALDGASLRVAAGSVHGLVGENGAGKSTLIKVLAGIHRPDAGSLLLDGQPHGHFSPRQVERLGIGFIHQERLLPARFTVGEALFFGHERRFGPLLDRRSQQREAARLLDDYFGLRLPANALIGELSSAEQQMVQIVRALLIKPRVLVFDEPSVALVQREVERLLRIVQRLRDDGLAIVYISHYLQEIEALCDRVTVLRNGRDVAEVSPRNTSLEQITRLMVNREVGELYPKVAVPAGALLLDVRGLGRARAYQGIDLQVRRGEIVGLTGLVGSGAKELLRSLFGLAPPDSGEVRLDGQPLSLRSPREAVAQGVALMPEERRRQGVALDLSVQENTTLAALSRFVRLGLLSPARERHTTLELIERLRIKAHGAHAKVRQLSGGNQQKVALAKWFARCSSLYLLDEPSVGIDVGAKVEIYRLIGELVKEGAGVLILSSDLPELIGLCDRIHVMHRGAIAARFAAGEANSDRLLAVATGAQRAQNEERPFYAYAIAI

SEQ ID NO: 38690 - DNA, 1521 bp, Escherichia coli CFT073
  CDS (1)..(1521): transl_table=11
atggtcagctcaacgactccgtcttccggggaatacttgttggaaatgagcggtatcaacaagtcttttcctggtgttaaggcacttgataacgttaacttaaaagtccgaccacattctatccatgcattaatgggggaaaatggtgcgggaaaatcaacattattaaaatgcctgtttggtatttatcaaaaagactctggcaccattttattccagggtaaagagatcgatttccattccgccaaagaagcactggaaaatggtatttcgatggtacatcaggagttaaacctggtattacaacgttcggtgatggacaacatgtggctggggcgatatcccaccaaaggcatgtttgtcgatcaggacaaaatgtaccgcgaaaccaaagcgatttttgatgaactggatattgatatcgatccgcgtgcgcgcgtcggtacattatctgtttcgcaaatgcagatgatcgaaatcgccaaagcgttttcctataacgcgaaaattgtgattatggatgaaccgacttcttcgttaaccgaaaaagaggtcaatcatctgttcactattattcgtaaattaaaagagcgcggctgcggtattgtttatatctcgcataaaatggaagaaatcttccagttatgtgatgaagttaccgtattgcgcgacggtcagtggatcgctaccgaaccgctggcaggactgacgatggacaagatcatcgccatgatggttgggcgttctcttaaccagcgtttccctgacaaagaaaacaagccgggcgaagtgattctggaagtgcgtaacctgacgtcgctgcgccagccgtcgatacgcgatgtctcgtttgatctgcataaaggggagattctcggtatagccggtctggtgggagcgaaacgtaccgatattgttgagacgttatttggtattcgcgagaaatcggctggcaccattacgttgcacggcaaaaagatcaataaccataatgccaacgaagccataaaccacggatttgcactggtaactgaagagcgccgctcaacgggaatttatgcctatctggatattggctttaactcgttaatttccaatatccgcaactataaaaataaagttggtttactggataactcgcggatgaaaagcgatacccagtgggtgattgattcgatgcgggtaaaaacaccggggcatcggacgcaaattggttcgctctccggtggtaatcagcaaaaagtgattattggtcgctggctgttaacgcaaccagaaatattaatgctcgatgaaccgacgcgcggtattgatgttggggctaagtttgagatttatcagttaattgccgaactggcgaagaaaggcaaggggattattattatctcctccgaaatgccagagttgttagggataacagaccgtattctggttatgagcaatggtctcgtttccggaattgtcgatacaaaaacaacaacgcaaagcgaaattctgcgtcttgcgtctttgcacctttaa

SEQ ID NO: 38691 - protein, 506 aa, Escherichia coli CFT073
MVSSTTPSSGEYLLEMSGINKSFPGVKALDNVNLKVRPHSIHALMGENGAGKSTLLKCLFGIYQKDSGTILFQGKEIDFHSAKEALENGISMVHQELNLVLQRSVMDNMWLGRYPTKGMFVDQDKMYRETKAIFDELDIDIDPRARVGTLSVSQMQMIEIAKAFSYNAKIVIMDEPTSSLTEKEVNHLFTIIRKLKERGCGIVYISHKMEEIFQLCDEVTVLRDGQWIATEPLAGLTMDKIIAMMVGRSLNQRFPDKENKPGEVILEVRNLTSLRQPSIRDVSFDLHKGEILGIAGLVGAKRTDIVETLFGIREKSAGTITLHGKKINNHNANEAINHGFALVTEERRSTGIYAYLDIGFNSLISNIRNYKNKVGLLDNSRMKSDTQWVIDSMRVKTPGHRTQIGSLSGGNQQKVIIGRWLLTQPEILMLDEPTRGIDVGAKFEIYQLIAELAKKGKGIIIISSEMPELLGITDRILVMSNGLVSGIVDTKTTTQSEILRLASLHL

SEQ ID NO: 38692 - DNA, 1512 bp, Escherichia coli CFT073; identical to SEQ ID NO: 27256
  CDS (1)..(1512): transl_table=11

SEQ ID NO: 38693 - protein, 503 aa, Escherichia coli CFT073; identical to SEQ ID NO: 27257

SEQ ID NO: 38694 - DNA, 1527 bp, Escherichia coli CFT073
  CDS (1)..(1527): transl_table=11
ttggcgttttgttgtgacaccgaggtcattatgacggatgttattcttgatgtttcgcatattgcgaagacatttggtcatgttcaggcattaaaagatattacactctctttacgtaaagggcgggtgcatactttattaggcgagaatggtgccggtaaatcgacattaatgaaaatactggccggtgtttatccgccaacccagggaacgataacactacgtggtgaaaccatcaccattaataatccgcagcattctcgccagttagggattgcgattatttttcaggaactgagcctgagtaataatatgaccgtggcggaaaatatttatgccaataatgaaccgcgacgttttggtataattaacgataaagaaatgctcgcagattgccagaacctcctcgcggaactgggcatcccactagaccctctggaaatggtcggcaatatgtcgatggcacataggcaactggtagaaattgctaaagccttaagctatgcagcggatgtcgtgattatggatgaaccgacatcttcgctaagtgataatgaagcggagatcctgtttaacattattgaaaaattaaagcagcgaggctgtgcggttatttatatctctcatcgcatggatgaaattatgcggatttcagatgatatttcggtgatccgcgacggtgagtatatcgctacgcatgaaaagaaaaacagtgatatccagcacttgattgcccaaatggttggtcgggaaatgaaaaatatttggccagcacgtcttggggaaaaaccggatgaaaatgttcctgcaaaactggaagtaaaaaatctttcccatccttcgctttttaaagaggtcagtttcgctgtgcgtccgggggaagtcctcggattttttggcctggtgggggccgggcgttccgatgtgatgaaggcgctatttggcctcgtttcgtatcacgggactgtgttgattgatggtaaggaagtcaggatcgctaatccccaggctattgatcatggcattgcttttgtgaccgaaaaccgcaaggaagaagggttagtgctgatgcacgacatcaatatgaacacgcaccatgtggcgtttcaatataacgcttcgcggatgggactcatcaatcaccgacaagaagaggcgaagacgctgcaatcaattgccagaatgaacactaaagtgagttctgtgcatcaggcagtgggagcactgagcggcggtaatcaacagaaaatcgtgttatcgaagtggctggagaaaactccgcgtattttattgctcgatgaaccaacgcgcggagtggatgtcggcgcaaaatttgaaatctataacgtgatacgtcaactggctgcggcagggacagcaattattctggtgtcctctgaactgccagaagtcatggcacttagcgatcgtctggtggtaatgcgtaataaaacgattgccgatatttattcatgtgaaaatttaacgcagacacaggtaatgaccgctgcaacaggagtacgttaa

SEQ ID NO: 38695 - protein, 508 aa, Escherichia coli CFT073
MAFCCDTEVIMTDVILDVSHIAKTFGHVQALKDITLSLRKGRVHTLLGENGAGKSTLMKILAGVYPPTQGTITLRGETITINNPQHSRQLGIAIIFQELSLSNNMTVAENIYANNEPRRFGIINDKEMLADCQNLLAELGIPLDPLEMVGNMSMAHRQLVEIAKALSYAADVVIMDEPTSSLSDNEAEILFNIIEKLKQRGCAVIYISHRMDEIMRISDDISVIRDGEYIATHEKKNSDIQHLIAQMVGREMKNIWPARLGEKPDENVPAKLEVKNLSHPSLFKEVSFAVRPGEVLGFFGLVGAGRSDVMKALFGLVSYHGTVLIDGKEVRIANPQAIDHGIAFVTENRKEEGLVLMHDINMNTHHVAFQYNASRMGLINHRQEEAKTLQSIARMNTKVSSVHQAVGALSGGNQQKIVLSKWLEKTPRILLLDEPTRGVDVGAKFEIYNVIRQLAAAGTAIILVSSELPEVMALSDRLVVMRNKTIADIYSCENLTQTQVMTAATGVR

SEQ ID NO: 38696 - DNA, 1578 bp, Escherichia coli CFT073; identical to SEQ ID NO: 27260
  CDS (1)..(1578): transl_table=11

SEQ ID NO: 38697 - protein, 525 aa, Escherichia coli CFT073; identical to SEQ ID NO: 27261

SEQ ID NO: 38698 - DNA, 1533 bp, Escherichia coli CFT073
  CDS (1)..(1533): transl_table=11
atggccacgccatatatatcgatggcggggatcggcaagtcctttggtccggttcacgcattaaagtcggttaatttaacggtttatcctggtgaaatacatgcattactaggagaaaatggtgcgggtaaatctacgctaatgaaagtgttatccgggatacatgagccgaccaaaggcaccattaccattaataacattaactataacaaactggatcataaattagcggcacaactcggtatcgggattatttatcaggaactcagcgttattgatgaattaaccgtactggaaaatttatatattggtcgtcatctgacgaaaaaaatctgtggcgtcaatattatcgactggcgagaaatgcgtgtccgcgccgccatgatgttattacgcgtgggcttgaaagttgatttagatgagaaagtggcgaatttatctatcagccacaagcagatgctggaaattgccaaaacgctgatgctcgacgccaaagtcatcatcatggatgaacccacctcctcactcaccaataaagaggtggactatctgtttctgatcatgaatcagttgcgtaaggagggtacggccatcgtctatatctcgcataaattggcggaaattcgccgtatttgcgaccgctatacggtgatgaaagacggcagcagcgtttgcagcggcatggtgagcgatgtgtcaaatgacgatatcgtccgtctgatggtaggccgcgaattgcaaaaccgttttaacgcgatgaaggagaatgtcagcaaccttgcgcacgatacggtttttgaggtgcgcaacgtcaccagccgtgacagaaaaaaggtccgggatatctcatttagcgtctgccggggagaaatattaggctttgccggactggtcggttccggacgtactgaactgatgaactgcctgtttggcgttgataaacgcgctggcggagaaatccgtcttaatggcaaagatatctctccacgttctcccctggatgccgtgaaaaaagggatggcttacatcactgaaagccgccgggataacggctttttccccaacttttctatcgctcagaacatagctatcagccgcagtctgaaagacggcggctataaaggcgcgatggggttgtttcatgaagttgacgagcaacgtaccgctgaagcccagcgcgaactgctggcgctgaaatgtcattcggtaaaccagaacatcactgaactctccggcggtaaccagcagaaagtcctgatctccaaatggctgtgctgtcacccggaagtgatcattttcgatgaacctacccgtggcatcgacgttggcgcgaaagccgaaatttacaaagtgatgcgccaactggcggacgacggaaaagtcatcctgatggtgtcatctgaactacctgaaattatcaccgtctgcgaccgcatcgccgtgttctgcgaaggacgactgacgcaaatcctgaccaatcgcgatgacatgagcgaagaggagattatggcatgggctttaccacacgagtaa

SEQ ID NO: 38699 - protein, 510 aa, Escherichia coli CFT073
MATPYISMAGIGKSFGPVHALKSVNLTVYPGEIHALLGENGAGKSTLMKVLSGIHEPTKGTITINNINYNKLDHKLAAQLGIGIIYQELSVIDELTVLENLYIGRHLTKKICGVNIIDWREMRVRAAMMLLRVGLKVDLDEKVANLSISHKQMLEIAKTLMLDAKVIIMDEPTSSLTNKEVDYLFLIMNQLRKEGTAIVYISHKLAEIRRICDRYTVMKDGSSVCSGMVSDVSNDDIVRLMVGRELQNRFNAMKENVSNLAHDTVFEVRNVTSRDRKKVRDISFSVCRGEILGFAGLVGSGRTELMNCLFGVDKRAGGEIRLNGKDISPRSPLDAVKKGMAYITESRRDNGFFPNFSIAQNIAISRSLKDGGYKGAMGLFHEVDEQRTAEAQRELLALKCHSVNQNITELSGGNQQKVLISKWLCCHPEVIIFDEPTRGIDVGAKAEIYKVMRQLADDGKVILMVSSELPEIITVCDRIAVFCEGRLTQILTNRDDMSEEEIMAWALPHE

SEQ ID NO: 38700 - DNA, 1503 bp, Escherichia coli CFT073
  CDS (1)..(1503): transl_table=11
atgacgaccgaccaacaccaggaaatcctccgcaccgaaggattaagtaaatttttccccggtgtcaaagcgttagacaacgttgatttcagcctgcgccgtggtgaaatcatggcgctgctcggtgaaaacggggcgggaaaatcgacgctcatcaaagcattaaccggtgtataccacgccgatcgcggcaccatctggctggaaggccaggctatctcaccgaaaaacaccgcccacgcacaacaactcggcatcggcaccgtctatcaggaagtcaacctgctacccaatatgtcggtcgctgataatctattcataggtcgcgaacccaaacgtttcggccttctacgccgtaaagagatggaaaagcgctccaccgaactgatggcatcttacggtttctccctcgacgtgcgcgaaccgctcaaccgcttttcagtcgcgatgcagcaaatcgtcgccatttgccgggctatcgatctctccgccaaagtgctgatcctcgatgaacccaccgccagtctcgacactcaggaagtagagttactgtttggcctgatgcgtcaacttcgcgatcgcggcgtcagcctgatcttcgtcactcattttctcgatcaggtttatcaggttagcgatcggatcaccgtcttacgcaacggcagttttgtgggctgtcgggaaacccgcgagctaccgcagatcgaactggtaaaaatgatgctggggcgtgagctggacacccacgcgcttcagcgtgccgggagaacattgctgagcgacaaacctgttgccgcgttcaagaattacggcaaaaaaggaacgatcgcgccgtttgatctcgaagtgcgccccggcgagatcgtcggtctggcaggcttgctgggatcaggacgtaccgaaaccgccgaagtgatcttcggtatcaaacctgctgacagcggcactgcgttgatcaaaggcaaaccgcaaacgctacgctcgccacatcaggcttcggttcttggcattggcttctgcccggaagacaggaaaaccgatggcatcatcgctgccgcctcggtgcgggaaaatatcatccttgctctccaggcccagcgcggctggctacgacctatttcccgtaaagaacagcaagagattgccgaacgctttatccgccagcttggcattcgcacaccttcaactgaacaaccgattgaatttctctccggcggcaatcagcaaaaagtgttgctttcacgttggctactgacccgaccgcaatttctgatcctcgacgagccaacgcgcggaattgatgttggtgcccacgccgagatcatccgcctgattgaaacgctgtgcgccgatgggctggcgctgctggtgatctcctccgagctggaagagctggtgggctatgccgatcgggtgattatcatgcgcgatcgcaaacaggtggcggagatcccgctggcagagctttccgttccggcgatcatgaacgccattgcggcgtaa

SEQ ID NO: 38701 - protein, 500 aa, Escherichia coli CFT073
MTTDQHQEILRTEGLSKFFPGVKALDNVDFSLRRGEIMALLGENGAGKSTLIKALTGVYHADRGTIWLEGQAISPKNTAHAQQLGIGTVYQEVNLLPNMSVADNLFIGREPKRFGLLRRKEMEKRSTELMASYGFSLDVREPLNRFSVAMQQIVAICRAIDLSAKVLILDEPTASLDTQEVELLFGLMRQLRDRGVSLIFVTHFLDQVYQVSDRITVLRNGSFVGCRETRELPQIELVKMMLGRELDTHALQRAGRTLLSDKPVAAFKNYGKKGTIAPFDLEVRPGEIVGLAGLLGSGRTETAEVIFGIKPADSGTALIKGKPQTLRSPHQASVLGIGFCPEDRKTDGIIAAASVRENIILALQAQRGWLRPISRKEQQEIAERFIRQLGIRTPSTEQPIEFLSGGNQQKVLLSRWLLTRPQFLILDEPTRGIDVGAHAEIIRLIETLCADGLALLVISSELEELVGYADRVIIMRDRKQVAEIPLAELSVPAIMNAIAA

SEQ ID NO: 38702 - DNA, 1506 bp, Vibrio vulnificus CMCP6
  CDS (1)..(1506): transl_table=11
atgaaccaagcgattttacagctcagtgaaattgaaaaagcatttcctggcgtgaaggcgttagataaggcctcgctcaatgtctacccaggaagagtgatggctttaatgggagaaaatggagcaggaaaatccaccttgatgaaagtgcttaccggtatctattcacgagacgcaggtgagatagtttatcaaggtcaatcagcgcagttcaaagggccaagagattcacaacaagctggtatcagcattattcaccaagaactaaaccttattcgtgaactgaccatcgcagagaacatttttcttggtcgagagattacctcggcgtttgggcgtattgattggccccaaatgtacgcggaagcggacaaactgctcgcgcgcttgaaagtgaagcacagctcaaagacgttacttggtcagttaagtctgggtgagcagcagatggtggaaatcgctaaagcgctctcttttgagtccaaagtcatcatcatggatgaaccaacagacgccttgacggacaccgaaacagaggcgctgttttcggttattcgagagctgagagagcaggggtgtggcattgtttacatctcccaccgtttgaaagagatcttcgaaatttgtgatgacatcacggtgttgcgcgatggcaaatttatcggtcagtgcgaagtcgtgcaaacagacgaagatggcttaattgagatgatggttgggcgcaagcttgaagagcaatacccaagaattgacgtggtgcacggtcaaacctgtttagaagtgattggtctgacggggtctggcgtacacgatgtcagttttaccttaaaacgaggtgaaattttgggtatttcaggtctgatgggcgcaggtcgaacagagctgatgaaagtgatttatggtgctttgccgagtgagagaggcgtgatcaatcttgataatcgcaccattaatccgataagcccacaagatggtttggcaaatggcattgcttacatttcagaagaccgcaaaggcgacggcctcgtccttggcctttcggtgaaagaaaacatgtcactttgtgcgcttgataagctaagcaaaggtgtgcaaatccaacatcaagatgaagtggttgctgtggatgactttatccaacttttcaacatcaaaacgccatctcgcgagcaaattattggcaatctttctggcggaaaccagcaaaaagtggccattgcaaaagggttgatgaccaaaccgaaagttttgatcctagacgaaccgactcggggtgtagacgtcggcgcgaagaaagaaatttaccagttaatcaacaaattcaaagccgaagggatgagcatcattctggtctcatctgaaatgccagaagtgctcggcatgagcgatcgcatcttagtgatgcatgaaggtcgcattactggtgagtttgaagcaaaacacgccgatcaggaaaaactgatggcctgtgccgtcggcaaaaaagtatctgaggaagcagcatga

SEQ ID NO: 38703 - protein, 501 aa, Vibrio vulnificus CMCP6
MNQAILQLSEIEKAFPGVKALDKASLNVYPGRVMALMGENGAGKSTLMKVLTGIYSRDAGEIVYQGQSAQFKGPRDSQQAGISIIHQELNLIRELTIAENIFLGREITSAFGRIDWPQMYAEADKLLARLKVKHSSKTLLGQLSLGEQQMVEIAKALSFESKVIIMDEPTDALTDTETEALFSVIRELREQGCGIVYISHRLKEIFEICDDITVLRDGKFIGQCEVVQTDEDGLIEMMVGRKLEEQYPRIDVVHGQTCLEVIGLTGSGVHDVSFTLKRGEILGISGLMGAGRTELMKVIYGALPSERGVINLDNRTINPISPQDGLANGIAYISEDRKGDGLVLGLSVKENMSLCALDKLSKGVQIQHQDEVVAVDDFIQLFNIKTPSREQIIGNLSGGNQQKVAIAKGLMTKPKVLILDEPTRGVDVGAKKEIYQLINKFKAEGMSIILVSSEMPEVLGMSDRILVMHEGRITGEFEAKHADQEKLMACAVGKKVSEEAA

SEQ ID NO: 38704 - DNA, 1389 bp, Vibrio vulnificus CMCP6
  CDS (1)..(1389): transl_table=11
atgggagaaaatggggctggcaaatcaacactattaaaatgtctattcggtatttacgagaagaatgaaggaaatattctctttctcggtaaggaagtgaatttcacctcatcaaaagaagcattggaatccggtgtttctatggttcaccaagaattgaaccaagtaaaacaatgctccgtcatggataatatttggctcggtcgttacccaaagaaagggttctttgttgatcacgataaaatgtatcgcgataccaaagcaatctttgccgaactggatatcgatatcgatcctaaagtcaaagtcgcgaccttatccgtgtcacaaatgcagatggttgagatcgccaaagcgttctcctatgacgccaaaatcgtcatcatggatgaacccacctcatcgctgacggaaaaagaagtcagccacctgtttaccatcatcaacaagctgaaagagaaaggctgtggcgtggtgtacatctcgcacaagatggaagaaatctttgctatctgcgatgaaatcaccattttgcgcgatggacaatgggtcgacactcgccctctcaaagggctcgatatggaccagatcatcgccatgatggttggtcgcgaattaacgcatcgcttccctgaaaaaaccaacacaccgaaagatgtgattttggaagtggaaaacctcaccgcgctcaaccaaccgtcgattcaagatgtgtcgtttgaactgaaagcgggcgaaatcttaggcgttgcgggccttgtgggttcacgcagaaccgacatcgtcgaaacgattttcggtgtacgcgaacgcagcgaagggcacattcgcttgcatggtcgtgagatgaaaaaccgcgatgcgcatgaagcgatcaacaacggttttgccctcgtgaccgaggaacgtcgctccaccggcatctacggcaacctcgacatcaccttcaatgcgttggtggccaacgtcgatgagtacaaaacccaaatgggcctactcagcgacaaaaagatgaagagtgacacgcagtgggtgattgattccatgcgcgtgaaaacgccctctcatcaaacccacatcagctctttgtcggggggtaaccagcagaaagtcatcattggccgctggctactcacgcaaccggaaatcctcatgctggatgaaccgacacgcgggatcgacgttggcgccaagtttgagatttaccaattaattctcgaattagccaagaaaaacaaaggcatcattattatttcttcggaaatgcctgaattactgggtattacagaccgaatattagtcatgagtaatggccgcgcagcgggcatcgttaataccaaagaaacttcacagaatgaaatattagaactggcttctcgctatctctag

SEQ ID NO: 38705 - protein, 462 aa, Vibrio vulnificus CMCP6
MGENGAGKSTLLKCLFGIYEKNEGNILFLGKEVNFTSSKEALESGVSMVHQELNQVKQCSVMDNIWLGRYPKKGFFVDHDKMYRDTKAIFAELDIDIDPKVKVATLSVSQMQMVEIAKAFSYDAKIVIMDEPTSSLTEKEVSHLFTIINKLKEKGCGVVYISHKMEEIFAICDEITILRDGQWVDTRPLKGLDMDQIIAMMVGRELTHRFPEKTNTPKDVILEVENLTALNQPSIQDVSFELKAGEILGVAGLVGSRRTDIVETIFGVRERSEGHIRLHGREMKNRDAHEAINNGFALVTEERRSTGIYGNLDITFNALVANVDEYKTQMGLLSDKKMKSDTQWVIDSMRVKTPSHQTHISSLSGGNQQKVIIGRWLLTQPEILMLDEPTRGIDVGAKFEIYQLILELAKKNKGIIIISSEMPELLGITDRILVMSNGRAAGIVNTKETSQNEILELASRYL

SEQ ID NO: 38706 - DNA, 1527 bp, Bradyrhizobium japonicum USDA 110
  CDS (1)..(1527): transl_table=11
atggcggaaatcctgttcgaactcgccgggatcagcaagtcctatcccggggtcatggccctcgacgatgtcagcctgcgcgtgtaccgcggcgaggtgctgggcctgatcggcgagaacggcgccggcaaatcgacgctgatgcgcgtgctgggtggcgtgatcgcgccaacccagggcgtgatccgcatcggcggcgtcgaccgcgcccgcatgacggtgagcgaggcgacgcaggccggcatcgccttcgtgcatcaggaattgaacctgttcgagaatctcgacgtcgccgcgaacgtcttcatcggacgcgagaagcttgtcggcggcccgctgaagctggtggacaatgctgagatgcgcgcccgcgtgacgccgctgctggagcggctgggtgccgatttcgctcctgacacactggtcgacaatctgtcgatcgccgagcgccagatggtggagatcgccaaggcgctttcgatcgacgcccgcgtgatcatcatggacgagccgacctccagcctgacgatttcggagaccgagcggctgctcgaggtgattgccgatctgaaggcgcacggcatcgcggtcatctatatctcgcatcggctcggcgagatcatgacctgcgccgaccgcgtcgtggtgctgcgcgacgggcgcacggtgggggagctggcgcgagacgagttgagccatgccgcaatgatccggctgatgatcggccgcgacctgaaagcgctgcatacgccgccgaaacggccgccgcagccgggtggctgcgacatcctcggcctcgtgacatcggcctttcccgatcggcagatcgatctctccgtgcggcatggcgagatcctcggactggcggggctggtgggtgccggtcgcacctcgcttgcccgcgcggccttcggcatcgatccgctgctgggtggcgagatcaggatcgacaacgcgccggtcgatgtcgcatcgccgcgggacgcgatcaggcaaggcatctatctgatgccggaggaccgcaagaaatccgggctcgtgctggagctgccgatccgggagaacgtgacgctggcaagcctgctgaattatgcccggatgtggctggtcagcggcgcggccgagcgcaaggtggcgaaggagcaggtcagacgcctctccatcaaggcgccgagcgtcgatatcgaggccgtcacgctctccggcggcaaccagcagaaagtcgtgctgggcaagtggctctccatgcagccgcgcgtgatgttcttcgacgagccgacccgcggcgtcgatgtcggtgccaagagcgagatctacgcgctgatgcgcgagctcgccgaccacggcgtcgcgatcgtgatgatctcctcggacatggaggaggtgatcggcgtttccgaccggatcgcggtgatgcatgaggggagtgtcagcggcgtgctggagcgcccgcagttcagcgaatacaacgtgttgcagctcgcaatgggccaggcgccggaaaccgtggaagcggcggcgccatga

SEQ ID NO: 38707 - protein, 508 aa, Bradyrhizobium japonicum USDA 110
MAEILFELAGISKSYPGVMALDDVSLRVYRGEVLGLIGENGAGKSTLMRVLGGVIAPTQGVIRIGGVDRARMTVSEATQAGIAFVHQELNLFENLDVAANVFIGREKLVGGPLKLVDNAEMRARVTPLLERLGADFAPDTLVDNLSIAERQMVEIAKALSIDARVIIMDEPTSSLTISETERLLEVIADLKAHGIAVIYISHRLGEIMTCADRVVVLRDGRTVGELARDELSHAAMIRLMIGRDLKALHTPPKRPPQPGGCDILGLVTSAFPDRQIDLSVRHGEILGLAGLVGAGRTSLARAAFGIDPLLGGEIRIDNAPVDVASPRDAIRQGIYLMPEDRKKSGLVLELPIRENVTLASLLNYARMWLVSGAAERKVAKEQVRRLSIKAPSVDIEAVTLSGGNQQKVVLGKWLSMQPRVMFFDEPTRGVDVGAKSEIYALMRELADHGVAIVMISSDMEEVIGVSDRIAVMHEGSVSGVLERPQFSEYNVLQLAMGQAPETVEAAAP

SEQ ID NO: 38708 - DNA, 1524 bp, Bradyrhizobium japonicum USDA 110
  CDS (1)..(1524): transl_table=11
atgagcgacgcgcttccgatcgaggtcacctcacccacgccgctgctcgagctgcgcggcatcagcaaggagtttcccggcgtcaaggcgctggatgacgtgtcctttgccgtcttccccggcgaagtccatatgctgctgggggagaacggcgccggcaagtcgagcctgatgaaggtgctgtgcggcgcctaccgcgccgatgccggcgagttctactacaagggcgagaaggtcgcgatcggctcggccgcggatgcacagaagctcggcattgccgtgatcttccaggagttctcgctggtcccccatctcgacatcgcccagaacatcttcctcggccgcgagccgaagggccgcatccccggcacgatcgaccggagcaagatcctcgccgacgccaaacgcgtgctcggcaccatcggcttcgacatcgatccctccacgatcgtggacaagctcggggtggcgcagcagcagatggtcgagatcgccaaggcgatcagccagaacgcacgcatcctcgtcatggacgagccgaccgcggcgctgtccgaccgcgagaccgagctcctgttcgcgctgatcgcgcggctgaaagccgacggcgtgtcgatcgtctatatctcgcaccgcatggcggaggtgttcgcgctcggcgatcgcatcacggtgctgcgcgacggccgccgcatcgacggcgtccgcccggccgacgtcacgccggaccagctcgtccgcatgatggtcggacgcaccgtcgacatgacctatccgcgcaatttcgccgacaagcccggcgaggtactgctgcaggtcaagggcctgagctcctcgaccgggatctccgacatcaacatcgaggtgcgccggggcgagatcgtcggcctgtgcggcctggtcggctccggccgcagcgaagtcgcgcgcgccatcttcggcgccgatcccgtcagctccggcgagatcatcttcgacggcaagaccatctccggcgagcctgatctcgccgcccgccgcggcatcgcgctgatcccggagagccgcaagagcgagggcctcgctctgctgcggtcggtgagcgacaatctggtggtgtcggcgctgcgaaaactgttcccgagcggactgttcgaccagcgttcggcgcagcgcacctccgacggcctgatccggcagctgaggatcgcgacgcccagcgcgcgccagaccgtcggcctgctctcgggcggcaaccagcagaaggtcgtgatcggcaagtggctggccgccggctcgaagctcttcatcttcgacgagccgacgcgaggcatcgacatcggcgccaagtccgagatttttgcgctgatcgaccgcctggtcgcggaaggcgccgccgcactgatgatctcgtccgagcaggtcgagatctgccatgtctgcgaccgcgcctatgtgatgcgcgagggccgcatcgcgggacacctgacgcgcaacgaactgaccgaggagaacatcgtgcgactggggatgcatcatgcgtga

SEQ ID NO: 38709 - protein, 507 aa, Bradyrhizobium japonicum USDA 110
MSDALPIEVTSPTPLLELRGISKEFPGVKALDDVSFAVFPGEVHMLLGENGAGKSSLMKVLCGAYRADAGEFYYKGEKVAIGSAADAQKLGIAVIFQEFSLVPHLDIAQNIFLGREPKGRIPGTIDRSKILADAKRVLGTIGFDIDPSTIVDKLGVAQQQMVEIAKAISQNARILVMDEPTAALSDRETELLFALIARLKADGVSIVYISHRMAEVFALGDRITVLRDGRRIDGVRPADVTPDQLVRMMVGRTVDMTYPRNFADKPGEVLLQVKGLSSSTGISDINIEVRRGEIVGLCGLVGSGRSEVARAIFGADPVSSGEIIFDGKTISGEPDLAARRGIALIPESRKSEGLALLRSVSDNLVVSALRKLFPSGLFDQRSAQRTSDGLIRQLRIATPSARQTVGLLSGGNQQKVVIGKWLAAGSKLFIFDEPTRGIDIGAKSEIFALIDRLVAEGAAALMISSEQVEICHVCDRAYVMREGRIAGHLTRNELTEENIVRLGMHHA

SEQ ID NO: 38710 - DNA, 1587 bp, Bradyrhizobium japonicum USDA 110
  CDS (1)..(1587): transl_table=11
gtgtccgcagcatcagcggacgccggtgggagtgacgtcgttatggagaacagccccgatcctgctccgccccttctggaggtgcgcgggatcagcaagagcttcggcgctgtgcgtgcgttgcaggaggtcgacttcacgcttcgcgccggcgagatccatgcgctgctcggcgagaacggcgccggcaagtccacgctgatcaaggtcgtcaccggcgtattcccgcgcgacgccggcatcgtcaggctcggcggcgaggaggtcgcgccgcgctcggccaaggccgcgcttcaggccggcatcgctacggtctaccaggaggtcaatctgctgccgaatctctcggtggcgcagaacctgtttctcgaccgccagccgatgcgcttcggcatcgtgcgcgacggcgagatgcgccgccgcgccaaagcgctgctcgcggagttcggcctcgacatcgacgtatcagcgccgctcggcagctattccgtcgccgtgcagcatgtcaccgcgattgcgcgcgccgtggatctgtccgcgcgcgtgctgatcctggacgagccgaccgcgagtctcgaccgtcacgaggtcgagatcctcttcggcatcatgcgccaactggcgaaacgcggcatcggcatcgtcttcgtcagtcatttcctcgaccaggtctacgagatctccgaccgcatcaccgtcttgcgcaacggccgcctggtcggcgaacgcgagaccgcctcgctgccgcggatcgagctgatccgcatgatgctcggccgcgaactggccgagaccaccggcgcgcgggcggcgacacgcgagcatcaggcgcgcgagatctgcgcgagcttcgagaattacggcaaatccggctatgtcgcgccgttcaatctcgagctgcgccatggcgaggtcgtcggcctcgccggcctgctcggctcgggtcgcaccgagacggcgcggctggtgttcggcgccgagcgcgccgatcgcgggcaggcgaaggttgaaggcgcgcccgtgcggctgcactcgccgcgcgacggcgtgcgccacggctttggctattgcccggaggaacgcaagaccgacggcatcgtcgccgagctcagcgtgcgcgagaacatcgtgctggcgctccaggccaaacgcgggctgcatcggccgctgtcgcgccgcgagcaggacgagatcgcgcgccgctacgtcaggatgctggacatccgtccgtccgatccggagcgcccggtgggcctgctctccggcggcaatcagcaaaaagtgctgctggcgcgctggctcgcgacctcgccgcggctgctggtgctggacgagccgacccgcggcatcgacgtcggcgcgcatgccgagatcatccgccttatccgcgacctctgcgacgacgggctctctctgctcgtgatctcctcggagctggacgagatcgtgacctattcggatcgggtcgtggtgctgcgcgaccgcgcccatatcgaggagctcgcgggcgaggcgatcgacgtcggcaacattctcgcggccatcgcggccgacggcgccgccacagcgcatgaggggcgggcatga

SEQ ID NO: 38711 - protein, 528 aa, Bradyrhizobium japonicum USDA 110
MSAASADAGGSDVVMENSPDPAPPLLEVRGISKSFGAVRALQEVDFTLRAGEIHALLGENGAGKSTLIKVVTGVFPRDAGIVRLGGEEVAPRSAKAALQAGIATVYQEVNLLPNLSVAQNLFLDRQPMRFGIVRDGEMRRRAKALLAEFGLDIDVSAPLGSYSVAVQHVTAIARAVDLSARVLILDEPTASLDRHEVEILFGIMRQLAKRGIGIVFVSHFLDQVYEISDRITVLRNGRLVGERETASLPRIELIRMMLGRELAETTGARAATREHQAREICASFENYGKSGYVAPFNLELRHGEVVGLAGLLGSGRTETARLVFGAERADRGQAKVEGAPVRLHSPRDGVRHGFGYCPEERKTDGIVAELSVRENIVLALQAKRGLHRPLSRREQDEIARRYVRMLDIRPSDPERPVGLLSGGNQQKVLLARWLATSPRLLVLDEPTRGIDVGAHAEIIRLIRDLCDDGLSLLVISSELDEIVTYSDRVVVLRDRAHIEELAGEAIDVGNILAAIAADGAATAHEGRA

SEQ ID NO: 38712 - DNA, 1701 bp, Bradyrhizobium japonicum USDA 110
  CDS (1)..(1701): transl_table=11
gtgaggggctctctccacacgggcagttacccttgcggagactccccctcacccgatcgctacgcgatcgacctctccccgcaagcggggagaggtgaagtcagcgaccaagggacaacgacgatgaccgccatgctggagatgcgcaacgtcagcaagagctttgccggcgtccaggcgctgcgcgacgtcaacttctcggttcacgccgggcagatccacgcgcttgtcggcgagaacggcgcaggcaagtccacgctgatgaaggtgctcagcggcgtctatccgcacggcagctacgagggcaccatcatcttcgagggcgaggagcgccgcttccgcgacatcaacgattccgaggcgctcggcatcatcatcatccaccaggagctggcgttgatcccgttgatgtcgatcgccgaaaacatcttcctgtcgcatccgccgtcgaaattcggcgtgatcgaccgcgacgaggtgtaccggcgcacgcgcgagctgctggcgcaggtcggcctgagggaatcgccggatacgctgatcaccgacctcggcgtcggcaagcagcagctggtcgagatcgccaaggcgctgtccaagcgggtgcggatgctgatcctggacgagccgaccgcgagcctcaacgaagccgatagtgccgcattgctcgaacgcctgatggcgttccgcgagcagggcatcggctcgatcctgatctcgcacaagctcaacgaggtggccaaggtcgccgaccacatcaccgtgctgcgcgacggccgcaccgtcgacagcatcgactgccgtgccgagccgatccaggaagaccgcatcatccgcagcatggtcaaccgcgatctcgcccatcgcttccccgagcgcagcgtgaagatcggcgagcccgtgctcgccatcgagaactggtcggtctatcaccccattcatcccgagcggcaggtcatcaagaacgtcaatttcggcgtcaagcgcggcgaggtcgtcggcatcgccgggctgatgggcgccggccgcaccgaattcgccatgagcctgttcggccgctcctggggcaccaatatcagcggctcgatccggctcgaaggcagggagatcgtgctgccgagcgtcgccgccgcgatcgacgccggccttgcctatgtcaccgaggaccgcaagcagctcgggctgatcctcgccgacgacgtccgcaagaacatcacgctcgccagcctcgaccaggtcgcgccggggagggtgatcgacgacatcgccgagctgaaggttgccagcgactacaggaaccgcatgcgcatccgctgctcggacgtctaccaggagaccggccagctctccggcggcaaccagcagaaggtggtgctgtcgaaatggctgatgaccgaccccaaggtgctgatcctggacgagccgacaaggggcatcgacgtcggtgccaaatacgagatttactgtatcatcaacgagcttgcggaggccggccgcggcgtcgtggtcatctcctcggagatgcccgagctgctcggcatctgcgaccgcatctgcgtgatgaacgacggcgctttcgtcggcgagttctccggcacggaagcgacgcaggagaagatcatgcgcgccatcatgcgcaaccagagaagcaacggaaacggcgtgcctgaggccgcggagatgggaggattgcagccatga

SEQ ID NO: 38713 - protein, 566 aa, Bradyrhizobium japonicum USDA 110
MRGSLHTGSYPCGDSPSPDRYAIDLSPQAGRGEVSDQGTTTMTAMLEMRNVSKSFAGVQALRDVNFSVHAGQIHALVGENGAGKSTLMKVLSGVYPHGSYEGTIIFEGEERRFRDINDSEALGIIIIHQELALIPLMSIAENIFLSHPPSKFGVIDRDEVYRRTRELLAQVGLRESPDTLITDLGVGKQQLVEIAKALSKRVRMLILDEPTASLNEADSAALLERLMAFREQGIGSILISHKLNEVAKVADHITVLRDGRTVDSIDCRAEPIQEDRIIRSMVNRDLAHRFPERSVKIGEPVLAIENWSVYHPIHPERQVIKNVNFGVKRGEVVGIAGLMGAGRTEFAMSLFGRSWGTNISGSIRLEGREIVLPSVAAAIDAGLAYVTEDRKQLGLILADDVRKNITLASLDQVAPGRVIDDIAELKVASDYRNRMRIRCSDVYQETGQLSGGNQQKVVLSKWLMTDPKVLILDEPTRGIDVGAKYEIYCIINELAEAGRGVVVISSEMPELLGICDRICVMNDGAFVGEFSGTEATQEKIMRAIMRNQRSNGNGVPEAAEMGGLQP

SEQ ID NO: 38714 - DNA, 1503 bp, Bradyrhizobium japonicum USDA 110
  CDS (1)..(1503): transl_table=11
atgcgagaggatcgttcgcccatcctggaactgcaaggcatcacgaagagcttcggcggcgtcgaggcgcttcgtggtgtcgacttcgcgcttcatcccggcgagatccacggtctcgtcggcgagaacggcgccgggaaaagcacgctgatgaagatcatcgccggcgtgcacaccgaattctccggccgtttcctgctcgacgggaaggagacccatttccgctcgacgcgcgacgcgcatgcggccggcatcgccatggtgcaccaggagctctctgtcgcgcccgacctcacggtcgcggagaacgtcttcctcggcaaccaaccgaccaacgccctcggtctggtgcagtggcggcgcatggcgcgcgaggccggcgagcagcttgcccgcttcggcatcgacgtcgatccgatgagccggctcggcgacctcccgatcgggctccagcagctgatcgagatcgcccgcgtgctgttctccggcgcccgcatcgtcatcctggacgagccgacctccgccctctccccgcccgaggtcgagcggctgttcgcgacgctccggcgccttcgcgaggaaggcaccgcaatcgtcttcatctcgcatttcatcgaggacatcttgctcgtgtcggacacggtgaccgtgttccgcaacggacggaagatcgcggagacagcgagcgcggcgaccagcaagggcgcgctgatcgaggccatgatcggccgcggcggcgaagcgctcgagcatagctacaccgatgatctgatgctgccgcagccgagcggcagctcggtggtgctgaaggtcgaccagctctcgctggcgcgcagcctgaaggacatctccttcgaggcgcgcgccggcgaggtgctcggcatctacggcttcatgggttgcggacagcaggagctgtcgcgcatcctgttcggcaagctgaagccggacggcggcacgctcgccgtcgagggcaaacccaagaccttcgccagcacggcggctgcgcgccgcgcgggcgtcgcgctggtgccggagagccggcgcgacatgctgtttcaccaggagccggtctacaagaacatctcgatcagcattctggatcgcatctcgtcgctgctgctcaagccggcacaggagcgcgacatcgccaggcgccaggtcgagcaattgcagatcaggccgccggtggtcggcctcgatctcggcatgctctccggcggcaaccagcagaaggtcgcgctggcgaaatggctgacctatccgccaaagctgctggtgctgtgcgagccgacccgcggcatggacgtcggcgccaagaacgacgtcatcaacatcgtccgtgacctccgcgccagggggctcgcgatcatcgtgctgtcgaccgagccggagacggtgctgtcgctggccgaccgcatcctcgtgctcaagcgcggcgcactggtgcgggaattttcgaacgagccggtcagcaaggaccgcctgctggaagcggcgtga

SEQ ID NO: 38715 - protein, 500 aa, Bradyrhizobium japonicum USDA 110
MREDRSPILELQGITKSFGGVEALRGVDFALHPGEIHGLVGENGAGKSTLMKIIAGVHTEFSGRFLLDGKETHFRSTRDAHAAGIAMVHQELSVAPDLTVAENVFLGNQPTNALGLVQWRRMAREAGEQLARFGIDVDPMSRLGDLPIGLQQLIEIARVLFSGARIVILDEPTSALSPPEVERLFATLRRLREEGTAIVFISHFIEDILLVSDTVTVFRNGRKIAETASAATSKGALIEAMIGRGGEALEHSYTDDLMLPQPSGSSVVLKVDQLSLARSLKDISFEARAGEVLGIYGFMGCGQQELSRILFGKLKPDGGTLAVEGKPKTFASTAAARRAGVALVPESRRDMLFHQEPVYKNISISILDRISSLLLKPAQERDIARRQVEQLQIRPPVVGLDLGMLSGGNQQKVALAKWLTYPPKLLVLCEPTRGMDVGAKNDVINIVRDLRARGLAIIVLSTEPETVLSLADRILVLKRGALVREFSNEPVSKDRLLEAA

SEQ ID NO: 38716 - DNA, 1524 bp, Bradyrhizobium japonicum USDA 110
  CDS (1)..(1524): transl_table=11
atgaacgatccgatcctcgagatgcgcggggtctcgaaaagcttcttcggcatcaaggcgctgcgtgccgtcgatctcaccgtctatcccggcgaaatccatgccctgatgggcgagaatggcgccggcaaatcgactctgatgaagatattgtccggcgcctaccggcccgatccgggcggagagatccgcatcgaaggcaggccggtgcggatcgaaggcccgctcggcggccgcgccgcgggcatctccatcatctatcaggagctgtctttggctcccaatctcagtgtcgcggagaatatttatctcggccgcgagatctcgcgctcgggcttgctggcgcgcggcgccatgcgccagggcgtcggccccatcctggaacggctgggcgcggacttccagccatcgacattggtggcgcatctgtcgatgggccagcgccagctcgtcgagatcgcgcgtgcgctgcacgcgaggtcgaaaatcctgatcatggacgagccgaccactgcgctgtcggccggcgagagcgaacggctgttcgcgctgatccgtcagctccgcgccgaggggctcgccatcatctacatctcgcatcgcatggacgaggtctacgcgctcggcgaccgcgtcaccgtcttgcgcgatggccgtctcgtgggctcgctcgacaagccggaaatccgggccgataccatcgtgcggctgatggtggggcgcgacgtctcctctttctacaagaaggaccatgacccggaggcggggcggggacaccctgtgctctgtgcgatcgacatgtctgacggccggcgcgtcaagggctgctcgctcaccgtgcatgccggcgaggtagtggggcttgccggcctgatcggtgccggacgcacggagcttgcgcatctcatcatcggcgcggcggcaaaaacgtcgggccgtctcgaactcgaaggccgcccgatcgacatccgcacgcccggcgaggcgctcgaggccggcatcgcctatctgacggaggacaggaaggcgctcggcctgtttctcgacatgtcatgcctggacaacatcaatctcgcggtgctcgggcgcgatgcgaagcttggctggttcctggatggtgacaaggcgcgcgagcgcgccgacagggccttcgcggggctcagcatccgcgcggccaatgtcggcgtgccggccgggggcctgtccggcggcaaccagcagaaggtgctcttgtcgcggcttctcgccatcgcgccaaagatcctgatcctcgacgagccgacgcgcggcgtcgatgtcggcgcgaagtcggagatctattcgatcatcgacaatctcgccaaggccggcacagcgatcctcgtcatctcgtccgacctgccggagatcatcggcatctgcgatcgcgtcatcgtgatgcggtcgggacacatcgcaggcgaggtcagccgaaccgagacggcgccgctcaatcaggaggatatcatggcacttgctacggggatggagcatctcgatgcctga

SEQ ID NO: 38717 - protein, 507 aa, Bradyrhizobium japonicum USDA 110
MNDPILEMRGVSKSFFGIKALRAVDLTVYPGEIHALMGENGAGKSTLMKILSGAYRPDPGGEIRIEGRPVRIEGPLGGRAAGISIIYQELSLAPNLSVAENIYLGREISRSGLLARGAMRQGVGPILERLGADFQPSTLVAHLSMGQRQLVEIARALHARSKILIMDEPTTALSAGESERLFALIRQLRAEGLAIIYISHRMDEVYALGDRVTVLRDGRLVGSLDKPEIRADTIVRLMVGRDVSSFYKKDHDPEAGRGHPVLCAIDMSDGRRVKGCSLTVHAGEVVGLAGLIGAGRTELAHLIIGAAAKTSGRLELEGRPIDIRTPGEALEAGIAYLTEDRKALGLFLDMSCLDNINLAVLGRDAKLGWFLDGDKARERADRAFAGLSIRAANVGVPAGGLSGGNQQKVLLSRLLAIAPKILILDEPTRGVDVGAKSEIYSIIDNLAKAGTAILVISSDLPEIIGICDRVIVMRSGHIAGEVSRTETAPLNQEDIMALATGMEHLDA

SEQ ID NO: 38718 - DNA, 1494 bp, Bradyrhizobium japonicum USDA 110
  CDS (1)..(1494): transl_table=11
atgcagcccattctggaaatccgcaacggaacgaagctgtttggaaggatccccgccttccaggaagtcgatttcgccgtttcgccgggagaggttcacgccattctcggcgagaacggtgccggcaagtcgacgctgacgaaggttcttgccggcgtctacaagctcacgtccggagagatgctcctgaacgggacgccggtgcatttgtcgacgcctgccgaaggcctgaagcagggtgttgtcatggtctaccaggagaccaatctcgtgccgtcgatgacggtggcgcagaacatctacctaggcgaggagaaggtgttcaataggctgcggggactctacatccaggcccgacaattcctggctggcatgggattccaggtcgatcccacggcacaggtctcgcagctcggagcggcgcaaaagcagatggtggagatcgcgcgcgccgttcatcacaaggcgaaggtgatcatctttgacgaaccgacggcgacgctcacgccggaggagaagcggcacttcttcaacctgatccggcgtcttgtggccgacaaggtcgcgatcatcttcatttcgcacgcgcttgaagaggcgatgcagttggccgatcgcattacaattctccgggacgggcggcttgtcgcatcggatgtcaaggagacgttcacgcgcgatacggtcatccaggcaatggtcggacgaaacctgaccgagacgttgcatggcgaccacggccgcccgcccaggccgtatggtgaacgggtgctcagcgtggagaatttgtcttcgggcacgatggtccgcaacacgtcattctctatcttcgcaggacaggtgacgggtgtcttcgggctgatcggcgccggtcgcaccgaaatgatgaaggtggtcgctggcgtgttgaagcgggacatcttccatggtggcgagatcaagtatcgcggcaaatcggtccgctaccgggttccgcggatggcggtccgcgagggcatcgtctacgtcacggaagaccgcaagttcgacggttttttcgagacaatgacggtggccgagaacctgcatctgggcgagctctcgcgcttctcgaacccgctgtccgtgatctcgatgacacaggcgaaggagctggcgcgacaatgggccgggcggcttcagcttcggtcgatcaatgaaaaggccagggtgatcgaactctccggcggcaaccagcagaaggtcgtcatcgcgcggtcgctcatccagaagcccaggctgatcatcttcgacgagccgacccgcggtgtcgacgtcggcgccatcgtcgagatccaccagttcatcaatagcctggctgacgacggtctcgccgtggtcgtgatctcctcctacctgcccgaggtcctggcactctcggaccgcatcctggtcgcaaagcggggcaagatcgtcgaagagatcaagacagccgaggcaaccgagcagcagatcatgtacgccgccgtccactag

SEQ ID NO: 38719 - protein, 497 aa, Bradyrhizobium japonicum USDA 110
MQPILEIRNGTKLFGRIPAFQEVDFAVSPGEVHAILGENGAGKSTLTKVLAGVYKLTSGEMLLNGTPVHLSTPAEGLKQGVVMVYQETNLVPSMTVAQNIYLGEEKVFNRLRGLYIQARQFLAGMGFQVDPTAQVSQLGAAQKQMVEIARAVHHKAKVIIFDEPTATLTPEEKRHFFNLIRRLVADKVAIIFISHALEEAMQLADRITILRDGRLVASDVKETFTRDTVIQAMVGRNLTETLHGDHGRPPRPYGERVLSVENLSSGTMVRNTSFSIFAGQVTGVFGLIGAGRTEMMKVVAGVLKRDIFHGGEIKYRGKSVRYRVPRMAVREGIVYVTEDRKFDGFFETMTVAENLHLGELSRFSNPLSVISMTQAKELARQWAGRLQLRSINEKARVIELSGGNQQKVVIARSLIQKPRLIIFDEPTRGVDVGAIVEIHQFINSLADDGLAVVVISSYLPEVLALSDRILVAKRGKIVEEIKTAEATEQQIMYAAVH

SEQ ID NO: 38720 - DNA, 1497 bp, Bradyrhizobium japonicum USDA 110
  CDS (1)..(1497): transl_table=11
atgagcgacatcatgctctcgctgcgcaaggcgacaaaactctacgccggcgttcccgccatcgacggggtcgacttcgacctgcgccgcggcgagatccacgcgctggtcggcgagaacggtgccggcaagtcgacgctcaccaaggtcatggccggcgtggtgacgctgacctcgggcgccatgacggtcgacggcgcggacgtcgcaccgaggacgccgctggaggcacgcaatctcggcatcgccatggtgtttcaggagaacagcctggtgccgaccatgacggtggcgcagaatttattcctcgggcaggagaagttctataaccgcttgcgcggaatctacatcgccgcgcagcagtttttgcaatcgctcaattttgacgtcacgccgaccgccacggtcagcggtctcggcgcggccaagaagcagatggtggaaattgcgcgcgcggttctgcaccgcgccaaggtcatcatcttcgacgagccgaccgcgtcgttgacgccggaggagaagaagtacttcttcgacctcgtccgcgacctcaggaagcgcggtgtctcgatcgtcttcatctcacatgccctggaagaggccctgctgctcgccgaccgcatcacggtcctgcgcgacggcaagcatgtcgtgaccgacgacgccgccaaattcgaccgcgccgcgatcgtacaggccatggtcggccgcgacctgtcgaacacgctctacggcgcacgcaagcgcagcgtgcggccggccggcccgcgcgtgctcacggtgcagaatttgaagatggcgccgatggtgaagaacaattcgctgtcggtgttcgcagggcagatcaccggcgtattcggcctcgtcggggccggccgcaccgagacgttcaagatcgtctccggcgtgctgaagcgcgacttcttccacggcggcgagatcctgctgcacgacaagccggtgcgctaccgggtgccggcgccggcggtcaaggccggcatcgcctatgtcaccgaggatcgcaaggtcgagggcttcttcgagacgtcctcgatcgcgcgcaacatctatctcgggcttctgtcgaagtttcccaagggccgcatgatgctgtcgcggcgggaaaccgagaccatcggcaagacctggatcgagaagctcagggttcgcgccatcggcgaccacggcaaggtggtcgagctgtccggcggcaatcagcagaaggtcgtgatcgccaaatcgctggtgcaggagcccgacctgatcatcttcgacgagccgacccgcggcgtcgacgtcggcgccatcgtcgagatccacgagctgatcaaccagctggccgacgagggcaaggccgtcgtggtcatctcgtcctatttgcccgagatcatggcgctctccgaccgcatcctggtctcacgccagggcaaggtcgtggaggaattctccgcgctggacgcgacggaagagaggatcatgtacgcggcgatccactag

SEQ ID NO: 38721 - protein, 498 aa, Bradyrhizobium japonicum USDA 110
MSDIMLSLRKATKLYAGVPAIDGVDFDLRRGEIHALVGENGAGKSTLTKVMAGVVTLTSGAMTVDGADVAPRTPLEARNLGIAMVFQENSLVPTMTVAQNLFLGQEKFYNRLRGIYIAAQQFLQSLNFDVTPTATVSGLGAAKKQMVEIARAVLHRAKVIIFDEPTASLTPEEKKYFFDLVRDLRKRGVSIVFISHALEEALLLADRITVLRDGKHVVTDDAAKFDRAAIVQAMVGRDLSNTLYGARKRSVRPAGPRVLTVQNLKMAPMVKNNSLSVFAGQITGVFGLVGAGRTETFKIVSGVLKRDFFHGGEILLHDKPVRYRVPAPAVKAGIAYVTEDRKVEGFFETSSIARNIYLGLLSKFPKGRMMLSRRETETIGKTWIEKLRVRAIGDHGKVVELSGGNQQKVVIAKSLVQEPDLIIFDEPTRGVDVGAIVEIHELINQLADEGKAVVVISSYLPEIMALSDRILVSRQGKVVEEFSALDATEERIMYAAIH

SEQ ID NO: 38722 - DNA, 1545 bp, Clostridium tetani E88
  CDS (1)..(1545): transl_table=11
atggaaaaagttgttgaaatgaagggaataacaaaggtttttcctggaaccatagctaatgaagatgtagattttgaacttaaaaaaggagaaattcatgttcttttaggagaaaatggtgcaggtaaaaccactcttatgaatatactttatggattatatcaacctgaaggtggagaaatatatataaaaggacagaaagcaaaccttaaaaatcctaaagatgcaataaaattaggggttggaatggttcatcaacattttatgttggttcataattttacagtggcggaaaatatgattttaggtcaagaacctaaaaaaggaagcctaaaaatagacatagaaaaggctaaaaaagaaactaaggaattagcagataaatatggatttaatataagtcctgatgatattgtagaagatataactgtaggtcaacaacaaaaggttgaaatattaaaagctctttatagaggagcagaaatactaatattagatgagccaacagcagtattaacacctcaagaaatagaggagttaggaaagatacttaaaaacttagtaaaagaaggaaaatctataatcttaataactcataaattaaaagaagttatgagtatgagtgacagggttacagtaataagaagaggaaaatacatagatacagtaaaaactaaagataccgacatagacggtttagcagaacttatggtaggaagaaaggtaaatttagtaatagaaaaagaagaaactaagttaggagaatctatattaaaaatagaaaatctaaaagctaaagatcaaagaggattacctgctcttaaaggagtaaatttggaattaagagaaggggagatactaggtattgcaggagtagatggaaatggtcaaacagagttaatcgaaactatagttggcttgagaaaatctacagaaggaaatatatatttaaaaggcgaaaatataacaggaaaaactactaaagaaataacagaattaggtatagcccatgtaccagaagatagacataaaagagggttggttcttggatactctttagtagaaaattctgttttaggtattcatgataaagctccttttgctaaaggtattattatggattatgataaaataagagaacattccaaaaaacttatagaaaactttgatgtaagaactcctaatgaggatgtagttgcatcatcactatctggtggtaaccaacaaaagctcatagtagcaagagaaatagaaaaagatcctgcaatgataattgcagttcagcctactagaggattggatgtaggggctatagagtatatccacaaaagattagttggagaaagagatagaggaagaggagttttattggtatccttagagttagatgaagtaatgtctttatctgatagaattgcagtaatgtatgaaggtgaaattgtagatgtattggatgcaaaggatgccacagaacaaaaacttggaattcttatggcaggaggaactttaaaaaaagaaaaagaaggaggggcaaaacttgagtaa

SEQ ID NO: 38723 - protein, 514 aa, Clostridium tetani E88
MEKVVEMKGITKVFPGTIANEDVDFELKKGEIHVLLGENGAGKTTLMNILYGLYQPEGGEIYIKGQKANLKNPKDAIKLGVGMVHQHFMLVHNFTVAENMILGQEPKKGSLKIDIEKAKKETKELADKYGFNISPDDIVEDITVGQQQKVEILKALYRGAEILILDEPTAVLTPQEIEELGKILKNLVKEGKSIILITHKLKEVMSMSDRVTVIRRGKYIDTVKTKDTDIDGLAELMVGRKVNLVIEKEETKLGESILKIENLKAKDQRGLPALKGVNLELREGEILGIAGVDGNGQTELIETIVGLRKSTEGNIYLKGENITGKTTKEITELGIAHVPEDRHKRGLVLGYSLVENSVLGIHDKAPFAKGIIMDYDKIREHSKKLIENFDVRTPNEDVVASSLSGGNQQKLIVAREIEKDPAMIIAVQPTRGLDVGAIEYIHKRLVGERDRGRGVLLVSLELDEVMSLSDRIAVMYEGEIVDVLDAKDATEQKLGILMAGGTLKKEKEGGAKLE

SEQ ID NO: 38724 - DNA, 1515 bp, Clostridium tetani E88
  CDS (1)..(1515): transl_table=11
atggtggaaaataatattatcttagaaatgaatggtatttccaaaaatttccctggtgtaaaggctttagatggagtagatttaaaagtaaaaaaaggaacagtacatgctttaatgggggagaatggagctggaaaatctacacttatgaagtgtctctttggcatatatagatcggatgatggggaaatagttttaggtgggaaaaaagtacagtttaaaaatgcaaaagatgcactagaaaatggaatttctatgattcatcaagaacttcatccagtaccacatagaagtgttatggagaatgtgtggttaggtagatttcctgtaaaaaaggtatttggattgggcattgttgaccataaaaagatgtatgaagatacaaaggatttattaggtaaattgaaaatgaatatagatccaaatacattagtttccaaattatcagtatcacaagttcaaggtttagaaattgcaaaggctgtttcttataattccaaaataatagttatggacgagccgacttcttctttaacagagaatgaggttactcatctttttaatataattagtgatttaaaaaatcaaggagtagcaattatatatatatctcataaaatggaggaaattttaaaaattgctgatgaagtaactataatgagggatggtaagtatatagggacttgggaagcagaagggcttacaacggatttgattatatcaaagatggtaggaagagatttaacaaatagatttccacctaaagaaaacaccccaggtgaagttataatgaaagtagaaaatttaacttcagctaataacaaatcctttaaagatataagttttgaactaagaaagggagaaatattaggaattggaggcttagttggagctcaaagaacagaacttgttgagtctatatttggattaaggaaaatagaaacagggaaaatatatataaatggacaagaagttaaaattaaaagtcctataaatagcaagaaatatggtattgctttgttaacagaagagaggcgctcaactggaatttttccagtattaacagtaggtgacaatactataatagcaggtttagataaatacattgatttaaaatttgttgtaaatcaaaaaagaggaatgaaagatattaaaaacagtatagaaaaacttaatataagaacaccttctcatgctactcaaataaaaaatctttctggtggaaatcaacaaaaagttattttttcaagatggttacttacagaaccagatgtattaataatggatgagcctacaagaggaatagatgtaggtgctaaatatgaaatatatagtataatatctgacctatcaaaaatgggaaagagtattataatgatatcttctgaaatgcccgaattaattggaatgtctgacagaataatgataatgtgtgatggaagattaagcggaataatagagggtgaagaagctacccaagaagaaataatgaaatatgctactcgatttatttag

SEQ ID NO: 38725 - protein, 504 aa, Clostridium tetani E88
MVENNIILEMNGISKNFPGVKALDGVDLKVKKGTVHALMGENGAGKSTLMKCLFGIYRSDDGEIVLGGKKVQFKNAKDALENGISMIHQELHPVPHRSVMENVWLGRFPVKKVFGLGIVDHKKMYEDTKDLLGKLKMNIDPNTLVSKLSVSQVQGLEIAKAVSYNSKIIVMDEPTSSLTENEVTHLFNIISDLKNQGVAIIYISHKMEEILKIADEVTIMRDGKYIGTWEAEGLTTDLIISKMVGRDLTNRFPPKENTPGEVIMKVENLTSANNKSFKDISFELRKGEILGIGGLVGAQRTELVESIFGLRKIETGKIYINGQEVKIKSPINSKKYGIALLTEERRSTGIFPVLTVGDNTIIAGLDKYIDLKFVVNQKRGMKDIKNSIEKLNIRTPSHATQIKNLSGGNQQKVIFSRWLLTEPDVLIMDEPTRGIDVGAKYEIYSIISDLSKMGKSIIMISSEMPELIGMSDRIMIMCDGRLSGIIEGEEATQEEIMKYATRFI

SEQ ID NO: 38726 - DNA, 1506 bp, Clostridium tetani E88
  CDS (1)..(1506): transl_table=11
atggaatctaacatagtactctcaatggaggacataactaaaagttttccaggagtaaaagctttaaaaaatgcaaatttagaattgagaaaaggagaagtacacgttcttctaggtgaaaatggtgctggaaaatctacactaatgaaaatattgggcggggtttatacaaaagattcaggaaagatatatctagaaggtgaagaaaccgaaatagttagtgttaatgaagccaaagcaaaagggatatcaataatattccaagagttaaacttaattgaccacttaactgttgctgaaaatatttttattggaaatgagaatttaaaaaataaaaaactaaaaattgtagactacaagaccatgaatagtaaaacagagagcatattaagagaactagatatagaagtaaaaccaaatgaattagtgaaaaatctaagtattggacaaaaacaaatgattgaaattgctaaatcagtttcttttgatgcgagaataatagttatggatgaacctacgtcatctttaactgataaggaatgtgaaaaactatttcaaattgtaaataaactaaaaaaacaaggtgttgcaatagtctatatatctcataaatttgaagagtttaaatatattgccgacagaattacaataatgagagacggagagtatgtaaaaactgtagaatttaaaaatacatcagaagatgaattagtaaaattgatgataggaagagagcttggtaatagatttagtgatgaatatattaaaaaaggagaaattatattcaaagctgaaaacatagttactaataaaatcaacaatgtttcatttgaagttagagcaggagaaatagttggactatacggtcttatgggaagtggaagaactgaaaccgcaatggctatatttggatatgataagataaagtctggcaaattatatattgaaaataaagaagtgaaaattaaacatccaaaagatgctgttagggcaggaatagcttatgtaagcgaagatagaagaaatcttggagtagtagttggttttagtgtaggtgaaaatattagtttatcaagtatggataaggtttctagtagtggagtaataagtgaaaaagaagaaaaagaagtagcaaataaatttatagaaagcttaaagataaaaactccaagcgccttacaaaaagtgaaaaacttaagtggaggtaatcaacaaaaagttgccatagcaaaatggcttcagagaaatagtaaaatttacatatttgatgaaccaacaaggggtatagatattgggtctaaggcggaaatatataaattaataaaggacttagcaaaaaaaggacatgctataatacttatatcttctgaaatgcctgaaattataggattatcagatagaatagttgtcatgagtaatagctgtgtgtctggttctattgaaaatgatatacaaaataaaaaagatgtagaagaaaaaataatgaaatatgcaataggaaagtga

SEQ ID NO: 38727 - protein, 501 aa, Clostridium tetani E88
MESNIVLSMEDITKSFPGVKALKNANLELRKGEVHVLLGENGAGKSTLMKILGGVYTKDSGKIYLEGEETEIVSVNEAKAKGISIIFQELNLIDHLTVAENIFIGNENLKNKKLKIVDYKTMNSKTESILRELDIEVKPNELVKNLSIGQKQMIEIAKSVSFDARIIVMDEPTSSLTDKECEKLFQIVNKLKKQGVAIVYISHKFEEFKYIADRITIMRDGEYVKTVEFKNTSEDELVKLMIGRELGNRFSDEYIKKGEIIFKAENIVTNKINNVSFEVRAGEIVGLYGLMGSGRTETAMAIFGYDKIKSGKLYIENKEVKIKHPKDAVRAGIAYVSEDRRNLGVVVGFSVGENISLSSMDKVSSSGVISEKEEKEVANKFIESLKIKTPSALQKVKNLSGGNQQKVAIAKWLQRNSKIYIFDEPTRGIDIGSKAEIYKLIKDLAKKGHAIILISSEMPEIIGLSDRIVVMSNSCVSGSIENDIQNKKDVEEKIMKYAIGK

SEQ ID NO: 38728 - DNA, 1518 bp, Clostridium tetani E88; identical to SEQ ID NO: 27266
  CDS (1)..(1518): transl_table=11

SEQ ID NO: 38729 - protein, 505 aa, Clostridium tetani E88; identical to SEQ ID NO: 27267

SEQ ID NO: 38730 - DNA, 1557 bp, Tropheryma whipplei str. Twist; identical to SEQ ID NO: 27272
  CDS (1)..(1557): transl_table=11

SEQ ID NO: 38731 - protein, 518 aa, Tropheryma whipplei str. Twist; identical to SEQ ID NO: 27273

SEQ ID NO: 38732 - DNA, 1557 bp, Tropheryma whipplei TW08/27; identical to SEQ ID NO: 27276
  CDS (1)..(1557): transl_table=11

SEQ ID NO: 38733 - protein, 518 aa, Tropheryma whipplei TW08/27; identical to SEQ ID NO: 27277

SEQ ID NO: 38734 - DNA, 1554 bp, Pseudomonas syringae pv. tomato str. DC3000
  CDS (1)..(1554): transl_table=11
atgtcagcgtctgctcagacagctgttctttcggtcagtggcatcggcaaaacctacgctcaacccgtgctcggtgacgtcgacctgacgttgatgcgtggcgaagtgctggccctgaccggggaaaacggtgccggtaaaagcaccttgtcgaaaatcattggcggcctggtcacgccgactaccgggcgcatggagtttcaggggcagccttatgaacctgcgagccgcacccaggctgaaaagctcgggattcgcatggtcatgcaggaactcaacctgctgccgaccctgaccgtcgccgaaaacctgtttcttgacgatctgccgcgtcgcgcgggctggatcgatcgcaagcgtctgcgtgaaaacgcaatcaaagccatggcccaagtcgggctggatgccatcgaccctgacacactggtgggcgagctgggtattggccatcagcagatggttgaaatagcccgcaatctggtcggcgactgccacgtgctgatcctcgacgaacctaccgccatgctcacctctcgcgaagtagaaatgctgttcgagcagatcacgcgcctgcaggcgcgtggcgtttcgatcatctacatctcgcaccggcttgaagagcttgccagagtttcccagcgcatcgcagtgctgcgcgatggcaagctggtctgtgtcgagccgattgcccgctacaacagcgagcaactggtgacgctgatggttggccgcgaactgggcgagcacatggacatgggcgctcggcagattggcgaagtggccctgtcggtcaaggggctcagtcgtaccggcaaggttcaggatgtttcgttcgatgtgcgacggggtgaaatctttggcatctccgggctgattggtgccggacgaaccgaattgctgcgcctgatctacggcgcggacatcgccgacagcggcgcaatcgaagtgggccagccattgcaggccgtcaccattcgctcgccggccgacgctgtggcgcatggcattgcgctgatcaccgaagaccgcaaaagcgaaggtctgctgatgtcgcaatccatcagcgccaacatcgcattgggcaacatgcattccatctcccgcgctggcatggtcaatgccgacgaggagttgaagctggcgcaacggcaagtggccgccatgcgcattcgcagttcaagtcccacccaactggtgtccgagctgtccggcggcaatcaacagaaggtcgtgatcggtcgctggctggaacgtgattgcccggtgatgctattcgatgagcctactcgaggcattgacgtcggagccaagttcgatatctacacgctgctggccgagttgacccgtcagggcagggcgctggtggtggtgtccagtgatctgcgcgaactgatgctgatctgtgaccgtatcggcgtgctgtctgccggtcgcctgatcgatacgttcgagcgtgacagctggactcaggaccaattgcttgccgcagccttcgccggttatcagaaacgtaacgcgctgctcaacgacgcagcgcccaggaacgactcatga

SEQ ID NO: 38735 - protein, 517 aa, Pseudomonas syringae pv. tomato str. DC3000
MSASAQTAVLSVSGIGKTYAQPVLGDVDLTLMRGEVLALTGENGAGKSTLSKIIGGLVTPTTGRMEFQGQPYEPASRTQAEKLGIRMVMQELNLLPTLTVAENLFLDDLPRRAGWIDRKRLRENAIKAMAQVGLDAIDPDTLVGELGIGHQQMVEIARNLVGDCHVLILDEPTAMLTSREVEMLFEQITRLQARGVSIIYISHRLEELARVSQRIAVLRDGKLVCVEPIARYNSEQLVTLMVGRELGEHMDMGARQIGEVALSVKGLSRTGKVQDVSFDVRRGEIFGISGLIGAGRTELLRLIYGADIADSGAIEVGQPLQAVTIRSPADAVAHGIALITEDRKSEGLLMSQSISANIALGNMHSISRAGMVNADEELKLAQRQVAAMRIRSSSPTQLVSELSGGNQQKVVIGRWLERDCPVMLFDEPTRGIDVGAKFDIYTLLAELTRQGRALVVVSSDLRELMLICDRIGVLSAGRLIDTFERDSWTQDQLLAAAFAGYQKRNALLNDAAPRNDS

SEQ ID NO: 38736 - DNA, 1530 bp, Pseudomonas syringae pv. tomato str. DC3000
  CDS (1)..(1530): transl_table=11
atgcacgctgttctggataacccgacgccctacaacccagaggtcaccgctgcggcggtgctgtgcctgcgcaacatcggcaagtcctacggcccggtgcaggtgctttcgcagatcaacgtcgatgtgcggccgggcgaagtgctcgccctgctcggcgaaaacggcgcaggcaaatcgaccctgtcgtcgattatcgcgggcctggtgcagcctgaggcgggaggctccatgagctggcttggcgaggattacgcgcctgcctcgccgggcgcggcgctgggtgccggtatcggcctgattcatcaggaaatccgcctgctggcgcagttgtcgattgccgagaacatctttgtcgggcggctgccgatgcgccacggcaaggttgaccgcgactacatgctggcgcaggcgcaaaaacagctggaacgcctcggcctgaatgtgccggcttcgcgcaaggtcgagggtttgagcgtcgccgcgcagcaactggtcgagatcgccaaagccctgaccctgaacgcacgcctgctgattctcgacgaacccacggcggcccttggcggtgaagaaaccgagctgctgtttcagcaggtcgagcgcctcaaggccgaaggcgtgtcgttcatttacattagccatcgtctggaggaaatcgcgcggatcgccgaccgtattctggtcctgcgcgacggccgacagatcgcgctgcacgccacggctcaagtgccggtgcgtgaactggtcgagcagatggtcgggcgtagccttgaacgtatcttccctgccctgcaagcaccgcaggagcgggtgatgctgcaggtcaaagacctcacctgccgcgagttcgccttgcacggtatctacttcagcgtacgcgccggtgaagtgttcggcatcgccggagtggtcggcgcaggccgtaccgagctgatccgggtaattgccggtgcggcccaggatattcagggccacatgcaactggatggcgaaaccgttcacctgcgctcgccctcgcaagccattcaagcgggcgtggtgctggtaccggaagaccgcaaacaacagggcgtggtggtcgagcatcggattgaagacaatctggtctacggcaacaccgacctgctacacagcggtaactgggtgttgccaaaaggcctgcacgaattcgctcgcaacgctatttcgcgcctcggcgtaaaaggtgcgcccgagcagcgcatcgacagcctgtccggtggcaaccagcagaaagtcatcatcgccaaatggctggcccgtaaccccaaggtgttcattctcgacgagccgacccgaggcatcgacgtcggtgcgcgggcggcgatctacgaggtgatcgccgagctggcagccaccggcatggccgtgatcgtggtcagttccgacctcgacgaagtgctgggcctgtcgcaccgggtcatggtcatgagccgtggcaggcagatgggcatccttgaacgtggcgaggcgacaccggtgtcagtcatggaaatggccaccgcctga

SEQ ID NO: 38737 - protein, 509 aa, Pseudomonas syringae pv. tomato str. DC3000
MHAVLDNPTPYNPEVTAAAVLCLRNIGKSYGPVQVLSQINVDVRPGEVLALLGENGAGKSTLSSIIAGLVQPEAGGSMSWLGEDYAPASPGAALGAGIGLIHQEIRLLAQLSIAENIFVGRLPMRHGKVDRDYMLAQAQKQLERLGLNVPASRKVEGLSVAAQQLVEIAKALTLNARLLILDEPTAALGGEETELLFQQVERLKAEGVSFIYISHRLEEIARIADRILVLRDGRQIALHATAQVPVRELVEQMVGRSLERIFPALQAPQERVMLQVKDLTCREFALHGIYFSVRAGEVFGIAGVVGAGRTELIRVIAGAAQDIQGHMQLDGETVHLRSPSQAIQAGVVLVPEDRKQQGVVVEHRIEDNLVYGNTDLLHSGNWVLPKGLHEFARNAISRLGVKGAPEQRIDSLSGGNQQKVIIAKWLARNPKVFILDEPTRGIDVGARAAIYEVIAELAATGMAVIVVSSDLDEVLGLSHRVMVMSRGRQMGILERGEATPVSVMEMATA

SEQ ID NO: 38738 - DNA, 1524 bp, Pseudomonas syringae pv. tomato str. DC3000
  CDS (1)..(1524): transl_table=11
atgcaacaggctatcgagcaaacagccacaggcggtgccttgcgcttcaatggcatctgcaaggtatttcccggcgtcaaggcgctttcggacatcagcttcgaggcccgccctggcagtgtccatgcgctgatgggggagaacggcgcaggcaaatccacgctgctgaagattctgggcggctcttatcagcccaacagcggcaccctgcagatcggtgagcacagctatcaattcaaatccaccgccgagagtatcgcggcgggtgtggcggtgattcatcaggagctgcatctggtgccggaaatgaccgtcgccgagaacctgctgctcgggcacatgcctaatcgtttcggcttgatcaatcgtggcgccatgtaccgtcgagccggtgagctgctcaaaggtctggccgacgagatcgacccgcgcacgcgcttgggcgacctgtcgctgggccagcggcaactggtggaaatcgccaaggccatgtcgcgcaacgctcatgtcatcgcgttcgacgaacccaccagcagcctgtcggcgcgcgagatcgaccgtttgatggcgatcatcgtgcggctgcgggatgaggggcgggtgattctgtatgtgtcgcatcgtatggaagaaatcttccgggtctgcgatgccgtgaccgtcttcaaggacgggcgctttgtcaaaaccttcgagcagatggctgatctggaccacgaccggctggtgacttgcatggtcggtcgcgatattcaggacatctacaactatcgtccacgtcagcatcaggggccgagcctgcgggtcaccggtctgttggggctgggcttgcaggagccagtgagtttcgccgtgcagaaaggcgaggtgctgggctttttcggtctggtgggcgcaggtcgtaccgagctgtttcgcattctttccgggctgacgcgcagtaccgccggcagcctgcaactggacggtcagccgctgactttgaagtcgccacgtgatgccattgcggccggggtgctgctctgcccggaagaccgcaagaaagaaggcatcgtgccgctgtccagcgtcgcggagaacatcaacatcggtgcgcggccccggcatgtgaatcttggctgcctgatccagggcggctgggagcgggacaacgcgcgtgctcagatcaagtcgatgaacgtcaagacgccatcgcccgagcaacagatcatgtttctgtccggcggtaatcagcaaaaagccattctcggtcgctggctgtcgatgccgatgaaagtcctgctgctggacgagccgacccgcgggatcgatgtcggagccaaatccgagatctacgagatcattcacacattggccgccgatggcattgccgtgatcgtggtgtccagcgacctgatggaagtcatgggcatttccgatcgtattctggtgatgagtgaaggcgccattaccggtgaactcaaccgcgacgaggctgacgagtcgcgacttctgcaattggctctgccacgcacgcgcggctaa

SEQ ID NO: 38739 - protein, 507 aa, Pseudomonas syringae pv. tomato str. DC3000
MQQAIEQTATGGALRFNGICKVFPGVKALSDISFEARPGSVHALMGENGAGKSTLLKILGGSYQPNSGTLQIGEHSYQFKSTAESIAAGVAVIHQELHLVPEMTVAENLLLGHMPNRFGLINRGAMYRRAGELLKGLADEIDPRTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQDIYNYRPRQHQGPSLRVTGLLGLGLQEPVSFAVQKGEVLGFFGLVGAGRTELFRILSGLTRSTAGSLQLDGQPLTLKSPRDAIAAGVLLCPEDRKKEGIVPLSSVAENINIGARPRHVNLGCLIQGGWERDNARAQIKSMNVKTPSPEQQIMFLSGGNQQKAILGRWLSMPMKVLLLDEPTRGIDVGAKSEIYEIIHTLAADGIAVIVVSSDLMEVMGISDRILVMSEGAITGELNRDEADESRLLQLALPRTRG

SEQ ID NO: 38740 - DNA, 1569 bp, Pseudomonas syringae pv. tomato str. DC3000
  CDS (1)..(1569): transl_table=11
atggtttcagcgactttgcaggttcaatcagtacctgccttgcacctgagcggcatcagcaaacgtttcggcgcaacccaggcgcttgacggggtcaacctgcaggtggcgtcgggaacgattcatgggctggtcggcgaaaacggcgcgggcaaatcgacgctgatcaaggtgttggccggcattcaccgcgccgacgctggcagcctgagcatcaatggccagcgtttcgagggccacacgccgcgccaggtcgaagcggccggagtgcatttcattcatcaggaacggctgctgccgggcagtttcacggtcggcgaagcgctgtttttcggtcaggaaatcaaacgtggcctgtttgtcgaccggcgcgctcaggatcgtgaggcggctcggttgctggaggattactttgccatgcgtttgccacaaggcgcgctggtacgtgatctggacagcgcgcagcggcagatactacagatcacccgcgcgctgctggccaaacccggagtgctggtattcgacgagccgagtgtgtcgctggtcaagcaagaggtggaccggttgctggccatcgtgcggcgtttgcgcgatgaagggctgaccattgtgtacatctcgcattatttgcaggaaatagaatcgctctgcgatcaggtcaccgtgctgcgcaacgggcgcgatgtggcggtggttgatcccgcgctcaccagcaccgcgcagatcgcccggctgatggtcaatcgtgacgttggcgagcagtatttccgggctcaaagtgtgcccggtgcacctgtgttgcagttgaatgcgctgggggcagggcgcgtgtatgacggcatcgacctgagtgtgcgacgtggcgaagtggtcggcctgaccgggctggtgggttcgggcgccaaagagctgctgaaaagcctgttcgggctgctcaagccggagcgcggtgagttgctgttgaacggccagcccttgcagctgaaatcgccccgcgatgcagtgcgtaacggcattgcgctggtccccgaagagcgccgcacccacggtgtggcgccagtgctttcagtgctggaaaacatcaccatggccagcctcgggcgcttcagccactgggggttgcttgatgcctctgctcaggctcgggaaagcgagcggttgatcaccgaactggcgatcaagacccctggccccgacgcagcagtgcaactgctcagtggtggcaatcagcaaaaggtggctttggccaagtggctgagtcggcattcgtcgctgtacctgctggacgagcccagcgtgggcgtcgacatcggtgccaaggtggaaatctaccggttgattgcccggcttgccgagggtggcgcagccgtagtggtgctgtcctcggatttgccggaactgatcggcatcacccatcgcatcgtggtcttgcaccgaggccgcattgccggcgaattcgcttcccggaccaccgacagcgaccagttgctggcctgcgccaccggtgccagtgaaagcgatgaacaggtcgaaccgattattgaggaggccaggcatgtccgcgcttga

SEQ ID NO: 38741 - protein, 522 aa, Pseudomonas syringae pv. tomato str. DC3000
MVSATLQVQSVPALHLSGISKRFGATQALDGVNLQVASGTIHGLVGENGAGKSTLIKVLAGIHRADAGSLSINGQRFEGHTPRQVEAAGVHFIHQERLLPGSFTVGEALFFGQEIKRGLFVDRRAQDREAARLLEDYFAMRLPQGALVRDLDSAQRQILQITRALLAKPGVLVFDEPSVSLVKQEVDRLLAIVRRLRDEGLTIVYISHYLQEIESLCDQVTVLRNGRDVAVVDPALTSTAQIARLMVNRDVGEQYFRAQSVPGAPVLQLNALGAGRVYDGIDLSVRRGEVVGLTGLVGSGAKELLKSLFGLLKPERGELLLNGQPLQLKSPRDAVRNGIALVPEERRTHGVAPVLSVLENITMASLGRFSHWGLLDASAQARESERLITELAIKTPGPDAAVQLLSGGNQQKVALAKWLSRHSSLYLLDEPSVGVDIGAKVEIYRLIARLAEGGAAVVVLSSDLPELIGITHRIVVLHRGRIAGEFASRTTDSDQLLACATGASESDEQVEPIIEEARHVRA

SEQ ID NO: 38742 - DNA, 1587 bp, Pseudomonas syringae pv. tomato str. DC3000
  CDS (1)..(1587): transl_table=11
atgtccgactacctgctgcaaatgaacggcatcgtcaaaacctttgacggtgtcaaagcgctcaacggcatcgatatcaaggtacgccccggtgaatgcgtcggcctttgcggcgaaaacggcgcgggcaaatccaccttgatgaaagtgctctcggcggtctatccctacggcacctgggaaggcgagattctctgggacggcaaccctctcaaggcgcagtccatcagcgaaaccgaagccgccggaatcgtcatcattcatcaggaactgactctggtccccgacctgtcagtggccgaaaacatcttcatgggccacgaactgaccctgcgcggcgggcgcatgaactacccggcgatgatccaccgtgccgaaaccctgatgcgtgagctcaaagtgcctgacatgaacgtggcgctgccggtttcgcagtacggcggtggccatcagcaattggtggaaatcgccaaggcgctgaacaaacaggcacgactgttgatcctcgatgagccctcctcggccctgacccgctcggagattgaggtcctgctgggcatcattcacgacctcaaggccaaaggcgtggcctgcgtatacatctcgcacaaactcgatgaagtggcggccgtgtgcgacaccatttcggtgatccgcgatggcaagcacattgctactaccgctatggctgaaatggacatcccgaagatcatcacccagatggtcgggcgtgaaatgagcaacctctaccctaccgacgcgcatgacatcggcgaggtgattttcgaggcgcgcaacatcacctgctacgacgtcgacaaccccaaacgcaaacgggtggacgacatttcgtttgtcctcaagcgcggggaaatcctcggcatcgccgggctggtgggcgctggtcgcacagagctggtctcggcgctgtttggtgcttatccaggtcgctacagcggtgaggtctggctggacggccagccggtcgatacccgcacaccgctcaaatcaatccgcgccggcctgtgtatggtcccggaagaccgcaagcgccagggcatcatccccgacatgggcgtcggccagaacatcaccctcgccgtcctcgacaactactcgaaaatgacccgcatcgacgcagaagccgaattgggcagcattgaccgggaaatttcgcgcatgcacctcaagacggccagcccgtttctgccgatcaccagtctttccggcggcaaccagcagaaagccgtgctggccaagatgctcttgaccaggccccgcgtgctgattctcgatgagccgacgcgcggggtcgatgtgggtgccaagtacgagatctacaagctgatgggtgcgttggcggccgagggcgtggcgatcatcatggtgtcctcggagctggccgaagtgctgggggtttccgaccgcgtgctggtcattggtgagggccgcttgtgcggcgattttatcaaccatgaactcactcaggagcaggtgcttgccgccgcactcagccaccccggcgaccctgacagtaatgaccctgccaacaataatcataacgacaacgaccggaagaccacgtag

SEQ ID NO: 38743 - protein, 528 aa, Pseudomonas syringae pv. tomato str. DC3000
MSDYLLQMNGIVKTFDGVKALNGIDIKVRPGECVGLCGENGAGKSTLMKVLSAVYPYGTWEGEILWDGNPLKAQSISETEAAGIVIIHQELTLVPDLSVAENIFMGHELTLRGGRMNYPAMIHRAETLMRELKVPDMNVALPVSQYGGGHQQLVEIAKALNKQARLLILDEPSSALTRSEIEVLLGIIHDLKAKGVACVYISHKLDEVAAVCDTISVIRDGKHIATTAMAEMDIPKIITQMVGREMSNLYPTDAHDIGEVIFEARNITCYDVDNPKRKRVDDISFVLKRGEILGIAGLVGAGRTELVSALFGAYPGRYSGEVWLDGQPVDTRTPLKSIRAGLCMVPEDRKRQGIIPDMGVGQNITLAVLDNYSKMTRIDAEAELGSIDREISRMHLKTASPFLPITSLSGGNQQKAVLAKMLLTRPRVLILDEPTRGVDVGAKYEIYKLMGALAAEGVAIIMVSSELAEVLGVSDRVLVIGEGRLCGDFINHELTQEQVLAAALSHPGDPDSNDPANNNHNDNDRKTT

SEQ ID NO: 38744 - DNA, 1578 bp, Pseudomonas syringae pv. tomato str. DC3000
  CDS (1)..(1578): transl_table=11
atgtccggttccgctactgccagccctcccgcaaaacccgatctgccgtccagtgatggtgctggcctcacgccagatgctcagtgcccctatctgctggaaatcagccatatcagcaaaggcttccctggcgttatcgcgctcgacgatgtccagctgcgcctgcgtcccggcagtgtgctggcgctgatgggcgagaacggggcagggaagtcaacgttgatgaaaatcatcgccgggatctaccagcccgataccggcgaaattcgcttgcgcggcaagccgatcagctttaccaccccgctttcagcccttcaggcgggtatcgccatgatccatcaggaactgaacctgatgcccttcatgagcatcgccgagaatatctggatcggccgcgagcagctcaatggcctgcacatggtcgaccaccgggaaatgcaccgctgtacggcgcaattgctggagcgtctgcgcatcaagcttgatcccgaagagctggtgggcaacctgagcattgccgaacggcagatggtggagatcgccaaagccgtttcctacgattcggacgtgctgatcatggacgagcccacctcggccattaccgagactgaagtggagcacctgttttcaatcattgccgacctgcgctcgcagggcaaaggcatcatctacatcacccacaagatgaatgaagtgttcaagatcgccgacgaagtggcggtgtttcgtgatggcacctacattggcctgcagcgcgccgaaagcatggatggcgacagcctgatctcgatgatggtcggtcgcgagttgacccaattattcccgcagcgcgaaaagcctgcgggcgatgtcctgctttctgtcagtgacctgagcctgaaaggcattttccagcaggtctccttcgacctgcgggccggtgaggttctgggcattgccgggctgatgggttcggggcgcaccaatgtggccgagaccctgttcgggatcactcccagcgacagtggcgagatccgtttcgatggcaagacggtacgcattggcgacccgcatcaggccatcgaactggggtttgcgctgctgaccgaagaccgcaagctgaccggcctgtttccgtgcctgtcggtcatggaaaacatggaaatggccgtcttggccaattatgcgggtagtggcttcgtgcagcagaaagcattgcgggcgctgtgcgaagacatgtgcaagaagctgcgggtgaaaactccttcgctggagcagtgcatcgacacgctgtccggtggcaaccagcagaaagccctgttggcgcgctggttgatgaccaatcccagggtcttgattctcgacgagccgacgcgcggcatcgacgtcggtgccaaggcggaaatttatcggctgatctcgctgctggccagcgaaggcatggccgtcatcatgatctcttcggagctgccggaagtgctgggcatgagcgatcgggtcatggtcatgcacgaaggcgaaatgatggggattctcgaccgtagcgaagcgacccaggaaaaagtcatgcatctggcctccggccaccgggttcattga

SEQ ID NO: 38745 - protein, 525 aa, Pseudomonas syringae pv. tomato str. DC3000
MSGSATASPPAKPDLPSSDGAGLTPDAQCPYLLEISHISKGFPGVIALDDVQLRLRPGSVLALMGENGAGKSTLMKIIAGIYQPDTGEIRLRGKPISFTTPLSALQAGIAMIHQELNLMPFMSIAENIWIGREQLNGLHMVDHREMHRCTAQLLERLRIKLDPEELVGNLSIAERQMVEIAKAVSYDSDVLIMDEPTSAITETEVEHLFSIIADLRSQGKGIIYITHKMNEVFKIADEVAVFRDGTYIGLQRAESMDGDSLISMMVGRELTQLFPQREKPAGDVLLSVSDLSLKGIFQQVSFDLRAGEVLGIAGLMGSGRTNVAETLFGITPSDSGEIRFDGKTVRIGDPHQAIELGFALLTEDRKLTGLFPCLSVMENMEMAVLANYAGSGFVQQKALRALCEDMCKKLRVKTPSLEQCIDTLSGGNQQKALLARWLMTNPRVLILDEPTRGIDVGAKAEIYRLISLLASEGMAVIMISSELPEVLGMSDRVMVMHEGEMMGILDRSEATQEKVMHLASGHRVH

SEQ ID NO: 38746 - DNA, 1506 bp, Vibrio parahaemolyticus RIMD 2210633
  CDS (1)..(1506): transl_table=11
atgactcaagccattctacaactgagcgaaatcgaaaaagcgttcccaggtgtaaaggcgctagataaagcgagcctgaatgtatacccaggtcgtgttatggcgctcatgggcgaaaatggggcaggcaagtcaactttgatgaaagtgctgaccggtatttaccatatggatgcgggtagcattcagtatcaggggcaacctgctgcgtttaaaggtccgcgagattctcaagaagcgggtatcagcattattcaccaagagttgaacttaatccctgaactgacaatcgctgagaacatttttctcggtcgtgaatttaccggttctatggggcgcattcagtggagcaaaatgtacgcggaagcggacagacttctacaacgtttgaacgtgaaacacagctcgaaaaccttgcttggtgatctaagtttgggtgagcaacaaatggtagaaattgccaaagcgctctcgtttgaatcgaaagtcatcatcatggatgaaccaaccgatgcgcttactgatacagaaaccgaatctctgttcaaagtgattaatgagcttcgtgagcaaggctgcggcattgtatatatctcacaccgcctgaaagaaatctttgaaatctgtgacgacattaccgtgcttcgtgacggtaaatttatcggtgaatgccgagtagcagacacggatgaagacggcttaatcgaaatgatggttggccgtaaattagaggagcaatacccacgtattgatgtgaagcacggcgagacatgccttgaagtggttggcttgacgggctctggcgttcacgatgtgagcttcacgcttaaacgcggtgagattttgggtatctctggtttgatgggcgcaggccgtaccgagttaatgaaagtgatttacggcgcgctaccaagcgagcatggcgttatcaatctcgataacaaaaccattaatccggttagcccgcaagatggcttggcaaatggcatcgcttacatctcggaagaccgcaaaggggatggtctggttctgggtttatccgtgaaagagaacatgtctctgtgtgcattggataagctaaccaaaggcgtacaaatccagcacggcgaagaagtcatcgcagtggaagatttcatcaagttattcaacattaaaacaccaactcgcgaccaaattattggcaacctttctggtggtaaccaacagaaagtggcgattgcgaaagggttaatgaccaaacctaaagttctgattttggatgaaccaacgcgtggtgttgacgttggtgctaagaaagaaatctaccaactcatcaacaaatttaaagccgacggcatgagcatcatcttggtttcttctgagatgccagaagtgctaggcatgagcgatcgcattcttgtgatgcatgaaggtcgcataactggcgaatttgatgcgaaagacgccgaccaagaaaaattactcgcctgtgccgtaggcaaaaagatcaatgaggaagcagcatga

SEQ ID NO: 38747 - protein, 501 aa, Vibrio parahaemolyticus RIMD 2210633
MTQAILQLSEIEKAFPGVKALDKASLNVYPGRVMALMGENGAGKSTLMKVLTGIYHMDAGSIQYQGQPAAFKGPRDSQEAGISIIHQELNLIPELTIAENIFLGREFTGSMGRIQWSKMYAEADRLLQRLNVKHSSKTLLGDLSLGEQQMVEIAKALSFESKVIIMDEPTDALTDTETESLFKVINELREQGCGIVYISHRLKEIFEICDDITVLRDGKFIGECRVADTDEDGLIEMMVGRKLEEQYPRIDVKHGETCLEVVGLTGSGVHDVSFTLKRGEILGISGLMGAGRTELMKVIYGALPSEHGVINLDNKTINPVSPQDGLANGIAYISEDRKGDGLVLGLSVKENMSLCALDKLTKGVQIQHGEEVIAVEDFIKLFNIKTPTRDQIIGNLSGGNQQKVAIAKGLMTKPKVLILDEPTRGVDVGAKKEIYQLINKFKADGMSIILVSSEMPEVLGMSDRILVMHEGRITGEFDAKDADQEKLLACAVGKKINEEAA

SEQ ID NO: 38748 - DNA, 1521 bp, Vibrio parahaemolyticus RIMD 2210633
  CDS (1)..(1521): transl_table=11
atgatcatgataaattccccttcttaccttgagttttgcaacatatcgaagcatttcccaggagttaaggcattgagcaacattagttttcgcgccaacaaaggcagtattcatgcgctaatgggtgaaaacggtgcaggtaaatcaacgttgcttaaaactctcagtggcttacaccaacctactgaaggcgagttggtcgtcgatggtaaagctttggtgttcaactcagcgactgatgcgcttgagcaaggtatcgccattatttaccaagagctgaacttggtacctgagcttagtgtggcagaaaacatctacctaggtcagttgccaacaaaaggtggcagtgtagatgtggaaacattgaacgcccgagcgcgagaacagctaaaacgtttgggggaggattttgatccttctcgcccacttaaagagttttctatcggccagtggcaaatggtggaaattgccaaagcactaagccgcaatgctcagattatcgcgtttgatgaaccaaccagcagtttgtctcaacgcgagattcaaaacttattcaaagttattcgcgaattgcgcgatgacggcaaaatcattctgtacgtttcccatcgtatggaagagatcttcgatttgtgcgatgccattaccatcttcaaagatgggacacatgtacaaacatttgacgacatgaccgacttaacccatgaaaaattggttgagctgatggtcggtcgtgaaatcaacgatatctacaactaccgttcgcgttctctcggcgaaagtggcctacgcattgaaaaccttgaaggaaaagggttaacccaaccagtctcactcgatattcgtcaaggtgaaattctgggtctgtttggtttagttggggcagggcgaacagaactaacccgtctcattttcggcgcggaaaaagcgcaagccggacaaatttacattcatgggcagcccatcagtgtcagaagtccacaagatgcgattcgcgcaggcattacgttatgcccagaagaccgtaaagcggacgctatcgttcctattctctcggtggaagagaacaccaacatcagtgctcgtccatggaatttgaaattgggcggtttgatcgatttcaaatgggaaagagacaacgcagagcagcaacgtaaggctttgaacgttaaaaccgcctcattacaacaggctatagggcagttgtctggtggtaaccaacaaaaagtgattctaggtcgctggctctccaccgatatgagtgtgattttgttggacgagccaacacgaggcattgacgttggtgcgaaatcagagatctacgaactgattttcaatcttgctgagcgcggtgtcactgtgctggtggtgtcgagtgatttgccagaagttcttggtatatccgatcgcgtaatggtgatgaaagaaggtgcggtaacaggtgaactacagcgccatgagtttaaagaacaaactgctttgagtttagccatgctaggcaacaaccaagctgctgcataa

SEQ ID NO: 38749 - protein, 506 aa, Vibrio parahaemolyticus RIMD 2210633
MIMINSPSYLEFCNISKHFPGVKALSNISFRANKGSIHALMGENGAGKSTLLKTLSGLHQPTEGELVVDGKALVFNSATDALEQGIAIIYQELNLVPELSVAENIYLGQLPTKGGSVDVETLNARAREQLKRLGEDFDPSRPLKEFSIGQWQMVEIAKALSRNAQIIAFDEPTSSLSQREIQNLFKVIRELRDDGKIILYVSHRMEEIFDLCDAITIFKDGTHVQTFDDMTDLTHEKLVELMVGREINDIYNYRSRSLGESGLRIENLEGKGLTQPVSLDIRQGEILGLFGLVGAGRTELTRLIFGAEKAQAGQIYIHGQPISVRSPQDAIRAGITLCPEDRKADAIVPILSVEENTNISARPWNLKLGGLIDFKWERDNAEQQRKALNVKTASLQQAIGQLSGGNQQKVILGRWLSTDMSVILLDEPTRGIDVGAKSEIYELIFNLAERGVTVLVVSSDLPEVLGISDRVMVMKEGAVTGELQRHEFKEQTALSLAMLGNNQAAA

SEQ ID NO: 38750 - DNA, 1536 bp, Salmonella enterica subsp. enterica serovar Typhi Ty2; identical to SEQ ID NO: 27288
  CDS (1)..(1536): transl_table=11

SEQ ID NO: 38751 - protein, 511 aa, Salmonella enterica subsp. enterica serovar Typhi Ty2 [sequence omitted]

SEQ ID NO: 38752 - DNA, 1506 bp, Salmonella enterica subsp. enterica serovar Typhi Ty2
  CDS (1)..(1506): transl_table=11
atggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcgggatcgttgttatggctgggtaaagagaccacctttaatgggcctaaatcgtctcaggaagccgggatcggcattattcatcaggaactgaacctgattccgcagttgaccattgcggaaaacatcttcctgggccgtgagtttgtgaatcgctttggtaaaatcgactggaaaaagatgtatgccgaagccgaccacctcttagccaaactcaatctgcgctttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgactctctgttccgcgttatccgcgaattaaaatcgcaggggcgcggcattgtctatatctctcaccgtatgaaagagattttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctgaaggtcgataatctgtgcggaccgggcgtgaacgatgtctcttttgtgctgcgaaaaggcgagattcttggcatctccggcctgatgggcaccggtcgcactgagctgatgaaagtattgtacggcgcgatgccgcgaaccagcggttacgtgacgctcgagggacacgaagtggtgacgcgttctccgcaggacgggctggccaatggcatcgtttatatctctgaagaccgtaagcgcgatggactggtgctcggcatgtcagttaaagagaatatgtcgctgactgcgctggattatttcagtcgcgctggcggaagcctgaaacacaaagatgagcagcaggcggtgggggattttatccgtctgttcaacgtcaagacgccgtcaatggaacaggcgataggcctgctttctggcggtaatcagcaaaaagtggcgattgcccgcgggttgatgacgcgcccgaaagtgctcattctcgacgagccgacccgcggcgtggacgtcggcgccaagaaagagatttaccagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 38753 - protein, 501 aa, Salmonella enterica subsp. enterica serovar Typhi Ty2
MDALLQLKGIDKAFPGVKALSGAALNVYPGRVMALVGENGAGKSTMMKVLTGIYTRDAGSLLWLGKETTFNGPKSSQEAGIGIIHQELNLIPQLTIAENIFLGREFVNRFGKIDWKKMYAEADHLLAKLNLRFKSDKLVGELSIGDQQMVEIAKVLSFESKVIIMDEPTDALTDTETDSLFRVIRELKSQGRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGTGRTELMKVLYGAMPRTSGYVTLEGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 38754 - DNA, 1569 bp, Enterococcus faecalis V583
  CDS (1)..(1569): transl_table=11
ttgtctcaagaagaaaacgtaattgagatgcgtaaaatcaccaaagaatttgggacgttcaaagccaacgaccaaattgatttacaagtaaaacctggtgaaatccacgcactgctaggtgaaaatggtgcaggcaagtcgaccttgatgaatatcttatcagggctattggaaccgacctcaggtgagatttatatgaatggcgaaaaagtcaacattacaagtcctactgcagccaatcgtttaggaatcggaatggtccatcagcattttatgttagttgaagcctttactgtgactgaaaatattatcttaggtagtgaacctacccatggcggtattttagaccggaaaaaagcgaaaaaagagattgaagaagtgtctaagcaatacgggttggatgtaaatcccaatgcctatattcgcgatatttctgtgggtatgcaacaacgggttgaaattttaaagaccttatatcgtggtgcgaacgttttaatttttgacgaaccaaccgcagtattaacgccacaagaaattgatgaattaatgattattttgaaagaactaaccgatgaaggcaaatcgatcattttaattacacataagttagatgaaattaaaaaagtggcggaccgttgtacggttattcgccgggggcaaagtattggcaccgtcaatgtgaaagacgtttcttcgcaacagttagccgatatgatggtgggtcgttctgtttccttcaaaacagagaaaaaaccagcgcaaccgaaagaaacaattttatcaattaaagatttagtagtgaaagaaagccgcggcttagatgcagtgaaaaatcttagcttagatgtccgagcaggggaagttgttggaattgcggggattgatggcaatggacaaacagaattaatccaagccttagcaggattaaccaaagtcgaaaacgggtccattcatttgaatgaaaaagagattactaatcgcaaacctcgggaaattacggaaatgggtgtcgcccacgttcctgaagaccgacataaatatggcttggtattagagatgacattggctgaaaatattggcctacaaacgtattaccaaaaaccatacagttcaacaggtattttaaactatcgaatgattaacaaacatgcccgtgaattaattgaagaatatgatgtacggactcctaatgaattagtaccagctcgggcgctttcaggtgggaatcagcaaaaagcgattattgcccgagaagtggaccgcgatccagatttgttgattgtttctcaaccaacacgcggtttagatgtcggagctattgaatacattcatcgtcgactaattgaacaaagagataaaaataaagctgttttattagtaagttttgaattagatgaaattttaaacgtttctgatcgtatcgctgttattcatgcgggggaaattgtcggaattgttgatccgaaagaaacgacagaaaatgaattgggcttgttaatggctggctactcattggaagaagcccgtgctgagttatcaaaagtagaggcaggtgaaactgttgaataa

SEQ ID NO: 38755 - protein, 522 aa, Enterococcus faecalis V583
MSQEENVIEMRKITKEFGTFKANDQIDLQVKPGEIHALLGENGAGKSTLMNILSGLLEPTSGEIYMNGEKVNITSPTAANRLGIGMVHQHFMLVEAFTVTENIILGSEPTHGGILDRKKAKKEIEEVSKQYGLDVNPNAYIRDISVGMQQRVEILKTLYRGANVLIFDEPTAVLTPQEIDELMIILKELTDEGKSIILITHKLDEIKKVADRCTVIRRGQSIGTVNVKDVSSQQLADMMVGRSVSFKTEKKPAQPKETILSIKDLVVKESRGLDAVKNLSLDVRAGEVVGIAGIDGNGQTELIQALAGLTKVENGSIHLNEKEITNRKPREITEMGVAHVPEDRHKYGLVLEMTLAENIGLQTYYQKPYSSTGILNYRMINKHARELIEEYDVRTPNELVPARALSGGNQQKAIIAREVDRDPDLLIVSQPTRGLDVGAIEYIHRRLIEQRDKNKAVLLVSFELDEILNVSDRIAVIHAGEIVGIVDPKETTENELGLLMAGYSLEEARAELSKVEAGETVE

SEQ ID NO: 38756 - DNA, 1569 bp, Streptomyces avermitilis MA-4680
  CDS (1)..(1569): transl_table=11
gtgaccgcgtcacccgtatccgctgaagtcctcgccgtacgaggactgaccaaacgcttccccggcgtcaccgcactcgacgacgtcgacttctccgtacgcgcgggggaggtgcacgcgctcgtcggcgagaacggcgcgggcaagtccaccctcatcaaggtcctcaccggcgtccaccgggccgacgagggcggggtgttccaccggggcgagcccgtcgctttcggcacaccactggaagcgcagcacgccggtatctcgacgatctaccaggaagtcaacctcatcccgctgatgagcgtggcccgcaacctctttctcggccgcgagccccgcacccgcctcggactgatcgacttccgccgcatgcacacggaggcccaccaggtcctcaccgcgtacggggtcgacgtcgatgtccgccgaccgctgcgccaactcggcgtcggagcacagcagatggtcgccctggcccgcgcggtggccgtcgacgcgagcgtcgtcgtcatggacgaaccgacatcgtcgctggaaccacgcgaggtccacaccctcttcggcgtcatccgccgcctgcgcgaccagggcatcgccgtggtctatgtcagccaccgcatggaggagctgtacgccgtctgcgacagcgtcaccgtgctgcgcgacggccaccatgtgcacaccggcccgctcgccggcaccgaccgtctcaccctggtctcgtacatgctgggacgcgacctcggcgaggtgcgcagcgagggcacgaccaagttctccggtacgcacgacacgggcggtgagccggtgctgcgcgccgaaaacctcacccggccccaccaactgcgcgctgtctccctggaaatacaccccggtgaagtactcggcctcggtggattgctgggttccggccgcagcgagaccgccaaagccgtcgccggcgcgctggcactcgccgacggccgtgtcaccgtcgccggtgtcccggtacgcaccggctccaccgtcgcggccatccgcgccggcatcagtctcctgcccgaggaccgcaagtccgaaggcatcgtgccggggctgtcggtgcgggagaacatcgccctggccgccctgccccagctctcccgctacggcctggtcgccgagtcccgcatggacgccgtcgtcgacaccttcatgaagcggctgcgcatcaaggcgtccagtccgcaccagaaggtcggcgaactctccggcggcaaccagcagaaggtgctgctcgcccgctggctcgcgatgaaccccaaggtgcttcttctggacgagccgacccgcggcatcgacatcggtgccaaggccgaggtgcagcagctcatcgacgaactcgccgaggacggcctgggcgtcctgctcatctcgtccgacatcgaggaactgatcgaaggctccgaccgcgtcgtcgtcctccgggacggtgcggccatcgccgaactgcgcgctgacgacgtcacggccgaccggctgatgcgggccatcgcacaagcggcggaagaagaagcgtccaccgaggaggaggccgccacccatggctga

SEQ ID NO: 38757 - protein, 522 aa, Streptomyces avermitilis MA-4680
MTASPVSAEVLAVRGLTKRFPGVTALDDVDFSVRAGEVHALVGENGAGKSTLIKVLTGVHRADEGGVFHRGEPVAFGTPLEAQHAGISTIYQEVNLIPLMSVARNLFLGREPRTRLGLIDFRRMHTEAHQVLTAYGVDVDVRRPLRQLGVGAQQMVALARAVAVDASVVVMDEPTSSLEPREVHTLFGVIRRLRDQGIAVVYVSHRMEELYAVCDSVTVLRDGHHVHTGPLAGTDRLTLVSYMLGRDLGEVRSEGTTKFSGTHDTGGEPVLRAENLTRPHQLRAVSLEIHPGEVLGLGGLLGSGRSETAKAVAGALALADGRVTVAGVPVRTGSTVAAIRAGISLLPEDRKSEGIVPGLSVRENIALAALPQLSRYGLVAESRMDAVVDTFMKRLRIKASSPHQKVGELSGGNQQKVLLARWLAMNPKVLLLDEPTRGIDIGAKAEVQQLIDELAEDGLGVLLISSDIEELIEGSDRVVVLRDGAAIAELRADDVTADRLMRAIAQAAEEEASTEEEAATHG

SEQ ID NO: 38758 - DNA, 1539 bp, Streptomyces avermitilis MA-4680
  CDS (1)..(1539): transl_table=11
atggcaccagaaccaccgctgctcaccatgtccggcatcaccaagtcgttccccggcgtccgggccctcgacggcgtcgacctcgacgttcaggccggcgaggtccactgtctgctcggccagaacggcgccggaaagtccaccctcatcaaggtcctggccggcgcccaccagcccgacgacggccgtctgtgctggcgcggcgcacccgtcacgctccgctccccgatcgccgccatgcgcctcggcatcgccaccatctaccaggaactagacctggtggagggcctgtcggtggccgagaacgtccacctcggccatgagcccacgaccgccggcttcgtcgtacgagggaaggccgcgcgagcctcgacagcggctctcctcaagcgcctcggccacccggagatcgcaccgtcgcgcctcgtcggcgacctgtcggcagcccagcagcagatcgtctccatggcgcgcgcgctctcccacgacgtccgcctcatcgtgatggacgagccgtccgcggccctcgatcccgacgaggtcgacaacctcttccgcatcgtcggcgacctcaccgcggacggcgtcgccgtcgtccacatctcgcaccgcctcgaggagatccgccggatcggcgaccgggtgaccgtactgaaggacgggcgcgcggtggcgggcgggctgcccgcgaaatccacgccgacgcgcgagatcgtggcgctgatgaccggccgcgacgtggagtacgtcttcccggaccggccgcccgcccctgccccagccacctccgaccccctactcaaggtccagggcctcgccagggaaggcgagttcgagcccctcgacctcgaactgcgccccggcgagatcgtcggactggccggactggtgggttcgggacggtccgagatcctggagaccgtctacggggcccggaagccgtccgcagggcaggtcacggtggccggacgggcgctgcggcccggcagcgtacgcgccgccgtccgcgccggactcgggctcgcccccgaggagcgcaagacgcaggccctgctcctgctggagtccgtcacgcgcaatgtgtcgctctcctccatgtcccgcttcgcacacggaggttggatcgaccgcggcgccgaacgcgatgccgcgcgagccgcgacccgggaactgtcactgcgccccgaccgtccgtccgcgcccgcgcgcaccctgtccggcggcaaccagcagaaggccgtcctggcgcgctggctgctgcgcggctgccgggtgctgctcctcgacgaacccacccgcggcgtcgacgtcggcgcccgcgccgagctgtacgcggtgatccgccgcctcgccgacgagggcctcgccgtgctgctcgtgtccagcgaggtacccgaggtgctcggcctcgccgaccgggtgctggtgctgcgcgagggccgcgtcgtacaccgggcgcccgcccgtgaactcgacgaacaccgcgtcctcgacctggtcatggaaggaagccccgtggaaggaaccccggcgtcatga

SEQ ID NO: 38759 - protein, 512 aa, Streptomyces avermitilis MA-4680
MAPEPPLLTMSGITKSFPGVRALDGVDLDVQAGEVHCLLGQNGAGKSTLIKVLAGAHQPDDGRLCWRGAPVTLRSPIAAMRLGIATIYQELDLVEGLSVAENVHLGHEPTTAGFVVRGKAARASTAALLKRLGHPEIAPSRLVGDLSAAQQQIVSMARALSHDVRLIVMDEPSAALDPDEVDNLFRIVGDLTADGVAVVHISHRLEEIRRIGDRVTVLKDGRAVAGGLPAKSTPTREIVALMTGRDVEYVFPDRPPAPAPATSDPLLKVQGLAREGEFEPLDLELRPGEIVGLAGLVGSGRSEILETVYGARKPSAGQVTVAGRALRPGSVRAAVRAGLGLAPEERKTQALLLLESVTRNVSLSSMSRFAHGGWIDRGAERDAARAATRELSLRPDRPSAPARTLSGGNQQKAVLARWLLRGCRVLLLDEPTRGVDVGARAELYAVIRRLADEGLAVLLVSSEVPEVLGLADRVLVLREGRVVHRAPARELDEHRVLDLVMEGSPVEGTPAS

SEQ ID NO: 38760 - DNA, 1569 bp, Streptomyces avermitilis MA-4680
  CDS (1)..(1569): transl_table=11
gtgagcaacgcggacgagttgctgcgcatcgaaggcatacgcaagacgttccccggcgtcgtcgcgctcgacggcgtggacttcgatctgcgccgcggcgaggtgcacgtactgctcggcgagaacggcgcgggcaagagcaccctcatcaagatgctgtcgggtgcctaccggcccgacggcgggcgcgtcctcgtcgagggcgaggaggtgcgtatccatggggcgcaggactccgaggcgctcggcatcgccaccatctaccaggagttcaatctcgttcccgatctgacggtcgccgagaacatcttcctggggcggcagccgcgccgcctcggtctgatcgaccggaagaagatggaggcggacgccgccgaactgctggcgcgggtcggcgtccaggtgtcgccacgcgcgcgggtgcgtgaactcggtatcgcacgccttcagatggtcgagatcgcgaaggcgctgagcctgaacgcccgtgtcctgatcatggacgagccgaccgccgtgctcacctccgaagaggtggagaagctgttcgccatcgtgcgccagctgcgcgaggacggcgtcgggatcgtcttcatcacgcaccatctcgaggagatcgccgccctcggggatcgcgtcaccgtcatccgggacgggaagagcgtcggacaggtgcccgcatccaccagcgaggacgaactcgtacgcctcatggtgggacgctcgatcgaacagcagtatccgcgcgaacggccggactccggggccgcgctgctcagcgtcgaggggctcacccgggacggcgtcttccacgacgtgagcttcgaggtgcgggccggtgaggtcgtcggcgtcgcggggctcgtcggggcgggccgtacggaggtcgtacgggccgtcttcggggccgatccctacgaccgggggtccgtgcaggtcgcgggcgcgcgggtgccgcggcacgacgtcagcgcggcgatgagcgccggcatcggcctcgtacccgaggaccgcaagggtcaggggctcgtcctcgacgcctccgtcgaggagaacctcgggctcgtgaccatgcgggcggccacccgtggcgggctcgtcgacctcaaggggcagcgggacgccgccgcccgggtcgccggacagctgggcgtgcggatggccgggctcggccaacatgtgcgcacgctctccggcggcaaccagcagaaggtcgtcatcggcaagtggctgctcgcggacaccaaggtgctgatcctcgacgagccgacgcgcggtatcgacgtcggcgccaaggtcgagatctaccagctgatcaacgagctgacggccgcgggcgccgccgtcctgatgatctccagcgatctgcccgaggtgctcggcatgagtgaccgggtgctggtgatggcccagggccggatcgcgggcgagctcggggccgacgaggcgacccaggactccgtgatggcactcgccgtcagtacgaaccaatacaagccagataagtcagataagccagacgcgagtgcaggcaagacagaccagaaggaggccccccgtggccactga

SEQ ID NO: 38761 - protein, 522 aa, Streptomyces avermitilis MA-4680
MSNADELLRIEGIRKTFPGVVALDGVDFDLRRGEVHVLLGENGAGKSTLIKMLSGAYRPDGGRVLVEGEEVRIHGAQDSEALGIATIYQEFNLVPDLTVAENIFLGRQPRRLGLIDRKKMEADAAELLARVGVQVSPRARVRELGIARLQMVEIAKALSLNARVLIMDEPTAVLTSEEVEKLFAIVRQLREDGVGIVFITHHLEEIAALGDRVTVIRDGKSVGQVPASTSEDELVRLMVGRSIEQQYPRERPDSGAALLSVEGLTRDGVFHDVSFEVRAGEVVGVAGLVGAGRTEVVRAVFGADPYDRGSVQVAGARVPRHDVSAAMSAGIGLVPEDRKGQGLVLDASVEENLGLVTMRAATRGGLVDLKGQRDAAARVAGQLGVRMAGLGQHVRTLSGGNQQKVVIGKWLLADTKVLILDEPTRGIDVGAKVEIYQLINELTAAGAAVLMISSDLPEVLGMSDRVLVMAQGRIAGELGADEATQDSVMALAVSTNQYKPDKSDKPDASAGKTDQKEAPRGH

SEQ ID NO: 38762 - DNA, 1542 bp, Streptomyces avermitilis MA-4680; identical to SEQ ID NO: 27298
  CDS (1)..(1542): transl_table=11

SEQ ID NO: 38763 - protein, 513 aa, Streptomyces avermitilis MA-4680; identical to SEQ ID NO: 27299

SEQ ID NO: 38764 - DNA, 1530 bp, Streptomyces avermitilis MA-4680
  CDS (1)..(1530): transl_table=11
atgaccccgccgccgagtgacgctcccccggcggccgtcgaactccgcgggatcaccaagcgtttccccggcaccctcgccaacgacgccgtcgacctgacggtccgccgcggcgagatccacgccctgatgggcgagaacggcgcgggcaagtccaccctgatgtcggtcctgtacggcatggagcggcccgacgccggttcgatccggatcgacgggcgcgaggtgtccttcgccgatcccggtgccgcgatggccgccgggctcggcatggtgcaccagagcttcaagctgttcgactcgctgacggtcgccgagaacgtcgtgtacgccgccgagccgcgccgcttcggtctggtggaccggtccgcggcccgtcggcgggtgcgcgaactcgccgaggtgcacggcctcgccgtggacccggacgcccgcgtcggtgagctgccggtcggtctgcgccagcgggtggagatcctgaagctgctgcaccgcggcgcccggacgctcatcctcgacgagccgaccgcggtgctcacgcccgccgaggccgacgcgctgttcgcggtgctcaagtcgctggccgccgagggccgtacggtcatcctggtcacgcacaagctgcgcgaggtcctcgaaggcagcgaccgtgtgacggtgctgcgggacggcagggtcgtcgcccggctgcgcaccgccgggaccacggccgacgagatcgcggccgcgatgaccggccgcgcggtggaactggaccgcgtccacgcgccgggcacaccggccgacgtggtcctgggcgtgcgggggctcaccacggacgccgtgcgcgaggtcgaactgacggtccgcgcgggcgagatcgtcggtatcgcgggcgtcgccggcaacgggcagagcgagctggtcgaggcactggccgggctgcggccgaccgccgccgggcaggtcacgctgcggggcgaggacatcacgcacgcctcggcgaccgagcggcgcgccaggggcctcgcgtatgtgcccgaggaccggcacgcggtcggcaccgcgcccgccgcgtccgtcgcggacaacctcgcgatggggcaccaccgaacgtcgctgtcgtcccggggactgctgtcagccgcggccgtccgcgcccacgcgctggggctcgtcgagcgcttcggtatcaaggcggccacccccgaggtgcccgcgtccgccctgtccggcggcaatctccagaagctgctgatcggccgcgagctcgcccacgaggcaccgctgctgctggtcgaacagcccacgcgcggcgtcgacatcggcgccgtccagaacatccacgaccagctgatcgcctaccgcgacgccggtcacgccgtactcctggtctcggccgagctgagcgagatccgcgggctcgccgaccgggtgctcgtcatgtacgagggccgggtgacggcgacgtacccgaaggacgaggcggacgagcggacgctggggctcgcgatggcgggagccgccgcaccggcagaggtcggagactga

SEQ ID NO: 38765 - protein, 509 aa, Streptomyces avermitilis MA-4680
MTPPPSDAPPAAVELRGITKRFPGTLANDAVDLTVRRGEIHALMGENGAGKSTLMSVLYGMERPDAGSIRIDGREVSFADPGAAMAAGLGMVHQSFKLFDSLTVAENVVYAAEPRRFGLVDRSAARRRVRELAEVHGLAVDPDARVGELPVGLRQRVEILKLLHRGARTLILDEPTAVLTPAEADALFAVLKSLAAEGRTVILVTHKLREVLEGSDRVTVLRDGRVVARLRTAGTTADEIAAAMTGRAVELDRVHAPGTPADVVLGVRGLTTDAVREVELTVRAGEIVGIAGVAGNGQSELVEALAGLRPTAAGQVTLRGEDITHASATERRARGLAYVPEDRHAVGTAPAASVADNLAMGHHRTSLSSRGLLSAAAVRAHALGLVERFGIKAATPEVPASALSGGNLQKLLIGRELAHEAPLLLVEQPTRGVDIGAVQNIHDQLIAYRDAGHAVLLVSAELSEIRGLADRVLVMYEGRVTATYPKDEADERTLGLAMAGAAAPAEVGD

SEQ ID NO: 38766 - DNA, 1518 bp, Streptomyces avermitilis MA-4680
  CDS (1)..(1518): transl_table=11
atgacccacccgtccgacacgggtccggcccccgtgctggcgctcgaggacatctccaagtccttcggcgccgtgcgcgccctgcgggacgtctccctcgagctgttccccggcgaggtgcacgcgctcgccggtgagaacggcgcggggaagtcgaccctcatcaagacgctcgccggggtgcaccgaccggacgccggccaggtgctgctcgacggccggccgaccgtcttccacggtcccgccgacgcccgggacgcgggcatcgccgtgatctaccaggaaccgacgctcttccccgacctgtcgatcgccgagaacatctacatgggccgccggccccgccgctccttcggccgtatcgatcacaaggccacccgggccgcgaccgccgcgctgatgcggcgcctcggcgtcgaactcgaccccgaacgccccgcgcgcggactgtccatcgccgatcagcagatcgtcgagatcgccaaggcgctctccttcgacgcccgggtcctgatcatggacgagccgaccgcggccctgaccggcagcgaggtggcgcgtctgttcggtgtcgtccgcacgctgcgcgagcagggcgcggcggtgctgttcatctcgcaccgcctggaggagatcttccagatctgccaacgggtcaccaccctgcgcgacggtgccctgatctccagcgaaccgctggacggcatgacggaggacgacctcgtacggcggatggtcggccgcgacctcgacgagctgtaccccaagcaggaggtgcgggcgggcgaggtggcgatgagcgtgcgccgcctcaccagggagggcgtcttcaccgacgtctccttcgacgtccggcgcggcgagatcgtcggcctggccgggctcgtcggcgcgggacgcacggaggtggcacgggccgtcttcggcatcgaccgctgggacgcgggcgaggtcgaggtcgagggacgcaggctgacgaacggagccccgtccacggccatggccgccgggctcgccctcgtccccgaggaccggcgcgcccaggggctggtgatgaacatgtccatcgagcggaacatcgggctcaccggactgcggactaccgtccgggccgggctcgtggaccggggcgccgagcgcagccgctccctcgactgggccgccaagctccaggtcaagtacgcgcgcatcgccgacgccgtctccacgctgtccggcggcaaccagcagaaggtggtcctcgccaagtggctcgccaccggtcccagggtgctgatcgtcgacgagccgacccgcggtatcgacgtcggtacgaaggccgaggtgcaccggctgctctccgcactggccgcggacggagtggccgtcctgatgatctcctccgatctgcccgagatcctcggcatggccgatcgcgtgctcgtgatgcacgagggccgcgtcaccgccgagatcccgcgctccgaagccaccgaggaatccgtgatggccgcggccaccgggagggccgccgcatga

SEQ ID NO: 38767 - protein, 505 aa, Streptomyces avermitilis MA-4680
MTHPSDTGPAPVLALEDISKSFGAVRALRDVSLELFPGEVHALAGENGAGKSTLIKTLAGVHRPDAGQVLLDGRPTVFHGPADARDAGIAVIYQEPTLFPDLSIAENIYMGRRPRRSFGRIDHKATRAATAALMRRLGVELDPERPARGLSIADQQIVEIAKALSFDARVLIMDEPTAALTGSEVARLFGVVRTLREQGAAVLFISHRLEEIFQICQRVTTLRDGALISSEPLDGMTEDDLVRRMVGRDLDELYPKQEVRAGEVAMSVRRLTREGVFTDVSFDVRRGEIVGLAGLVGAGRTEVARAVFGIDRWDAGEVEVEGRRLTNGAPSTAMAAGLALVPEDRRAQGLVMNMSIERNIGLTGLRTTVRAGLVDRGAERSRSLDWAAKLQVKYARIADAVSTLSGGNQQKVVLAKWLATGPRVLIVDEPTRGIDVGTKAEVHRLLSALAADGVAVLMISSDLPEILGMADRVLVMHEGRVTAEIPRSEATEESVMAAATGRAAA

SEQ ID NO: 38768 - DNA, 1491 bp, Bacillus cereus ATCC 14579
  CDS (1)..(1491): transl_table=11
atgggaatgcatattgaaatgaaaaacatttcaaaggcgttcaatggcaatcctgttttgaagaatgcacagtttatgattgaaacaggagaagtccatgcattgatgggggaaaatggagcgggtaaatcaacgctcatgaagattttaacaggtgtatacaaaaaagatggtgggacaatcaagattgatgggcaagagcgcacctttaaaaatgcgaaagaagctgaagagtacggcatcgcatttatacatcaagaactaaacatattgccgaatttaacagtagctgaaaatatgtttctcggtaaagagttaatgtatgggaaaacaggtattttacgcactcgacaaatgaacgcgattgcgcagcagcaactagcagagctagggctgcatgtaagaggcgctatgttagcagaggaattatcggttggacaacagcaaattatcgaaattgcgaaagcattaatgacaaacgcgagcgttattattatggatgaacctactgcggcactgacggatcgtgaaatcgaaacgctctttacagtaatcaataagttacgtaaagaaggtgtttcattcgtgtacatttcgcatcgtatggaagagattttctcaatatgtgatgctattacgattttgcgtgatggagaatacgtgggaaagagattaattccagaaacatcatttgatgaagtagtgagtatgatggtggggcgcagcattggtgaacgttacccagagcgaaatagtcaaattggtgatgtcatttttgaaatgcgtaatggaacgaagaaagggaaatttgaaaatgtttcgtttcaagtgaggaaaggtgaaatccttggtgtagctggtttgatgggggctggtcgcactgatattatgaaagcgatatttggttatgaacctttagactctggacaaatttttataaatggacaagaagtaaagattgatagtccaatagatgcaattagacaaagaattgctttcattacagaagatagaaagtctgaaggattagtgttagatttttcaattcgagaaaatttagctttaccgaatttagaaaatctttcaaagggaagtgttctaagcaatgagctagaacaacagtttacagaggatatgatgaagcttcttaatgtgaaagcatctagcggggagcaggcagtgaaatctctttctggtggaaatcagcaaaagattgtaatcgcaaaatggctaggcattcatccacaattactcattttagatgagccaacaagaggtgttgatgttggagcgaaaaaagaaatttactctattatgaataagcttacagagcaaggcgatgccgttattatggtatcatctgagcttccggaagttttagggatgagtgatcgagttcttgttattcatgaaggaaaagtcggcggaattttagggaaagatgaggcatcacaagagtctattatggcactagctacagggggagagtaa

SEQ ID NO: 38769 - protein, 496 aa, Bacillus cereus ATCC 14579
MGMHIEMKNISKAFNGNPVLKNAQFMIETGEVHALMGENGAGKSTLMKILTGVYKKDGGTIKIDGQERTFKNAKEAEEYGIAFIHQELNILPNLTVAENMFLGKELMYGKTGILRTRQMNAIAQQQLAELGLHVRGAMLAEELSVGQQQIIEIAKALMTNASVIIMDEPTAALTDREIETLFTVINKLRKEGVSFVYISHRMEEIFSICDAITILRDGEYVGKRLIPETSFDEVVSMMVGRSIGERYPERNSQIGDVIFEMRNGTKKGKFENVSFQVRKGEILGVAGLMGAGRTDIMKAIFGYEPLDSGQIFINGQEVKIDSPIDAIRQRIAFITEDRKSEGLVLDFSIRENLALPNLENLSKGSVLSNELEQQFTEDMMKLLNVKASSGEQAVKSLSGGNQQKIVIAKWLGIHPQLLILDEPTRGVDVGAKKEIYSIMNKLTEQGDAVIMVSSELPEVLGMSDRVLVIHEGKVGGILGKDEASQESIMALATGGE

SEQ ID NO: 38770 - DNA, 1536 bp, Rhodopirellula baltica SH 1
  CDS (1)..(1536): transl_table=11
atgattgtctccgatgacgtggtgtttgaggccaaacagatttcgaagctgtttccaggcgtgaaagcgttggacggcgttgacctgacgttgcgagcggggaggctcaccacgttgctcggcgagaatggcgctggcaaatcaacgttgatgaaaatattggcgggagtgcaaccgcccgacgaaggcgagttgttggtgcagggtgaaccggttcatttcaccagcccacgcgacgcgcaggatcacggcatcgcgatgatccatcaagaactgagtttggtgcccgatctgaccgtcgccgaaaacattttccttggccgtgagccgctgcgtttcgaaacgctgattgactacaccgaactgaaccgtcaagcaaacgaatggttgaaacgtttggaactcgacgtgtcgccaacgacgcccgtccggcgactgcgagtcggtcaacaacagttggttgagattgctcgcgcgttggctggcaacgttcgaatcctgatcatggatgagcccacctccgcaatcaccgaacgcgagacggaggttctgttccgatgcattgcggatctaaagaaacagggtgtcgcgatcgtctatatcactcaccgcttggaagaactcgaacagattgctgacgacattgtcgtgatgcgtgatggttgcttgatcggcacggccgagtttggtgagctcagccacgacgcaatggttcgaatgatggttggacgagatgtgaaaatcctttccaagcagtcttcctccaacaatcagccggttcttcgtgccgaagggatctcgctcagccatccaacacggcccggcgactacctcgtgcacgaagttgacatgcacgtttgcaaaggcgaagtgctgggcatctttggattgatgggggccggtcgcacggaattgctggagtgtttgttcggactgcacccgacggcgtcgaccgggcaggtgagcatgcacgatcgaagtgttcgattgagaaaccccgccgatgcaatttctcatggtttggcgttggtccccgaggaccgaaagcaggatggtttggtgttgtcgatgtccgtcggtgaaaacgcgagcctggcgagcctcaaacacgctgaacggtttggcttcatcgatcgtgggcgggaacgcgagcacactcggcgtttcgtggaacgttttcgcgtgaagacaccgtcgctgcgtgaaaagatcatcaacttgagtggtggcaaccagcagaaagtgatcttggcgaaatggttggcgactgggcctgccgtgctgatgctcgacgagcccactcgcgggatcgatatccatgccaagaacgagatctattcgctcatcaatgaactgaccgctgacggattggcggtgatcatggtttcatcggaattgcccgaggtgatggcggtttccgatcggattttggtgatgtgcgaagggcgtgcaacccaatcgttcgaccgttctgaggccacggaggaaaatattctgcaagcggctttaccgagaaggaactcgattccatgttag

SEQ ID NO: 38771 - protein, 511 aa, Rhodopirellula baltica SH 1
MIVSDDVVFEAKQISKLFPGVKALDGVDLTLRAGRLTTLLGENGAGKSTLMKILAGVQPPDEGELLVQGEPVHFTSPRDAQDHGIAMIHQELSLVPDLTVAENIFLGREPLRFETLIDYTELNRQANEWLKRLELDVSPTTPVRRLRVGQQQLVEIARALAGNVRILIMDEPTSAITERETEVLFRCIADLKKQGVAIVYITHRLEELEQIADDIVVMRDGCLIGTAEFGELSHDAMVRMMVGRDVKILSKQSSSNNQPVLRAEGISLSHPTRPGDYLVHEVDMHVCKGEVLGIFGLMGAGRTELLECLFGLHPTASTGQVSMHDRSVRLRNPADAISHGLALVPEDRKQDGLVLSMSVGENASLASLKHAERFGFIDRGREREHTRRFVERFRVKTPSLREKIINLSGGNQQKVILAKWLATGPAVLMLDEPTRGIDIHAKNEIYSLINELTADGLAVIMVSSELPEVMAVSDRILVMCEGRATQSFDRSEATEENILQAALPRRNSIPC

SEQ ID NO: 38772 - DNA, 1569 bp, Rhodopirellula baltica SH 1
  CDS (1)..(1569): transl_table=11
atgaaggtcgctctttcggttcgaggcctgacgaagtcttacggcaacgtcacggtgctgaacgacgtctccatcgattttcatgccgggcatctacacgctttgcttggtgccaatggtgctgggaaaagcacgctgtgcaaaatcatcagtggattgatcccagcgaccggtgggcagatgtctctggacgccagtgactatcagcccggcagcaaacaggatgcggaggcgagtggagttcagatcgttcaacaagaattgaatttgattgaaacgttgtcggtcgcggaaaaccttcgcctggcgtctcttcccaaccggttcggcgttttacgaatgagcgagctgcatcgttccgcacgtcaaatattggatcggtttggtctgcccgatgtcgatacacgcacgattgtcggcagcttgggggtcggcaaacaacagatgatcgaaatcgcggcggcgctagcccgtgacgctcgcgttttgattttggatgaaccaacggccgctctttccggaagtgaatccgaagagctgtttgcacatctcacccagatgcgcaagcaaggtgtcgcgatcatttacatctcgcaccgactcgaagaagttcagcaactgtccgacgaagtcagcgtgctgcgtgatgggcgactggttacaaccgaacccatcgcaaagatcaatcgcgaaaagatggttgcttggatgagttccgaggaagaagcccgaggcggttcaaatcacacagcggccacctttgaaagtcatcgtcgaggcgaggtgggattgtcggtgcagggtatctcgtgcgggatggtcgacaacgtttcgtttgatgttcatcgaggagaacgattgggaatcgcaggattggtggggtccggaagaacggaattgttgcgagcgatctttggtgccgacgtggccgattctggacatgtgcggttggcggatggcgaggcggttcgcttcacccaccccagtcaggccgttgaagctggtttcgcaatggtgaccgaagatcgcaagcaaaatgggttgttgttgactcagccgattcgaaccaacacatcgttggccgcactcgccagcaaattttcagccaaaggatggatacgacaaacggcggaggttgaatcggccagtgcgatccacgcctcgctcgaaactcggtgccaatccttggagcaacctgtcggcacgctcagcggtggcaatcaacaaaaggtcgcggtggccaagtggttgacgcgtggtgccgaggtctacctgttcgatgaaccgtctcgcgggattgatgtggccgctcgcgcaagactttatgaactgtttgaggaattggccaaacaaggcaagacgatcgtgattgtgagcagtgatttggaagagttgtttgaaacgtgcgatgcaatcgcagtcatgtccgccggcagaatggtgacaaagttcgaacgagacgacttcagcgaagattcgattttggaagcttccttcgcggggcaagaatcgaagcggaccaccgcggagtcggatgacagatggcagaacgaagaggcgacaccatga

SEQ ID NO: 38773 - protein, 522 aa, Rhodopirellula baltica SH 1
MKVALSVRGLTKSYGNVTVLNDVSIDFHAGHLHALLGANGAGKSTLCKIISGLIPATGGQMSLDASDYQPGSKQDAEASGVQIVQQELNLIETLSVAENLRLASLPNRFGVLRMSELHRSARQILDRFGLPDVDTRTIVGSLGVGKQQMIEIAAALARDARVLILDEPTAALSGSESEELFAHLTQMRKQGVAIIYISHRLEEVQQLSDEVSVLRDGRLVTTEPIAKINREKMVAWMSSEEEARGGSNHTAATFESHRRGEVGLSVQGISCGMVDNVSFDVHRGERLGIAGLVGSGRTELLRAIFGADVADSGHVRLADGEAVRFTHPSQAVEAGFAMVTEDRKQNGLLLTQPIRTNTSLAALASKFSAKGWIRQTAEVESASAIHASLETRCQSLEQPVGTLSGGNQQKVAVAKWLTRGAEVYLFDEPSRGIDVAARARLYELFEELAKQGKTIVIVSSDLEELFETCDAIAVMSAGRMVTKFERDDFSEDSILEASFAGQESKRTTAESDDRWQNEEATP

SEQ ID NO: 38774 - DNA, 1524 bp, Rhodopirellula baltica SH 1
  CDS (1)..(1524): transl_table=11
gtgatccagccacaggcggacaaccccgatcaaccctctcgcttgcggttgtcgggaatcagtaaacggtttggctccacccaagctttgtcgaatgtttcgatggaagtggaaggtggccaagccatcgcggttatcggtgaaaacggtgccggcaaaagtactttgatgaaggtgctggccgggatcgtctcgccggaccagggtcaaattgaattggacggtcaagtcctttcctggtccggaccgcgcgacgcgattgatgccgggatcgcgttgattcatcaagagctgaacctgcacgacaacctgagcgttgccgagaatttgtttctcggccgtgagccctcccgatttggtttgctcgatcgggcggagttacgacgcacggcgtcatcatggctggatcgagttggtttgtcggtgtccccggatgcgcccgtcgggccacttcccattgcgtccaagcaattgatcgagatcgcgcgagctttgtcgaccgatgcacgcgtggtcatcatggacgaaccgaccagcagtctgagcgaagaggaatcgctgcggttgttcgagttgatcgaacggcttcgcgaagaaggtgttgcgattctctatatctcgcaccgcttgcacgaaatcattcgcttggccgatcgagtggaagtgctgcgggatggtgagcatgtcgaaacgttgacgaaaggcaatatcacgcatgattcgatggttcgtgcgatggtggggcgtgatctgacgcgtcgttctcacgaaaccgcgaaagagtgtcttgagcctcgactgaccgtgtcgggtttgagggtcggatcccgcgccgcacctccggttgatttgcaggtgctcggtggcgaagtggtcgccttggttggattggtcggtgcagggcgaaccgagatcgtagaaacgatcttcggcgtccgcgaacggttcggtggcgagatcttgattgactccgagccgctcaaaggcggtgtcgactccgcgatcgcagccggattggcgttggtaccggaagaccgcaagcggactgggctgttgatccaatcgagtgttcgtgacaacgcgaccattgtttcgatgacgcgggacggagtgtttcgcaatcgcaaaacggaacgtgcgacggccgcagaattgatcgaccggctgcgagtgaagactgcttcgcaagaaattgagattgcttctttgtccggtggaaaccagcaaaaggtggccttggcgaagtggttggccggtgacgtgaaggtcttgatgctcgatgagccaacacgaggcgtcgacattggcgcaaaatctgagatctacgaagtgatcgatcagttggcgagccaaggcatgggtgtgttggtggtcagcagtgaaatggaagaagtctttgcgatcgccgatcgggtgattgtcatttccgatggttgtgtcgcgggtgaattgacaagatcggaattgaccgaagaggcgatcatgcgtctcgcggtggcaaagggcgaacctgcccaaggttga

SEQ ID NO: 38775 - protein, 507 aa, Rhodopirellula baltica SH 1
MIQPQADNPDQPSRLRLSGISKRFGSTQALSNVSMEVEGGQAIAVIGENGAGKSTLMKVLAGIVSPDQGQIELDGQVLSWSGPRDAIDAGIALIHQELNLHDNLSVAENLFLGREPSRFGLLDRAELRRTASSWLDRVGLSVSPDAPVGPLPIASKQLIEIARALSTDARVVIMDEPTSSLSEEESLRLFELIERLREEGVAILYISHRLHEIIRLADRVEVLRDGEHVETLTKGNITHDSMVRAMVGRDLTRRSHETAKECLEPRLTVSGLRVGSRAAPPVDLQVLGGEVVALVGLVGAGRTEIVETIFGVRERFGGEILIDSEPLKGGVDSAIAAGLALVPEDRKRTGLLIQSSVRDNATIVSMTRDGVFRNRKTERATAAELIDRLRVKTASQEIEIASLSGGNQQKVALAKWLAGDVKVLMLDEPTRGVDIGAKSEIYEVIDQLASQGMGVLVVSSEMEEVFAIADRVIVISDGCVAGELTRSELTEEAIMRLAVAKGEPAQG

SEQ ID NO: 38776 - DNA, 1668 bp, Rhodopirellula baltica SH 1
  CDS (1)..(1668): transl_table=11
ttgcagccaagacccattggatctgcttcgcggagccggcgtcgacatgacccagcccgaagcggtgaagacgactttggatcacttcgccagtctctccaagcaactcgacgaactgctgtgaccgacgccacccatcgtctggaactgaccggaattcgcaaacactttggatcgaccaaggcgctcgacggcgtcgatttggtcgtcggtcctggcgaagtgcatgcgatcatcggcgaaaacggggctggcaagagcaccttgatgaaggtcttgtccggtgctcatcgcccagacgccggtcgaatccaaatcgatggggaagaggttgatctgagcaacccgcgagcctcccaggccgcgggtatcgcgatgatttatcaggagctgaacctggctcctgatttgtcggtcgcggacaacatcaccttgggcgacgaaccgtctcgatggggcggacgcggaggtggttggctggatcgtggtcggcaacatgcgatcgccaaggaagctttgaagcggttgcactgcgaagacattgatccggcgcaacccgttcgcaaattgtcgatcgctcagcagcaaatggtcgagatcgctcgcgcggttgtggccgatcgcaagctgaaactgttgatcttggacgaacctaccagcagcctgacccaggtcgacaccgagaacctgttcgcggtgatcgagcgactgaaatccgaaggcgtcagcgtgctgtacatcagccactttctggaagagtgtcagtcggtcggtgatcgcttcaccgtccttcgagatggcgtgacagcaggctcaggcagcttgactgaaaacgacccggattggatgccgatggattccatcgtgcagatgatggttggtcgtgagatctcgcaactctatcccgacctcgaccatgttcgtggcgaacccgtgttgcaactcgaagatgttcgcgggtcacgtttgcctaccgatgtttcattgacgctgcaccgaggcgagatcttggggctcgccggattgatcggcgcgggacggacggaaacgattcgagccctgtttgggctggatcgattggcgtctggcaaagtcgtcgtgatgggtcgcgaagatgcgcggcgggatccgcagaagagttggattcgagacgcgatgggtttggtgtccgaggatcgcaagaacgaaggtttgttcttggaacgcagtctgaccgagaacctgacgctgactcgaaccgagccctaccgacgaggcccgttccttcgtcgatcggaaatgaagaaggcgaccgagcattggatgaaagaattggcggttcgggcgagcgacccggaccaggcgatcggtgagctatccggtggtaatcaacagaagatcgcattggctcgtttgctgcatcatgattgcgagatcttgttgcttgatgagcccactcgcggcatcgacatcggcagcaaacgcacgatctatcaaacgattggtgagctggcggcggagggcaaagcgatcttgttgatcagcagttacttgcccgagttgctcggcgtctgcgattcaattggcgtgattcaccaaggccgcttgaccagcatccgtcccgccagcgaatggaccgaacacagtctgctgaccgaagcgctgggcgccgcggcaacatccgagtga

SEQ ID NO: 38777 - protein, 555 aa, Rhodopirellula baltica SH 1
MQPRPIGSASRSRRRHDPARSGEDDFGSLRQSLQATRRTAVTDATHRLELTGIRKHFGSTKALDGVDLVVGPGEVHAIIGENGAGKSTLMKVLSGAHRPDAGRIQIDGEEVDLSNPRASQAAGIAMIYQELNLAPDLSVADNITLGDEPSRWGGRGGGWLDRGRQHAIAKEALKRLHCEDIDPAQPVRKLSIAQQQMVEIARAVVADRKLKLLILDEPTSSLTQVDTENLFAVIERLKSEGVSVLYISHFLEECQSVGDRFTVLRDGVTAGSGSLTENDPDWMPMDSIVQMMVGREISQLYPDLDHVRGEPVLQLEDVRGSRLPTDVSLTLHRGEILGLAGLIGAGRTETIRALFGLDRLASGKVVVMGREDARRDPQKSWIRDAMGLVSEDRKNEGLFLERSLTENLTLTRTEPYRRGPFLRRSEMKKATEHWMKELAVRASDPDQAIGELSGGNQQKIALARLLHHDCEILLLDEPTRGIDIGSKRTIYQTIGELAAEGKAILLISSYLPELLGVCDSIGVIHQGRLTSIRPASEWTEHSLLTEALGAAATSE

SEQ ID NO: 38778 - DNA, 1554 bp, Bordetella bronchiseptica RB50
  CDS (1)..(1554): transl_table=11
atgatgcattccgaaggcgccgccagcgcggcgccctccccccagccgccgccgctgttgcgcttgcggcagatcagcaagcgcttcggcgccacccaggcgctggacgatgtgtccgtatcgttcgaggccggcaaggtgcactgcctgctgggcgagaacggcgcgggcaaatcgaccataggcaagatcgtcgccgggctgtttgcgccggacagcggcgcgctgctgctcgacggccacgaagtgcgcctggccgacgccagcgaggcgcgccggcgcggcatcgccgtcgtgtaccaggagctgtcgctggcgccggacctgtcggtgcgcgccaacctgtgcctgggcgccgaggccgggcgccggccctggtcgcccttgcggcgcggcgccgagaccgcgcaagtcggcgccgtgctggcgcggctggggctggacctggacatggaagcgccggtgcgccagctgcccgccggcgtgcagcagctggtggagatcgccaagtcgctgatgagcagcccgcgcatcgtgatcttcgacgagccgaccgccatgctgggcgcggccgagaagcagcgcttcttcgaggtggtgcgcggcctgcgcgccgacggcatcgcctgcatcctggtcacccaccacatggacgacgtcgaagcggtgggcgattgcgtcaccatcatgcgcaatggccggcgcgtcgactcgttcgacctgcacgccggcatcaccagcgacgcggtgctggagaaactgaccggacgccgcgaagtgctggcggccgccgccgaggcgccgcgccggctcggcgccacccggctgcgcatcgcgctgccggccggcggcgggctggccggcatcgaagcgcgcgccggcgaggtggtgggcttctatggcgtgctgggctgcggcgcgggcgaactgatgtacggcctggtgggcctggacggaccgccgcgcgccgactactacctggacgacgccccttatcggccgcgcaatccggccgcggccttgcgccagggcgtggggctgctgccggccggccgccagagccacggcgtgctgaccggccgctcgatccgcgagaacctgatgctgacccagctcgaccgcgtcagccgctggcaatgcatcgatccggcccgcgaggccgcctgggcgcgcgaacagctcgaacgcgccggcgtcaagcacggcgaccccgccgacccgatcgaaagcctgagcggcggcaaccagcaaaaggccttgctggcccgcgccctgggcgcggcgcgccggctgttgctgctgcacgaacccacggccggcgtggacatcctggccaagcagcacatccacgaactggtgcgcgcggcggccgcgcaggggttgaccgtcgtggtgctgtccagcgacctgcccgaggtgatcgccctgtgcgacaccgtctacaccttcttccacggcgcggccgtcgcgcgctacgcgcagcccggcccggattgccaaccccacatcctcgccgatgtcctcggccaacgggagtcccagcatgctcactaa

SEQ ID NO: 38779 - protein, 517 aa, Bordetella bronchiseptica RB50
MMHSEGAASAAPSPQPPPLLRLRQISKRFGATQALDDVSVSFEAGKVHCLLGENGAGKSTIGKIVAGLFAPDSGALLLDGHEVRLADASEARRRGIAVVYQELSLAPDLSVRANLCLGAEAGRRPWSPLRRGAETAQVGAVLARLGLDLDMEAPVRQLPAGVQQLVEIAKSLMSSPRIVIFDEPTAMLGAAEKQRFFEVVRGLRADGIACILVTHHMDDVEAVGDCVTIMRNGRRVDSFDLHAGITSDAVLEKLTGRREVLAAAAEAPRRLGATRLRIALPAGGGLAGIEARAGEVVGFYGVLGCGAGELMYGLVGLDGPPRADYYLDDAPYRPRNPAAALRQGVGLLPAGRQSHGVLTGRSIRENLMLTQLDRVSRWQCIDPAREAAWAREQLERAGVKHGDPADPIESLSGGNQQKALLARALGAARRLLLLHEPTAGVDILAKQHIHELVRAAAAQGLTVVVLSSDLPEVIALCDTVYTFFHGAAVARYAQPGPDCQPHILADVLGQRESQHAH

SEQ ID NO: 38780 - DNA, 1509 bp, Chromobacterium violaceum ATCC 12472
  CDS (1)..(1509): transl_table=11
atgcaagtgaccatgcgcggcatcagcaaggctttcgggccggtcaaggtgctggagaacgtggagttcacgctgcgcggcggcgagatccacgcgctgatgggcgagaacggcgccggcaagtccacgctgatgaagatactcagcggcgtgcaccgcgccgacgccggcgagatcctgctggacggccgcaaggccgaactgaggagcaccgaggcggcggaagcggccggcatcgccatcatccaccaggaattgaacctgattccgcagctgtcggtgatggagaacctgtttctcggccgcgagccgtcccgcttcggcatcatcgactacgcggcgatgcggcgcgaggcgcgggcgcagctggaggcgctgggcgccggcggcatcgatccggacgccgaggccggcagcctgtccatcggccagcagcagatggtggagatcgccaaggcgctggcgctgaacgcccgcgtgctgatcatggacgagccgacggcggcgctcaccgagcgcgagatcgaccggctgttcgagctgatggcccagctgagggaaaacggcgcggccatcgtctacgtctcgcaccggatggaagagatcttccgcgtctgcgaccgcatcagcgtgctgcgcgatggctgcttcgtcggcgagcgcgaaatcgcccgcaccgatttcgacgaagtggtgcggatgatggtggggcgcgagatcggcgaccgctatccgaagcgcgaggccgcgccgggcgaggtgaggctgaaggtggagaacctggccgacgagaacatgatcgccggcatcggcttcgaggtgcgcgccggcgaggtgctgggcatcgccgggctgatgggctcgggacgcagcgacatcctgaagacgctgttcggcgccaagcgccgcaccgccggccgcgtcgagctggacggtaaggaattgaaagtggccgcgccgggcgacgccatcgccgccggcctgggcttcgtgcccgaagaccgcaaaagcaaggggctggtgctgggcatgtcgctgcgcgaaaacgcgaccctggtgcatctggaccagtacgcccggctgggcgtggtcagcgccgccgaggaaaagcgggcggtggacggcttgatcgctcagctgcgcatccgcgcccgcgacgccgagctcgacgtcaagtcgctgtccggcggcaaccagcagaaagtggtgttcgccaaatggctggcgaatccgcccaaggtgctgctgctggacgagccgacgcgcggcgtcgacgtcggcggcaaggccgagatctaccacatcgtcaaccagctggccgccgccggcaccgccatcgtgatggtgtcgtccgagctgccggaagtgctggcgctgagcaaccgcatcctggtgctgcacgaaggccgccaggccggcatcttcgacgccgccggctgcagccaggaaaccctgatggccgccgcgaccggcggcgccgttcactccgaaaccaggaagcaagcatga

SEQ ID NO: 38781 - protein, 502 aa, Chromobacterium violaceum ATCC 12472
MQVTMRGISKAFGPVKVLENVEFTLRGGEIHALMGENGAGKSTLMKILSGVHRADAGEILLDGRKAELRSTEAAEAAGIAIIHQELNLIPQLSVMENLFLGREPSRFGIIDYAAMRREARAQLEALGAGGIDPDAEAGSLSIGQQQMVEIAKALALNARVLIMDEPTAALTEREIDRLFELMAQLRENGAAIVYVSHRMEEIFRVCDRISVLRDGCFVGEREIARTDFDEVVRMMVGREIGDRYPKREAAPGEVRLKVENLADENMIAGIGFEVRAGEVLGIAGLMGSGRSDILKTLFGAKRRTAGRVELDGKELKVAAPGDAIAAGLGFVPEDRKSKGLVLGMSLRENATLVHLDQYARLGVVSAAEEKRAVDGLIAQLRIRARDAELDVKSLSGGNQQKVVFAKWLANPPKVLLLDEPTRGVDVGGKAEIYHIVNQLAAAGTAIVMVSSELPEVLALSNRILVLHEGRQAGIFDAAGCSQETLMAAATGGAVHSETRKQA

SEQ ID NO: 38782 - DNA, 1488 bp, Gloeobacter violaceus PCC 7421
  CDS (1)..(1488): transl_table=11
atgcctctccttgctctcgaaaagatcacccgccgcttcgggccggtcacggtgctcgacggggtggatttcaccgtcgaggcgggggaggtgcacgcattggtcggtgaaaacggcgccggtaaatcgacgctgatgaaaattctctcgggcgcccttgctcccgacgcgggtaccgtccgctggcagggtgccgccgtccggttcgattcgccccgcgccgcccgcgccgccggcatcgccatgatccaccaggaactggcgctggtgccggcgttgtcggtggccgaaaatatctgcctgggggaggcgcagagctggtggcggccggtggactataggaacttcgaaaattcggcccgcgcggtactggagcggttgggccaaccgatcgacccgcgcacgccggtcggacggcttaatttgcccgaacagcagatggtcgagaccgcccgcgccctcaggcaaaaggcgcgcctgcttatcctcgatgaacccacggccagcctgagcgcccagcagagcgagcagctgtttgccgtgctcaggcggattcgcacggagggcacggcaattatctacatctcccaccgcctggaggaaatctttgccctttgcgatcgggtgacgattctgcgcaacggcaggcgcgtccactgcgctgcggtgggcgaactgtcgatggcggcggtggtgcgccacatggtgggccgcaccctcgaacccaccggcaccccggccgcttcgcaaaccggccgacccgtcctcaccgtgcacaatctgtgctgcggccggctcaggaatttgcacctggaactgcgcgcaggtgaggtggtggggctgatgggggtggccggggcgggccgctcccggttggtgcgcacgctgttcggtgcccaaaggcccgaggcgggagagattgtgctggatggacgaccggtggtctggcgctcgccccgcgacgccatcgcccgcggcatcggcctgttgggggaggaccgcaagcgccacagcctgctgcccgagcgctgcgtgcgcgaaaatatggccctggtgagcctgctcggccgcgcccgctggggagtcgtcgagcagtaccgcgagcggagtgcctgccgcgcactgggggggcaactgcgcctggcgccgcgcacccaggagatggccatccgcgccctgagcggcggcaaccagcaaaaggcgctattggggcgctggctgctcgccgggtgccgggtgctgctgctcgacgaaccgacccgcggcgtcgatgtcgaggccaaagccgagatctacggactcattcgcgccctcgccgcgggcggcaccgccgtgctggtggtctcttcggatctgcccgaattgaccttgctggccgagcgcctgctggtgctccagggcgggcgcatcgtgggcgagcagcggcctccctacgaccctcgggcgctgttggcccaggcgttgggggtggcagccgaggacggctga

SEQ ID NO: 38783 - protein, 495 aa, Gloeobacter violaceus PCC 7421
MPLLALEKITRRFGPVTVLDGVDFTVEAGEVHALVGENGAGKSTLMKILSGALAPDAGTVRWQGAAVRFDSPRAARAAGIAMIHQELALVPALSVAENICLGEAQSWWRPVDYRNFENSARAVLERLGQPIDPRTPVGRLNLPEQQMVETARALRQKARLLILDEPTASLSAQQSEQLFAVLRRIRTEGTAIIYISHRLEEIFALCDRVTILRNGRRVHCAAVGELSMAAVVRHMVGRTLEPTGTPAASQTGRPVLTVHNLCCGRLRNLHLELRAGEVVGLMGVAGAGRSRLVRTLFGAQRPEAGEIVLDGRPVVWRSPRDAIARGIGLLGEDRKRHSLLPERCVRENMALVSLLGRARWGVVEQYRERSACRALGGQLRLAPRTQEMAIRALSGGNQQKALLGRWLLAGCRVLLLDEPTRGVDVEAKAEIYGLIRALAAGGTAVLVVSSDLPELTLLAERLLVLQGGRIVGEQRPPYDPRALLAQALGVAAEDG

SEQ ID NO: 38784 - DNA, 1506 bp, Photorhabdus luminescens subsp. laumondii TTO1
  CDS (1)..(1506): transl_table=11
atgcagcctgtactggaactaaaaggaattagtaaatcttttcctggtgtcaaagcattatctggtgcggcattacgtgtttatccaggtaaagtgatggcactggtgggagagaatggtgcaggtaagtccacgatgatgaaagtgttgactgggatatataccagagatacaggcacagttcattatttaggaaaagaagtgattttttctggccctagatcctctcaggaagcggggatcgggattatccatcaggaattaaatcttattccccaactgactattgctgaaaatattttcctgggacgcgaatttgttaataaattcggtgcaattgactggagaaaaatgtatcaggaagccgatcgcctgttaaaaaaattgaatctgagttacagcagtcaccgtttagtcgctgaactttctatcggtgatcaacaaatggttgaaattgctaaggtgctgagttttaaatccaaagttatcattatggatgagccgacggatgcgctgactgatacagaaactgaatcattatttcgcgtaatatatgaactaaaatctcagagatgtggcattgtttatatctcccatcgtttgagagaaatttttgaaatttgcgatgatgtaacggtatttcgtgatggacaatttattggtgaaaagtcagtaaaagagctaaaagaagagactctgattgaaatgatggttgggcgaaaactggaagatcagtatcctcgcctgaatttacctcggggtaaaaaacgacttgaagttaagcagatttctggccccggtgtgacaaatgccagtttttccctttatagcggggaaattttgggtatatcagggctaatgggggctggccgcactgaattgatgaaaattatttatggtgcgttgccaaaaactcaggggcaaatcacactggatggaacccccattgtaattcgtaaccctcaggatgggttagcttgtgggattgtttatatttcagaagatcgtaaacgtgatggcttagttttgggaatgtcaatcaaagataatatgtctcttactgccttgcgttatttcagtaaccggttaggtggtcttaatcataaagaagaacagaatgcagttagtgactttattaaattgtttagtatcaagacaccttcaatgggacaagttattggtttactttctggtggtaatcagcaaaaagtagctattgcccgtggattaatgaccagaccaaaagttcttattctggatgaacctacgcgtggtgtagatgttggtgcaaaaaaagaaatttatcagttaattaatcaattcaagaaagaggggttaagcattattctcgtttcttctgaaatgccagaagtgataggaatgagtgatcgtattttggttatgtgtgaaggccagatcagtggagaattttttgctgaacaggcaactcaagaaattttgatggcagcggctgtaggcaaacaatatggagcgattcaggagtaa

SEQ ID NO: 38785 - protein, 501 aa, Photorhabdus luminescens subsp. laumondii TTO1
MQPVLELKGISKSFPGVKALSGAALRVYPGKVMALVGENGAGKSTMMKVLTGIYTRDTGTVHYLGKEVIFSGPRSSQEAGIGIIHQELNLIPQLTIAENIFLGREFVNKFGAIDWRKMYQEADRLLKKLNLSYSSHRLVAELSIGDQQMVEIAKVLSFKSKVIIMDEPTDALTDTETESLFRVIYELKSQRCGIVYISHRLREIFEICDDVTVFRDGQFIGEKSVKELKEETLIEMMVGRKLEDQYPRLNLPRGKKRLEVKQISGPGVTNASFSLYSGEILGISGLMGAGRTELMKIIYGALPKTQGQITLDGTPIVIRNPQDGLACGIVYISEDRKRDGLVLGMSIKDNMSLTALRYFSNRLGGLNHKEEQNAVSDFIKLFSIKTPSMGQVIGLLSGGNQQKVAIARGLMTRPKVLILDEPTRGVDVGAKKEIYQLINQFKKEGLSIILVSSEMPEVIGMSDRILVMCEGQISGEFFAEQATQEILMAAAVGKQYGAIQE

SEQ ID NO: 38786 - DNA, 1536 bp, Photorhabdus luminescens subsp. laumondii TTO1; identical to SEQ ID NO: 27316
  CDS (1)..(1536): transl_table=11

SEQ ID NO: 38787 - protein, 511 aa, Photorhabdus luminescens subsp. laumondii TTO1; identical to SEQ ID NO: 27317

SEQ ID NO: 38788 - DNA, 1509 bp, Vibrio vulnificus YJ016
  CDS (1)..(1509): transl_table=11
atggtaaatcaaacacatgaattcctgttggagatgacaggagtaagtaaagagtttcctggggtaaaggcattagataaggttaatttaaacgttcgccctcattctattcatgcattaatgggagaaaatggggctggcaaatcaacactattaaaatgtctatttggtatttacgagaagaatgaaggaaatattctctttctcggcaaggaagtgaatttcacctcatcaaaagaagcattggaatccggtgtttctatggttcaccaagaattgaaccaagtaaaacaatgctccgtcatggataatatttggctcggtcgttatccaaagaaagggttctttgttgatcacgataaaatgtatcgcgacaccaaagcaatctttgccgaactggatatcgatatcgatcctaaagtcaaagtcgcgaccttatccgtatcacaaatgcagatggttgagatcgccaaagcgttctcctatgacgccaaaatcgtcatcatggatgaacccacctcatcgctcacggaaaaagaagtcagccacctgtttaccatcatcaacaagctgaaagagaaaggctgtggcgtggtgtacatctcgcacaagatggaagaaatctttgctatctgcgatgaaatcaccattttgcgcgatggacaatgggtcgacactcgccctctcaaaggactcgatatggaccagatcatcgccatgatggttggccgcgagttaacgcatcgcttccctgaaaaaaccaacacaccgaaagatgtgattttggaagtggaaaacctcaccgcgctcaaccaaccgtcgattcaagatgtgtcgtttgaactgaaagcgggcgaaatcttaggcgttgcgggccttgtgggttcacgcagaaccgacatcgtcgaaacgattttcggcgtacgcgaacgcagcgaagggcacattcgcttgcatggtcgtgagatgaaaaaccgcgatgcgcatgaagcgatcaacaacggttttgccctggtgaccgaagaacgtcgctccaccggcatctacggcaacctcgacatcaccttcaatgcgttggtggccaacgtcgatgagtacaaaaccaaaatgggcctactcagcgacaaaaaaatgaagagtgacacgcagtgggtgattgattccatgcgcgtgaaaacgccctctcatcaaacccacatcagctctttgtcggggggtaaccagcagaaagtcatcattggccgctggctgctcacgcaaccggaaatcctcatgctggatgaaccgacacgcgggatcgacgttggcgccaagtttgagatttaccaattaattctcgaattagccaagaaaaacaaaggcatcattattatttcttcggaaatgccggaattactgggtattacagaccgaatattagtcatgagtaatggccgcgcagcgggcatcgttaataccaaagaaacctcacagaatgaaatattagaactggcttctcgctatctctag

SEQ ID NO: 38789 - protein, 502 aa, Vibrio vulnificus YJ016
MVNQTHEFLLEMTGVSKEFPGVKALDKVNLNVRPHSIHALMGENGAGKSTLLKCLFGIYEKNEGNILFLGKEVNFTSSKEALESGVSMVHQELNQVKQCSVMDNIWLGRYPKKGFFVDHDKMYRDTKAIFAELDIDIDPKVKVATLSVSQMQMVEIAKAFSYDAKIVIMDEPTSSLTEKEVSHLFTIINKLKEKGCGVVYISHKMEEIFAICDEITILRDGQWVDTRPLKGLDMDQIIAMMVGRELTHRFPEKTNTPKDVILEVENLTALNQPSIQDVSFELKAGEILGVAGLVGSRRTDIVETIFGVRERSEGHIRLHGREMKNRDAHEAINNGFALVTEERRSTGIYGNLDITFNALVANVDEYKTKMGLLSDKKMKSDTQWVIDSMRVKTPSHQTHISSLSGGNQQKVIIGRWLLTQPEILMLDEPTRGIDVGAKFEIYQLILELAKKNKGIIIISSEMPELLGITDRILVMSNGRAAGIVNTKETSQNEILELASRYL

SEQ ID NO: 38790 - DNA, 1485 bp, Bacillus cereus ATCC 10987
  CDS (1)..(1485): transl_table=11
atgcgtattgaaatgaaaaatatttcaaaggcgttcaatggcaatcctgttttgaagaatgcacaatttatgattgaaacaggagaagtccatgcattgatgggggaaaatggagcgggtaaatcaacgctcatgaagattttaacaggtgtatacaaaaaagatggtggaacaatcacgattgatgggcaagagcacacctttaaaaatgcgaaagaagctgaagagtacggtattgcatttatacatcaagaattgaacatattatcgaatttaacagtagctgaaaatatgtttctcggtaaagagttaatgtatggaaagacagggattttgcgtacacgtcaaatgaatgcgattgcgcagcagcaactagcggaactagggttacatgtaaaaggcgctatgttggcaggagagttatcggttggacaacagcaaattatcgaaattgcgaaagcattaatgacaaacgcgagcgttattattatggatgagcctacagcggcattaacagatcgtgaaattgaaacgttgtttactgtcattaataaattacgtaaagaaggcgtttcgttcgtgtatatctcacaccgaatggaagaaattttttcaatatgtgataccattacgattttacgtgatggggaatacgtcggaaagagatccattccggaaacatcgtttgatgaagtagtgagtatgatggtggggcgcagcattggtgaacgttacccagaacggaatagtcaagttggcgatgttatttttgaaatccgtaatggaacgaaaaaagggaagtttgaaaatgtttcgtttcaagtgagaaaaggtgaaatccttggtgtagctggcttgatgggagcttgccgtacggatattatgaaagcgatatttggatacgaacctttagattctggccaaatttttataaatgggcaagaagtaaagattgatagtccgatagatgcgattagacaaagaatcgcattcattacagaggatagaaaatctgaagggttagtgctagatttctcaattcgagaaaatttagctttaccaaatttagaaagtctttcaaagggaagtgttctaagcgacgaactagaacaacagtttacagcggacatgatgaaacttcttaatgtgaaagcatctagtggagaacaagcggtgaaatctctttctggtggaaatcagcaaaaagttgttattgcaaaatggttaggtatccacccgcagttactcattttagatgagccaacaaggggtgttgatgttggagcaaaaaaagaaatttactctattatgaataagcttaccgagcaaggagatgcagttattatggtatcatctgagcttccagaagttttagggatgagtgatcgcgttcttgttattcatgaaggaaaagtcggcggcattttagagaaagatgaggcatcacaagagtctattatggcactagctacagggggagagtaa

SEQ ID NO: 38791 - protein, 494 aa, Bacillus cereus ATCC 10987
MRIEMKNISKAFNGNPVLKNAQFMIETGEVHALMGENGAGKSTLMKILTGVYKKDGGTITIDGQEHTFKNAKEAEEYGIAFIHQELNILSNLTVAENMFLGKELMYGKTGILRTRQMNAIAQQQLAELGLHVKGAMLAGELSVGQQQIIEIAKALMTNASVIIMDEPTAALTDREIETLFTVINKLRKEGVSFVYISHRMEEIFSICDTITILRDGEYVGKRSIPETSFDEVVSMMVGRSIGERYPERNSQVGDVIFEIRNGTKKGKFENVSFQVRKGEILGVAGLMGACRTDIMKAIFGYEPLDSGQIFINGQEVKIDSPIDAIRQRIAFITEDRKSEGLVLDFSIRENLALPNLESLSKGSVLSDELEQQFTADMMKLLNVKASSGEQAVKSLSGGNQQKVVIAKWLGIHPQLLILDEPTRGVDVGAKKEIYSIMNKLTEQGDAVIMVSSELPEVLGMSDRVLVIHEGKVGGILEKDEASQESIMALATGGE

SEQ ID NO: 38792 - DNA, 1533 bp, Bacillus cereus ATCC 10987
  CDS (1)..(1533): transl_table=11
atggaatacgtaattgagatgaacaatattacaaaagtattcccaggcattgtagcgaatgatgatattacgctgcaagtaaaacagggagaaatacatgctttacttggagaaaatggtgcagggaaatccacattgatgaatgtactatttggtttgtaccaaccagaacaaggtgaaattaaaattaaaggaaaacctgtaaaaattacaaatccgaatatagcaaatgaccttggtattgggatggtccatcagcattttatgcttgttcataattttacagttacagagaatattattcttggaaatgagccgaagaaaaacgggaaaattgctgttgaagaggcggcaaaagaaattaagcaattatctgaacagtatggtttggctgttgatccacatgcgaaaattgaagatatttctgttgggatgcagcaaagggttgaaatattaaagactctttatcgtggtgctgagattttaatatttgatgagccaaccgcggtgttaactcctcaagaaattcatgagttgattcaaattatgaaaaagcttgtgcaagaggggaaatctattatccttattacacataagttgaaagaaattatggaagtttgcgatcgttgtacaattattcgtaaaggtaaggggattggtactgttgatgtagcggaaacggatgagcataaacttgcagagttaatggtcggacgtcaagtgaattttaaaacagaaaaaatagaagctaaaccaatggaagaagtactatctattgcaaacctaattgttcatgatacgcgcaagttacctgctgtaaaaggccttgacttaactgttcgtgcaggagaaatcgttgggattgcagggattgatggaaatggtcaaagtgaattaatagaggcgattactggtttacgaaaagttgagtcaggttctattgcaattaaaggaaaagaaataacgaattggcctgttcgaagaataacagaagaggggattggtcatattcctgaagaccgtcataaacacggacttgttctcgatttttctgttcgggacaatattgttttacaaacatactataaaaatccattttcaaagaaagggattttaaattttagtaaaattacagaaaaagcgaaagcacttattgaacagtttgatgtacgtacacctagtgaacaaacgttagctcgcgctctatctggtggaaaccaacaaaaggcaattattgcacgtgaggtagatcgtaatccagatttattaattgcagcacagccaacacgtggtttagatgtaggtgcgattgaatttattcataaaaaattaattgagcagagagataatggtaaggcagtattacttttatctttagagctggatgaaattttaaatgtaagtgatcgagtggctgttatatatgaagggaaaattgtagcgattgtcgatgcgaaagaaacaaatgaacaacagcttggattattaatggccggcgggacagggaaagagaaggtgaacacaaatggctaa

SEQ ID NO: 38793 - protein, 510 aa, Bacillus cereus ATCC 10987
MEYVIEMNNITKVFPGIVANDDITLQVKQGEIHALLGENGAGKSTLMNVLFGLYQPEQGEIKIKGKPVKITNPNIANDLGIGMVHQHFMLVHNFTVTENIILGNEPKKNGKIAVEEAAKEIKQLSEQYGLAVDPHAKIEDISVGMQQRVEILKTLYRGAEILIFDEPTAVLTPQEIHELIQIMKKLVQEGKSIILITHKLKEIMEVCDRCTIIRKGKGIGTVDVAETDEHKLAELMVGRQVNFKTEKIEAKPMEEVLSIANLIVHDTRKLPAVKGLDLTVRAGEIVGIAGIDGNGQSELIEAITGLRKVESGSIAIKGKEITNWPVRRITEEGIGHIPEDRHKHGLVLDFSVRDNIVLQTYYKNPFSKKGILNFSKITEKAKALIEQFDVRTPSEQTLARALSGGNQQKAIIAREVDRNPDLLIAAQPTRGLDVGAIEFIHKKLIEQRDNGKAVLLLSLELDEILNVSDRVAVIYEGKIVAIVDAKETNEQQLGLLMAGGTGKEKVNTNG

SEQ ID NO: 38794 - DNA, 1572 bp, Yersinia pestis biovar Medievalis str. 91001
  CDS (1)..(1572): transl_table=11
atgtcagcaccccattctgcgttacaagccgagttggacgccgcacagtcaccttatctggcttttcgtggcatcggaaaaagtttccccggtgttctggcgctggatgatatcagtttcacctgtcaggcgggccagatccatgcgctgatgggcgagaatggcgcggggaaatcaaccctattaaagatcctcagtggtaactacaccccgacacagggtgaaatccacattaaagggaaagccgttaactttaccaatactacggatgcgttggatgctggtgtggcgatcatttatcaggaactgcatttggtgcctgaaatgacagtggcagaaaacatctatctgggccaattacccaccaagatgggtatggttgatcgaaaattgctgcgttatgaatctcgcatacagctatcacatctggggttggacattgatcccgataccccactgaaatatctctccatcggccaatggcagatggtggaaattgccaaagcattagcccgcaatgcaaaaataatcgcctttgatgaacccaccagttcgctctctgcccgagaaattgagcaactgttccgcgtgatccgcgagttacgggccgaagggcgggtcatcttgtatgtctcccatcgaatggaagaaatttttgccctgagtgatgccattacggtgtttaaagatggccgctatgttcgtacgtttgatgatatgacccaagtgaataatgcgtcactggtgcaagctatggtagggcgtaatttaggggatatctatggttatcagccccgagagataggttctgaacgcttaacgctacaagcggtgaaggccatcggtgtggcctcgccgatcagcttgactgtacaccaaggggaaattgtggggctgtttgggttagtgggggccgggcgtagtgaactgctcaaggggctgtttggtgacaccaaactgaccagtgggaaactcttgcttgatggccaaccactgactatccgttcgccgattgacgctatttctgctgggatcatgttgtgtccagaagatcgaaaagcggatggcatcattcctgttcactcggtacaggacaatatcaatatcagtgcccgccgcaaaacattaaccgcaggctgtctgattaacaaccgctgggaagcggataatgcgttgctgcgtattcagtctctgaatattaaaacgccaggcccccaacaactcattatgaatctatccggggggaatcagcagaaagccattttaggacgctggttgtccgaggacatgaaagtgatcctgttggatgaaccgacccgtggtattgacgtcggggccaaacatgaaatctataacgtgatttatcaactggcgaaacagggcattgcggtgctgtttgcttccagtgatttgccggaagtgcttgggctggcagatcgtattgtggtgatgcgtgagggcgctatctctggtgagctagaccatgaatatgccactgaagagcaagccttaagtctggcaatgttacgcaccccgaatattgccaccaataccgcgtctgcggttgcctga

SEQ ID NO: 38795 - protein, 523 aa, Yersinia pestis biovar Medievalis str. 91001
MSAPHSALQAELDAAQSPYLAFRGIGKSFPGVLALDDISFTCQAGQIHALMGENGAGKSTLLKILSGNYTPTQGEIHIKGKAVNFTNTTDALDAGVAIIYQELHLVPEMTVAENIYLGQLPTKMGMVDRKLLRYESRIQLSHLGLDIDPDTPLKYLSIGQWQMVEIAKALARNAKIIAFDEPTSSLSAREIEQLFRVIRELRAEGRVILYVSHRMEEIFALSDAITVFKDGRYVRTFDDMTQVNNASLVQAMVGRNLGDIYGYQPREIGSERLTLQAVKAIGVASPISLTVHQGEIVGLFGLVGAGRSELLKGLFGDTKLTSGKLLLDGQPLTIRSPIDAISAGIMLCPEDRKADGIIPVHSVQDNINISARRKTLTAGCLINNRWEADNALLRIQSLNIKTPGPQQLIMNLSGGNQQKAILGRWLSEDMKVILLDEPTRGIDVGAKHEIYNVIYQLAKQGIAVLFASSDLPEVLGLADRIVVMREGAISGELDHEYATEEQALSLAMLRTPNIATNTASAVA

SEQ ID NO: 38796 - DNA, 1608 bp, Yersinia pestis biovar Medievalis str. 91001
  CDS (1)..(1608): transl_table=11
ttgtttgagcgatgtaacgtaattgttgccggagtgtggacgttttttattccacacagtagtgttcatttgtttttggttcgttcatatgaggcattcatgatccgtaacgagatactggcaaaaaaaccggactatctattagaagcgacgggactaaaaaaatcctttggcgatgtgatcgcgctaaacaatgctgaattctgtttaaaacggggttctatccatgcgctttgcggtgggaacggtgccggtaaatcaacatttcttggcctattaatgggatttattcagcctgatgatggggcgtttttcatcaacgggcaatactgcgaattcgactcaccgggacaagccctagccgcagggattaccattgttcaacaagagctcagtggggtacaggatctgtctgtggccgaaaatatttatctgggttctgagccaaggcgctttggtattgtcgattttcgtgcgcttaaccgccaggccgatgtgttattacacgagctgggtttcgccatttcacccaaagccaaaatgcgcagcctgagcgtagcagagcaacaacgggtggaaattgccaaagcgctgtcacatacccatgccgatatcatcattatggatgaacccacctccgcattaggtgaagaggatgcgcaaaaactgtttcagaccataaaaaaactggcctctctgggaaaaggggttatttatgtctcccaccgcttgtcagaaatatttcaaattgcagacagctacacggtatttcgagatggttgttatatttgtgaaggagagacgagtcacatcactcgcgaacaactgattgagcatattattggtggcgagattgatggtgagttctccaaatacaatactccaaccaatgtgccactctttaaagcctctggcatatgttggaaatcgaaagtgaatgatgtcagcctgacattacattgcggtgaaattttagggatttatggcttagtaggatcggggcgcagtgagtttcttaatctgctgtttggtcttgagcgtgctgatcacgggagcatccatatcggtgatgagatattactgaaacacacaccagaaaaagcaatcaacgccggtatcgcctatgtgaccgaagatcgtcaagagacaggattagtattgaaccattcggtatcggaaaatattaatatctcctcattaaacgtcattagtcgtatgagtatcattaatgaaaatgatattcagcgccgtgctgaccacacgatccgtatctttaatattaagacaccgagtcgccaacaacgagtggctaatttaagcggtggtaatcaacaaaaggtggtgttaggccgctgggcactgttagaccctaaagttttattattagatgagccaaccaggggaattgacattggggcaaaaaaagaaatttatcgctttatgtcggattttgccctcaaaggaaaaggcattgttatggtctcctccgagctttctgaaattattggcatgagcgacagaatcttggtttttaaaaaagggaaaatagtcggtgaaattacgggcactgaggcaacacaggccaaattaatgtcgatggcggtataa

SEQ ID NO: 38797 - protein, 535 aa, Yersinia pestis biovar Medievalis str. 91001
MFERCNVIVAGVWTFFIPHSSVHLFLVRSYEAFMIRNEILAKKPDYLLEATGLKKSFGDVIALNNAEFCLKRGSIHALCGGNGAGKSTFLGLLMGFIQPDDGAFFINGQYCEFDSPGQALAAGITIVQQELSGVQDLSVAENIYLGSEPRRFGIVDFRALNRQADVLLHELGFAISPKAKMRSLSVAEQQRVEIAKALSHTHADIIIMDEPTSALGEEDAQKLFQTIKKLASLGKGVIYVSHRLSEIFQIADSYTVFRDGCYICEGETSHITREQLIEHIIGGEIDGEFSKYNTPTNVPLFKASGICWKSKVNDVSLTLHCGEILGIYGLVGSGRSEFLNLLFGLERADHGSIHIGDEILLKHTPEKAINAGIAYVTEDRQETGLVLNHSVSENINISSLNVISRMSIINENDIQRRADHTIRIFNIKTPSRQQRVANLSGGNQQKVVLGRWALLDPKVLLLDEPTRGIDIGAKKEIYRFMSDFALKGKGIVMVSSELSEIIGMSDRILVFKKGKIVGEITGTEATQAKLMSMAV

SEQ ID NO: 38798 - DNA, 1566 bp, Mycoplasma mobile 163K
  CDS (1)..(1566): transl_table=4
atgaataaaaatgattacatttttcaatttgaaaatgtgactaaaaaatatcctggtgtaattgctttaaatgatgttagttttaacttgaaaaaagctaaaattactagtattgtaggcgaaaatggggctggtaaatcaactttgttaaaagttatttctggtgttattccctttaacaaaatagaaggcagaattatttacgaaggtaaagaaaaacattacaaaagtattaatgattcaatttctgatggaattgcaataatccatcaagaactttctatttctccatatttaccagtttatgaaaacattttcattggaaattttaaaactaaatttgggattttaaaccaaaatcaaatgattgtggaagcaaaaaaacttttagaaaaggttggcttacctaagatagatcctagaactcttgcgattaatctatcagttgctcaacaacaattagtagaaattgcaaaagctttaagtaaagaggtaaagcttttaattttagatgaacctacttcttctttaaatgataaagatagttttgaacttctgaatattatgaagaatttaaaagaaaaaagtggtattacaagcgtttttgtaagtcataaattaaatgaagtagaatatgttgcagatgaaattattgtaataagagatggaaaatttatttcccaatataacaaagaaactactaaaatttctgaagatcaattaattaaagatattgttggaagacaattatcttccaaatttccagagaaaaatcttcaaaggaaaattggagaaattgctttagaagtaaaaaactttactgttgaacaccctaaattagatgggtataatgttgtacaagatgctagttttaatgttaaaaaaggtgaaataattggaattagtggtcttgtaggatctggaagaagtgaattagctttaagtatttttggaaaacaatatggaaaagtactttcgggagaaatttttattaatggaaaaaaaatgaatataaactcccctaaaaaagcaattacaaataaattaatgtatgcaaccgaagatagaaaaggtactggattaattcaaatttttgatatcaattttaatatcaatttagctgccatgaatttaaattcaaaatttggatttttaaatttaaataaagaaattaaaaatagtaatgaattaaaaaaggaaattaaaatcaaagttccaaatattgattacaaagttgaaacactaagtggtggaaatcagcaaaaagttgttatcgctaaagctataacaacaaaatttgaaatattaattattgatgaacctacaaaaggaattgatgttgggtctaaatttgaaatttattctctacttcaagaatttgccttacaagggaaagcaatcgttattatttcttcagaaattgaagaattacttggaacaacagatagaatttatgttatgtcccaaggaaaaattaaaggtcaaataaaaacttctgatgcaactcaggaaaaaataattcaattaggaattggaaaggaaaaaaatgaaacaaaatatgtttaa

SEQ ID NO: 38799 - protein, 521 aa, Mycoplasma mobile 163K
MNKNDYIFQFENVTKKYPGVIALNDVSFNLKKAKITSIVGENGAGKSTLLKVISGVIPFNKIEGRIIYEGKEKHYKSINDSISDGIAIIHQELSISPYLPVYENIFIGNFKTKFGILNQNQMIVEAKKLLEKVGLPKIDPRTLAINLSVAQQQLVEIAKALSKEVKLLILDEPTSSLNDKDSFELLNIMKNLKEKSGITSVFVSHKLNEVEYVADEIIVIRDGKFISQYNKETTKISEDQLIKDIVGRQLSSKFPEKNLQRKIGEIALEVKNFTVEHPKLDGYNVVQDASFNVKKGEIIGISGLVGSGRSELALSIFGKQYGKVLSGEIFINGKKMNINSPKKAITNKLMYATEDRKGTGLIQIFDINFNINLAAMNLNSKFGFLNLNKEIKNSNELKKEIKIKVPNIDYKVETLSGGNQQKVVIAKAITTKFEILIIDEPTKGIDVGSKFEIYSLLQEFALQGKAIVIISSEIEELLGTTDRIYVMSQGKIKGQIKTSDATQEKIIQLGIGKEKNETKYV

SEQ ID NO: 38800 - DNA, 1386 bp, Bacillus anthracis str. 'Ames Ancestor'
  CDS (1)..(1386): transl_table=11
atgggggaaaatggagcgggtaaatcaacgctcatgaagattttaacaggtgtatacaaaagagatggtggaacgatcacgattgatggacaagaacgaacttttaaaaatgcgaaagaagctgaagaatacggtattgcatttatacatcaagaattgaacatattaccgaatttaacagtagctgaaaatatgtttctcggtaaagagttaatgtatggaaagacaggtattttacgtacgcgtcaaatgaacgcgattgcgcagcagcaactagcagagttaggattacatgtaaaaggcgctatgttggcaggagagttatcggttggacaacagcaaattatcgaaattgcgaaagcactaatgacaaacgcgagcgttattattatggatgaacctacagctgcattaacagatcgtgaaattgaaacgttgtttaccgtcattaataaattacgtaaagaaggcgtttcgttcgtttatatctcacaccgaatggaagaaatcttttcaatatgcgatgccattacgattttacgtgatggggaatacgtcggaaagagatccattccggaaacatcgtttgatgaggtagtgagtatgatggtggggcgcagcattggtgaacgttacccagaacgaaatagtcaaattggcgatgttatttttgaaatgcgtaatggaacgaaaaaagggaagtttgaaaatgtttcgtttcaagttagaaaaggtgaaatccttggtgtagctggcttgatgggagctggccgcacagatattatgaaagcaatatttggatacgaacctttagattctggccaaatttttataaatgggcaagaagtaaagattgatagcccgatagatgcgattagacaaagaatcgcattcattacagaggatagaaagtctgaaggattagtgctagatttctcaattcgagaaaatttagccttaccgaatttagaaagtctttcaaagggaagcgtcttaagtaacgaactagaacaacagtttacagcggacatgatgaaacttcttaatgtgaaagcatctagtggagagcaagctgtgaaatctctttctggtggaaatcagcaaaaggttgttattgcaaaatggttaggtattcacccgcaattactcattttagatgagccaacaaggggtgttgatgttggagcgaaaaaagaaatttactctattatgaataagcttaccgaagaaggagatgccgttattatggtatcatctgaacttccagaagttttagggatgagtgatcgcgttcttgttattcatgaaggaaaagtcggcggcattttagagaaagatgaggcatcgcaagagtctattatggcactagctacagggggagagtaa

SEQ ID NO: 38801 - protein, 461 aa, Bacillus anthracis str. 'Ames Ancestor'
MGENGAGKSTLMKILTGVYKRDGGTITIDGQERTFKNAKEAEEYGIAFIHQELNILPNLTVAENMFLGKELMYGKTGILRTRQMNAIAQQQLAELGLHVKGAMLAGELSVGQQQIIEIAKALMTNASVIIMDEPTAALTDREIETLFTVINKLRKEGVSFVYISHRMEEIFSICDAITILRDGEYVGKRSIPETSFDEVVSMMVGRSIGERYPERNSQIGDVIFEMRNGTKKGKFENVSFQVRKGEILGVAGLMGAGRTDIMKAIFGYEPLDSGQIFINGQEVKIDSPIDAIRQRIAFITEDRKSEGLVLDFSIRENLALPNLESLSKGSVLSNELEQQFTADMMKLLNVKASSGEQAVKSLSGGNQQKVVIAKWLGIHPQLLILDEPTRGVDVGAKKEIYSIMNKLTEEGDAVIMVSSELPEVLGMSDRVLVIHEGKVGGILEKDEASQESIMALATGGE

SEQ ID NO: 38802 - DNA, 1485 bp, Bacillus anthracis str. Sterne
  CDS (1)..(1485): transl_table=11
atgcgtattgaaatgaaaaatatttcaaaggcgttcaatggcaatcctgttttgaagaatgcacagtttatgattgaaacaggagaagtccatgcattgatgggggaaaatggagcgggtaaatcaacgctcatgaagattttaacaggtgtatacaaaagagatggtggaacgatcacgattgatggacaagaacgaacttttaaaaatgcgaaagaagctgaagaatacggtattgcatttatacatcaagaattgaacatattaccgaatttaacagtagctgaaaatatgtttctcggtaaagagttaatgtatggaaagacaggtattttacgtacgcgtcaaatgaacgcgattgcgcagcagcaactagcagagttaggattacatgtaaaaggcgctatgttggcaggagagttatcggttggacaacagcaaattatcgaaattgcgaaagcactaatgacaaacgcgagcgttattattatggatgaacctacagctgcattaacagatcgtgaaattgaaacgttgtttaccgtcattaataaattacgtaaagaaggcgtttcgttcgtttatatctcacaccgaatggaagaaatcttttcaatatgcgatgccattacgattttacgtgatggggaatacgtcggaaagagatccattccggaaacatcgtttgatgaggtagtgagtatgatggtggggcgcagcattggtgaacgttacccagaacgaaatagtcaaattggcgatgttatttttgaaatgcgtaatggaacgaaaaaagggaagtttgaaaatgtttcgtttcaagttagaaaaggtgaaatccttggtgtagctggcttgatgggagctggccgcacagatattatgaaagcaatatttggatacgaacctttagattctggccaaatttttataaatgggcaagaagtaaagattgatagcccgatagatgcgattagacaaagaatcgcattcattacagaggatagaaagtctgaaggattagtgctagatttctcaattcgagaaaatttagccttaccgaatttagaaagtctttcaaagggaagcgtcttaagtaacgaactagaacaacagtttacagcggacatgatgaaacttcttaatgtgaaagcatctagtggagagcaagctgtgaaatctctttctggtggaaatcagcaaaaggttgttattgcaaaatggttaggtattcacccgcaattactcattttagatgagccaacaaggggtgttgatgttggagcgaaaaaagaaatttactctattatgaataagcttaccgaagaaggagatgccgttattatggtatcatctgaacttccagaagttttagggatgagtgatcgcgttcttgttattcatgaaggaaaagtcggcggcattttagagaaagatgaggcatcgcaagagtctattatggcactagctacagggggagagtaa

SEQ ID NO: 38803 - protein, 494 aa, Bacillus anthracis str. Sterne
MRIEMKNISKAFNGNPVLKNAQFMIETGEVHALMGENGAGKSTLMKILTGVYKRDGGTITIDGQERTFKNAKEAEEYGIAFIHQELNILPNLTVAENMFLGKELMYGKTGILRTRQMNAIAQQQLAELGLHVKGAMLAGELSVGQQQIIEIAKALMTNASVIIMDEPTAALTDREIETLFTVINKLRKEGVSFVYISHRMEEIFSICDAITILRDGEYVGKRSIPETSFDEVVSMMVGRSIGERYPERNSQIGDVIFEMRNGTKKGKFENVSFQVRKGEILGVAGLMGAGRTDIMKAIFGYEPLDSGQIFINGQEVKIDSPIDAIRQRIAFITEDRKSEGLVLDFSIRENLALPNLESLSKGSVLSNELEQQFTADMMKLLNVKASSGEQAVKSLSGGNQQKVVIAKWLGIHPQLLILDEPTRGVDVGAKKEIYSIMNKLTEEGDAVIMVSSELPEVLGMSDRVLVIHEGKVGGILEKDEASQESIMALATGGE

SEQ ID NO: 38804 - DNA, 1506 bp, Erwinia carotovora subsp. atroseptica SCRI1043
  CDS (1)..(1506): transl_table=11
atgcaacctttactgcaactacaaggcatcacgaaatcttttcccggcgttaaagcactttccggtgcggcactcaatgtttatccgggaaaagtgatggcgctggtgggcgagaacggtgcgggtaagtccaccatgatgaaagtcctgaccgggatctatcgtaaagatgccggcagcatccattttttagggcaagaggtggatttcaacgggccgaaagcgtctcaggaagccggtatcggtattattcatcaggaacttaacctgattccccagctcacgattgccgagaatatcttcctcggtcgtgaatttaccaaccgcttcggtcgtatcgactggaataagatgtatgcggaagccgataaactgctgaagcgccttaatctgcgctatgacagccgccgtatggtaggggatttatcgattggcgatcagcaaatggtggaaatcgccaaggtgctgagctttgaatccaaagtcatcatcatggatgaacctaccgatgccctgacggataccgaaacggcttcgttattcagcgtgatcaacgagctgcaatctcagggatgcggcattgtctacatttcccaccgcctgaaagaaatctttgaaatctgcgatgacattactgttttccgcgatggtcagtttatcggcgaacgcccggtgagtgacttagaggaagacacgctgattgaaatgatggtgggccgcaagctggaagatcagtatccgcgctcgaataaagcgccgggagaggttcgtcttaaggtgcagaacctgtctgggccgggcgttgacagcgtcagctttaccgtacgtaaaggtgaaattctgggtgtcgcagggctgatgggcgcgggccgtaccgaactgatgaagattctctacggcgcactgccacgaacgggcggcaatgtgacgcttgatggccgcgacgtggtgacccgtaaaccgcaggatggcttggcgaacggtattgtctacatttccgaagatcgcaagcgtgatggtctggtgctgggcatgtcggtaaaagaaaacatgtcattaaccgcactgcgttatttcagccatgcgggcggtcgtctcaagcatgctgaagagcaactgacggttgccgactttatccgcctgttcaacgtcaaaacgccctcaatggagcagcctatcggcctgctttccggtggcaatcagcaaaaagtggcgattgctcgtggcctgatgacgcgccctaatgtcttgatcctcgatgaaccgacgcgtggcgttgacgtcggggcgaaaaaagaaatttatcagttaatcaatcaattcaaagaagaagggctgagcatcatattggtgtcatccgaaatgcccgaagtcttgggaatgagcgatcgcatcatcgtgatgcatgaagggcgcttgagcggtgatttcccgattgagcaagcaacccaggaagcactgatggctgcggccgttggtaagcaatacggcgcaaagcaggagtaa

SEQ ID NO: 38805 - protein, 501 aa, Erwinia carotovora subsp. atroseptica SCRI1043
MQPLLQLQGITKSFPGVKALSGAALNVYPGKVMALVGENGAGKSTMMKVLTGIYRKDAGSIHFLGQEVDFNGPKASQEAGIGIIHQELNLIPQLTIAENIFLGREFTNRFGRIDWNKMYAEADKLLKRLNLRYDSRRMVGDLSIGDQQMVEIAKVLSFESKVIIMDEPTDALTDTETASLFSVINELQSQGCGIVYISHRLKEIFEICDDITVFRDGQFIGERPVSDLEEDTLIEMMVGRKLEDQYPRSNKAPGEVRLKVQNLSGPGVDSVSFTVRKGEILGVAGLMGAGRTELMKILYGALPRTGGNVTLDGRDVVTRKPQDGLANGIVYISEDRKRDGLVLGMSVKENMSLTALRYFSHAGGRLKHAEEQLTVADFIRLFNVKTPSMEQPIGLLSGGNQQKVAIARGLMTRPNVLILDEPTRGVDVGAKKEIYQLINQFKEEGLSIILVSSEMPEVLGMSDRIIVMHEGRLSGDFPIEQATQEALMAAAVGKQYGAKQE

SEQ ID NO: 38806 - DNA, 1542 bp, Erwinia carotovora subsp. atroseptica SCRI1043
  CDS (1)..(1542): transl_table=11
atgccgcacctgttggaaatgaaaaacatcacgaaggcgtttggtgcggtgaaagccgtcgataacgtcagcctgacgctggaggctggtcaggtcttgtcgctgtgcggcgagaatggctcagggaaatccaccttaatgaaggtgttatgtgccatctatccacatggcagctatgacgggcagattatcttttccggtgatgaactgcgtgccaaccatatccgtgatacggagcaaaaaggcatcgcgattattcatcaggaactggcgctggtgaaagagatgacggtgctggagaacatgttcctaggtaatgagtggacgcgttttggcgtgatggattacgacaatatgtatctacgctgccagcgcatgttggagcaggtcaagctggccgtcgacccgaatactaaagtgggggagcttggattgggtcagcagcaactggtggaaatcgccaaggcgctgaacaagcaggtgcgtctgttggtgctggatgagccaacggcctcattgaccgaacgggaaacgggtatcctgctggaaatcattcaggatctgcgcgatcacggtatcgcctgtatctatatttctcacaagcttaacgaagttaaagcgatttccgatgtgatttgcgtgattcgtgacgggaagcatattggtacgcgtccggcggctgagctgagtgaggatcatatcattgccatgatggtagggcgggaactgacagagctttatcccaatgagccgcatgtcattggtgaagaggtgttgcgcgtggagcaccttaccgcctggcaccccgtgaatcgccacattcgtcgggtggatgatgtgtcgtttgctttgcaccgaggcgaaattctcggtattgccgggctggttgggtcagggcgtacggagacggtccagtgtctgtttggtgcctaccgcgggcgctggcagggcgacatatttattgacggtaagccggtgaccatcagcaactgccagcaggctatggcgcagggaattgcgatggtgccggaggatcgtaagaaggacggcatcgtcccggtgatgggcgtggcgcaaaatatgacgctggcggcgcttgaccaattcacggggccgctttccatgttggatgatgcccgtgagcaggacatcatccggcaatcgctagcgaatctgaaagtgaaaacctccagcccggaactggcgatcgcccgattaagcggcggtaaccagcaaaaagcggtgctagcgaaatgcctgctgctgaaccctcgtattctcatccttgatgaacccacgcgcggcatcgatatcggtgccaaatatgaaatctataagctcatcaatgcgctggtaaaacagcatattgccgtcatcgtgatttcctcagaattgcccgaggtgctggggttgagcgatcgagtattggtgatgcatcaggggcgtattaaagcagatttgatcaatcgtgatttaactcaggaacaggttatggaagctgcattgaggagtgaacatcgtgctgaaaacatcgcagtctga

SEQ ID NO: 38807 - protein, 513 aa, Erwinia carotovora subsp. atroseptica SCRI1043
MPHLLEMKNITKAFGAVKAVDNVSLTLEAGQVLSLCGENGSGKSTLMKVLCAIYPHGSYDGQIIFSGDELRANHIRDTEQKGIAIIHQELALVKEMTVLENMFLGNEWTRFGVMDYDNMYLRCQRMLEQVKLAVDPNTKVGELGLGQQQLVEIAKALNKQVRLLVLDEPTASLTERETGILLEIIQDLRDHGIACIYISHKLNEVKAISDVICVIRDGKHIGTRPAAELSEDHIIAMMVGRELTELYPNEPHVIGEEVLRVEHLTAWHPVNRHIRRVDDVSFALHRGEILGIAGLVGSGRTETVQCLFGAYRGRWQGDIFIDGKPVTISNCQQAMAQGIAMVPEDRKKDGIVPVMGVAQNMTLAALDQFTGPLSMLDDAREQDIIRQSLANLKVKTSSPELAIARLSGGNQQKAVLAKCLLLNPRILILDEPTRGIDIGAKYEIYKLINALVKQHIAVIVISSELPEVLGLSDRVLVMHQGRIKADLINRDLTQEQVMEAALRSEHRAENIAV

SEQ ID NO: 38808 - DNA, 1548 bp, Erwinia carotovora subsp. atroseptica SCRI1043
  CDS (1)..(1548): transl_table=11
atgacggaacccctactgaacatcaccaatctggcaaagagcttctctggcgtctgggcgctgagcagtgcgcaactgaccgtacagccgggagagattcatgcgctattgggagaaaacggcgcgggtaaatcgacgctattaaaggcgctggcaggggcgcagccgcagaccagcggcgatatctggtttggcggccagcagctgttaccgctcgaatcgccagttgaacgccaaaagcggggaattattactatttatcaggaattcaatctgctgccgaacatgagcgtcgcggaaaacatgttcctggggcgtgagccgcagcgcagtggattattcgtagacgcactggcggttaatcgcgaggcgaaagcggtactggattacctgaaattgaatattgcgccgacgacgcaggtggcgcgtttgagcgtggcccagcagcagatggtggaaatcgccagagcgctgacgctgaacgccaaactgattgtgatggatgagccatcggcggcgctgagcgatagcgaagttgacagcctgcatcgtgtggtgcgtgagctaaaagggcgcggtgtgagcgtggtgtatgtgacgcaccgactgcatgaagtcttccagctatgcgatcgctttaccgtatttcaggacggccgctacaccggttctggggatgtcgccagcaccaacgtgcaggaaattattcgcttgatggtcggtcgtgacgtggtgtttaaccgtcgtccgccttcagaaacgcatcatcaggataagccagttcgattggcggtaaaggggttaagccgggaaaagccgccgctggatgcgcacggcattgcgctaaaagacatcagcttccaggtgcatgccggagaagtgctcggcattgctgggctggtcggtgcagggcgcacggaaatcgcacgctgcctgtttggtgccgatgggttctctaccggtgagtttatgctggatgacgcgccttatcatccatccacgccacttcatgcgctgtcgcagggtattgctctggtgccggaagaccgcaagaaagagggcgcggtactggggttgtcaatcagggaaaacatctcgctctccaacctctcatcgctcatgcgctggcgctggtttgtgaacacccgcaaagaagacgatttgattgacgcctatcgtcaggcgttgcacatcaagatggtgaacagcgatcaggaagtgcgcaagctgtcgggcggtaaccagcaaaaggtgattcttgctcgctgtatggcgctgaaccctaaggtgttaattgtggatgaacccacgcgcggcatcgatgtcggcaccaagtccgaagtccatcaggtgctgttcgatatggcgaaacggggtgttgccgtgattgtgatttcctccgatttaccggaaatcatggcgatttccgaccgcatcatcacgctcagcgaagggcggatcagcggggaaattcatggcgatgacgctacagaagaaaaactgatgacgatgatggccatttgccacgacgcattacacgcagcataa

SEQ ID NO: 38809 - protein, 515 aa, Erwinia carotovora subsp. atroseptica SCRI1043
MTEPLLNITNLAKSFSGVWALSSAQLTVQPGEIHALLGENGAGKSTLLKALAGAQPQTSGDIWFGGQQLLPLESPVERQKRGIITIYQEFNLLPNMSVAENMFLGREPQRSGLFVDALAVNREAKAVLDYLKLNIAPTTQVARLSVAQQQMVEIARALTLNAKLIVMDEPSAALSDSEVDSLHRVVRELKGRGVSVVYVTHRLHEVFQLCDRFTVFQDGRYTGSGDVASTNVQEIIRLMVGRDVVFNRRPPSETHHQDKPVRLAVKGLSREKPPLDAHGIALKDISFQVHAGEVLGIAGLVGAGRTEIARCLFGADGFSTGEFMLDDAPYHPSTPLHALSQGIALVPEDRKKEGAVLGLSIRENISLSNLSSLMRWRWFVNTRKEDDLIDAYRQALHIKMVNSDQEVRKLSGGNQQKVILARCMALNPKVLIVDEPTRGIDVGTKSEVHQVLFDMAKRGVAVIVISSDLPEIMAISDRIITLSEGRISGEIHGDDATEEKLMTMMAICHDALHAA

SEQ ID NO: 38810 - DNA, 1554 bp, Erwinia carotovora subsp. atroseptica SCRI1043
  CDS (1)..(1554): transl_table=11
atggaacgttcagatgcggctatgcaacccgatgcggttagccgacccgaaatagtgatggcgacccgaggcatcaccatgctgtttcccggcaccaaagcgttggataacgtcgattacaacgtttaccgcggcaaggtcaacgtgattattggtgaaaacggggcgggtaaatcgacgttgatgaagattctggctggtgtgcagcagccgacgtccggccagattctgctgaatggcgaagcggtgcgcattgcggatacacgcgatgcggcggcgaaaggcatcggcatggtgcatcaggaacttaacctgtccgagaatctgagcgtggcggagaacatttttctggggcgggaactgcaaaagggtgttgcacctatcgattatctggagcaggagcggattgcggcggagctaatgtcgcgtctcgatcaggctatttcgccgcgtaccgaagtcgccagcctgaaagtcggccagcagcagttggtggaaatcgccaaggcgttggcagatcaggccgacattctgattctggacgaaccgacctccgcgctaagcaaaaccgaagtggagattctgtttcgcgtgatccgcgaactgactcgccagaatgtttccatcatctatatttcgcatcggttggaagagttgatggcgattggtgactacatcactatcctgcgtgacggctgttttcaggcggaagcggcggtcagcgacattgacgtgccgtggatcgtccgggaaatgctcggcggtgaccctgtcaccagtttcctgcattcgggtagaacgttcggtgcgccgatattggaagcggagcatctgacctgcctcaatgatgcaggacatcaggtcgttaacgatgtctcgctgatggtacgtgaaggggaaatcgtcggtatttacgggctgatgggggcaggacgcaccgaactttttgagtgtctgttgggcattcagaatgattatctgggtaagatttatctcgatagcaaaccggtgagcccgcgcctttctaccgcgcagcgcattcgtatgggaatgagtctggtgccggaagatcgcaaaaaaactggcatctttccgctctcgtcagtggcttccaatctgaccatagccagcctgtggcggcgactgaaatacggcatggcgatcttccagcgacaagagcaagaggtggttgccagcaccgttgggcggttagcaatcaaagtgtcttcacccgaggtcgaaattcaggcgctcagcggcggcaatcagcaaaaagtggtgattggccgctcgttactgaccagccctaaggtgctgttactggacgaaccgacgcgcggtattgatgtgggggccaaggccgatgtgtttgaaatgatggttgggctttccgaacagggcatcggcgtgctgttttccacctcggatctgaaagagattatggcggtatcggaccgtattttggtgatgtcgaatggcaaactgacggcgaatattgtgcgtcagtcggccagcgaatcggcattggtttcagcaagtgcacaagggttctga

SEQ ID NO: 38811 - protein, 517 aa, Erwinia carotovora subsp. atroseptica SCRI1043
MERSDAAMQPDAVSRPEIVMATRGITMLFPGTKALDNVDYNVYRGKVNVIIGENGAGKSTLMKILAGVQQPTSGQILLNGEAVRIADTRDAAAKGIGMVHQELNLSENLSVAENIFLGRELQKGVAPIDYLEQERIAAELMSRLDQAISPRTEVASLKVGQQQLVEIAKALADQADILILDEPTSALSKTEVEILFRVIRELTRQNVSIIYISHRLEELMAIGDYITILRDGCFQAEAAVSDIDVPWIVREMLGGDPVTSFLHSGRTFGAPILEAEHLTCLNDAGHQVVNDVSLMVREGEIVGIYGLMGAGRTELFECLLGIQNDYLGKIYLDSKPVSPRLSTAQRIRMGMSLVPEDRKKTGIFPLSSVASNLTIASLWRRLKYGMAIFQRQEQEVVASTVGRLAIKVSSPEVEIQALSGGNQQKVVIGRSLLTSPKVLLLDEPTRGIDVGAKADVFEMMVGLSEQGIGVLFSTSDLKEIMAVSDRILVMSNGKLTANIVRQSASESALVSASAQGF

SEQ ID NO: 38812 - DNA, 1524 bp, Erwinia carotovora subsp. atroseptica SCRI1043
  CDS (1)..(1524): transl_table=11
atgacagcacagtcaccctatttgtcgtttcatgggattggtaaagaatttcccggtgttaaggcgctttcggatatcagcttttcctgccatgccggccagatccatgcattgatgggggaaaacggggcgggcaagtcgacgctgttaaaaatcctgagcggcaactattcaccgtcagcgggcgaaatccacattcagggcaagcctgtgcagtttagtaatacgatggatgccctgaatgcgggcgttgccattatttatcaggaactgcatttggtgccagaaatgacggtcgccgagaatatctatctgggtcaattgccgcataaatacggcatggtgaactactcactgctgcgctatgaagccaaactgcaattacagcatctggggctggatatcgatcctgataccccgctgaaatacctgtctatcgggcagtggcaaatggtggaaatcgccaaagcgctggcgcgtaatgccaagattatcgcttttgatgaaccgaccagttcgctgtctgcccgtgaaatcgagcaacttttccgggtgattactgaattgcgtagtgaaggccggatcattttgtatgtttcgcaccggatggaagaaatttttgcgctgagcgatgccattaccgtgtttaaagatggtcgctacgtgtgcacgtttgacgatatgcaacaggtgaaccatgagtcgctggtacaggcgatggtagggcgtaacttggggaatatctatggttacgcgccgcgtccgcacggcgaagaccgcttgacgctgaaagacgtaaaagcgccgggcgtgaaatccacgatttccctgaacgtcaagcagggggaaattgtcgggctatttggtctggtgggggccggccgcagcgaactgatgaaagggctgtttggtgcgaccaaaatcaccagcggtcaggtgttgctggatggcaaaccgctggtggtgaattcccccatcgatgcgattcgccaaggcgtgatgctctgccctgaggatcgcaaagcggacggtatcattccggtgcactcggtgcgtgacaacatcaatatcagcgcaagacgtaagagcctgaaagccggttttattattaataatcagtgggaagcagataacgccgcgcagcgcattgacgcgttgaatatcaaaacgccgtccgatgaacagctgattatgaatctttccggcggaaatcagcagaaagtcattcttggtcgctggttgtccgaagagatgaaagtcattttgctcgatgagcccacgcgcggcatcgatgtcggcgcgaagcacgaaatttatcatgtcatctatgaactggcgaatcaggggatcgcggtgctgtttgcctccagcgatttacccgaagtgcttgggctggccgaccggattatcgtcatgcgcgaaggtgccgtctccggcgaactgctacatgctgatgccacggaacagaaggtgctcagcctagccatgttacgaatccccgatatcgaatctgcggttgcctga

SEQ ID NO: 38813 - protein, 507 aa, Erwinia carotovora subsp. atroseptica SCRI1043
MTAQSPYLSFHGIGKEFPGVKALSDISFSCHAGQIHALMGENGAGKSTLLKILSGNYSPSAGEIHIQGKPVQFSNTMDALNAGVAIIYQELHLVPEMTVAENIYLGQLPHKYGMVNYSLLRYEAKLQLQHLGLDIDPDTPLKYLSIGQWQMVEIAKALARNAKIIAFDEPTSSLSAREIEQLFRVITELRSEGRIILYVSHRMEEIFALSDAITVFKDGRYVCTFDDMQQVNHESLVQAMVGRNLGNIYGYAPRPHGEDRLTLKDVKAPGVKSTISLNVKQGEIVGLFGLVGAGRSELMKGLFGATKITSGQVLLDGKPLVVNSPIDAIRQGVMLCPEDRKADGIIPVHSVRDNINISARRKSLKAGFIINNQWEADNAAQRIDALNIKTPSDEQLIMNLSGGNQQKVILGRWLSEEMKVILLDEPTRGIDVGAKHEIYHVIYELANQGIAVLFASSDLPEVLGLADRIIVMREGAVSGELLHADATEQKVLSLAMLRIPDIESAVA

SEQ ID NO: 38814 - DNA, 1527 bp, Erwinia carotovora subsp. atroseptica SCRI1043
  CDS (1)..(1527): transl_table=11
atgctgatggaaacgacacggttgttagatattcggagcatgagcgttgaatttccaggggtgaaagcattagatcaggtggactttacgcttaatcgcggcgagatagttgctctactgggggaaaatggtgcagggaaatcaacgctaattaaggcgctgactggtgtttaccatcgctcatcgggtgacattatcctcgatggcatagcgattaatcctgttaatacggcccatgctcagtcattgggcatcggtacggtatatcaagaggttaatctattaccgaatctgtctgttgcggcaaatttatttattggccgtgaacccacacgatggggcattgttgatcaacacaaaatcctgcttcaggccgaggccctgttattgaactatgggctggctattgatgttagtcatccgcttggaaattattccattgcagtccagcaaattgtagcgattgccagagctgtcgatctttccgctaaagtcttgattctcgatgaacctaccgccagcctcgatgcaaaagaagtcgatatgctgctggatatattgcggaagctacgcgatcgtggaatcggcatgatatttgtcacgcattttctggatcaggtttaccgcattagcgacagaattaccgttttacgcaatggacggttagtcgggacattaccaactgcagagctaccgcgtattgaattagtccaaatgatgctggggcacagttttgatgaaacgttacttaaacgtggtgaacacagtgacgtctcgggtgaacccattgtgcaatttaaacattatggtcggcgtggttcgattaacgacttcgagctttccgtgcgtccgggagaaattgttggtctggctggtctgctgggatcgggcaggacagaaaccgcgcaactgatatttggcatcaacgtgcctgacgccggtgaagcgtgggttgatggtaaaaaaatcaacattcgcacgccgcgtgcagcaggaaagctgggttttggctattgcccagaggatcgcaaaactgacggcatcgtcggtgcagcaacggtacgagagaacattattctggcccttcaggcgcagcgcggctggctgaagcctatttctttacgcgagcaaacccgtatagctgaaaagtttatcagcctattggggattcgcacgcctagtgctgagcaggaaattcagtatctatcgggagggaatcagcaaaaagtactgttatcacgctggctggcaacagaaccgcgtttcttgattctagatgagccaacgagaggtattgatgtcggcgcgcatgctgaaatcattcgcctgatcgaaaaactgtgtgagcagggaatggcgttattggtgatctcctctgaactggaagagctgaccggttatgccgaccgcatcattgtgctgcgtgacaggcagcatgttgcgcatctcgaacatagcgagatctcggttgccgcagtgatgcaggccatcgcagtacaaacgggagcggctgatgacagacaataa

SEQ ID NO: 38815 - protein, 508 aa, Erwinia carotovora subsp. atroseptica SCRI1043
MLMETTRLLDIRSMSVEFPGVKALDQVDFTLNRGEIVALLGENGAGKSTLIKALTGVYHRSSGDIILDGIAINPVNTAHAQSLGIGTVYQEVNLLPNLSVAANLFIGREPTRWGIVDQHKILLQAEALLLNYGLAIDVSHPLGNYSIAVQQIVAIARAVDLSAKVLILDEPTASLDAKEVDMLLDILRKLRDRGIGMIFVTHFLDQVYRISDRITVLRNGRLVGTLPTAELPRIELVQMMLGHSFDETLLKRGEHSDVSGEPIVQFKHYGRRGSINDFELSVRPGEIVGLAGLLGSGRTETAQLIFGINVPDAGEAWVDGKKINIRTPRAAGKLGFGYCPEDRKTDGIVGAATVRENIILALQAQRGWLKPISLREQTRIAEKFISLLGIRTPSAEQEIQYLSGGNQQKVLLSRWLATEPRFLILDEPTRGIDVGAHAEIIRLIEKLCEQGMALLVISSELEELTGYADRIIVLRDRQHVAHLEHSEISVAAVMQAIAVQTGAADDRQ

SEQ ID NO: 38816 - DNA, 1506 bp, Propionibacterium acnes KPA171202
  CDS (1)..(1506): transl_table=11
gtgacaacagtacttcgactcgaccacgtcactaaggctttcggacccgtcaaggtcatccaagacgtatcggtggacgtcattcctggcagggtgcgcgtcctgctcggtgaaaacggagccggaaagaccaccctcattaagatgatgagcggcatttatcaccccgactctggttcggttgtcattgacgacacacccgttgaactgcctactgttaaggctgccgaagctcggggtatcgcgacgatccaccaggaacttaatctcgttccgcagatgtcggtggctgagaacatcatgcttggacgcacccccagccggggcgggctggtgaattggggcttgatgcgggctcaggcccgtgctgcgctggagcggattggtttagacgtctccccggaccgcctcgtcggttcgctgagtactgcccaccaacagctcgtggagatcgcgcgagctctgtcgatggatgccagggtgctcatccttgacgagcccaccgctgctctgacgcgcaaggagtctggccagctcttcgaggtgatggatgacctcaagactaagggcgtggcgatggtgttcatctcccatcacctcgacgagattccccgcgtcggtgacgacgtttcggtgttgcgcgacggcactctcgtaggggaggtaccggcccgtacctcggaacgtgagctggtcacgatgatggtcggccgcgacattgacgaccagttcccgcgccatcgcggtgaggtcggagaggtgttgctatcggttacgggactcagccgcgaaagggcatttcaagatgtcgggttcgacttgcacgccggcgaagtgttgggtctggcgggtctggtgggagccggacgcaccgaggtgctgcgcgccatcgccggagccgataaatacgactcaggcaccgtgcgtgtgcgtggtaaggagctcccgaaaggaaagatttcgcgcgcaatcgtcgacggtatcggccatgtgccggaggaacgcaaatcgcagggattagttctcgatgcttcggttaacgagaatctcggttacgcgaccatgaaatcgacctcgcacgcgggattagttgatcgctctgggcaacgtcgacgcgctcagaatgttgctgagaagctgagggtcagaatggctagcttggatcagccggtgcgcaatttgtctggtggtaatcagcagaaggttgttattggacgctggattctcgcggactcgtcaattctgttgcttgatgagctaaccaggggtgtcgacgtcggcgccaaggtcgagatctaccagcttattaatgctgttaccgatgccgggggcgccgtcctcatggtttccagcgagcttcccgaggtcatcgggatgagtgaccggatcctcgtcatgtcccatggccgagcgatggggatcctcgacgccaagacggccactgaagacgctgtcatggagctagcggtggcttccgtcgatcctgttgatgaaaaaacaggatga

SEQ ID NO: 38817 - protein, 501 aa, Propionibacterium acnes KPA171202
MTTVLRLDHVTKAFGPVKVIQDVSVDVIPGRVRVLLGENGAGKTTLIKMMSGIYHPDSGSVVIDDTPVELPTVKAAEARGIATIHQELNLVPQMSVAENIMLGRTPSRGGLVNWGLMRAQARAALERIGLDVSPDRLVGSLSTAHQQLVEIARALSMDARVLILDEPTAALTRKESGQLFEVMDDLKTKGVAMVFISHHLDEIPRVGDDVSVLRDGTLVGEVPARTSERELVTMMVGRDIDDQFPRHRGEVGEVLLSVTGLSRERAFQDVGFDLHAGEVLGLAGLVGAGRTEVLRAIAGADKYDSGTVRVRGKELPKGKISRAIVDGIGHVPEERKSQGLVLDASVNENLGYATMKSTSHAGLVDRSGQRRRAQNVAEKLRVRMASLDQPVRNLSGGNQQKVVIGRWILADSSILLLDELTRGVDVGAKVEIYQLINAVTDAGGAVLMVSSELPEVIGMSDRILVMSHGRAMGILDAKTATEDAVMELAVASVDPVDEKTG

SEQ ID NO: 38818 - DNA, 1590 bp, Propionibacterium acnes KPA171202
  CDS (1)..(1590): transl_table=11
gtgaccaccaacaccaccgtcgccccacccggtgacaatgcacccctcaaagatgggctgagcctgcgcggcgtcacgaagagattcgggaccctcacggccaacgaccacattgacctcgacatcgttcccgggcgaatccactgcttgctcggtgaaaacggtgccggcaagtcaaccctgatgaacattctgtacggcttgctgccttccgatgaagggcaggtctacatcgacggggtggagcaacacttcgataattccaagcaggccatggcggccggtattggaatggttcaccaacacttcatgctcgtcaacgtattcacggtggctgagaacattgcgttggggcgggaagaatcgaccgctggcatcctgtcgatgcgacgggctcgcgcaaaggtgcgcgaattgtctgatcgctaccactttgacgtcaatccagactcggtcatcgagaacctgccggttggcgtccagcagcgtgtcgagatcctgaagtccctagccaacgacgctcagtacctcatctttgacgaacccactgctgtgcttaccccgcaggaaatcgacgagctcatggctgttatgaagaccttgcgtgacgagggccgggccatcgttttcattacccacaagctgcgtgaggttcgcgccatcgctgacgacatcactgtggtccgacgtggccgcatcgtaggcaaggccagcgcggaccagtccgaggctgaacttgctgagatgatggtgggacgggccgtcaagctcgtcgtcgataaggacgaggctaagccgaccggttctcgcctggacatcaaggacctcaccgtggctgacgaccgcggctcagtcgttgtcgacggcgtgtcattgtccgttgcggggggtgagattctcggcgtcgccggagtgcagggtaatggtcagacggaactcgcttcctccctgcttggactcattaagccgacgtcgggaacgatccgcattgatggcaaggacaccacgggcgcggcccccgccaaggttattgaggccggactcggattcgtgcctgaggatcgtcagcgggacggttttgttggcgagttctccatcgctgagaacctcgtgctgaatcaggttggcgcgtactccaagcacggtaaccttcagctcaggcggatcgctgacaatgcacgtgaccgtgtcgaggagttcgacattcgtaccccgtcggcttcgttgccggtgtcttcattgtcgggtggtaaccagcagaaggtcgtgttggcgcgcgaactttcgcgttcgttgagtgttctggtggcttctcagcccacccgcggtgtcgacgtcggtgctatcgagttcttgcacaagcgggtagtcgaggagcgtgacaacggcacagcggtgctcatcgtctccactgagcttgacgaaatcgaggcgctatcggaccgcattgcggtgatgtaccgcggtcgcatcgtcggcatcgcgccggcgggaactccccgcgatgttctcggcctcatgatggccggattcagttatgacgaggcgtgtgacagcgtcgccaagggacacaaggaggtctcggaatga

SEQ ID NO: 38819 - protein, 529 aa, Propionibacterium acnes KPA171202
MTTNTTVAPPGDNAPLKDGLSLRGVTKRFGTLTANDHIDLDIVPGRIHCLLGENGAGKSTLMNILYGLLPSDEGQVYIDGVEQHFDNSKQAMAAGIGMVHQHFMLVNVFTVAENIALGREESTAGILSMRRARAKVRELSDRYHFDVNPDSVIENLPVGVQQRVEILKSLANDAQYLIFDEPTAVLTPQEIDELMAVMKTLRDEGRAIVFITHKLREVRAIADDITVVRRGRIVGKASADQSEAELAEMMVGRAVKLVVDKDEAKPTGSRLDIKDLTVADDRGSVVVDGVSLSVAGGEILGVAGVQGNGQTELASSLLGLIKPTSGTIRIDGKDTTGAAPAKVIEAGLGFVPEDRQRDGFVGEFSIAENLVLNQVGAYSKHGNLQLRRIADNARDRVEEFDIRTPSASLPVSSLSGGNQQKVVLARELSRSLSVLVASQPTRGVDVGAIEFLHKRVVEERDNGTAVLIVSTELDEIEALSDRIAVMYRGRIVGIAPAGTPRDVLGLMMAGFSYDEACDSVAKGHKEVSE

SEQ ID NO: 38820 - DNA, 1548 bp, Leifsonia xyli subsp. xyli str. CTCB07
  CDS (1)..(1548): transl_table=11
atgctgtcgaacgcagtcatcctgcagatgcgtgccatcaccaaggaatttcccggggtcaaagctctggaggatgtctccctgaccgtccgcgccgaagagatccacgcgatctgcggtgagaacggtgcgggcaaatccacgctgatgaaggtcctctccggcgtctacccgttcggaacctacagcggcgacatcgtctaccagagcgaaatcatgcggttcaaaaacatcaagtcctcggagcagcagggcatcgtgatcatccaccaggagctcgcgctgatccccgagctctcgatcaccgagaatatcttcctcggcaacgaaccggtccgcttcggcgtcatcgactggcgtgaggccaaatcgcgcgccgtcgaactgctcgcccgcgtcggactgagcgacgaccccgacacgcagatcaagaacatcggcgtcggcaagcagcaactcgtggagatcgccaaggcgctcaacaagcacgtcaaactgctcatcctggacgagccgaccgccgccctgaacgaggcggagtcggctcacctgctcgacttgatcgtcggcctgaagcacaagggcgtcagctccatcatcatcagccacaagctcaacgagatcgagaaagtcgccgaccagatcacgatcatccgcgacggccgcgcgatcgagaccctcgacgtgaaagcggacggcgtggacgaggaccgcatcatccgtgggatggtcggccgctcgctcgagagccgcttcccggaccgcacccccgacatcggcgaggttctcttcgaggtccgcaactgggtcgtccagcatccccaggaccccgagcgcctggtcgtgaagaactccagcttcactgtccgccgcggcgagatcgtcggcttcgcggggctcatgggcgccggtcgaaccgaactcgcgatgagcgtcttcggccgctcctacggcaccttcgtctccggtgagctctacaaggacggcaagcagattcaggttcgcaccgtctccgaagccatcgacaacggtctcgcctacgtgagcgaggaccgcaaagttctcggtctcaacctcctggacgacatcaaacagtcgatcgtctccgcgaagctcaaaaagatcgccacgcgcggtgtcgtcgacgatcaaaaggagtacgcggtcgcggaggagtaccgcaagagtctccgcatcaagacaccggatgtcgaccgcggcgtcgcgaccctctccggcggcaaccagcagaaggtcgtcctggccaagtggatgttcaccgacccggacatcctgatcctggacgagcccacgcgcggcatcgacgtcggcgctaaatacgagatctacgcgatcatccagcaactggccgcccaggggaaaggcgtcatcgtcatctcgtccgagcttcccgagctgctcggaatctccgaccgcatctacacgatcttcgagggacagatcaccgacgagctcccgattctcgaggccacgcccgaggctctcctgaaaagcatgacatccgccaagaagaaggcaacccgataa

SEQ ID NO: 38821 - protein, 515 aa, Leifsonia xyli subsp. xyli str. CTCB07
MLSNAVILQMRAITKEFPGVKALEDVSLTVRAEEIHAICGENGAGKSTLMKVLSGVYPFGTYSGDIVYQSEIMRFKNIKSSEQQGIVIIHQELALIPELSITENIFLGNEPVRFGVIDWREAKSRAVELLARVGLSDDPDTQIKNIGVGKQQLVEIAKALNKHVKLLILDEPTAALNEAESAHLLDLIVGLKHKGVSSIIISHKLNEIEKVADQITIIRDGRAIETLDVKADGVDEDRIIRGMVGRSLESRFPDRTPDIGEVLFEVRNWVVQHPQDPERLVVKNSSFTVRRGEIVGFAGLMGAGRTELAMSVFGRSYGTFVSGELYKDGKQIQVRTVSEAIDNGLAYVSEDRKVLGLNLLDDIKQSIVSAKLKKIATRGVVDDQKEYAVAEEYRKSLRIKTPDVDRGVATLSGGNQQKVVLAKWMFTDPDILILDEPTRGIDVGAKYEIYAIIQQLAAQGKGVIVISSELPELLGISDRIYTIFEGQITDELPILEATPEALLKSMTSAKKKATR

SEQ ID NO: 38822 - DNA, 1518 bp, Leifsonia xyli subsp. xyli str. CTCB07
  CDS (1)..(1518): transl_table=11
atgacacccgtcctcgaagcccgcggagtgaccaaacggttcgccggcgcgacagcgctgaacgcggtgaacttccgcctcgcccacggcgagagcctcgcgctcatgggcgagaacggcgccggcaagtcgacgctcatcaaggtgctcaccggggtctatcagcccgatgacggcgagctcctgctgaacggcgagcccacggcgttcgcccggcccctcgacgcccagcgctcggtcgtcagcaccatctaccaggaggtcactctggtgccgctgatgtcggtggcgcagaacatcttcctcgggcgcgagccccggaaccgtctgggtctcatcgacttccgccggatgaacgcggaggccgccgagctgctggcggggtacggcatccaggtcgacggccagcggccgctgcgctcgctccccctcggcatccagcagatggtggccctggcgcgcgcggtgagcatcgacgtccgggtggtcatcatggacgagcccacctcgtcgctggaggcccgcgaggtcgagacactcttccgggttatcgggatgctgcgcgcacagggcatcgcgatcgtctacgtcagccaccggatggacgagatctaccgggtgtgcgacacggtcgccgtgctgcgggacggcagagccgtccacaacggccggctcgacgcgctctcccgcatcgaactcgtctcgctcatgctcggccgctcggtcgagaagcggacgagcgccgtggcggacactgctgcgcgggcggagagcggctccgctccggtgctggtcgcgaccgatctgagccggcagcaccagatcgacggagtcgggctgtcgatccagcccggcgagatcgtgggcctcgggggcctgctcggctccggacgctcggagacactgaaggcgatggccggggtcatgcgcctggatcgcggtcgcgtggcggtggacggcaaaaccgtgcgcagcggctcgatcgccgcagccatccgcgccgggatcgtgatgctgcccaaggaccgcaaggccgagggaatcgtaccgaacctctcgatccgggacaacatcgcactggccgcgctcccgcggctctcccgcttcggcttcgtctccaagcgcaggcaggatgccgtggtcgatgtcttcatgagacgtctgcgcatcaaagcctccagcgccgatcaggcggtctcggagctctccggcggcaaccagcagaaggtgatgatcgcccgctggctggcgatgagcccgcgtgtgctgctgctggacgagccgacgcgcggcatcgacgtcggcgcgaaggccgaagtccagaggctcatcgacgagctggccggcgaaggactcgcgatcgtgctggtctcctccgagatcgaggaggtcatcgacgggtccgaccgggtgatcgtgctgcaagacggcagcgtcgcgaccgagctcaccggcgtccacgtcaacgaagaacagctgctcgccgctctcgccggcgacgccgggaaggagtcgtaa

SEQ ID NO: 38823 - protein, 505 aa, Leifsonia xyli subsp. xyli str. CTCB07
MTPVLEARGVTKRFAGATALNAVNFRLAHGESLALMGENGAGKSTLIKVLTGVYQPDDGELLLNGEPTAFARPLDAQRSVVSTIYQEVTLVPLMSVAQNIFLGREPRNRLGLIDFRRMNAEAAELLAGYGIQVDGQRPLRSLPLGIQQMVALARAVSIDVRVVIMDEPTSSLEAREVETLFRVIGMLRAQGIAIVYVSHRMDEIYRVCDTVAVLRDGRAVHNGRLDALSRIELVSLMLGRSVEKRTSAVADTAARAESGSAPVLVATDLSRQHQIDGVGLSIQPGEIVGLGGLLGSGRSETLKAMAGVMRLDRGRVAVDGKTVRSGSIAAAIRAGIVMLPKDRKAEGIVPNLSIRDNIALAALPRLSRFGFVSKRRQDAVVDVFMRRLRIKASSADQAVSELSGGNQQKVMIARWLAMSPRVLLLDEPTRGIDVGAKAEVQRLIDELAGEGLAIVLVSSEIEEVIDGSDRVIVLQDGSVATELTGVHVNEEQLLAALAGDAGKES

SEQ ID NO: 38824 - DNA, 1491 bp, Yersinia pseudotuberculosis IP 32953
  CDS (1)..(1491): transl_table=11
atggaaatattgttagaagtccgtggcttatctgttgagtttcctggtgttaaggcattggactccgtagatttttctctgcaacgcggtgaggttgttgcgttattaggagagaatggcgcaggaaaatcgacattaataaaagcattaaccggggtttataaacgatccgctggtgaggtgctgttggacggcaaggctgtgtgccccattgataccgcagatgcccaactcatggggattggtactgtctatcaagaggtcaacttactgccgaacatatctgttgctgcgaatttatttattggccgtgagccgctacgttgggggctaattgatcacaataaaatgaaccagcaagcagcaaaattgctgacgggttatggtttaacgttagatgttcagcagcctttggctaatttctctattgcaatacaacagattgtagcaatcgcccgcgccgttgacctttccgcgaaggtgctgattctggatgagcctacagcaagtttagatgctaaagaagtcagtatgttactggatatcttgtgccagctacgggaccagggtattggtatggtttttgtgacccattttctcgatcaggtttatcgaatcagtgatcgcattacagttttgcgaaatggcaagctcgtcggtaccaaaactgtggcagaacttccccggattgagctagtgcaaatgatgctggggcatagttttgatgaacaattactgaaacgtggtgaacacagtattacgaataagaatccattggttgagtttaaaaactatggccgacggggtgtggtagagaattttgatttgtctgtatctcccggtgaaattgtcgggttggccgggttattaggttcaggacggactgaaacagcacagctaatttttggcataacgacacctgatacgggggaagccaaaatacaaggcaaaccggttaaaattagaacaccacgtaaggcatcaaaatttggttttggctactgcccagaagatcgcaaaacagagggtattgttggtgcggcaaccgtaagggaaaacatcattttagccttacaagcgcagcgtgggtggctgaggcccctttctatgcgtgagcagacacaaattgcagacgattttatccagcaactgggtattcgtaccccaagccctgaacagcaaattcaatatctctccggtggaaaccaacaaaaagtattacttgcccgctggcttgccacgaaaccccgatttttaattttagatgaaccgactcgtggtatcgatgtaggtgctcacgccgaaattattcggttgatcgaaaagttgtgtgatgaagggttggcgctgttaattatctcttccgaattagaagaattggcgggttacgctgatcgggtcatcgttcttcgtgatcgtcggcatgttgctcaactcgaccacgatgaaatttccgttcctgccattatgcaggcgatcgcggtgcaataa

SEQ ID NO: 38825 - protein, 496 aa, Yersinia pseudotuberculosis IP 32953
MEILLEVRGLSVEFPGVKALDSVDFSLQRGEVVALLGENGAGKSTLIKALTGVYKRSAGEVLLDGKAVCPIDTADAQLMGIGTVYQEVNLLPNISVAANLFIGREPLRWGLIDHNKMNQQAAKLLTGYGLTLDVQQPLANFSIAIQQIVAIARAVDLSAKVLILDEPTASLDAKEVSMLLDILCQLRDQGIGMVFVTHFLDQVYRISDRITVLRNGKLVGTKTVAELPRIELVQMMLGHSFDEQLLKRGEHSITNKNPLVEFKNYGRRGVVENFDLSVSPGEIVGLAGLLGSGRTETAQLIFGITTPDTGEAKIQGKPVKIRTPRKASKFGFGYCPEDRKTEGIVGAATVRENIILALQAQRGWLRPLSMREQTQIADDFIQQLGIRTPSPEQQIQYLSGGNQQKVLLARWLATKPRFLILDEPTRGIDVGAHAEIIRLIEKLCDEGLALLIISSELEELAGYADRVIVLRDRRHVAQLDHDEISVPAIMQAIAVQ

SEQ ID NO: 38826 - DNA, 1515 bp, Yersinia pseudotuberculosis IP 32953
  CDS (1)..(1515): transl_table=11
atgactcatatttctgatgttgatagagacgtgccgcttatcacgttaaaagcgctgtccaaaagctttggcggtcatcaggcactgaaaaatatcacgttgacgttgaataaaggcgaagttcactgtctggccggggctaatggttgcggaaaaagtacgctgattaagacgattagtggcgtttatgccccagatgacggcagtgaaattatcattgatgaaaaatcttatcaccgcctgacgcctgatcgcgcacgcgctttgggcgtacaggtgatttatcaagacctttcgctgttccctaacctgacggtagccgaaaatattgccttcgaatataacttgaaaggttacttcggctggttcaacaagcagaaaatcaaacaaaaagcctgccagatcttgcatgaactggcttttagtctcgatcccgatgcgctggtacaacatttacccattgcccaacgccagcaggtggctatctgccgtgcgttggttgccgatgcgcgcttggtgattatggatgagcctacagcctctttgacgcgcaccgaagtgaatcaattattacgcacagtaaattacctgcgagataagcacattaccgtggtcttcgtcagccaccgattagatgaagtgaaagagatttcggatcgtattacggtgatccgcgatggcgaaaaagtggggacctggccagccactgagctttctaccgggcgtattaccgagttgatgaccggcctgaccctcacccacgagcagaaatcacccaatgccgaattaggcaaagtggtgctgcaactggaaaacctaagccgtaaagggcaattcgacgatatctcgtttagcctgcatcgcggcgaagtgctcggcctgtgtggtttgctgggttccgggcgaaccgaattggcccttagcctatttggcatcacccatcctgatagcggcaagattgccattgacggtaacccggtgcgcattaaagacaatacccgtgccattgagctaggtattggctatgtatctgaagatcgcctgaccctcggtgccgtattgcaacaatctatcgccgacaacatggtgctgtcgattctgcaacgcatccgtactccactttatctggttgatgacgctaaacagaacgcgctggtgcaagaatgggtgaaggatttggacatcaaaatcacggatgctgataacgcgctgtcaacgttgtcagggggcaatcagcaaaaagtggtgctggcaaaatggatcctgaccaaaccgaaagtgttaattctcgattcacctactgtgggggtcgatatcggtgccaaagacagtatttacaagctgatccatcgtctctccggggtgggtatctcggtgttgctgctctctgatgaaatccccgaagcctattacaactgcgatcgcatcctgcatatgcagcaggggcgtatcgtcaatgaactgatcccgaatcaaatgactgaacaacagctggcggaggtcatcaatggctaa

SEQ ID NO: 38827 - protein, 504 aa, Yersinia pseudotuberculosis IP 32953
MTHISDVDRDVPLITLKALSKSFGGHQALKNITLTLNKGEVHCLAGANGCGKSTLIKTISGVYAPDDGSEIIIDEKSYHRLTPDRARALGVQVIYQDLSLFPNLTVAENIAFEYNLKGYFGWFNKQKIKQKACQILHELAFSLDPDALVQHLPIAQRQQVAICRALVADARLVIMDEPTASLTRTEVNQLLRTVNYLRDKHITVVFVSHRLDEVKEISDRITVIRDGEKVGTWPATELSTGRITELMTGLTLTHEQKSPNAELGKVVLQLENLSRKGQFDDISFSLHRGEVLGLCGLLGSGRTELALSLFGITHPDSGKIAIDGNPVRIKDNTRAIELGIGYVSEDRLTLGAVLQQSIADNMVLSILQRIRTPLYLVDDAKQNALVQEWVKDLDIKITDADNALSTLSGGNQQKVVLAKWILTKPKVLILDSPTVGVDIGAKDSIYKLIHRLSGVGISVLLLSDEIPEAYYNCDRILHMQQGRIVNELIPNQMTEQQLAEVING

SEQ ID NO: 38828 - DNA, 1524 bp, Yersinia pseudotuberculosis IP 32953
  CDS (1)..(1524): transl_table=11
atgaaccacagacctgacattgtcatgcgtgctgaggacatttcaatgcgttttcctggcacattggcgctcgatagcgtcaattacactgtttatcgcggcaaagttaacgtcattattggcgaaaacggggccggtaaatcaacgctgatgaaaattctggccggggtgcagcagcaaacctccgggcaaatttacctaaacgggcagaaggtcagcattgccaatactcgtgaggcggcagcgctgggcattggcatggtgcatcaggaactgaatttatcggaaaacctcaatgtggcggaaaatatttttcttggccgcgaaatccagcacggcttgaaaccgatcaatcaggcagcgcaggaacgggttactgaacaactgatggtgcgtcttgatcaggtcatttcaccgcaagagaaggtgtcaaacctgaaagtgggccaacaacagttgattgaaattgccaaggcactggcggagcaggccgatatcctgattctggatgaaccgacctcggccctcagtaaaacggaggtggatatcctgttccgtgtgatccgcgaactcactcggcaaggggtttccatcgtttatatttcccaccgattggaagagttaatggcgattggcgactacatcactattttacgcgatgggcgctttcaggctgaagccgcagtaaaagacattgatgtgccgtggattgtgcgtgaaatgctgggtagcgatccggtttccagcttccttcgtccggggcgtacctttggtgaaccaatgatggaggtggaagatgtcaccctcatcaatgaatccggtaataccgtggttaatcatgtctcattgcacgtccgggcaggcgagattgtcggtatttatggcctgatgggggcgggccgtaccgaattgttcgaatgtttactgggcacgcaacaaaactatcttggcaccgttcgcctcaatggcacggtcatgaatgccaaaacctccaccgcagagcgtatccgccttgggatgagcttggtgccggaagatcgtaaaaaagccgggattttccctgcttcatcggtcgcctgtaatttgaccatctccagcttatggcgtcggctgaagcaccgctttgctatctggcaggagagtgaagtgcaagtggtggcagcgactatcggtgagctgtcgatcaaagtttcttcacctgatgtcgaaattcaggcactcagcgggggcaatcaacaaaaagtggtcattggccgctcgttactgacccgcccgaacattttgctgctggatgaaccgacgcgtggcattgatgttggcgcaaaagcggatgtgtttgaaatgatggtgaaactctctgagcaggggatcggcattctgttttccacctccgacctaaaagaaattatggcggtatccgaccgcattctggtgatgtcgaacggcaaactgacggcaaatttatcccgtcaatcggccagtgaatcggcattggttacagcaagcgcacaagggtttgaatga

SEQ ID NO: 38829 - protein, 507 aa, Yersinia pseudotuberculosis IP 32953
MNHRPDIVMRAEDISMRFPGTLALDSVNYTVYRGKVNVIIGENGAGKSTLMKILAGVQQQTSGQIYLNGQKVSIANTREAAALGIGMVHQELNLSENLNVAENIFLGREIQHGLKPINQAAQERVTEQLMVRLDQVISPQEKVSNLKVGQQQLIEIAKALAEQADILILDEPTSALSKTEVDILFRVIRELTRQGVSIVYISHRLEELMAIGDYITILRDGRFQAEAAVKDIDVPWIVREMLGSDPVSSFLRPGRTFGEPMMEVEDVTLINESGNTVVNHVSLHVRAGEIVGIYGLMGAGRTELFECLLGTQQNYLGTVRLNGTVMNAKTSTAERIRLGMSLVPEDRKKAGIFPASSVACNLTISSLWRRLKHRFAIWQESEVQVVAATIGELSIKVSSPDVEIQALSGGNQQKVVIGRSLLTRPNILLLDEPTRGIDVGAKADVFEMMVKLSEQGIGILFSTSDLKEIMAVSDRILVMSNGKLTANLSRQSASESALVTASAQGFE

SEQ ID NO: 38830 - DNA, 1548 bp, Yersinia pseudotuberculosis IP 32953
  CDS (1)..(1548): transl_table=11
atgtcgcaacctttattgaaaatcaccgatatggcgaaaagcttctctggtgtctgggcgctcagtaacgtacagctcaccgtagagcagggtgaaatacatgcactcttgggtgagaacggcgcaggtaaatcaacactcttgaaagcactctcgggtgctcaaccccagactcacggcgaaatctggtttaacggtgaaatgctggcattggacgactcgccagtggaacgccagaacaaaggcattatcaccatctatcaagaagttaatctactgcccaacatgacggtggcagaaaacatgtttcttggtcgtgaaccgcgccgccgtcaggtatttgtcgacgaaaaagccgtcaatcaggaagcccaagcgatcctcgattacctgcaacttaacgtgttgcccaccacggcggtggcgcgcttgagtatcgcgcagcaacagatggtagagatcgcccgggcgctgaccttgaacgcgaagctcattgtcatggatgagccttcggcagcactcagcgacagcgaagtcgaaagcctgcatcgcgtggtacgggaactgaaaggccgtggtgtgagcattatctatgtcacccaccgcttgcacgaagtgttccaactctgtgaccgtttcacggtgtttcaggatgggcgttacaccggttctgatgaggttgcaggcaccaacgttgagaagattatccgcctgatggtggggcgagacgtcgtatttaaccgccgccccgccagtgagacccatcaccaagaccagcccattcgcctatctgtgcaagggctgtgtcgtgaaaaacccccgctcgacccacatggtgtggcgctaaaagacatcagctttcatgtccacgccggggaagtcttgggtatcgccgggttggtaggggcagggcgtaccgaagtggcacgttgtctgtttggggcaggggctttcacctctggcaattttgagatagacggtgtgccctatcagccacgggatccaatgttcgcgctggaacaggggatcgcactggtgccggaagaccgtaaaaaagagggggcagtgcaagggctttctattcgcgacaatctgacactttcgagcctggccgggctgttacagtggcgttttttcgtcaatacccgcaaagaagatcaactgattgagacctaccgtttagcactgcaaatcaagatggtgaacagcgaacaggcggtgcgtaagctctctggcggtaaccagcagaaggtgatcttggcccgctgcatggcgctcaatccacggatcctgatcgtcgatgaaccgacacggggcattgatgtgggcacgaaatcggaagtgcatcaggtgttgtttgatatggctaaacagggcgtggcagtgatcgtcatctcctcggatttaccggaagttctcgcggtttctgaccgggtcatcacgctaagcgaagggcgagtcactggagagattcacggtgatgacgccagcgaagaacggctgatgaccatgatggccatcaatcataacgccttaaatgccgcctaa

SEQ ID NO: 38831 - protein, 515 aa, Yersinia pseudotuberculosis IP 32953
MSQPLLKITDMAKSFSGVWALSNVQLTVEQGEIHALLGENGAGKSTLLKALSGAQPQTHGEIWFNGEMLALDDSPVERQNKGIITIYQEVNLLPNMTVAENMFLGREPRRRQVFVDEKAVNQEAQAILDYLQLNVLPTTAVARLSIAQQQMVEIARALTLNAKLIVMDEPSAALSDSEVESLHRVVRELKGRGVSIIYVTHRLHEVFQLCDRFTVFQDGRYTGSDEVAGTNVEKIIRLMVGRDVVFNRRPASETHHQDQPIRLSVQGLCREKPPLDPHGVALKDISFHVHAGEVLGIAGLVGAGRTEVARCLFGAGAFTSGNFEIDGVPYQPRDPMFALEQGIALVPEDRKKEGAVQGLSIRDNLTLSSLAGLLQWRFFVNTRKEDQLIETYRLALQIKMVNSEQAVRKLSGGNQQKVILARCMALNPRILIVDEPTRGIDVGTKSEVHQVLFDMAKQGVAVIVISSDLPEVLAVSDRVITLSEGRVTGEIHGDDASEERLMTMMAINHNALNAA

SEQ ID NO: 38832 - DNA, 1521 bp, Yersinia pseudotuberculosis IP 32953
  CDS (1)..(1521): transl_table=11
atggccgatattaatacagcacaacctcgtgactggttactggaaatgagcaatattgataaatcatttccaggcgtgaaggcgttagataacgttaatcttaaagtccggccctattctatccatgcactgatgggcgaaaatggtgcaggtaagtcaacgctattaaaatgtctgtttggtatctataaaaaagattccggaagtattattttccagggacaagaaattgaatttaaaagttctaaagaagcattagaacagggtgtttcgatggtacatcaagaattaaacttggtgttgcaacgtacagtaatggacaacatgtggttggggcgctatccaaccaaaggtttttttgtcgatcaagacaagatgtataaagagacaaaggccatctttgatgaattagatattgatattgatccgcgcgataaagtagccacgttatcggtatctcagatgcaaatgatcgagatcgccaaggctttttcttacaatgcaaaaatcgtcattatggatgagccaacctcttcactaacagaaaaagaggtgaaccatttattcaccataatccgaaagttaaaggcgcgaggctgcggcatcgtttatatttctcacaagatggaagagatattccaactgtgcgatgaaattactattctgcgggatggtcagtggattaccacccagcctttggatggtttgacgatggatcagatcatttcaatgatggtcggtcgctctctgagccaacgttttcctgatcgcctgaacaagcccggtgaagtcattcttgaggtgaagaatctgacctcattgcgccagccctctatccgcgatgtttcctttgatttacataaaggggaaatcctggggattgcaggcttggtcggggctaaacgcacagatatcgttgaaactttatttggtatccgagaaaaagtgaccggcacgattaaattgcatggtaagaatattaataaccacagcgctaacgaagccattaaccacggttttgccttagtgactgaagagcgccgttcaaccgggatctacgcttatctcgatatcagttttaactccctgatctctaatattcgtaactacaaaaataaatttgggctgctggataacactcgcatgaaaagtgatacccagtgggttatcgatgcgatgcgggtaaaaacgccaggccatcggacaaatattggttctttgtcgggggggaatcagcagaaggttattattggccgctggttactcacgcagccagaaatattaatgttggatgagccaactcgaggtatcgatgttggcgctaagtttgaaatctatcagttaatgactgaactggcgaagaaagacaaagggattattattatctcctctgaaatgcctgagttattagggattactgacagaatactggtaatgagtaacggtcaggttgcgggcattgttgataccaagcaaaccacgcaaaatgaaatattacgccttgcatccttgcatctctaa

SEQ ID NO: 38833 - protein, 506 aa, Yersinia pseudotuberculosis IP 32953
MADINTAQPRDWLLEMSNIDKSFPGVKALDNVNLKVRPYSIHALMGENGAGKSTLLKCLFGIYKKDSGSIIFQGQEIEFKSSKEALEQGVSMVHQELNLVLQRTVMDNMWLGRYPTKGFFVDQDKMYKETKAIFDELDIDIDPRDKVATLSVSQMQMIEIAKAFSYNAKIVIMDEPTSSLTEKEVNHLFTIIRKLKARGCGIVYISHKMEEIFQLCDEITILRDGQWITTQPLDGLTMDQIISMMVGRSLSQRFPDRLNKPGEVILEVKNLTSLRQPSIRDVSFDLHKGEILGIAGLVGAKRTDIVETLFGIREKVTGTIKLHGKNINNHSANEAINHGFALVTEERRSTGIYAYLDISFNSLISNIRNYKNKFGLLDNTRMKSDTQWVIDAMRVKTPGHRTNIGSLSGGNQQKVIIGRWLLTQPEILMLDEPTRGIDVGAKFEIYQLMTELAKKDKGIIIISSEMPELLGITDRILVMSNGQVAGIVDTKQTTQNEILRLASLHL

SEQ ID NO: 38834 - DNA, 1557 bp, Yersinia pseudotuberculosis IP 32953
  CDS (1)..(1557): transl_table=11
atgtccagcattcccccctcccgccttgagatgcggaatatttctatctctttctctgggtttcatgccttgcaagaagttgattttactctagaaggtggttcaacccatgcgctaatcggtgctaatggtgcgggcaaatccaccctgatggcaatcctctccggcgctcataatcactatcgtggcgagatctttattgatggtcagccaatcgatattcactccccacggcaagccaggcagcacggtattcatgtggttcaacaagaggtggatgtcgcgttgatccccacgttgtctgtggcagagaatattatgctggatgagttggcagaccgggggcacctgttcaattggccacaactttatcgtcaggcagaagccttgcttgagcaactggaactcaagttgaatgtgcgtcaacgtttggaatcctgcacgctggcagagaagcagcaagtgctgttggcccgcgccctgtcccaccaatgtcgttttctcatactggatgaacccactgcacccctggatcaagaagagagcgcccgcttgttccgcgtcgtgcgtcgcttgcaatctgagggcatcggcattgtctttatttcgcaccgtattcatgaactgcgcgaggtgtgtgatcaactcacggtactgcgtgatggccgtcgcgtgagccatgacaccatggaaggaatgagtggtgagcagattgtagaaaaaatgctcggccatacactggaggatattttcccccctcggcgagcggcagtcagcagcaaaacactattgtcgaaaacacggttgtcgaaaacactattgccgaaaacactgttatcggtcagcggcctacatgatcagtataagttgcgcgatatctccctcacattacatcagggcgaaattttaggcattgcgggcttagccggtgccggtaaaacagaattgtgcaaagccttgtttggcgacacgcctagtacgctggagcgcggtgaattgagcggcaaagcctggcggccacgctcacccgatcgatccgtggcgcaagggctggcactggtacctgaagagcgccgcaaagaaggtatttttattgacgaaggcatcccaatgaacctgagtgttgccgccgatgacagtttttcccgttggagtctcttcagccgccgtcaggaattgagttgggctaaggaactgattgagcgcctgggtatacggacatcatccccacaacaaaaactggcccgcctctctggggggaatcagcaaaaagtggccattggtaaatggctgcgcggtgatgcacaggtgctgatttttgacgaaccgaccaaaggggtcgatatcaaagccaaacaagaccttttctctctgattgaccaattggcgcaacaagggaaaggtattatttatgcatcaggtgaattttcagaattagtcggtttatgtgatcgtatctgcgtattgtgggatggccgaattgttgccgaactgaatgctgcagaggtcgatgaagagacattattactattttcaaccggaggaacccctcagtga

SEQ ID NO: 38835 - protein, 518 aa, Yersinia pseudotuberculosis IP 32953
MSSIPPSRLEMRNISISFSGFHALQEVDFTLEGGSTHALIGANGAGKSTLMAILSGAHNHYRGEIFIDGQPIDIHSPRQARQHGIHVVQQEVDVALIPTLSVAENIMLDELADRGHLFNWPQLYRQAEALLEQLELKLNVRQRLESCTLAEKQQVLLARALSHQCRFLILDEPTAPLDQEESARLFRVVRRLQSEGIGIVFISHRIHELREVCDQLTVLRDGRRVSHDTMEGMSGEQIVEKMLGHTLEDIFPPRRAAVSSKTLLSKTRLSKTLLPKTLLSVSGLHDQYKLRDISLTLHQGEILGIAGLAGAGKTELCKALFGDTPSTLERGELSGKAWRPRSPDRSVAQGLALVPEERRKEGIFIDEGIPMNLSVAADDSFSRWSLFSRRQELSWAKELIERLGIRTSSPQQKLARLSGGNQQKVAIGKWLRGDAQVLIFDEPTKGVDIKAKQDLFSLIDQLAQQGKGIIYASGEFSELVGLCDRICVLWDGRIVAELNAAEVDEETLLLFSTGGTPQ

SEQ ID NO: 38836 - DNA, 1539 bp, Yersinia pseudotuberculosis IP 32953
  CDS (1)..(1539): transl_table=11
ttggacgccgcacagtcaccttatctggcttttcgtggcatcggaaaaagtttccccggtgttctggcgctggatgatatcagtttcacctgtcaggcgggccagatccatgcgctgatgggcgagaatggcgcggggaaatcaaccctgttaaagatcctcagtggtaactacaccccgacacagggtgaaatccacattaaagggaaagccgttaactttaccaatactacggatgcgttggatgctggtgtggcgatcatttatcaggaactgcatttggtgcctgaaatgacagtggcagaaaacatctatctgggccaattacccaccaagatgggtatggttgatcgaaaattgctgcgttatgaatctcgcatacagctatcacatctggggttggacattgatcccgataccccactgaaatatctctccatcggccaatggcagatggtggaaattgccaaagcattagcccgcaatgcaaaaataatcgcctttgatgaacccaccagttcgctctctgcccgagaaattgagcaactgttccgcgtgatccgcgagttacgggccgaagggcgggtcatcttgtatgtctcccatcgaatggaagaaatttttgccctgagtgatgccattacggtgtttaaagatggccgctatgttcgtacgtttgatgatatgacccaagtgaataatgcgtcactggtgcaagctatggtagggcgtaatttaggggatatctatggctatcagccccgagagataggttctgaacgcttaacgctacaagcggtgaaggccatcggtgtggcctcgccgatcagcttgactgtacaccaaggggaaattgtggggctgtttgggttagtgggggccgggcgtagtgaactgctcaaggggctgtttggtgacaccaaactgaccagtgggaaactcttgcttgatggccaaccactgactatccgttcgccgattgacgctatttctgctgggatcatgttgtgtccagaagatcgaaaagcggatggcattattcctgttcactcggtacaggacaatatcaatatcagtgcccgccgcaaaacattaaccgcaggctgtctgattaacaaccgctgggaagcggataatgcgttgctgcgtattcagtctctgaatattaaaacgccaggcccccaacaactcattatgaatctatccggggggaatcagcagaaagccattttaggacgctggttgtccgaggacatgaaagtgatcctgttggatgaaccgacccgtggtattgacgtcggggccaaacatgaaatctataacgtgatttatcaactggcgaaacagggcattgcggtgctgtttgcttccagtgatttgccggaagtgcttgggctggcagatcgtattgtggtgatgcgtgagggcgctatctctggtgagctagaccatgaatatgccactgaagagcaagccttaagtctggcaatgttacgcaccccgaatattgccaccaataccgcgtctgcggttgcctga

SEQ ID NO: 38837 - protein, 512 aa, Yersinia pseudotuberculosis IP 32953
MDAAQSPYLAFRGIGKSFPGVLALDDISFTCQAGQIHALMGENGAGKSTLLKILSGNYTPTQGEIHIKGKAVNFTNTTDALDAGVAIIYQELHLVPEMTVAENIYLGQLPTKMGMVDRKLLRYESRIQLSHLGLDIDPDTPLKYLSIGQWQMVEIAKALARNAKIIAFDEPTSSLSAREIEQLFRVIRELRAEGRVILYVSHRMEEIFALSDAITVFKDGRYVRTFDDMTQVNNASLVQAMVGRNLGDIYGYQPREIGSERLTLQAVKAIGVASPISLTVHQGEIVGLFGLVGAGRSELLKGLFGDTKLTSGKLLLDGQPLTIRSPIDAISAGIMLCPEDRKADGIIPVHSVQDNINISARRKTLTAGCLINNRWEADNALLRIQSLNIKTPGPQQLIMNLSGGNQQKAILGRWLSEDMKVILLDEPTRGIDVGAKHEIYNVIYQLAKQGIAVLFASSDLPEVLGLADRIVVMREGAISGELDHEYATEEQALSLAMLRTPNIATNTASAVA

SEQ ID NO: 38838 - DNA, 1539 bp, Yersinia pseudotuberculosis IP 32953
  CDS (1)..(1539): transl_table=11
atgacccaagaaacagataacgaacagcaggatgatcccaatgtcgtgttagcggcgcggaatatcagcaaaatttacggttcgacccacgccttacaaggtgtgaacttcgatattcgtcgcggtaaggtgaccacactatttggggaaaatggcgcgggaaaatcgacgttaatgaaaattctctccggtgtggtcacgccttcctccggtgatattttactcaatggtgaagtgaaaaacttcacctcgacagcccaggcgcgtcagcatgggattgccattattcatcaggagctgaatctcgcccccaacatgaatgtgcgcgataacatctttattggccgagaaatgatgactgtttcaggagtagattttgccaatgaagagcgcattacccgggatctcatgcgtgaacttgaggaagatatcgatccattgacgcgggtagaagatttgcgcttaggtcagcaacagattgtggagattgcccgtgcgctatcggttaaggcgcgtattttgattatggatgaaccaacatcagcactcagtgcctcggaagtcggcgtgctgttcagcattatccgtgacttgacccagcggggcgtttcgattgtctatatctcacatcatttggaggaagcactggaaatcaccgatcacgccgtggtattgcgcgatggggtggtgaccgccagtggccagcgcagtgatatcgatctggagtggattgttcacaatatggtgggtgaccattttgacttaggttcaccgccgcagggctacgagtttggtgatgtcgcgctggcggttgatcagctcagcgttcccggcccgagcggttatatggccgtggataacctttcattaagtgtgcgggccggggagatcatttgcatttacgggttgatgggcgcgggccgtactgaactgatggagtgcatcgccgggcggcttagcgctgagcgcggcagtatcctgctcaacaaccaagatatttcccccctcagcattgctgaccgtattgaaagcggtttggcgttggtacccgaagatcgtcaacgcgacggcttggtgcagacgatgtcagtcggggaaaacctcacactggccagtattcgcgagtttgttcgccgcttggtgctttctccccgtcgtgaacaggaattggtggttgactccattcgcaatgtgacggtgaaaacgacagggggtgaggcaacgatagggtcactatccggcgggaatcagcaaaaggtcgtgatcggcaagatactggcgacccggccaaaagtcattttattggatgaacccagccgtggcattgatattggtgccaaagcggaggttttccgtttacttgctgagagcgcccgaaaaggactggccgttatttactccacctccgaagtaggagagtgcctgagtatagcgcaccgcattgtggtgatgagtaaagggcatattaccgccatctttgattctgcggtttctaaagaacgcatcatggccgcttctggcgagtccgtgattgcctga

SEQ ID NO: 38839 - protein, 512 aa, Yersinia pseudotuberculosis IP 32953
MTQETDNEQQDDPNVVLAARNISKIYGSTHALQGVNFDIRRGKVTTLFGENGAGKSTLMKILSGVVTPSSGDILLNGEVKNFTSTAQARQHGIAIIHQELNLAPNMNVRDNIFIGREMMTVSGVDFANEERITRDLMRELEEDIDPLTRVEDLRLGQQQIVEIARALSVKARILIMDEPTSALSASEVGVLFSIIRDLTQRGVSIVYISHHLEEALEITDHAVVLRDGVVTASGQRSDIDLEWIVHNMVGDHFDLGSPPQGYEFGDVALAVDQLSVPGPSGYMAVDNLSLSVRAGEIICIYGLMGAGRTELMECIAGRLSAERGSILLNNQDISPLSIADRIESGLALVPEDRQRDGLVQTMSVGENLTLASIREFVRRLVLSPRREQELVVDSIRNVTVKTTGGEATIGSLSGGNQQKVVIGKILATRPKVILLDEPSRGIDIGAKAEVFRLLAESARKGLAVIYSTSEVGECLSIAHRIVVMSKGHITAIFDSAVSKERIMAASGESVIA

SEQ ID NO: 38840 - DNA, 1491 bp, Yersinia pseudotuberculosis IP 32953
  CDS (1)..(1491): transl_table=11
atgacgcctttattagaattaaagcagataaaaaaatcttttccgggtgttaaagcactggatggaattgatctcaccattcaacgcggagaggttcatgcgttgctgggggagaatggggcaggcaaatctacactggttaaaataatgtgtggtatttatcagccagattctggggggatttttctggaaggtcaacgctgtcgctttgcgaattatcgtgatgccattgatgcgggtattgggattatttttcaagagttctccctgatcccctatatgaatacgattgataatatttttcttaatcgagaaataaagaatcgttgggggttattagatcgccgtgaaatgcggcgcaaggcccgcgctattttcaagcgcctgacggtggatattgatcttgattgtcccgtggaacaactcagtgtggcgcaacagcagtttgtcgagatagccaaagctctgtcgttggatgcgcgcattctggtcttggacgaacccacggcgacgctgacaccaggcgaagccgaacatttatttagcatcatgcacgatctgaaattgctcggtgtcggtatggtgtttatttcacatcatctggacgaaattttcacgatttgtgaccagatcacggtgctgcgtgatggcgcttatattcagacactgccgactgccgagaccaatgtcgaagagctggttaatctgatggtcgggcgcaaaatcgagaatgccttcccggtgaaatcgcatccggtagacacctcggtgcgggtgctggaggcgacggttcagcacacaaaacacgtgatggaaaacagcttccatctgtataaaggcgaaatattggggtttgccgggttggtggggtcaggccgtactgaactgatgtccgcactgatcggtgcgcgctcctgctatcaaaagagtgtcagcctcaatggtcagcccaccgtgctacgtaatccggcgcaggcgttggatcacggtattggtctgttaccggaaagccgtaaaaccgaagggctgatcttgccgttttccgtctcccaaaacattacgcttaatcggcacgaaaaacgcggaaaaatcttcgttaatgccggtaaagagcacgatatcgtgcagcgattaatccgcgcggttggcgtaaagacaccggatgccgatacggctgtgaataccttgagcggtggcaatcaacaaaaagtggtaattgcccgctggcttaacaacgattgcgatattcttattttcgatgaacctacacggggtatcgacgtgggggccaagtctgaaatttatcaattaatgcaacaactgacgcagaaaggcatatctatcatcatgatttcatccgaattaccggaaattattggcgtttgtgatcgcgtcctggttttccgtggtgggcacattgttgccgaactggcgggtgatgaaattgaatctaataacatcatgcttcacgcaacagggagtgcattatga

SEQ ID NO: 38841 - protein, 496 aa, Yersinia pseudotuberculosis IP 32953
MTPLLELKQIKKSFPGVKALDGIDLTIQRGEVHALLGENGAGKSTLVKIMCGIYQPDSGGIFLEGQRCRFANYRDAIDAGIGIIFQEFSLIPYMNTIDNIFLNREIKNRWGLLDRREMRRKARAIFKRLTVDIDLDCPVEQLSVAQQQFVEIAKALSLDARILVLDEPTATLTPGEAEHLFSIMHDLKLLGVGMVFISHHLDEIFTICDQITVLRDGAYIQTLPTAETNVEELVNLMVGRKIENAFPVKSHPVDTSVRVLEATVQHTKHVMENSFHLYKGEILGFAGLVGSGRTELMSALIGARSCYQKSVSLNGQPTVLRNPAQALDHGIGLLPESRKTEGLILPFSVSQNITLNRHEKRGKIFVNAGKEHDIVQRLIRAVGVKTPDADTAVNTLSGGNQQKVVIARWLNNDCDILIFDEPTRGIDVGAKSEIYQLMQQLTQKGISIIMISSELPEIIGVCDRVLVFRGGHIVAELAGDEIESNNIMLHATGSAL

SEQ ID NO: 38842 - DNA, 1509 bp, Yersinia pseudotuberculosis IP 32953
  CDS (1)..(1509): transl_table=11
atgatccgtaacgagatactggcaaaaaaaccggactatctattagaagcgacgggactaaaaaaatcctttggcgatgtgatcgcgctaaacaatgctgaattctgtttaaaacggggttctatccatgcgctttgcggtgggaacggtgccggtaaatcaacatttcttggcctattaatgggatttattcagcctgatgatggagcgtttttcatcaacgggcaatactgcgaattcgactcaccgggacaagccctagccgcagggattaccattgttcaacaagagctcagtggggtacaggatctgtctgtggccgaaaatatttatctgggttctgagccaaggcgctttggtattgtcgattttcgtgcgcttaaccgccaggccgatgtgttattacacgagctgggtttcgccatttcacccaaagccaaaatgcgcagcctgagcgtagcagagcaacaacgggtggaaattgccaaagcgctgtcacatacccatgccgatatcatcattatggatgaacccacctccgcattaggtgaagaggatgcgcaaaaactgtttcagaccataaaaaaactggcctctctgggaaaaggggttatttatgtctcccaccgcttgtcagaaatatttcaaattgcagacagctacacggtatttcgagatggttgttatatttgtgaaggagagatgagtcacatcactcgcgaacaactgattgagcatattattggtggcgagattgatggtgagttctccaaatacaatactccaaccaatgtgccactctttaaagcctctggcatatgttggaaatcgaaagtgaatgatgtcagcctgacattacattgcggtgaaattttagggatttatggcttagtgggatcggggcgcagtgagtttcttaatctgctgtttggtcttgagcgtgctgatcacgggagcatccatatcggtgatgagatattactgaaacacacaccagaaaaagcaatcaacgccggtatcgcctatgtgaccgaagatcgtcaagagacaggattagtattgaaccattcggtatcggaaaatattaatatctcctcattaaacgtcattagtcgtatgagtatcattaatgaaaatgatattcagcgccgtgctgaccacacgatccgtatctttaatattaagacaccgagtcgccaacaacgagtggctaatttaagcggtggtaatcaacaaaaggtggtgttaggccgctgggcactgttagaccctaaagttttattattagatgagccaaccaagggaattgacattggggcaaaaaaagaaatttatcgctttatgtcggattttgccctcaaaggaaaaggcattgttatggtctcctccgagctttctgaaattattggcatgagcgacagaatcttggtttttaaaaaagggaaaatagtcggagaaattatgggctcggaggcaacacaggccaaattaatgtcgatggcggtataa

SEQ ID NO: 38843 - protein, 502 aa, Yersinia pseudotuberculosis IP 32953
MIRNEILAKKPDYLLEATGLKKSFGDVIALNNAEFCLKRGSIHALCGGNGAGKSTFLGLLMGFIQPDDGAFFINGQYCEFDSPGQALAAGITIVQQELSGVQDLSVAENIYLGSEPRRFGIVDFRALNRQADVLLHELGFAISPKAKMRSLSVAEQQRVEIAKALSHTHADIIIMDEPTSALGEEDAQKLFQTIKKLASLGKGVIYVSHRLSEIFQIADSYTVFRDGCYICEGEMSHITREQLIEHIIGGEIDGEFSKYNTPTNVPLFKASGICWKSKVNDVSLTLHCGEILGIYGLVGSGRSEFLNLLFGLERADHGSIHIGDEILLKHTPEKAINAGIAYVTEDRQETGLVLNHSVSENINISSLNVISRMSIINENDIQRRADHTIRIFNIKTPSRQQRVANLSGGNQQKVVLGRWALLDPKVLLLDEPTKGIDIGAKKEIYRFMSDFALKGKGIVMVSSELSEIIGMSDRILVFKKGKIVGEIMGSEATQAKLMSMAV

SEQ ID NO: 38844 - DNA, 1500 bp, Yersinia pseudotuberculosis IP 32953
  CDS (1)..(1500): transl_table=11
gtggatcagtacgctattgaagtcatacaggtgacgaaaagcttcggggggattcacgcgctgaagtcaattaatctgcaaattcgcaccggtagcattcatgccattatcggcgagaatggtgccgggaaatcgacattaatgaagatcctgtcggggatttacaccaaagacagcgggcgcattatgatccacggagaggagaaaaactttacttcaccgatccacagtaaagaaagccgtattggcattatttatcaggaactggcgttatcgccggatctgacggtagcagagaatatttttctcgacgatcttggttttggcaccggcatgatcaactggaagcgtttgaatgaaaaagccagcctcatcctgaatgaactgggatttcaaatcgatccccgcgccagagtgggggatctgagtgttgcctatcaacagatggtcgaaatcgctaagtcgctggccaaagatgtcaacattctgatccttgatgaaccttcagcagtactgtcaggtaaagaggtcgcgatattgtttacccagctacgcaagttaaaggcacgcggggtgaccatcatttatatttcacatcggctggaagaattgatggttattgctgatgtgatcaccgtcattaaagatggcgagaccgtcaagaccttagatccccagtcctgtagcgaagacgaaattatcaccagcatggtagggcgcaaactggaaagcctctatcccgagaaaaatgtgccaggtaatgaggtggtcttggaggtcaaagccctctcaacccgtgcgctgctgcatgatattaatctgacattgcataaaggcgagatcgtcggtttagcgggcttggtcggggcagggcgtagcgaggtcgcacgttgtctctttggcattgacaagatagcggggggaacggtgtccaaggccggtacgcctattcagattaatcacccgtcacaggcgatgtcccatgggattggtctggtgcctgaaagccgtaaggagcagggggcgattttggtacgcccaatccgcgaaaatatgacgttatcgaatctgaaggcggttagcggctggatgggttttattcgtcgtcgtcaggagcgagagaccagccagaagctacaacaaaaactggccatcaaactggggtcggttgaggatcccatcgccagcttaagtggtggtaatcagcaaaaagtagtcatcgctaaatggttgaacacggattgccatattttgatcttggatgaacctacccgcggtgttgatgtgggagccaaggctgaaatttataacatcattcaccaattggccgaacgcggttattccattttagtgatctcatcggagatggttgaagtgattaatctttgtcatcgcatttatgtgatgagtgaagggcgcattaccaaagagctgcaacacgatgagatttcagaagaaaatatcatgcgctatgccattcccaagcgcgagacaatatga

SEQ ID NO: 38845 - protein, 499 aa, Yersinia pseudotuberculosis IP 32953
MDQYAIEVIQVTKSFGGIHALKSINLQIRTGSIHAIIGENGAGKSTLMKILSGIYTKDSGRIMIHGEEKNFTSPIHSKESRIGIIYQELALSPDLTVAENIFLDDLGFGTGMINWKRLNEKASLILNELGFQIDPRARVGDLSVAYQQMVEIAKSLAKDVNILILDEPSAVLSGKEVAILFTQLRKLKARGVTIIYISHRLEELMVIADVITVIKDGETVKTLDPQSCSEDEIITSMVGRKLESLYPEKNVPGNEVVLEVKALSTRALLHDINLTLHKGEIVGLAGLVGAGRSEVARCLFGIDKIAGGTVSKAGTPIQINHPSQAMSHGIGLVPESRKEQGAILVRPIRENMTLSNLKAVSGWMGFIRRRQERETSQKLQQKLAIKLGSVEDPIASLSGGNQQKVVIAKWLNTDCHILILDEPTRGVDVGAKAEIYNIIHQLAERGYSILVISSEMVEVINLCHRIYVMSEGRITKELQHDEISEENIMRYAIPKRETI

SEQ ID NO: 38846 - DNA, 1524 bp, Yersinia pseudotuberculosis IP 32953
  CDS (1)..(1524): transl_table=11
atgaataaagtccccctcttggagatgcgtaatattaccaagtcgtttggcaaatttcaggcgcttaaaggtgtcgatttgacggtgttttccggcgagatccacgcgctgatgggcgaaaacggggcggggaaaagtaccctaatgaagatcctcgctggcgcatataccaccaccagcggcgagatccttattgagggtaggccttggtccatcaaaggcccaaaagatgcgctgaatgcaggtattagtttgatttaccaagagatgcagctcgcacctaacctgaccgttgcggaaaatattttccttggcagcgagctttcccggggagggctggtgcagcgtaaagagatggtgatgcagacccaggcggttatcgaccgtctcggcgctcagtttaaagccagcgatttagtgatggggcttaccatcgccgaacaacagcaggtcgagattgctcgtgcacttcatcgtaacagccgcattttggtgatggatgaacccacagcggcgctttctactcgtgaaacgcatcgcctatttgaacttattttgcggctgcgcgatgaggggatggccattatctacatcagccatcgtatggcggaagtgtatgaactttctgaccgtgtgagcgtactgcgcgacgggcaatacgtcggcagcctgatgcgcgccaacctcaacgccaacgaactggtgcgcatgatggtggggcgtccgcttagcgatctgttcaataaagaacgggatattccactcggtcatttacgccttaatgttcatcacctgacggatggtgccaaagtgcaggcggtgagtttacaggtccgttccggtgaaatcgttgggttagcggggttggtgggcgcagggcgttcggagctggcgcaactgatttttggtgtccgcaaagccaccggaggaacgatagagatagatggcgtaccgttggtcattcactcccctcgtgaagccattcgccacggtattggttttctgaccgagaaccgcaaagagcaagggctgtttttggaactggccgcgcaggacaacatcactatggcaaccctggagcgggacgcctgttacggcctgctcgatcgcaaaaaagcccgtgctatttcagacgacgccatcaatcggttgaacatacgtgtacctcatgcgcaggtgcgtgccggaggcttgtccgggggtaaccagcaaaagctgctgatttcccgttgggtagcgattagcccacgcattcttatccttgatgagccaacacgtggagtggacgtcggcgctaaaagcgagatttaccgcatcatgagccagatggcgcgcgagggggtggcgattttgatgatttccagtgagttgcccgaagtggtagggatgagcgaccgggtgtacgtgatgcatgaaggacgtattgcaggggaactacatcaccctgatatcacgcaggaaaatattatgacgctggcaactggcgtgaccgaggaccataaaaaagaggtttaccatgactaa

SEQ ID NO: 38847 - protein, 507 aa, Yersinia pseudotuberculosis IP 32953
MNKVPLLEMRNITKSFGKFQALKGVDLTVFSGEIHALMGENGAGKSTLMKILAGAYTTTSGEILIEGRPWSIKGPKDALNAGISLIYQEMQLAPNLTVAENIFLGSELSRGGLVQRKEMVMQTQAVIDRLGAQFKASDLVMGLTIAEQQQVEIARALHRNSRILVMDEPTAALSTRETHRLFELILRLRDEGMAIIYISHRMAEVYELSDRVSVLRDGQYVGSLMRANLNANELVRMMVGRPLSDLFNKERDIPLGHLRLNVHHLTDGAKVQAVSLQVRSGEIVGLAGLVGAGRSELAQLIFGVRKATGGTIEIDGVPLVIHSPREAIRHGIGFLTENRKEQGLFLELAAQDNITMATLERDACYGLLDRKKARAISDDAINRLNIRVPHAQVRAGGLSGGNQQKLLISRWVAISPRILILDEPTRGVDVGAKSEIYRIMSQMAREGVAILMISSELPEVVGMSDRVYVMHEGRIAGELHHPDITQENIMTLATGVTEDHKKEVYHD

SEQ ID NO: 38848 - DNA, 1533 bp, Yersinia pseudotuberculosis IP 32953
  CDS (1)..(1533): transl_table=11
atgccctacctactagaaatgaaagatattaccaagcagttcggcgtcgtcaaagccgtagataatatcagcctaacgctggaagcggggcaggtattatcgttgtgcggtgaaaatgggtctggaaaatccacgctaatgaaagtgctatgtggtatttatcccgtaggttcctatcagggggaaataatattttccggcgaaaccttacaggcaaaaaatatccgcgaaacagaacaaaaaggcattgcgattattcatcaagaattggcactggtgaaacaaatgtcagtgctggagaacatgttcctcggctccgaatggggccgtttcggtatcatggattacgacgccatgtatttacgctgccaacggatgctggcgcaggtcaaactggtggttgacccccatacaccggtcagtgaattgggccttgggcagcaacaattggtcgaaattgcaaaagcattaaataaacaagtgcggctgctggtactggatgaaccaacggcatcactgacagaaagtgaaactgccattttactggatattattcgtgacctgcgtaaccacggtattgcctgcatctatatttctcacaaattgaatgaagtaaaagagatatcagatcatatctgtgtgatccgcgatggtcgtcatatcggcacccgcccggcatcgaccatgagcgaggatgacattatcgccatgatggtagggcgtgagctaaaagaactctatccccacgaagcccatcacattggcgaggagattctacgggttgaaaacctctgtgcctggcatccggtgaatcggcatattcgccgggtcgatgatgtttctttctcattgaaacgcggtgaaattctcgggatcgccggtttggtcggttcagggcggacggaaacggttcagtgcctgtttggggtatatccgggccgctggcagggcgatatctttattaaagggcaagccgcgactattcggacgtgccagcaagcgatgaaattgggtatcgcgatggtgccggaagatcgcaaaaaagacggcatcgtacccgtgatgggagttggcgctaatatcacattggcggcactggatgattttactggcgctttcagtttgctggatgatgcgaaagaacaatcgataattgtacagtctttggcccggttgaaagtgaaaacgtcttcttcagagctggccattgcccgcctgagtgggggcaatcagcaaaaagctattttggctaagtgcctgctattaaacccacaaatattgatcctcgatgaaccgacacgtggtatcgacatcggtgcaaaatacgaaatctacaaacttatcaatcaactggtccaacaggggatcgcggtcattgtgatttcctctgaactgccagaggtcttgggattaagtgatcgggtgctggtcatgcatcaggggcgcatcaaagccgatcttatcaaccataacctgactcaagaaaaggtcatggaagccgcactcaggagtgaaacccatgtcacaagctaa

SEQ ID NO: 38849 - protein, 510 aa, Yersinia pseudotuberculosis IP 32953
MPYLLEMKDITKQFGVVKAVDNISLTLEAGQVLSLCGENGSGKSTLMKVLCGIYPVGSYQGEIIFSGETLQAKNIRETEQKGIAIIHQELALVKQMSVLENMFLGSEWGRFGIMDYDAMYLRCQRMLAQVKLVVDPHTPVSELGLGQQQLVEIAKALNKQVRLLVLDEPTASLTESETAILLDIIRDLRNHGIACIYISHKLNEVKEISDHICVIRDGRHIGTRPASTMSEDDIIAMMVGRELKELYPHEAHHIGEEILRVENLCAWHPVNRHIRRVDDVSFSLKRGEILGIAGLVGSGRTETVQCLFGVYPGRWQGDIFIKGQAATIRTCQQAMKLGIAMVPEDRKKDGIVPVMGVGANITLAALDDFTGAFSLLDDAKEQSIIVQSLARLKVKTSSSELAIARLSGGNQQKAILAKCLLLNPQILILDEPTRGIDIGAKYEIYKLINQLVQQGIAVIVISSELPEVLGLSDRVLVMHQGRIKADLINHNLTQEKVMEAALRSETHVTS

SEQ ID NO: 38850 - DNA, 1503 bp, Symbiobacterium thermophilum IAM 14863
  CDS (1)..(1503): transl_table=11
atgctgctgagactcgaaggcatcaccaaacgattcgggtcgctggtagccaacgaccacatcgacctggagatccggcagggggagatccacgccctgctgggcgagaacggggccggcaagtcgacgctgatgaacatcctctatggcctctacacgcccgacgaggggcggatcttctggaaaggcaaggaagtgcagatccgaaaccccaggcacgccatcgacctggggatcggcatggtgcaccagcacttcatgctcgtcccggtgttcaccgttgctgagaacatcaccctgggcaaggaagtggtgcgcaaccgcttcctggacatgaacgaagcccggcggcaggtggcggagctgtccaggcggttcggcctcgaggtcaaccccgacgaccggatcgagtccatctccgtcggcctgcagcagcgcgtggagatcctgaaggcgctgtaccggggcgcggagctgctgatcctcgacgagcccacggcggtgctcacgccgcaggaggtcgaggagctgggcaagatcatgaagcggctggtcgccgaggggcacacgatcatcatcatcacccacaagctcaaagaggtgcttcacctggcggaccgggtgaccgtcatccgccgcggcaagaagatcgcgacgctggacgccgccggccagaccgaggacgagctggcccggctcatggtcggccgcgacgtcatcctgcgggtggacaagcagccggccaaccccgggaaggtggtgctggaggtgaacgaccttcacgccaagaacgaccggggggtggacgcggtccggggcgtctccttcaccgtgcgggccggggagatcgtgggcatcgccggcgtcgacggcaacggacagtccgagctgatttcctgcatcaccggtctgcgcaagcccaccgcgggcaccatccgggtcaacgggcaggacgtgaccggccagagcccgcgccgcatccgggacgcgggcgtgggccacatccctgaagaccggcagaagcgggggctggtgctgaacttcaccgtggcggagaacgcggcgctcggcgaccacagggccttcgcccggcgggggttcataagccagcagcagatggtccagaaggcgcaggagatcatcagcgggttcgacgtgcgcccgccccgccatgactacctggcccgggcgctctccggcggcaaccagcagaaggtgatcgtcggccgcgagatcctgcgcaaccccgacctgctggtggccgtacagcccacccgcggcctcgacgtcggcgcgatcgagttcatccacaagcacctggtggccgagcgcgacgcaggccgggcagtcctcctggtttcgctggaactggacgagatcatgaacctggcagaccggatcctggtgatgtacaagggccagatcgtagccgaagtgccgggccacgaggcgaccgaagaaggcctcggtctgctgatgatgggaggtagcgccagtgcctga

SEQ ID NO: 38851 - protein, 500 aa, Symbiobacterium thermophilum IAM 14863
MLLRLEGITKRFGSLVANDHIDLEIRQGEIHALLGENGAGKSTLMNILYGLYTPDEGRIFWKGKEVQIRNPRHAIDLGIGMVHQHFMLVPVFTVAENITLGKEVVRNRFLDMNEARRQVAELSRRFGLEVNPDDRIESISVGLQQRVEILKALYRGAELLILDEPTAVLTPQEVEELGKIMKRLVAEGHTIIIITHKLKEVLHLADRVTVIRRGKKIATLDAAGQTEDELARLMVGRDVILRVDKQPANPGKVVLEVNDLHAKNDRGVDAVRGVSFTVRAGEIVGIAGVDGNGQSELISCITGLRKPTAGTIRVNGQDVTGQSPRRIRDAGVGHIPEDRQKRGLVLNFTVAENAALGDHRAFARRGFISQQQMVQKAQEIISGFDVRPPRHDYLARALSGGNQQKVIVGREILRNPDLLVAVQPTRGLDVGAIEFIHKHLVAERDAGRAVLLVSLELDEIMNLADRILVMYKGQIVAEVPGHEATEEGLGLLMMGGSASA

SEQ ID NO: 38852 - DNA, 1536 bp, Symbiobacterium thermophilum IAM 14863
  CDS (1)..(1536): transl_table=11
atggaaccgctcgttcggatggatcacatcaccaagacgtttccgggggtcagggccctcagcgacatcaccttcgacatccgtcccggcgaggtgcacgtgctgctgggggaaaacggcgccggcaagtcgacgctcatgaagatcctgagcggcgcttacgaacccaccagcgggaccatcaccgtcgatggccgcgcgtacccgcggctcaccccggcgctctcggccaagctgggcatcagcatcatctatcaggaactgagcgtgatcaacgagctcagcatcgaggagaacatcttcgtcggccgcctgccggtgcggaaggtgatgggcgtcccggtcgtcgactacgcgttcatgcggcagcggacccaggagctgctggacatcctggacctgcgccggtcgccggagacgctcgtcggggatctgagcatctcggagaagcagatggtggagatcgccaaggctgtggcgttcaacgccagggtcatcatcatggacgagccgacctcgtcgctgaccgacgccgaggtggagaagctctttgcgatcatccgccggctgaagggcgagggaaagggcatcgtctacatctcccacaagctgaaggagatcctcgccatcggcgaccggatcaccgtcctgaaggacgggacctacgtggggacgcgggacgtgcaggacgtcaccatggacggcctggtgacgatgatggtgggccgggagctgaaggacaagtaccaggccaacaccgacgtccaccggaccggaaaggtcatcttcgaggtccggaacctgacccgccgggacgggcgcgtgcaggacgtctccttcgccctccgggagggcgaggtgctgggattcgcagggctggtcggcgccggacggagtgagaccatgtgcgccatctacggcaccgaccccatccgctcgggcgagatctggctgcacggcgaacgaatggagatccgctcgccctacgacgccttgaagaaaggcatcggtctggtcaccgaaaaccgccgcgagacgggcttcttcccgaatttcagcatccggcggaacgtggccatcgcccggcagctgaagctcgcccgctggggcggcctgtgggggctcgtgaacgagcgggacgagcagaagacggccgagaaggcgcgggccgacatgcagatcaagtgcgcctcgctggagcagaacatcaccgagctctcgggcggcaaccagcagaaggtgatcctcggcaagtggctggcggcgggcgtgaaagtcttgatcttcgacgagcccacccggggcattgacgtgggcaccaaggcggagatctacaagctgatgcggtcgctggccgaaagcggcatcggggtcatcgtcgtctcgtcggagctgccggaactcttgtcggtgtgcgaccgcattatcgtcatgagcgagggccggatcagcgcggagttcacggccgcggaagcgaccgaggaaaagattgtgaaggcggccaccgtcggcgccggagcgagtggagggaactga

SEQ ID NO: 38853 - protein, 511 aa, Symbiobacterium thermophilum IAM 14863
MEPLVRMDHITKTFPGVRALSDITFDIRPGEVHVLLGENGAGKSTLMKILSGAYEPTSGTITVDGRAYPRLTPALSAKLGISIIYQELSVINELSIEENIFVGRLPVRKVMGVPVVDYAFMRQRTQELLDILDLRRSPETLVGDLSISEKQMVEIAKAVAFNARVIIMDEPTSSLTDAEVEKLFAIIRRLKGEGKGIVYISHKLKEILAIGDRITVLKDGTYVGTRDVQDVTMDGLVTMMVGRELKDKYQANTDVHRTGKVIFEVRNLTRRDGRVQDVSFALREGEVLGFAGLVGAGRSETMCAIYGTDPIRSGEIWLHGERMEIRSPYDALKKGIGLVTENRRETGFFPNFSIRRNVAIARQLKLARWGGLWGLVNERDEQKTAEKARADMQIKCASLEQNITELSGGNQQKVILGKWLAAGVKVLIFDEPTRGIDVGTKAEIYKLMRSLAESGIGVIVVSSELPELLSVCDRIIVMSEGRISAEFTAAEATEEKIVKAATVGAGASGGN

SEQ ID NO: 38854 - DNA, 1569 bp, Bacillus licheniformis ATCC 14580
  CDS (1)..(1569): transl_table=11
atgtccgattgcattttagagatgagaggcatcacgaaggagtttcccggcgtcaaagcgctcgacaatgtccaccttcgcgttaaagcgggcgaaatccatgccctctgcggggaaaacggggcgggcaagtcgactttgatgaaggtgctgagcggcgtctatccgtacggtgcgtatacgggcgacattttatataaaggggaagtatgccaattcaaaaatattaagcaaagcgaggaagcggggatcgtcatcatccaccaggagctggcgctcgtcccccagctttccattgcggaaaatctttttttgggcaatgaacaggccagccgcggcgtcatcaattggcgaaagacaaagctggaaacgctcgaattaatgaaaaaagtcgggcttcaagaatctccggatacgcttgtttcccaaatcggcgtcggaaagcagcagcttgttgaaatcgccaaagctttggcaaaaaaagtgcagctcttgattttggatgaaccgacggcggctttaaatgaagctgacagcgagaatctgctgcagctcttgctcgaactgaaaaaacagggaatctcttcgattatgatttcccataaattaaatgaagttacgaaagtcgcagattcgattaccgtgctccgggacggacagacgatcgaaacgcttgatgttcaaagcgggcaattgactgaaaaccggatcatcagaggcatggtcggcagggagctgcaaaaccgctaccctgacagaagcgccgagatcggcgacgtcatctttgaagtgaaggattggacagttcaccatcctcttcaacaggaccgcaaagtggtaaacatggcggcgttttccgtgaaaagaggcgagatcgcaggaattgccggactgatgggctccggaaggacggagctggcgatgagcatttttggaagatcatatgggaaaaacatttccggcacaatcgaaaaagacgggcgggagctttacatcaaccaccctgaagatgccattaaaaacggcatcgtctatgtgacggaggacaggaaaggaaacggtttgattctgaaggacagcattaaagaaaacattacgctgtcgaaactggataaggtgtcgagccgattggtgatggacgagcggcgcgaacaacatgaagcggaggattttcgccggaaattaaacatcaagacgcccgatatcagccagcggaccggaaatttaagcggaggcaaccagcagaaggtcatgctgagcaagtggattttcgcggagcctgacgttttaatcctggatgaaccgacgcgcggcatcgatgtcggcgccaaatacgaaatctacggcgtcatcaatcagcttgccgaagcgggtaaagcggttatcatgatctcttcggagcttcccgagctgctggggatgtgcgacagaatctatacgatgtgtgagggggaaatcaccgccgaattttccaaagaagaagccgatcaggagaagctgatgaaatatatgaccatccgcatgaagagagggggagaagcgtatgcagacaccggtgcaaacggataa

SEQ ID NO: 38855 - protein, 522 aa, Bacillus licheniformis ATCC 14580
MSDCILEMRGITKEFPGVKALDNVHLRVKAGEIHALCGENGAGKSTLMKVLSGVYPYGAYTGDILYKGEVCQFKNIKQSEEAGIVIIHQELALVPQLSIAENLFLGNEQASRGVINWRKTKLETLELMKKVGLQESPDTLVSQIGVGKQQLVEIAKALAKKVQLLILDEPTAALNEADSENLLQLLLELKKQGISSIMISHKLNEVTKVADSITVLRDGQTIETLDVQSGQLTENRIIRGMVGRELQNRYPDRSAEIGDVIFEVKDWTVHHPLQQDRKVVNMAAFSVKRGEIAGIAGLMGSGRTELAMSIFGRSYGKNISGTIEKDGRELYINHPEDAIKNGIVYVTEDRKGNGLILKDSIKENITLSKLDKVSSRLVMDERREQHEAEDFRRKLNIKTPDISQRTGNLSGGNQQKVMLSKWIFAEPDVLILDEPTRGIDVGAKYEIYGVINQLAEAGKAVIMISSELPELLGMCDRIYTMCEGEITAEFSKEEADQEKLMKYMTIRMKRGGEAYADTGANG

SEQ ID NO: 38856 - DNA, 1482 bp, Bacillus licheniformis ATCC 14580
  CDS (1)..(1482): transl_table=11
atgcatattaaaatgaaggacatttttaaagcctttggccaaaaccaggtgctgtccggcgtttccttcgagcttcaagaaggtgaagtccacgctttaatgggagaaaacggcgccggaaagtcgacactcatgaatctgttgactggacttcacaagctggacagcggaacgatcgagatcgacggaaaagaaacgtatttttcagatccaaaggaagccgaacagaacggaatcgcctttatccatcaggagctgaacatttggcctgaaatgaccgttttggaaaatctgtttatcggcagagagctttcttccaaacttggatttttaaacaacaagaaaatgaaagcgctagcaaaagagcagcttgaaaggctcggtgtctcaatttctcttgaaaaagaagccggagactgttccgtcggccagcagcaaatgatcgaaatcgcaaaagcccttatgacagacgcgaaagtgatcatcatggatgaaccgacggcagcgttgacagaaagagaaattgaaaaactgttcggcgtcattagagcattaaagaaaaacggcgtctccatcgtctatatatcccaccgcatggaagaaatcttcacgatttgcgacaggatcacggtgatgcgcgatggaaaaacggtggacacgaaacggattcccgacaccgactttcatgaagtggtgaaaaagatggtcggacgggagctgaccgaacgctatcctgaaagacagccaaatccgggacgcgtcgtcctcgaagtcaagcaggcatccaaaaaaggagtcttccaaaatatcagcttttccgtccgctccggcgaaatcgtcgggatttcaggactgatgggtgccgggcgcaccgagctgatgagagcggttttcgggctcgatccgcttgactcgggagacattttcatcgaaggcaaaaaagcggcgctcaaaaaaccgagcgatgccgttcaaaagggaatcggctttattaccgagaaccgcaaggatgaaggacttgtgctcgacacgtccatcagagaaaatatcgcccttccgaatctcgccagcttttcgccgaaaggatggattgacaaaaaaagcgagcaggaatttgtcgatcttctgatcaagcggctgacgatcaaaacggaatcgccggaaacccacgcgcgaaacctttcaggaggaaaccagcaaaaagtggtcattgccaaatggatcggcatcggccctaaagtgctgattttggatgagccgaccagaggcgtcgatgtcggcgcgaaaagggagatttatcagctgatgaacgagctgacagaccgcggcgtcgcgatcgtcatggtctcttcagagctccccgagattctcgggatgagcgaccgcgtccttgtaatccatgaaggaacgctaagcggagagctatcaagaaatgatgccacgcaagaacgaattatgacactcgctacaggaggacggtaa

SEQ ID NO: 38857 - protein, 493 aa, Bacillus licheniformis ATCC 14580
MHIKMKDIFKAFGQNQVLSGVSFELQEGEVHALMGENGAGKSTLMNLLTGLHKLDSGTIEIDGKETYFSDPKEAEQNGIAFIHQELNIWPEMTVLENLFIGRELSSKLGFLNNKKMKALAKEQLERLGVSISLEKEAGDCSVGQQQMIEIAKALMTDAKVIIMDEPTAALTEREIEKLFGVIRALKKNGVSIVYISHRMEEIFTICDRITVMRDGKTVDTKRIPDTDFHEVVKKMVGRELTERYPERQPNPGRVVLEVKQASKKGVFQNISFSVRSGEIVGISGLMGAGRTELMRAVFGLDPLDSGDIFIEGKKAALKKPSDAVQKGIGFITENRKDEGLVLDTSIRENIALPNLASFSPKGWIDKKSEQEFVDLLIKRLTIKTESPETHARNLSGGNQQKVVIAKWIGIGPKVLILDEPTRGVDVGAKREIYQLMNELTDRGVAIVMVSSELPEILGMSDRVLVIHEGTLSGELSRNDATQERIMTLATGGR

SEQ ID NO: 38858 - DNA, 1485 bp, Bacillus cereus E33L
  CDS (1)..(1485): transl_table=11
atgcgtattgaaatgaaaaatatttcaaaggcgttcaatggcaatcctgttttgaaaaatgcacagtttatgattgaaacaggagaagtccatgcattgatgggggaaaatggagcgggtaaatcaacgctcatgaagattttaacaggtgtatacaaaagagatggtggaacgatcacgattgatggacaagaacgaacttttaaaaatgcgaaagaagctgaagagtacggtattgcatttatacatcaagaattgaacatattaccgaatttaacagtagctgaaaatatgtttctcggtaaagagttaatgtatggaaagacaggtattttacgtacgcgtcaaatgaacgcgattgcgcagcagcaactagcggagttaggattacatgtaaaaggcgctatgttggcaggagagttatcggttggacaacagcaaattatcgaaattgcaaaagccctaatgacaaacgcgagcgttattattatggatgaacctacagctgcattaacagatcgtgaaattgaaacgttgtttaccgtcattaataaattacgtaaagaaggcgtttcgttcgtttatatctcacaccgaatggaagaaatcttttcaatatgcgatgccattacgattttacgtgatggggaatacgtcggaaagagatccattccagaaacatcgtttgatgaggtagtgagtatgatggtggggcgcagcattggtgaacgttacccagaacgaaatagtcaaattagcgatgttatttttgaaatgcgtaatggaacgaaaaaagggaagtttgaaaatgtttcgtttcaagtgagaaaaggtgaaatccttggtgtagctggcttgatgggagctggccgcacagatattatgaaatcgatatttggatacgaacctttagattctggccaaatttttataaatgggcaagaagtaaagattgatagtccgatagatgcgattagacaaagaatagcattcattacagaggatagaaaatctgaagggttagtgctagatttctcaattcgagaaaatttagctttaccgaatttagaaagtctttcaaagggaagcgtcttaagtaacgaactagaacaacagtttacagcggacatgatgaaacttcttaatgtgaaagcatctagtggagagcaagctgtgaaatctctttctggtggaaatcagcaaaaggttgttattgccaaatggttaggtatccacccacagttactcattttagatgagccaacaaggggtgttgatgttggagcgaaaaaagaaatttactctattatgaataagcttaccgaagaaggagatgccgttattatggtatcatctgagcttccagaagttttaggaatgagtgatcgcgttcttgttattcatgaaggaaaagtcggcggcattttagagaaagatgaggcatcacaagagtctattatggcactagctacagggggagagtaa

SEQ ID NO: 38859 - protein, 494 aa, Bacillus cereus E33L
MRIEMKNISKAFNGNPVLKNAQFMIETGEVHALMGENGAGKSTLMKILTGVYKRDGGTITIDGQERTFKNAKEAEEYGIAFIHQELNILPNLTVAENMFLGKELMYGKTGILRTRQMNAIAQQQLAELGLHVKGAMLAGELSVGQQQIIEIAKALMTNASVIIMDEPTAALTDREIETLFTVINKLRKEGVSFVYISHRMEEIFSICDAITILRDGEYVGKRSIPETSFDEVVSMMVGRSIGERYPERNSQISDVIFEMRNGTKKGKFENVSFQVRKGEILGVAGLMGAGRTDIMKSIFGYEPLDSGQIFINGQEVKIDSPIDAIRQRIAFITEDRKSEGLVLDFSIRENLALPNLESLSKGSVLSNELEQQFTADMMKLLNVKASSGEQAVKSLSGGNQQKVVIAKWLGIHPQLLILDEPTRGVDVGAKKEIYSIMNKLTEEGDAVIMVSSELPEVLGMSDRVLVIHEGKVGGILEKDEASQESIMALATGGE

SEQ ID NO: 38860 - DNA, 1509 bp, Mannheimia succiniciproducens MBEL55E
  CDS (1)..(1509): transl_table=11
atgcaagttccatatttagaatttgataatgtgagcaaaagctttcccggcgttaaagcattgcaaaatatttcctttaaatgctatgagggcaaagttcatgcgttaatgggtgagaatggtgcgggcaagtccaccttgttaaaaattttaagcggcaactatctgcctagcgagggcaaattaagtatcggcggtcgccaactggttttccgtaatactaaagaagccttattagccggtgtcgccattatttaccaggaattaaatattgtgccggaaatgaccgttgcggagaatttatgcttaggtcagttaccccattctttcggcattgtagataaagcggaattaattgagagaacacaacaatacctggataaactggatctcaatatttcgcctaatacccctttaaaagaattatctatcggtcaatggcaaatgatcgagattgccaaagccttaagccggggcgcaaaaatcattgcatttgacgaacccaccagcagcctttccgctcctgaaattgagaaattattcagcgtaattaacgagttacgggatgaaggcaaggtgattttatatgtatctcaccgaatggaagaaattttccgtatcagtgatgaaattaccgtgctgaaagacgggcaatttgtggagactttctccgatctttcaaaaatcaccaatgacgatttagtacgcagcatggtcggacgcaatttgggtgatatttaccattatcgtccccgtgaagtgggtgatgtccgtttgaaaattgcacatttatccggtgaaaaactgcaaggtgattttagtttaacggttcgggccggtgaggttttaggcttattcggcctggtcggcgcagggcgttcggaattattaaaagtgattttcggtgcggatccttgtgtgtcgggaagcattgaattagacggtaaaaccttgtctatccgcagccctaaagacgctattgaacaaggtatcgtcctttgtccggaagaccgtaaaaaagaaggcattgtccccactgccagcgtaggggaaaatattaatatcagcgcccgcagattacataatttttttaaatttattattaatgataaatgggaaaagaaaaacgctgaaaaacaacgccaacaaatgaatgtgaaaaccccgtctatcgagcaattaattgtcaatctttccggtggtaatcaacaaaaagcgattttaggccgttggctttccgaagatattaaagtgttattgctggacgaaccgacccggggtatcgacgtgggggcgaagtccgaaatttacgatttaatttttaagctggccgaccaaaaattagccattattgtggtttccagtgatttacccgaagttatcggcgtatccgatagaattatggtaatgcgcgcccatcaaattaccggtgtggtagaacgcgcggatgcaacggaagaaaaagtattaaaacttgctatggtagaaagccttaatgtaggagattga

SEQ ID NO: 38861 - protein, 502 aa, Mannheimia succiniciproducens MBEL55E
MQVPYLEFDNVSKSFPGVKALQNISFKCYEGKVHALMGENGAGKSTLLKILSGNYLPSEGKLSIGGRQLVFRNTKEALLAGVAIIYQELNIVPEMTVAENLCLGQLPHSFGIVDKAELIERTQQYLDKLDLNISPNTPLKELSIGQWQMIEIAKALSRGAKIIAFDEPTSSLSAPEIEKLFSVINELRDEGKVILYVSHRMEEIFRISDEITVLKDGQFVETFSDLSKITNDDLVRSMVGRNLGDIYHYRPREVGDVRLKIAHLSGEKLQGDFSLTVRAGEVLGLFGLVGAGRSELLKVIFGADPCVSGSIELDGKTLSIRSPKDAIEQGIVLCPEDRKKEGIVPTASVGENINISARRLHNFFKFIINDKWEKKNAEKQRQQMNVKTPSIEQLIVNLSGGNQQKAILGRWLSEDIKVLLLDEPTRGIDVGAKSEIYDLIFKLADQKLAIIVVSSDLPEVIGVSDRIMVMRAHQITGVVERADATEEKVLKLAMVESLNVGD

SEQ ID NO: 38862 - DNA, 1530 bp, Mannheimia succiniciproducens MBEL55E
  CDS (1)..(1530): transl_table=11
atggctaccgaacgtttaagtatgcgcaatatgacaaagaaatatgggacggtgacggtattagaagatgtttcttttaatgttaaagccggagaggttcatgctcttatcggtgagaacggagcgggaaaatccacattattgaatttgttatcgggagtaagagacgctacggcgggagaaatttatattgacggacaaaaagtaaatataaattctccgaaagcggctaaagattgcggtatcgcaatgatacaccaagagctacaaaatgtgcctgaactctccgtttttcaaaatatatttttggggcgttctttaaaaaagaatttgggtttatttgtggataaatctaaagaaagtcaattagccttggaagtcttaaagagtttagatcctggtattgatccgtcggttcccattaagacgcttaaagttgcacagcaacagattgttgagatagcgcgagctttactggataacgccaagattatcgcaatggacgaaccgacatcaagtttaacgccgagtgagttcgaacgtttggccgagttgattaaaggactggcgaatagcggcgtttcaattatttacgtatcgcacaagatggatgaaatattcaaggtgtgtgatcgtgcgacaattctccgtgacggacgttttatcgactgtgtaaatatgtccgagcaaacggaagaaagtatcgtaaccaaaatggtcggccgtaaaatcgaaaaattgactcatatgagttatgccaccgatgaaaaaattttagaagtacgcaatttgggccgggataaagcggtaaaagatattaattttattgctcataaaggagaggttgtcggtatttcgggtttagtcggcgccggtcgtacggaattattcagattgatagcgggtttagataaaccgacatcgggagagattcttgttgaaggtaaaagattaaaattaaacagtgtgcgcgattcaatcaaaatgggaataggtctggtgccggaagaccggaaaaaagaaggtattttacgtgatcgcagcgtattgattaatattgccatgccttcaatggatcgattttctcaaaacgggtttattcgtaaggattatctgggcgctgtttctcatcggttaatgatggatctaaatttaaaaccctttgatttagaaaaaacggtagggacttttagcggaggaaatcaacaaaaagtcattatcggccgttggcttgcggcggggaccaaaatttatctctttgatgaacctacgcgaggtatagatattgggactaaatctgaaatctacaatttaattgagaatttagcaaaagcaggaaatgttattttagtcgtttcatcagaaatgccggaaattattcgagtatctgaccgcgtattagttatgaaggaaggcgctatcacagccgaattatgtggtggtgatatcaatgaagaaaatattgcccaatatgcgattggacaaaataaaattaagaatgaagagggattaaattatgtcagcaattaa

SEQ ID NO: 38863 - protein, 509 aa, Mannheimia succiniciproducens MBEL55E
MATERLSMRNMTKKYGTVTVLEDVSFNVKAGEVHALIGENGAGKSTLLNLLSGVRDATAGEIYIDGQKVNINSPKAAKDCGIAMIHQELQNVPELSVFQNIFLGRSLKKNLGLFVDKSKESQLALEVLKSLDPGIDPSVPIKTLKVAQQQIVEIARALLDNAKIIAMDEPTSSLTPSEFERLAELIKGLANSGVSIIYVSHKMDEIFKVCDRATILRDGRFIDCVNMSEQTEESIVTKMVGRKIEKLTHMSYATDEKILEVRNLGRDKAVKDINFIAHKGEVVGISGLVGAGRTELFRLIAGLDKPTSGEILVEGKRLKLNSVRDSIKMGIGLVPEDRKKEGILRDRSVLINIAMPSMDRFSQNGFIRKDYLGAVSHRLMMDLNLKPFDLEKTVGTFSGGNQQKVIIGRWLAAGTKIYLFDEPTRGIDIGTKSEIYNLIENLAKAGNVILVVSSEMPEIIRVSDRVLVMKEGAITAELCGGDINEENIAQYAIGQNKIKNEEGLNYVSN

SEQ ID NO: 38864 - DNA, 1521 bp, Mannheimia succiniciproducens MBEL55E
  CDS (1)..(1521): transl_table=11
atgacagcacaatcagcgcaaagtgataatcaagtgctactcaccatgacaaacgtgagtaaatctttccctggtgtaaaagcgctagataaagcaaatttaactgtcaaatcccattccgttcacgcccttatgggagaaaacggtgcgggtaaatctactttattaaaatgcctgtttggtatttatgccaaagatgaaggggaaattctttttcttggtaaaccggtaaatttcaaaacgtcgaaagaagcgctggaaaatgggatttccatggtgcaccaagaactcaatctcgtccgtcagcgtaatgtaatggataatctttggttgggccgctatccgttaaaaggcgtgtttgtggatcatacaaaaatgtataacgataccaaagccatttttgacgagctcgatatcgacattgatccgagagaaaaagttgccaatttatccgtttcgcaaatgcaaatgatagaaattgccaaagctttctcttataacgcaaagatcgtaatcatggatgaacctacttcttctctttccgaaaaagaagtggagcatttatttaaaatcatcgaaaaattaaaagatcgcggttgcggaatcgtttatatttcccacaaaatggatgaaatctttaaaatttgcgatgaaattaccattttgcgcgacggtaaatggattaatacggtgccggtaaaaggctccactatggaacaaattgtcgccatgatggtaggccgtgaattaacgcaacgcttcccgccaaaaatcaacgagccgaaagaagtgattcttgaggtggaacatttaaccgcattaaaccaaccttccattcaggatattaattttgaattacgcaaaggtgaaattctggggatcgccggtcttgtgggggcaaaacggaccgatatcgtcgaaaccattttcggtgtgcgcgagcgtaaatccggtacggtaaaacttcatggcaaaattatgaaaaatcgtaccgcacttgaagccatcaacaacggctttgctctggtaaccgaagaacgccgttccaccgggatttacgcaaacctgagtattgaatttaactcattgatttcaaatatgaaatcctatatgaacaaatggggcttattgagtgacaagaaaatgaaaagcgatactcaatgggtaatcgattcaatgaacgtgaaaaccccgtcccataaaactaccatcggctcgctttccggcggtaaccaacaaaaagtggttatcggccgctggttgctcacacaacctgaaattctgatgctggacgaaccgacccgtgggattgacgtgggcgcgaaatacgaaatttatcaacttattatgcaacttgcccaaaaagacaaaggtatcattatgatctcttcggaaatgcccgaattattagggattaccgaccggattttagtaatgagcaacggtaaagttgccggtattgttgaaacagcaaaaacttcgcaagaagaaattttgcaactagctgctaaatatttatag

SEQ ID NO: 38865 - protein, 506 aa, Mannheimia succiniciproducens MBEL55E
MTAQSAQSDNQVLLTMTNVSKSFPGVKALDKANLTVKSHSVHALMGENGAGKSTLLKCLFGIYAKDEGEILFLGKPVNFKTSKEALENGISMVHQELNLVRQRNVMDNLWLGRYPLKGVFVDHTKMYNDTKAIFDELDIDIDPREKVANLSVSQMQMIEIAKAFSYNAKIVIMDEPTSSLSEKEVEHLFKIIEKLKDRGCGIVYISHKMDEIFKICDEITILRDGKWINTVPVKGSTMEQIVAMMVGRELTQRFPPKINEPKEVILEVEHLTALNQPSIQDINFELRKGEILGIAGLVGAKRTDIVETIFGVRERKSGTVKLHGKIMKNRTALEAINNGFALVTEERRSTGIYANLSIEFNSLISNMKSYMNKWGLLSDKKMKSDTQWVIDSMNVKTPSHKTTIGSLSGGNQQKVVIGRWLLTQPEILMLDEPTRGIDVGAKYEIYQLIMQLAQKDKGIIMISSEMPELLGITDRILVMSNGKVAGIVETAKTSQEEILQLAAKYL

SEQ ID NO: 38866 - DNA, 1494 bp, Mannheimia succiniciproducens MBEL55E
  CDS (1)..(1494): transl_table=11
gtgaaaatgactgataccaatattctgacgctgaaaaatatttcaaaaagttttttcgacgtaacggttttggaagatatcaatctggatatcagatgcggcgaggtgctttgtctgattggggaaaacggcgcaggaaaatccaccctgtgtaagattatcgcagggatctacagccgtgatacgggcgaaatgctttatcaggggcaaccctattcccccactacggtaaaagaagcgcaggaagcgggcatcggctttatccatcaggaattaatgctggtaccgaaactcacggtgatggaaaatatttttctcggtgcggaaaaaaccttatccttcggtcgtatgaactggtcggaaatgcgtgaaaaaacccagcatattatcgacgaactggaactggatattaaacccgacgatttaatcgccgatctttccattgcccagcaacaaatggtagaaatcgccaaagctgttttcagcgaatataaaatcattattttcgacgaaccgacatcctctatttcccgcaaaaacacggaagtgttgttcaaaatcattcatcagctgaaaaccaaaaacgtggcgatgatttatatttcccaccgtctggaagaattcaaatatattgccgatcgcgttaccgtactgcgggacggacgtattaccggtaccatgcgttacgaagaaacttcaccggaagacattgtacgtttaatggtgggacgcaaagtggatttcagccgttatcgccgcgataccgtatttacccaagaaaaactacgggtggaaaacattcaaagcaagcatatcagcccgatttcctttcaggtaaacaaaggtgaaatcttaggctttgccggtctggtaggtgccggccggaccgaagttttacgcgccgtttacggggcggacgaagcaaccggcaagatttatatcgatcaaaaagaaatcagcattcattcaccggaagatgcggttaaacacaaaatcggctttattaccgaagaccgtaaatcccaagggttagtgcttggtatgagtatccgtgaaaatatcaccttaccgatcttgaaacgcttctggaacggttggcagttggataaaaagaaagagcgagaagtggtggaagccaaccgcagcaagttgcatatcgtatccaaggatcaggaacagcagactaaaaccctgtcgggcggtaatcaacaaaaagtgattttagcccgttggctggaaagcggcgtggatattctgttttttgacgaaccgacgcgcggtatcgatatcggcgccaagtcggaaatctatgacttaatgcggcagtttaccgaaaacggcggaaccattgtgatggtatcgtctgatttgccggaactcatcaccatttccgatcgcgtcatcgtgatgcgtaacggcgaaaaagtaaaagaaatcgccaatcgcgacgacattacggaagaaaatttaatgcatgccatgatcggtatttaa

SEQ ID NO: 38867 - protein, 497 aa, Mannheimia succiniciproducens MBEL55E
MKMTDTNILTLKNISKSFFDVTVLEDINLDIRCGEVLCLIGENGAGKSTLCKIIAGIYSRDTGEMLYQGQPYSPTTVKEAQEAGIGFIHQELMLVPKLTVMENIFLGAEKTLSFGRMNWSEMREKTQHIIDELELDIKPDDLIADLSIAQQQMVEIAKAVFSEYKIIIFDEPTSSISRKNTEVLFKIIHQLKTKNVAMIYISHRLEEFKYIADRVTVLRDGRITGTMRYEETSPEDIVRLMVGRKVDFSRYRRDTVFTQEKLRVENIQSKHISPISFQVNKGEILGFAGLVGAGRTEVLRAVYGADEATGKIYIDQKEISIHSPEDAVKHKIGFITEDRKSQGLVLGMSIRENITLPILKRFWNGWQLDKKKEREVVEANRSKLHIVSKDQEQQTKTLSGGNQQKVILARWLESGVDILFFDEPTRGIDIGAKSEIYDLMRQFTENGGTIVMVSSDLPELITISDRVIVMRNGEKVKEIANRDDITEENLMHAMIGI

SEQ ID NO: 38868 - DNA, 1521 bp, Burkholderia mallei ATCC 23344
  CDS (1)..(1521): transl_table=11
atggacacgatactggcgctcaccggcatcacgaagcggtttcccggcgtcgtcgcgctgcgcggaatcgatctgcgcgtcgcgcgcggcgagattcacgcgctgctcggcgagaacggcgcgggcaagtcgacgctgatgaagatcctctgcgggatccacccgccggacgagggcgtgatcgcgctcgacggcgagccgcggcgcttcgcgaaccatcacgacgcgatcgcggcgggcgtcggcatcgtgtttcaggagttcagcctgattccggagctgaacgcggtcgacaatctgttcctcggccgcgagtggcgcggccggctcgggctgcgcgagcgcgcgcggatgcgccgcgcggcggcggacatcttcgcgcggctcgacgtcgcgatcgatctgtcggcgccggtgcgcgagctgtcggtcgcgcagcagcagttcgtcgagatcggcaaggcgctgtcgctcgacgcgcggctgctgatcctcgacgagccgaccgcgacgctcacgcccgccgaagccgcgcacctgttcggcgtgatgcgcgagctcaagcgccggggcgtcgcgatgatcttcatctcgcaccacctcgacgagatcttcgaggtgtgcgatcggatcaccgtgctgcgcgacgggcaatacgtcggcacgaccgaggtcgcgcgcaccgatgtcggcgcgctcgtcgagatgatggtgggccggcgcatcgagcagagctttccgccgaagccgcgtcttgcgcgcgacgccgcgcccgtgctcgaggtggacgcgctgcaggtgcgcgagaacggccccgtgaaccgcttcgcgctgcgcgagggcgagattctcggcttcgcgggcctcgtcggctccgggcgcacgtcgagcgcgctcgcgctgatcggcgcgaagcccgcgcgcgtgcggcgaatgcgcgtgcgcggccgcccggtgcgcctcgccgatcccgccgccgcgctcgccgcgggcatcggcctcctgccggagagccgcaagacgcaggggctcatccccgcgttctcgatccggcacaacatcgcgatcaacaacctcggcaagcaccgccggctgcgctggttcgtcgacgcggcggccgagacgcgcacgacgctcgagctgatgcagcggctcggcgtgaaggcgccgacgccgcacacgcgcgtcgacacgctctcgggcggcaatcagcagaaggtcgtgatcgcgcgctggctcaaccatcacacgcggatcctgatcttcgacgagccgacgcgcggcatcgacatcggcgcgaaggcggaaatctatcaactgatgcgcgagctgagcgcgcgcggctattcgatcgtgctgatctcgagcgagttgccggagatcgtcggcctgtgcgatcgcgtcgcggtgttccggcagggccgtatcgaggcgatgctcgaaggcgaggcgatcgagccgaacacggtgatgacctatgcgacttccgacgtacgcggagcgaatcatgaacatgcatga

SEQ ID NO: 38869 - protein, 506 aa, Burkholderia mallei ATCC 23344
MDTILALTGITKRFPGVVALRGIDLRVARGEIHALLGENGAGKSTLMKILCGIHPPDEGVIALDGEPRRFANHHDAIAAGVGIVFQEFSLIPELNAVDNLFLGREWRGRLGLRERARMRRAAADIFARLDVAIDLSAPVRELSVAQQQFVEIGKALSLDARLLILDEPTATLTPAEAAHLFGVMRELKRRGVAMIFISHHLDEIFEVCDRITVLRDGQYVGTTEVARTDVGALVEMMVGRRIEQSFPPKPRLARDAAPVLEVDALQVRENGPVNRFALREGEILGFAGLVGSGRTSSALALIGAKPARVRRMRVRGRPVRLADPAAALAAGIGLLPESRKTQGLIPAFSIRHNIAINNLGKHRRLRWFVDAAAETRTTLELMQRLGVKAPTPHTRVDTLSGGNQQKVVIARWLNHHTRILIFDEPTRGIDIGAKAEIYQLMRELSARGYSIVLISSELPEIVGLCDRVAVFRQGRIEAMLEGEAIEPNTVMTYATSDVRGANHEHA

SEQ ID NO: 38870 - DNA, 1512 bp, Burkholderia mallei ATCC 23344
  CDS (1)..(1512): transl_table=11
gtggctgcggcactgcgttttgacaatatcggcaaggtctttcccggcgtgcgtgcgctcgacggcatttcgttcgacgtgcaggcgggacaggtgcacgggctgatgggcgagaacggggcgggcaagtcgacgctgctcaagattctcggcggcgaatatcagctcgattcgggcagcgtgctcgtcgacgggcgggcgatgcgctttccgagcgcggccgcgtcgatcgcggcgggcgtcgcggtgatccatcaggagctgcaatacgtgcccgatctgacggtggccgagaacctgctgctcggccggctgccgagcgcgctcggctgggtccgcaagcgcgacgcgcagcgcttcgtgcgcgagcggctcgccgcgatgggcgtcgatctcgatgcgcaggcgaagctgcggcggctgtcgatcgcgcagcggcagatggtcgagatctgcaaggcgctgctgcgcaacgcgcgggtgatcgcgctcgacgagccgacgagctcgctgtcgcatcgcgagaccgaggtgctcttcaagctcgtcgacgatctgcgccgcgacggccgcgcgctcatctacatctcgcaccggatggacgagatctaccggctctgcgacgcgtgcacgatctttcgcgacggccgacaggtggcgtcgcacgcgtcgctcgccaacgtgccgcgcgagacgctcgtgcggcagatggtcggccgcgagatcagcgacatctatcactacgcgccgcgcgcgctcggcgacgtgcgcctgtcggcgcgcgcgctcgagggcgatgcgctgcgcgcgggggcgagcttcgacgtgcgcgcgggcgagatcgtcggctttttcgggctcgtcggcgcggggcgcagcgaactgatgcgcgtgatctacggcgcgcagcgcaggacgggcggcgcgctcatgctggacggcgagccgctcgacatccgctcgacgcgcgacgcgatccgccgcgggatcgtgctgtgccccgaggatcgcaaggaagagggaatcgtcgcgcatgcgtcggtcgccgagaacatcaacatcagttgccgccgccacgggctgcgcgcggggctttttctcgaccgcaagcgcgaggccgagacggccgatcgcttcatcaagctgctgaagatcaagacgcccaaccgccggcagaagatccgcttcctgtcgggcggcaatcagcagaaggcgattctcgcgcgctggctcgccgagccggatctgaaggtcgtgatcctcgacgagccgacgcgcggcatcgatgtcggcgcgaagcacgagatctacggcgtgatctacgagctcgcgaagcgcggctgcgcgatcgtgatggtgtcgtccgagctgccggaagtgctcggcgtatcggatcgcatcgtcgtgatgcgcgaagggcggatcgcgggcgagctcgcgcgcggcgaagcgaacgaagaggcggtgctcaatctcgcgctgccgcagggcgcgaccgcgcacgccgcgtga

SEQ ID NO: 38871 - protein, 503 aa, Burkholderia mallei ATCC 23344
MAAALRFDNIGKVFPGVRALDGISFDVQAGQVHGLMGENGAGKSTLLKILGGEYQLDSGSVLVDGRAMRFPSAAASIAAGVAVIHQELQYVPDLTVAENLLLGRLPSALGWVRKRDAQRFVRERLAAMGVDLDAQAKLRRLSIAQRQMVEICKALLRNARVIALDEPTSSLSHRETEVLFKLVDDLRRDGRALIYISHRMDEIYRLCDACTIFRDGRQVASHASLANVPRETLVRQMVGREISDIYHYAPRALGDVRLSARALEGDALRAGASFDVRAGEIVGFFGLVGAGRSELMRVIYGAQRRTGGALMLDGEPLDIRSTRDAIRRGIVLCPEDRKEEGIVAHASVAENINISCRRHGLRAGLFLDRKREAETADRFIKLLKIKTPNRRQKIRFLSGGNQQKAILARWLAEPDLKVVILDEPTRGIDVGAKHEIYGVIYELAKRGCAIVMVSSELPEVLGVSDRIVVMREGRIAGELARGEANEEAVLNLALPQGATAHAA

SEQ ID NO: 38872 - DNA, 1482 bp, Burkholderia mallei ATCC 23344
  CDS (1)..(1482): transl_table=11
gtgactcctgttctgctcgaagcaagccaggtggcgaagcgattcaacggcgtgagcgcgttgcgcgacggacgcctgagccttgcggccggccgcgtgcatgcgctgtgcggcggcaacggcaccggaaaatccacgttcctgaacatcctgatggggctcttgcgccgcgacgagggcacgatccggctgaacggccgcgatgtcgatttcgcgtcgcccgccgaagcgctcgcgagccgcatggcgatcatcacgcaggagctctcgccggtgccggggatgacggtcgccgagaacctgtatcttggtcgcgagcccacccgcgcgggcgtcgtcgtcgatttccgcgcgctgaagcgccgcgcgcaggcgctgctcgaccggctcggcttcgcgatcgacgcgggcgcgccgatgcatcggctgagcctcgcgcagacgcagctcgtcgagatcgcgaaagcgttcagccacgattgccaggtgatgatcatggacgagccgacttccgcgatcggcgagcgcgagaccgagacgctgttcgccgcggtccgcaacgtcaccgcgcacggcgcgggcatcatctacgtgtcgcaccggctgagcgagctgttcgacatcgccgacgactacacggtgtttcgcgacggcgcgtacgtcgagagcggccgcctcgccgatatcgaccgcgcgcatctcgtgcgcgcgatcgtcggccgcgagatgcccgtcgtcgacaaggcgcgccggcccgcgcacggcgagctgtgcctgaaggtggagggcctcacgcgcgcgaacgagttcgaggacgtgagcctcgacgtgcggcgcggcgagattctcggcatctatgggctgatgggctcgggccgcagcgaattcctcaattgcgtgtatggcttgacgcgccccgacgcgggcgccgccaccctcggcggcaagccgctgccgcgcggcgagcccgcgcggtcgatccgcgcgggcatcgcgctcgtcaccgaggaccgcaaggattcgggcctcgtgctctgcggcagcgtgcaggagaacatcgcgatggccgcgtaccgtcgcctgtcgcgcggcggcgtgatccggcgctcgctcgtgcggcggctcgcgcaggcgatggtcgagcggctgcggatcaaggccgcttcgctgcgcatgccggtatcggcgatgagcggcggcaaccagcagaaggtcgtgctcgcgaaatgcctgtcgaccgagcccgtgctgctgctgtgcgacgagccgacgcgcggcatcgacgaaggcgcgaaacaggagatctaccggctgctcgatgcgttcgcgcgcgacggcggcgcggtgatcgtcgtgtcgtcggaggcgcccgagctgctgtatctgagcgaccggatcgccgtgttcaagggcggccgcgtcgccgccgtccgcccgggcgacggcgccacccaggaatccctgctccatctcgcttcatga

SEQ ID NO: 38873 - protein, 493 aa, Burkholderia mallei ATCC 23344
MTPVLLEASQVAKRFNGVSALRDGRLSLAAGRVHALCGGNGTGKSTFLNILMGLLRRDEGTIRLNGRDVDFASPAEALASRMAIITQELSPVPGMTVAENLYLGREPTRAGVVVDFRALKRRAQALLDRLGFAIDAGAPMHRLSLAQTQLVEIAKAFSHDCQVMIMDEPTSAIGERETETLFAAVRNVTAHGAGIIYVSHRLSELFDIADDYTVFRDGAYVESGRLADIDRAHLVRAIVGREMPVVDKARRPAHGELCLKVEGLTRANEFEDVSLDVRRGEILGIYGLMGSGRSEFLNCVYGLTRPDAGAATLGGKPLPRGEPARSIRAGIALVTEDRKDSGLVLCGSVQENIAMAAYRRLSRGGVIRRSLVRRLAQAMVERLRIKAASLRMPVSAMSGGNQQKVVLAKCLSTEPVLLLCDEPTRGIDEGAKQEIYRLLDAFARDGGAVIVVSSEAPELLYLSDRIAVFKGGRVAAVRPGDGATQESLLHLAS

SEQ ID NO: 38874 - DNA, 1572 bp, Burkholderia pseudomallei K96243
  CDS (1)..(1572): transl_table=11
atggattcgaccgacccagattcgacgcccgacacgccgacgctcgtcgtgaccggcatcggcaagacctatgccgagcccgtgctcgacgacgtgtcgctcgcgctgtatccgggcgaggcgctcgcgctgacgggcgagaacggcgcgggcaagagcacgctgtcgaagatcgtcgccgggctcgtcgcgccgacgacgggcgcgatgcggctcgcgggcgccgagtatgcgccgcacagccgcgcgcacgcggaggcgctcggcgtgcggatggtgatgcaggagctcaatctcgtgccgacgctcaccgtcgccgagaatctctttctcgaccgcctgccgcaccgcttcggcgtgatcgaccgcaggcggcttgccgccgacgcgcgcgcggcgatggcgcgcgtggggctcgattcgctcgatcccgatacgctcgtcggctcgctcgggatcggccaccagcagatggtcgagatcgcgagaagcctcgcgggcgactgccgcgtgctgatcctcgacgagccgaccgcgatgctgaccgcgcgcgaagtcgagctgctgttcgatcagatcgcgcggctgaaggccgacggcgtcgcgctcgtctacatctcgcaccggctcgaggagctcgcgcgcgtcgcgcagcgggtggcggtgctgcgcgacggccggctcgtgcacgtcgaccggatcgacgcgcagccgaccgagcggctcgtcgcgctgatggccgggcgcgagatcgccgagcaggcggtgcacggcacgcgcacgccgggcgcgccgcgcctgcgggtggagcggctctcgtgcggcgacgcggtgcgcgacgtgtcgttcgacgtgcgcgcgggcgagattttcggcatttccgggctgatcggcgcggggcgcaccgagttgctgcggctcgtgtacggcgcggacgcggcggacggcggcaccgtgtcgatcggcgatccgccgcggccggcggcgatccgctcgcccgccgacgcggtgcgccacggcatcgcgctcgtcagcgaggaccgcaagggcgagggcctgctgctgccgcagtcgatcgcggcgaacctgtcgctcgggcaactggcgcgcgtcgcgcgcggcggcgtcgtcgacggggagcgggaaaacgcgctcgccgcgcggcagatcgacgcgctgcgcatccgcgcgcgcggccccgcgcagccggtggcggagctctcgggcggcaatcagcagaaggtcgcgatcggccgctggctcggccgcgacatgggcgtgctgctgttcgacgagccgacccgcggcatcgatgtcggcgcgaagttcgacatctatgcgctcctcgacgcgctcgcgcgcgagggccgcgcgatcgtcgtcgtgtcgagcgacctgcgcgagctgatgctgatctgcgaccggatcggcgtgatgtcggcgggacggatgcacgccgtgttcgagcgcggcgggtggacgcaggacgcgctcctcggcgcggcgttcgccggctacgcgcgccgcgacgcggcgctgcacccgcccggcggcgcgagctccgccgcgtga

SEQ ID NO: 38875 - protein, 523 aa, Burkholderia pseudomallei K96243
MDSTDPDSTPDTPTLVVTGIGKTYAEPVLDDVSLALYPGEALALTGENGAGKSTLSKIVAGLVAPTTGAMRLAGAEYAPHSRAHAEALGVRMVMQELNLVPTLTVAENLFLDRLPHRFGVIDRRRLAADARAAMARVGLDSLDPDTLVGSLGIGHQQMVEIARSLAGDCRVLILDEPTAMLTAREVELLFDQIARLKADGVALVYISHRLEELARVAQRVAVLRDGRLVHVDRIDAQPTERLVALMAGREIAEQAVHGTRTPGAPRLRVERLSCGDAVRDVSFDVRAGEIFGISGLIGAGRTELLRLVYGADAADGGTVSIGDPPRPAAIRSPADAVRHGIALVSEDRKGEGLLLPQSIAANLSLGQLARVARGGVVDGERENALAARQIDALRIRARGPAQPVAELSGGNQQKVAIGRWLGRDMGVLLFDEPTRGIDVGAKFDIYALLDALAREGRAIVVVSSDLRELMLICDRIGVMSAGRMHAVFERGGWTQDALLGAAFAGYARRDAALHPPGGASSAA

SEQ ID NO: 38876 - DNA, 1533 bp, Burkholderia pseudomallei K96243
  CDS (1)..(1533): transl_table=11
atggcaggaaacggaggcgacgtggctgcggcactgcgttttgacaatatcggcaaggtctttcccggcgtgcgtgcgctcgacggcatttcgttcgacgtgcaggcgggacaggtgcacgggctgatgggcgagaacggggcgggcaagtcgacgctgctcaagattctcggcggcgaatatcagcccgattcgggcagcgtgctcgtcgacgggcgggcgatgcgctttccgagcgcggccgcgtcgatcgcggcgggcgtcgcggtgatccatcaggagctgcaatacgtgcccgatctgacggtggccgagaacctgctgctcggccggctgccgagcgcgctcggctgggtccgcaagcgcgacgcgcagcgcttcgtgcgcgagcggctcgccgcgatgggcgtcgatctcgatgcgcaggcgaagctgcggcggctgtcgatcgcgcagcggcagatggtcgagatctgcaaggcgctgctgcgcaacgcgcgggtgatcgcgctcgacgagccgacgagctcgctgtcgcatcgcgagaccgaggtgctcttcaagctcgtcgacgatctgcgccgcgacggccgcgcgctcatctacatctcgcaccggatggacgagatctaccggctctgcgacgcgtgcacgatctttcgcgacggccgacaggtggcgtcgcacgcgtcgctcgccaacgtgccgcgcgagacgctcgtgcggcagatggtcggccgcgagatcagcgacatctatcactacgcgccgcgcgcgctcggcgacgtgcgcctgtcggcgcgcgcgctcgagggcgatgcgctgcgcgcgggggcgagcttcgacgtgcgcgcgggcgagatcgtcggctttttcgggctcgtcggcgcggggcgcagcgaactgatgcgcgtgatctacggcgcgcagcgcaggacgggcggcgcgctcacgctggacggcgagccgctcgacatccgctcgacgcgcgacgcgatccgccgcgggatcgtgctgtgccccgaggatcgcaaggaagagggaatcgtcgcgcatgcgtcggtcgccgagaacatcaacatcagttgccgccgccacgggctgcgcgcggggctctttctcgaccgcaagcgcgaggccgagacggccgatcgcttcatcaagctgctgaagatcaagacgcccaaccgccggcagaagatccgcttcctgtcgggcggcaatcagcagaaggcgattctcgcgcgctggctcgccgagccggatctgaaggtcgtgatcctcgacgagccgacgcgcggcatcgacgtcggcgcgaagcacgagatctacggcgtgatctacgagctcgcgaagcgcggctgcgcgatcgtgatggtgtcgtccgagctgccggaagtgctcggcgtatcggaccgcatcgtcgtgatgagcgaagggcggatcgcgggcgagctcgcgcgcggcgaagcgaacgaagaggcggtgctcaatctcgcgctgccgcagggcgcgaccgcgcacgccgcgtga

SEQ ID NO: 38877 - protein, 510 aa, Burkholderia pseudomallei K96243
MAGNGGDVAAALRFDNIGKVFPGVRALDGISFDVQAGQVHGLMGENGAGKSTLLKILGGEYQPDSGSVLVDGRAMRFPSAAASIAAGVAVIHQELQYVPDLTVAENLLLGRLPSALGWVRKRDAQRFVRERLAAMGVDLDAQAKLRRLSIAQRQMVEICKALLRNARVIALDEPTSSLSHRETEVLFKLVDDLRRDGRALIYISHRMDEIYRLCDACTIFRDGRQVASHASLANVPRETLVRQMVGREISDIYHYAPRALGDVRLSARALEGDALRAGASFDVRAGEIVGFFGLVGAGRSELMRVIYGAQRRTGGALTLDGEPLDIRSTRDAIRRGIVLCPEDRKEEGIVAHASVAENINISCRRHGLRAGLFLDRKREAETADRFIKLLKIKTPNRRQKIRFLSGGNQQKAILARWLAEPDLKVVILDEPTRGIDVGAKHEIYGVIYELAKRGCAIVMVSSELPEVLGVSDRIVVMSEGRIAGELARGEANEEAVLNLALPQGATAHAA

SEQ ID NO: 38878 - DNA, 1554 bp, Burkholderia pseudomallei K96243
  CDS (1)..(1554): transl_table=11
atgcagcgttctgatccgccccgcccgttgctcgagatgcgcggcatcagcaagacgttcccggccgtgcgcgcgctcgccggcgtgagcctcaccgtccatccgggcgaggtccattcgctgatgggcgagaacggcgcgggcaagtcgacgctcatgaagatcctgtcgggcgcgtatcaggccgatcccggcggcgagatcctgatcgacggccggccgatctcgatcgacgggccgctcgccgcgcgcgatgcgggcgtcgcggtgatctatcaggagctctgcctcgcgccgaacctgagcgtcgcggagaacatccatgtcggccgcgagctgcgccgcggcaacggccgccggggcacgatcgaccgcgccgcgatggcgcgcggctgtcaggacgtgctcgagcggctcggcgcggatttcgggccgaacacgctcgtcggcacgctgtcgatcgccgagcagcagctcgtcgagatcgcgcgcgccgttcacacccgggcgcgcatcctcgtgatggacgaaccgacgacgccgctgtcgtcgcgcgaaaccgataacctgttccggctgatccgccagttgcgcgccgaagggctcgcgatcatctacatcagccaccggatggcggaaatctacgagctgtccgaccgcgtctcggtgctgcgcgacggcgcgtacgtcggcacgctcgagcgcgacgcgctgtcggccgagcggctcgtcggcatgatggtcggccgcgatatttcgggcttctacaagaaagcgcacgcgccctacgatccgggcaacctgctgctgtcggtgcgcgacatcgcggacggcgcgcgcgtgcgcggctgcagcctcgatctgcacgcgggcgaagtgctcggcatcgcgggtcttgtcggcgcgggccgcaccgagctcgcgcggctcatcttcggcgccgagccgcgcgtgcgcggcgaggtgacgctcgccggcaaggcgttcgccgcgcattcgccgcgcgaggcgatcgacgccgggctcgtgtatctgaccgaggaccgcaagcgccagggcctgttcctcgacatgagcgtgcgcgagaacatcaacatctccgtgtgcgggcgcgacgcgcggctcggcgcgctcgatctcgcgcgcggcgcgcagcgcgcgcgcgacgcgatcgccgcgctgtcgattcgcgtgccgcatgcgaacgtgaacgtcggcgcgctgtcgggcggcaaccagcagaaggtgctgctgtcgcgcctgctggagacgaagccgcgcgtgctgattctcgacgagccgacgcgcggcgtcgacatcggcgcgaaatccgagatctaccggatcatcaacgagctcgcgcgcgccggcgtcggcgtgatcgtgatctcgagcgagctgccggagatcatcggcgtggccgaccgcgtgctcgtgatgcgcgaaggccgcattgccggcgagctcggcgggcgcacggacgcgccgatcacgcaggaggcgatcatcgcgctcgccaccggctcccgcaccgaagcgtcggccgcgcactga

SEQ ID NO: 38879 - protein, 517 aa, Burkholderia pseudomallei K96243
MQRSDPPRPLLEMRGISKTFPAVRALAGVSLTVHPGEVHSLMGENGAGKSTLMKILSGAYQADPGGEILIDGRPISIDGPLAARDAGVAVIYQELCLAPNLSVAENIHVGRELRRGNGRRGTIDRAAMARGCQDVLERLGADFGPNTLVGTLSIAEQQLVEIARAVHTRARILVMDEPTTPLSSRETDNLFRLIRQLRAEGLAIIYISHRMAEIYELSDRVSVLRDGAYVGTLERDALSAERLVGMMVGRDISGFYKKAHAPYDPGNLLLSVRDIADGARVRGCSLDLHAGEVLGIAGLVGAGRTELARLIFGAEPRVRGEVTLAGKAFAAHSPREAIDAGLVYLTEDRKRQGLFLDMSVRENINISVCGRDARLGALDLARGAQRARDAIAALSIRVPHANVNVGALSGGNQQKVLLSRLLETKPRVLILDEPTRGVDIGAKSEIYRIINELARAGVGVIVISSELPEIIGVADRVLVMREGRIAGELGGRTDAPITQEAIIALATGSRTEASAAH

SEQ ID NO: 38880 - DNA, 1518 bp, Burkholderia pseudomallei K96243
  CDS (1)..(1518): transl_table=11
atgagcaaaagctcagtcactctccgggatacgaccgtgactcctgttctgctcgaagcaagccaggtggcgaagcgattcaacggcgtgagcgcgttgcgcgacggacgcctgagccttgcggccggccgcgtgcatgcgctgtgcggcggcaacggcaccggaaaatccacgttcctgaacatcctgatggggctcttgcgccgcgacgagggcacgatccggctgaacggccgcgatgtcgatttcgcgtcgcccgccgaagcgctcgcgagccgcatggcgatcatcacgcaggagctctcgccggtgccggggatgacggtcgccgagaacctgtatcttggccgcgagcccacccgcgcgggcgtcgtcgtcgatttccgcgcgctgaagcgccgcgcgcaggcgctgctcgaccggctcggcttcgcgatcgacgcgggcgcgccgatgcatcggctgagcctcgcgcagacgcagctcgtcgagatcgcgaaagcgttcagccacgattgccaggtgatgatcatggacgagccgacttccgcgatcggcgagcgcgagaccgagacgctgttcgccgcggtccgcaacgtcaccgcgcacggcgcgggcatcatctacgtgtcgcaccggctgagcgagctattcgacatcgccgacgactacacggtgtttcgcgacggcgcgtacgtcgagagcggccgcctcgccgatatcgaccgcgcgcatctcgtgcgcgcgatcgtcggccgcgagatgcccgtcgtcgacaaggcgcgccggcccgcgcacggcgagccgtgcctgaaggtggagggcctcacgcgcgcgaacgagttcgaggacgtgagcctcgacgtgcggcgcggcgagattctcggcatctatgggctgatgggctcgggccgcagcgaattcctcaattgcgtgtatggcttgacgcgccccgacgcgggcgccgccaccctcggcggcaagccgctgccgcacggcgagcccgcgcggtcgatccgcgcgggcatcgcgctcgtcaccgaggaccgcaaggattcgggcctcgtgctctgcggcagcgtgcaggagaacatcgcgatggccgcgtaccgccgcctgtcgcgcggcggcgtgatccggcgctcgctcgtgcggcggctcgcgcaggcgatggtcgagcggctgcggatcaaggccgcttcgctgcgcatgccggtatcggcgatgagcggcggcaaccagcagaaggtcgtgctcgcgaaatgcctgtcgaccgcgcccgtgctgctgctgtgcgacgagccgacgcgcggcatcgacgaaggcgcgaaacaggagatctaccggctgctcgatgcgttcgcgcgcgacggcggcgcggtgatcgtcgtgtcgtcggaggcgcccgagctgctgtatctgagcgaccggatcgccgtgttcaagggcggccgcgtcgccgccgtccgcccgggcgacggcgccacccaggaatccctgctccatctcgcttcatga

SEQ ID NO: 38881 - protein, 505 aa, Burkholderia pseudomallei K96243
MSKSSVTLRDTTVTPVLLEASQVAKRFNGVSALRDGRLSLAAGRVHALCGGNGTGKSTFLNILMGLLRRDEGTIRLNGRDVDFASPAEALASRMAIITQELSPVPGMTVAENLYLGREPTRAGVVVDFRALKRRAQALLDRLGFAIDAGAPMHRLSLAQTQLVEIAKAFSHDCQVMIMDEPTSAIGERETETLFAAVRNVTAHGAGIIYVSHRLSELFDIADDYTVFRDGAYVESGRLADIDRAHLVRAIVGREMPVVDKARRPAHGEPCLKVEGLTRANEFEDVSLDVRRGEILGIYGLMGSGRSEFLNCVYGLTRPDAGAATLGGKPLPHGEPARSIRAGIALVTEDRKDSGLVLCGSVQENIAMAAYRRLSRGGVIRRSLVRRLAQAMVERLRIKAASLRMPVSAMSGGNQQKVVLAKCLSTAPVLLLCDEPTRGIDEGAKQEIYRLLDAFARDGGAVIVVSSEAPELLYLSDRIAVFKGGRVAAVRPGDGATQESLLHLAS

SEQ ID NO: 38882 - DNA, 1446 bp, Mycoplasma hyopneumoniae 232; identical to SEQ ID NO: 27402
  CDS (1)..(1446): transl_table=4

SEQ ID NO: 38883 - protein, 481 aa, Mycoplasma hyopneumoniae 232; identical to SEQ ID NO: 27403

SEQ ID NO: 38884 - DNA, 1539 bp, Mycoplasma hyopneumoniae 232
  CDS (1)..(1539): transl_table=4
ttgaaaaaaactaatattctatcactaaaaaaaataaaaaaagtttatggtcctgtaattgccctttctgatgtgacttttgttgttccaaaaggggaaataactagcctagttggcgaaaatggcgcgggaaaatcgacacttttaaaaattttatcaggagtgattcctgctggacaatatgaaggtgatctaatttttgaagataaaattatggcttttgcaaatacaaaagcctccgaacgtgtcggaattgcaataattcatcaagaactttcaatttcaccttatttatcaatttgcgagaacatgtatatcggtaattatccgactaaatttggcaaagttaactgaaataagatgatttccgaatgcaaaaaatatctagaaatggtcggtcttgatgaagatccaacaacaattgctggctccctttcgattgcaaaacagcaaatgattgagatcgcaaaagcactttcaaaaaatgcaaaactactaattttagatgaaccgacttcttctttaaatgatgaaaatgcttttcgcttacttgatattatgaaaagtttaaaaagtaaaggaattacttcgatttttgtctcccataaattaaatgaagtcaaatatgtctctgataatattgttgtaatccgcgatggtaaattcatttcccagtataataaaaatgaagaaataattgatgaaaaccggctaattcaggacattgttggccggcctttaaagtccaaatttcctccaagggatttagatcgaaaaatcggggaaattatttttgagatcaaagatatagttattcctcatgcaagtattgcaaattataatgttgtcaaaaatgcttcccttgatgtaaaacaaggcgaaattgtcggaatttccggacttgttggatcgggtcgaaccgaattaatgctttcactttttgggcagtattataacaaaccttcaagtggcaaagttttctataaaggtaaagaagtaaaatttactaacacaaaacaggcaatcaaatcgggaattatgtatgcttctgaagatcgaaaaaatgttggtctaatccaaattttttcgattcaaaataatatcacttccgccgctttgcatttattttcaaaatgaggaattctaaataaaaataaggaaataattaatgcccaaaaactaaaaaaagatgtaagtattaaaacaaaaaatattctaaataatgtcgaatccctttctgggggaaatcagcaaaaagttgtaattgccaaagctttaagtaccaaatttgaccttctaattatcgatgagccaacaaaaggtattgatgttggctcaaaatacgaaatttataaaattttactagacctttcatcgcaaggtaaaacaattattgtaatctcttcggaaattgaagaacttttaggaatcaccgatcgaatttttgtcatgtcccagggaattatcaaaggtcagataaaaacttctgaggcaaatcaagaaaaaattatgcaactaagtattgggggtcttatctaa

SEQ ID NO: 38885 - protein, 512 aa, Mycoplasma hyopneumoniae 232
MKKTNILSLKKIKKVYGPVIALSDVTFVVPKGEITSLVGENGAGKSTLLKILSGVIPAGQYEGDLIFEDKIMAFANTKASERVGIAIIHQELSISPYLSICENMYIGNYPTKFGKVNWNKMISECKKYLEMVGLDEDPTTIAGSLSIAKQQMIEIAKALSKNAKLLILDEPTSSLNDENAFRLLDIMKSLKSKGITSIFVSHKLNEVKYVSDNIVVIRDGKFISQYNKNEEIIDENRLIQDIVGRPLKSKFPPRDLDRKIGEIIFEIKDIVIPHASIANYNVVKNASLDVKQGEIVGISGLVGSGRTELMLSLFGQYYNKPSSGKVFYKGKEVKFTNTKQAIKSGIMYASEDRKNVGLIQIFSIQNNITSAALHLFSKWGILNKNKEIINAQKLKKDVSIKTKNILNNVESLSGGNQQKVVIAKALSTKFDLLIIDEPTKGIDVGSKYEIYKILLDLSSQGKTIIVISSEIEELLGITDRIFVMSQGIIKGQIKTSEANQEKIMQLSIGGLI

SEQ ID NO: 38886 - DNA, 1524 bp, Photobacterium profundum SS9
  CDS (1)..(1524): transl_table=11
atggtccctttattaaagatgacaaatatcgttaagtgttttggaacggtcaaagcacttgatggtgtcaatattcagctgcaacaaggtgagatcctctcgttgtgtggtgaaaatggttctggtaaatcaacgttaatgaaagtgttgtgcggtatttatccacacggcgactttgaaggggagatagtgtttgatgggcaagttgttgaggtaaaaacgattgcagagaccgaagcgttaggcattgcgattattcatcaagaattgaccctagtgaaagagctgtcggttttagagaacctgtttttaggtgctgaaattgagacatttggtgtgcttgattttgatcgcatgcacgcagaagccgtgaaattattaaagaaagtgaagcttgatgtaccacccgatacgcgggtgggagatctaggtgtcggacaacaacagcttattgaaatagcgaaggcactttcaaaaaatgcccgattactggtacttgatgaaccgacggcccccttgaccgaatctgaaaccgacatcttgctagagcttgttaatgacctgagggaagagggcgttagctgtatctatatttctcataaactcaacgaagtgaaagctatctctgatcagatctgcgttattcgtgatgggcagcatatcggcacccgtgatgctaagtcgatgacgacggatgacattattaccatgatggttggacgtgagatgaagcaactttttcctcgagaagaacacgatattggcgacattgtacttgaggtgaaaaatatcagcgcttggagtaaagccaatagtcatattcgtaaagtggatgatgtcagtttcgtgttacgaaaaggcgaaattcttggtgtgtcgggcttggttggggctgggcgcaccgaattaatggaatgcttgttcggttgttatcaagggcggtattctggtgaggtgtatttacagggacaaaaactgacattgcagagttgccatgacgcattggatgcggggattgccatggtaccagaagatcgaaagcgtcacggcattatcccaattatgtcagtaggagagaacattactctggcgagtttaacggcgtttacacaatctggtgttctgaatgacgtaaaagaggcgtctgcaatcagtgaatctataaaagcgttaaccgttaaaacaccgaatgccgatctcgcgattaaacacctttctgggggaaaccagcaaaaagcaattcttgcgcgtttcttgttggtgaatccaacggtattgattttagatgaaccgacccgagggatagatgttggcgcaaaatatgaaatttataaattaatgtttcagctcgtcaagcaagggatcagtgtgatcatggtgtcttctgagttacctgaggttctagggatcagtgatcgagtgcttgtgatgcatgaaggaaagataaaaggtgatttgattaacgacaacttgtcgcaagagcaaatcatggactgtgcgctatcggaaaaggtgacagcataa

SEQ ID NO: 38887 - protein, 507 aa, Photobacterium profundum SS9
MVPLLKMTNIVKCFGTVKALDGVNIQLQQGEILSLCGENGSGKSTLMKVLCGIYPHGDFEGEIVFDGQVVEVKTIAETEALGIAIIHQELTLVKELSVLENLFLGAEIETFGVLDFDRMHAEAVKLLKKVKLDVPPDTRVGDLGVGQQQLIEIAKALSKNARLLVLDEPTAPLTESETDILLELVNDLREEGVSCIYISHKLNEVKAISDQICVIRDGQHIGTRDAKSMTTDDIITMMVGREMKQLFPREEHDIGDIVLEVKNISAWSKANSHIRKVDDVSFVLRKGEILGVSGLVGAGRTELMECLFGCYQGRYSGEVYLQGQKLTLQSCHDALDAGIAMVPEDRKRHGIIPIMSVGENITLASLTAFTQSGVLNDVKEASAISESIKALTVKTPNADLAIKHLSGGNQQKAILARFLLVNPTVLILDEPTRGIDVGAKYEIYKLMFQLVKQGISVIMVSSELPEVLGISDRVLVMHEGKIKGDLINDNLSQEQIMDCALSEKVTA

SEQ ID NO: 38888 - DNA, 1494 bp, Photobacterium profundum SS9
  CDS (1)..(1494): transl_table=11
atgaaccaagttttattagaaatgcgtggtattaccaaaacatttcccggcgtaaaagcactcgataatgtgcaattaacgttaaaaaaaggtcgagtaatggctttaatgggagaaaatggtgcgggtaaatccaccctaatgaaagtgctgtttggtatttatcaacgcgactgcggcacgattcgttatcaaggagaacaggttaattacagtggtgctaaagaagcactagaagctggggtttcaatgatccaccaagagctatcccctattcttcaccgcagtattgctgaaaatatttggttagggcgtgaaccacttaagggtccattacgccttatcgaccacgcaaaaatgtaccgtgatacgactgaactcttaaaaaaattagatttgcacctcgacccacgtacgccaatgagcgaactcaccgtcgcgacaatgcaaatgatcgagatatctaaagcgatttcctacaattcaaaaattattattatggatgaacccacctctgctttaaccggtaaagaagtggaccatctgtttgaaatcatagaaaaattaaagaaacaaggcgtatccattgtttacattagccataaaatggatgaaatcttccgcatctgtgacgatataacagtatttcgtgatgggtgttacatcggcgaacgtgaagcacaaaataccaatcacgatgaacttgttcagatgatggtgggtcgtgatttaggcgatgtattcccgcctcctactgcaaaacctggaaaagtacgtcttgaagtaaaaaacctgagcgttgaaggtgtatttgacaacattagcttcaagctgcatgaaggtgaaattttaggtattgcagggcttgtcggcgctggacgcaccgagcttatcgaaaccttatttggggtaagaaagcacgatgtaggtgaaatctggattaacggcgaaaacgtcgaaatcaaaacgcctcaagatgcaatcagtcataaaatggcctttttaaccgaagatcgacgccaatcgggtctttatttgatgcttgatatcttcgctaatacctctattgctcatcttgatgcttaccgcaataaagtcgtgaacgtgcttgatgtacgttcgatgcaaaaagattgcgctagccagtgcaccaaattaaaagtcaaaacaccgggtatggcagaaaaaattgataacctcagcggcggtaatcaacaaaaggttcttcttgcacgttggatgctaaccaaaccagacatcctctttttagacgaaccaacgcgcggtattgatatcggtgcgaagtctgaaatttataaactaatgcgattactcacaggtatgggcaaaagcttagtcatgatctcgtctgaactgcctgaagtgataggaatgagcgaccgaatactggtcatgcatggaggcaagctgaagggtgaacttgacggtaaagatgcctctcagcaacaagtaatgtcaatggctttcaattaa

SEQ ID NO: 38889 - protein, 497 aa, Photobacterium profundum SS9
MNQVLLEMRGITKTFPGVKALDNVQLTLKKGRVMALMGENGAGKSTLMKVLFGIYQRDCGTIRYQGEQVNYSGAKEALEAGVSMIHQELSPILHRSIAENIWLGREPLKGPLRLIDHAKMYRDTTELLKKLDLHLDPRTPMSELTVATMQMIEISKAISYNSKIIIMDEPTSALTGKEVDHLFEIIEKLKKQGVSIVYISHKMDEIFRICDDITVFRDGCYIGEREAQNTNHDELVQMMVGRDLGDVFPPPTAKPGKVRLEVKNLSVEGVFDNISFKLHEGEILGIAGLVGAGRTELIETLFGVRKHDVGEIWINGENVEIKTPQDAISHKMAFLTEDRRQSGLYLMLDIFANTSIAHLDAYRNKVVNVLDVRSMQKDCASQCTKLKVKTPGMAEKIDNLSGGNQQKVLLARWMLTKPDILFLDEPTRGIDIGAKSEIYKLMRLLTGMGKSLVMISSELPEVIGMSDRILVMHGGKLKGELDGKDASQQQVMSMAFN

SEQ ID NO: 38890 - DNA, 1521 bp, Photobacterium profundum SS9
  CDS (1)..(1521): transl_table=11
atgctgccctttagctggaaacccatcatgtcaaacgaagcatttattaccttaaagcgtgtatccaagcattttggttccgttaaggcccttgatggcatcaacttaacttttaataaaggtgaagtgcattgcttagcagggaaaaatggttgtggaaaaagtaccttgtttaaagtgatttctggggtacatgcacctgaaaaaggtgcagagattgtacttgatgggaaaacctattcccgcttgaatccgcaacaatccatagagcatgggattcaggttatctatcaagatttatctttatttcctaaccttactgtcgctgaaaatattgctgtgcaagatcacatggcatggacgaaagggttagttaagcaagcgcgtttagatgcgatagccaaggctgcgatggataaagtgggggtatcacttcctttaactaaacgcgtagagcaactttctattgcggagtgccagttggtcgcgatttgccgtgcaatggcgtctgatgccaaacttgtcattatggatgaaccgacggcttctctgactcgcactgaagttaatagcttaattaaggtggttgcagatttaaaatccaaaggtatcactgttgtgtttgttagccacaagctggatgaggtcatggagatttctgatcgtataacggttattcgtgacggtaaaaccattggtacgtatccagcagaagaaatgaatagtgatgaattggctttcttaatgacggggcaacgttttgagtattctccgttaggtgaatataaacagcaaggagacgtgaagttagaggtcactaaccttactaaaaaaggtcagtttaatgatattaatcttcaagttcgtgctggtgagattgtctctattacggggctgttaggctcaggccgtactgagttatgtttggctttatttggtatgactcgaccagatagcggtcaaatgaaggttaatggcaaacttgttgaatttagttctaacagagaagcgattgctcatggcattggttatgtctcggaagacagaatgagtaccggattagtcatggagcaatccatacaagacaatactacagcgactgttctgtctcgattgaaaaagccgaatggttttcttgatcatgcaaaagcgacaaacttagtgaaaagactcatatcatcgttatcaattaaagttgctgatcctatgttaccagtgaccagtttgtcgggcggtaacgctcagcgaatttctattgctaagtggattgcggctgagcctgatgtgttgattctcgactctccaaccgtgggtgttgatattgcgaacaaagaaagtatttatcagatagcgaaagatctcgccttaaagggaatggctatcatcatggtgagcgatgaaattcctgaagtgttttacaacagccatcgtgtgattgttatgaaagatggacatttttcacatgaatttcatccaataacatcttcagaaaaagaaatcatggaggccgtcaatgcgtga

SEQ ID NO: 38891 - protein, 506 aa, Photobacterium profundum SS9
MLPFSWKPIMSNEAFITLKRVSKHFGSVKALDGINLTFNKGEVHCLAGKNGCGKSTLFKVISGVHAPEKGAEIVLDGKTYSRLNPQQSIEHGIQVIYQDLSLFPNLTVAENIAVQDHMAWTKGLVKQARLDAIAKAAMDKVGVSLPLTKRVEQLSIAECQLVAICRAMASDAKLVIMDEPTASLTRTEVNSLIKVVADLKSKGITVVFVSHKLDEVMEISDRITVIRDGKTIGTYPAEEMNSDELAFLMTGQRFEYSPLGEYKQQGDVKLEVTNLTKKGQFNDINLQVRAGEIVSITGLLGSGRTELCLALFGMTRPDSGQMKVNGKLVEFSSNREAIAHGIGYVSEDRMSTGLVMEQSIQDNTTATVLSRLKKPNGFLDHAKATNLVKRLISSLSIKVADPMLPVTSLSGGNAQRISIAKWIAAEPDVLILDSPTVGVDIANKESIYQIAKDLALKGMAIIMVSDEIPEVFYNSHRVIVMKDGHFSHEFHPITSSEKEIMEAVNA

SEQ ID NO: 38892 - DNA, 1515 bp, Photobacterium profundum SS9
  CDS (1)..(1515): transl_table=11
atgaaccagccaattttagaacttaaaggcattgaaaaagcattccctggtgtaaaagcgctagataatgcttgtttgaatgtttacccaggcaaggtaatggctttaatgggtgaaaatggtgccggtaagtcgacgcttatgaagtccttaactggaatctatgcgatggatgcaggtgaaattcgctaccaagggaaagccgttaacttcgatggccctcgccactctcaagaagctggcatcagtattattcaccaagaactgaacctgatccctgaattaaccattgctgagaatatctttcttggtcgtgaaaaaaccaatgcatttggtggcattaaatgggcagaaatgttccgtgaagccgatgatctacttaagcgcttaaacgtaaaacaccactcccgccaattattgggagagttaagccttggtgagcagcaaatggttgagattgcgaaagccttatctttcaaatctcaagtcatcattatggatgagccaaccgatgcactgacagatactgaaactgagtcgttgtttaaagtgattaatgagttgcgtgctgaaggttgcggtattgtgtatatctcgcaccgcctaaaagaaatcttcgaaatctgcgacgacattaccgtattacgagacggaaaattcattggtgaacgtgctgtagccgataccgatgaagacggcttgatcgaaatgatggtaggccgtcgcttagatgagcaataccctcgtattgatgtgcgccacggtgaaacctgccttgaagtaacaaacctgactggtgcaggtgtcaataatgtcagcttcaaactggatcgcggtgagatcttaggtgtatcaggcttaatgggtgcgggtcgtagcgaattaatgaaagtgatttacggtgccctaaagcgtgaatcaggcgatatcaaacttaacggcaaaaccattaacccagtaaccccacaagatggcttagcgaacgggattgcgtatatatcggaagaccgcaaaggtgatgggctggtacttgggttatcagtgaaagagaacatgtcgctatgttcactagaacagctttctaaaggtgttcagctaaaacattacgaagaagtgaccgcggtggaagatttcatccgcttattcaacatcaaaaccccaacgcgtgatcaaatcattggcaacctctctggcggtaaccaacagaaagtcgctatcgccaaagggttaatgacccgtcccaaagtcctgattttggatgagccaacccgtggtgtcgatgtaggggcaaagaaagagatttatcaactcatcaaccaatttaaagcggaaggcatgagcatcatcttagtttcttctgaaatgccagaagtactgggaatgagtgaccgcatcatagtgatgcacgaaggccgtattagcggtgaatttatggcagccgatgccaatcaagaaaaattactggcctgtgcggtaggtaaaaccaccgagcagaacaacgaggtagcagcatga

SEQ ID NO: 38893 - protein, 504 aa, Photobacterium profundum SS9
MNQPILELKGIEKAFPGVKALDNACLNVYPGKVMALMGENGAGKSTLMKSLTGIYAMDAGEIRYQGKAVNFDGPRHSQEAGISIIHQELNLIPELTIAENIFLGREKTNAFGGIKWAEMFREADDLLKRLNVKHHSRQLLGELSLGEQQMVEIAKALSFKSQVIIMDEPTDALTDTETESLFKVINELRAEGCGIVYISHRLKEIFEICDDITVLRDGKFIGERAVADTDEDGLIEMMVGRRLDEQYPRIDVRHGETCLEVTNLTGAGVNNVSFKLDRGEILGVSGLMGAGRSELMKVIYGALKRESGDIKLNGKTINPVTPQDGLANGIAYISEDRKGDGLVLGLSVKENMSLCSLEQLSKGVQLKHYEEVTAVEDFIRLFNIKTPTRDQIIGNLSGGNQQKVAIAKGLMTRPKVLILDEPTRGVDVGAKKEIYQLINQFKAEGMSIILVSSEMPEVLGMSDRIIVMHEGRISGEFMAADANQEKLLACAVGKTTEQNNEVAA

SEQ ID NO: 38894 - DNA, 1476 bp, Photobacterium profundum SS9
  CDS (1)..(1476): transl_table=11
atgacaggaataagtaaagagttccctggggttaaagctctcgataaagtaaacttgaaagtacgccctcattctattcacgcattaatgggagagaatggagcagggaaatcgacgttattaaaatgcttatttgggatctatgagaaaaacgaaggggatatcgttttcttaggtaaaagcattaatttttcatcatcaaaagaagcgctagaagccggtgtttctatggtgcaccaagaacttaatcaggttctgcagcgtaccgttatggataatatttggcttggccgttatccgacaaaaggtttctttgttgatcaaaagaaaatgtacgaagaaactaaaaaagtatttgaagaactcgatattgatatcgaccctaatgtaaaagtcgcgaccttatctgtatctcaaatgcagatgttagaaattgcaaaagcattttcttatgacgcaaaaattgtgattatggatgagccaacatcgtcattaactgaaaaagaagttaatcacctattcaagatcattaaaaagctaaaagagaaaggctgtggcattgtttacatttctcacaagatggaagaaatatttgaaatctgcgatgaaattaccattttacgggatggtatttgggttgatactcgcccgttagaaggtttaaccatggatcaaatcatcggcatgatggttggacgtgaactaacgcagcgatttcctgaaaaaacaaatacgccgaaagaaaccattttagctgtaaagaatttaacggcgttgaatcagccttctgttaacgatgttagttttgaacttcgtaaaggtgaaattctaggtattgctggattagtgggggcgaagcgaaccgatattgtagaaacattattcggtattcgtgaacgcagcagcggcgatattattttacatggtaaacacctaaagaataaagatgcccacgaagccattaataatggttttgcgttagtgacagaagagcgacgctctactgggatttatagcaacctcgatattacatttaattctttggtagcgaatgttgaacaatataaagaaggctttgggctactcagtaaccgaaaaatgaaaagcgatactcagtgggtaatcgatgccatgagtgtgaaaacaccgtcgcataaaaccatgattggttcgttatctggcgggaaccagcaaaaaatcattattggacgctggttattaaccggccctgaaatcttaatgttagatgagcctacgcgaggtattgatgttggtgcgaaatttgaaatctatcagctgatattagaattggcaaataaagataaagggataattattatctcttccgaaatgcctgaacttttaggtattactgatcgcatactcgtgatgagtaatggtcgtgctgctggcatcgtagaaacaaaaaataccacacagaatgaaattctcagtttggcctctcgttacctttaa

SEQ ID NO: 38895 - protein, 491 aa, Photobacterium profundum SS9
MTGISKEFPGVKALDKVNLKVRPHSIHALMGENGAGKSTLLKCLFGIYEKNEGDIVFLGKSINFSSSKEALEAGVSMVHQELNQVLQRTVMDNIWLGRYPTKGFFVDQKKMYEETKKVFEELDIDIDPNVKVATLSVSQMQMLEIAKAFSYDAKIVIMDEPTSSLTEKEVNHLFKIIKKLKEKGCGIVYISHKMEEIFEICDEITILRDGIWVDTRPLEGLTMDQIIGMMVGRELTQRFPEKTNTPKETILAVKNLTALNQPSVNDVSFELRKGEILGIAGLVGAKRTDIVETLFGIRERSSGDIILHGKHLKNKDAHEAINNGFALVTEERRSTGIYSNLDITFNSLVANVEQYKEGFGLLSNRKMKSDTQWVIDAMSVKTPSHKTMIGSLSGGNQQKIIIGRWLLTGPEILMLDEPTRGIDVGAKFEIYQLILELANKDKGIIIISSEMPELLGITDRILVMSNGRAAGIVETKNTTQNEILSLASRYL

SEQ ID NO: 38896 - DNA, 1551 bp, Geobacillus kaustophilus HTA426
  CDS (1)..(1551): transl_table=11
atgaacgggttgtcaatgcggggcatggaaaaatcgtttggcgccgtgcgcgtgctcgacggcgtggacttcgacgttcgtcctggcgaagtccacgcccttttaggcatgaacggcgccggcaaaagcacgctcatgaacattttggccggcgccattccgcctgacgctggtacgatcacgatcgacggtacgatatacacgttttcatcgccgcgcgaagcaaaacaagccggcatcggcctcgtcgttcaagaagttgacacagcgctctttcccggcttgccgatttacgaaaatgtagcggcggacgagttcgtccatgtgaagcaacggccgattcgctcgctgcgtcaagaaaaagagcgggccgccgccctgcttcgccgcgtcggcctgtcgttgccgccgacgaaattggttcgcgactgctcgctccatgaaaagcagctgattgtgctcgccaaagtgctgtcatccaacgcgcgctatatcatcctagacgaaccgacggccgccttaagcgaggcggaaacaaggcgtctgtttgccatcatcgatgaactgaagcagcaaggcgtcggctttatttacatctctcataaactgaaagaagttcaggagatcgctgaccggctgacgattttgcgcgacggccgcgtcgtctatcacggaggcgcccgcagcctgccgcttgaggacatcgtccttcatatgactggaacgaagcggaccgccgccgcgaaacaagcacgcacatacagaagcgacatcgcgtttgccgcccgcggaattttgatcgacaaaaccgggacaacagtcgacctatacgcccaccgcggcgaaatcgtcggcatcgctggcctcgtcggcgccggcaagacggagcttgccgaaagcctcatcgcccaccggaacacatccggcgagtgggaaattgatggcagacgctatgtgttctcatcgccttatgaagccatcgacgccggcctttgcctcatcccggaagaacggcgcaaacaagggttgtttttgcccgaatcagtgaaaacgaacttgaccgtccgccttctttcccgcctgtcgcgctggcaatggatcagctgggcgaaagaagcggctgaagccgacgggctcgtccgctcgctaggtgttcatccgccgtcaagcaccaccgtcgttcgccacttgagcggcggcaatcaacaaaaagtcgtcatcggcaaatggctcaacacaaacgcacgcgtctttttgtttgacgaaccgaccaaagggatcgacgtccatgcgaagcaagaggtgttttccatcattcgctcccttgccgatgaaggaaaaacggtgctgtacttttccagcgaatttcaagagctgcttgacatttgcgacaccatctacgtgatggtcgacggccggctgctcgctcgcctgccggccgctgaattgacgtatgaacagcttgtttactattgcagcggaggtgagatccatgagccagccagccgtttccacaacgccgtcgaaaaaaacggcgccgtccattcttga

SEQ ID NO: 38897 - protein, 516 aa, Geobacillus kaustophilus HTA426
MNGLSMRGMEKSFGAVRVLDGVDFDVRPGEVHALLGMNGAGKSTLMNILAGAIPPDAGTITIDGTIYTFSSPREAKQAGIGLVVQEVDTALFPGLPIYENVAADEFVHVKQRPIRSLRQEKERAAALLRRVGLSLPPTKLVRDCSLHEKQLIVLAKVLSSNARYIILDEPTAALSEAETRRLFAIIDELKQQGVGFIYISHKLKEVQEIADRLTILRDGRVVYHGGARSLPLEDIVLHMTGTKRTAAAKQARTYRSDIAFAARGILIDKTGTTVDLYAHRGEIVGIAGLVGAGKTELAESLIAHRNTSGEWEIDGRRYVFSSPYEAIDAGLCLIPEERRKQGLFLPESVKTNLTVRLLSRLSRWQWISWAKEAAEADGLVRSLGVHPPSSTTVVRHLSGGNQQKVVIGKWLNTNARVFLFDEPTKGIDVHAKQEVFSIIRSLADEGKTVLYFSSEFQELLDICDTIYVMVDGRLLARLPAAELTYEQLVYYCSGGEIHEPASRFHNAVEKNGAVHS

SEQ ID NO: 38898 - DNA, 1515 bp, Geobacillus kaustophilus HTA426
  CDS (1)..(1515): transl_table=11
atgcaatcatatgttttggaaatgaagggaattacaaaagagtttccaggggttcgggcgttggataacgtgactttttctgtccgtaagggagaaattcatgccctttgtggtgaaaatggtgcagggaagtctaccttgatgaaagtcttaagtggggtttatccatatggatcatatgatggaaagatctacatcgagggaaaagaagtccgatttagaaatattaaagagtctcaagaagcaggaattgcgattatttatcaagaactagctgtagtcgaggaaatgacggttgcggagaacttgtttctcggtcatgaactaatgcgaggtaaatatattgattggaatcgtttatattctgaggcacagaaatggttgcagaaaattgggttggacattgacccagagacaaaggttcgcaatttaacggtgggcaaacagcagttaattgaaattgctaaagcactctcaaaaaatgctaaaattattattttagacgaaccgacagcagcattaaccgatagtgatgttgccaccttaaaaaatattttgtgcgatcttcgttctcaaggagtaacttgcatttatatctcccatagactgaatgaagttatggaattggcagatacggtaaccgttttgcgtgatggccaaacaatcagcaccgatcgtatcgaactgctgacagaagagcagattattgcaaaaatggttggaagggaattaaatgaattatatccgtatgaaccaaggaatgttgggaaagaaattctcaaagttgaccactattctgtcattgatgaacaaacgggaagggaagtaattcacgatgtttcattttcattaaaagcaggggaaatcctcggaatctcaggattgatgggttcagggaggaccgaattgtttaccagcctattcggcgcctatcatggcaagaaaaaaggaacagtttggattgatgggaaacaagttgatattcgtcgtcctgcagaggcgattcagtacggaatggcgtatgtatctgaagaccgaaaaaagtatggtctcgttttagagatggatattattaagaattccactcttgtcgctttgaaaaaagtcacaaaatggaacgttattgatcatgcgttagaagtgaagcaggcagaagaaataacgaaaagaatgaaattaaaagctcctactttagaagcgaaagtatcccaactaagcggtggaaaccagcaaaaagtcgttttaagcaaatggcttttaaatagcccgaaaatattgattttggatgaaccgactcgcggaatcgatgtcggggcaaagtacgaaatttacaaaattattaacgagttagctagtcagggagtgggaattgttttaatttcatctgagttgccagaagtcatgggaatgtcggatcgcattttagtcatgtccgagggaagaataaccggggagtttcagcgtcatgaggccacccaagagaaaattatgacttgtgcaacgggaggaaaatga

SEQ ID NO: 38899 - protein, 504 aa, Geobacillus kaustophilus HTA426
MQSYVLEMKGITKEFPGVRALDNVTFSVRKGEIHALCGENGAGKSTLMKVLSGVYPYGSYDGKIYIEGKEVRFRNIKESQEAGIAIIYQELAVVEEMTVAENLFLGHELMRGKYIDWNRLYSEAQKWLQKIGLDIDPETKVRNLTVGKQQLIEIAKALSKNAKIIILDEPTAALTDSDVATLKNILCDLRSQGVTCIYISHRLNEVMELADTVTVLRDGQTISTDRIELLTEEQIIAKMVGRELNELYPYEPRNVGKEILKVDHYSVIDEQTGREVIHDVSFSLKAGEILGISGLMGSGRTELFTSLFGAYHGKKKGTVWIDGKQVDIRRPAEAIQYGMAYVSEDRKKYGLVLEMDIIKNSTLVALKKVTKWNVIDHALEVKQAEEITKRMKLKAPTLEAKVSQLSGGNQQKVVLSKWLLNSPKILILDEPTRGIDVGAKYEIYKIINELASQGVGIVLISSELPEVMGMSDRILVMSEGRITGEFQRHEATQEKIMTCATGGK

SEQ ID NO: 38900 - DNA, 1512 bp, Geobacillus kaustophilus HTA426
  CDS (1)..(1512): transl_table=11
atgagcgaagactatgtgctggaaatgatagacataaccaaagaatttccaggcgtcaaagcgttagacggtgtgcagctgaaggttaaaagaggcacggttcacgcgctcatgggagagaatggggctgggaaatcgacattgatgaaaattttaattggcatttacacgccggaccgaggcaagattatccttgacggcgaagagttgaaagtctccacgatcaaacatgcgcttgatagaggcatttcaatgattcaccaagagttaagccctgttccgaacatgacagtagcggaaaacatttttcttggcagggagccgagttatccgttcgccggctgggtcaaaatgaaagagctcgtcaaaaagacgaggcaactattcgaacggcttgagatcgatattgaccccaatgcgaagatggcggatttgagcatcgccaatatgcagatggtggaaattgcaaaggcgatttcttatcattcgaagctcattattatggacgaaccaacgtctgcgattacagagaaagaggttcaccaccttttccgaattatccgttcgttgaaaaaagagggagtctccattatttatattacccataagatggatgagctcgaacaaatcaccgatgaggtgaccgtgctgagggatggcaagtacatcgggacgaagccgagccatcaaatgacaagagatgaactcattcaaatgatggttgggcgggaactaaatcaaattttccataaaccaaaagtcccgattggggaagtggcgttgtcggttcaagggttgacgaaaaaagggaaatttcatgatgtgagctttgaagtgcgaaaaggggaaattgtcggatttgccggtttgatgggatccggaagaacggaagtattagaaagcgttttcggtgttaccaaaccggatgcgggagacatttatgtccacggaaaaaaggcgacgatccgctcgacgcgggatgcgattcggtatggaatgggattgttgacggaagaccgaaaactgacaggcctgtttttgccgctgtcggtcgaggacaacatgatcacggttacggtcaaccagtatacgaaggcaggctttttgcagcaacgaaaaatccgcgaagactgccaacggcttgctgaacagctttcgattaaaacaccgagcttgcagcagttgatcaaatacttaagcggaggcaatcagcaaaaggcactcattgcccgttggttgcttcacaacccggatattttgttcctcgatgaaccgacaaggggaatcgacgtaggagcgaaagcggaaatttatcatctgatttttgagctcgccaagaatggaaaagcgatcattgtggtttcgtctgaaatgccagaaatattaggattgagcgaccgggttattgttatgcatgaagggagaaaaatgggagaactaacgagggaagaagcgacccaagagcggattatgcagctggcaacgggccagctgatcgagacgaaaagataa

SEQ ID NO: 38901 - protein, 503 aa, Geobacillus kaustophilus HTA426
MSEDYVLEMIDITKEFPGVKALDGVQLKVKRGTVHALMGENGAGKSTLMKILIGIYTPDRGKIILDGEELKVSTIKHALDRGISMIHQELSPVPNMTVAENIFLGREPSYPFAGWVKMKELVKKTRQLFERLEIDIDPNAKMADLSIANMQMVEIAKAISYHSKLIIMDEPTSAITEKEVHHLFRIIRSLKKEGVSIIYITHKMDELEQITDEVTVLRDGKYIGTKPSHQMTRDELIQMMVGRELNQIFHKPKVPIGEVALSVQGLTKKGKFHDVSFEVRKGEIVGFAGLMGSGRTEVLESVFGVTKPDAGDIYVHGKKATIRSTRDAIRYGMGLLTEDRKLTGLFLPLSVEDNMITVTVNQYTKAGFLQQRKIREDCQRLAEQLSIKTPSLQQLIKYLSGGNQQKALIARWLLHNPDILFLDEPTRGIDVGAKAEIYHLIFELAKNGKAIIVVSSEMPEILGLSDRVIVMHEGRKMGELTREEATQERIMQLATGQLIETKR

SEQ ID NO: 38902 - DNA, 1542 bp, Geobacillus kaustophilus HTA426
  CDS (1)..(1542): transl_table=11
atgtctgagtttattttagaaatgagagggattacgaaacaattccctggagtgaaagcacttgataatgtgaatttaaaaatacgggaaggggaaattcacgcgctttgtggagagaatggagcaggaaaatcgacattaatgaaagtcttgagcggcgtttatccgtacggcacgtatgacggagaaattttatttaagggcgaagtatgtagatttaaagatattaaacagagcgaacagttaggaattgttatcattcatcaagagctggccttgattccctatttatccattgccgaaaatatttttttagggaatgaacgggcgaaaagaggcatcattaactggaatgaaacgatcgctcaaacaaaaaagctgttgcagaaagtcggattagaggagtcgccgcatacattggtcggccaacttggcgtcggcaagcagcaacttgtagaaatcgcgaaggcgttggctaaagatgtgaaattgcttattttggatgagccgaccgcagcgttgaatgaagatgacagcgaaaatttgctgaatttgcttttggaattgaaaaaacaggggttatcggccattattatttcccataaattaaatgaaattacgaaagtcgctgattcgatcacgattttacgagatggaaaaacaattgaaacgttggatatgaaacatgatgaggtgaccgaagaccggattatccgtggaatggtcggacgcgatttaacgaatcgctatccttcaagaacaccgaagataggcgaaatcatattcgaggtcaggaattggacagtatatcaccctgtttattcggagcgcaaagtgcttgataatatcaatctgtcgattcgcagaggagaaattgtggggatcgccggccttatgggggcgggacgaaccgaattggccatgagcatctttggtcggtcatacggaaagaaaattagcggagaaatatggaaaaacggggtcaaaatcgatgtcagcgatgtcagcaaggccattgccaacgggattgcctatgtaacagaagatcgaaaaggaaatggccttatcctaatggaagacattcggaaaaatattacgctttcccgtttaggaaaaatctcgaatcattttgtggtcgatgaaaatcaagaaattgttgaatcggagcgattccgtgaccaattcaaaattaaaacgccaagcgtatttcaaaaagtagaagcccttagtggcgggaatcaacaaaaagtggtgttaagcaaatggatttttgctgagccagatattttgattctcgacgaaccaacacgggggattgacgtcggcgcgaaatatgaaatttacacgatcattcagcagctagccgatgcagggaaaggtattttaatgatttcgtccgaacttccagaaattcttggcatgtgcgatcgaatttatgtgatgagtgaagggagaatcactggagaggtgtcgcgggaagaagcgacacaggaaaaactaatgaggcttatgacgaaaacagcgattcaggagggggcataa

SEQ ID NO: 38903 - protein, 513 aa, Geobacillus kaustophilus HTA426
MSEFILEMRGITKQFPGVKALDNVNLKIREGEIHALCGENGAGKSTLMKVLSGVYPYGTYDGEILFKGEVCRFKDIKQSEQLGIVIIHQELALIPYLSIAENIFLGNERAKRGIINWNETIAQTKKLLQKVGLEESPHTLVGQLGVGKQQLVEIAKALAKDVKLLILDEPTAALNEDDSENLLNLLLELKKQGLSAIIISHKLNEITKVADSITILRDGKTIETLDMKHDEVTEDRIIRGMVGRDLTNRYPSRTPKIGEIIFEVRNWTVYHPVYSERKVLDNINLSIRRGEIVGIAGLMGAGRTELAMSIFGRSYGKKISGEIWKNGVKIDVSDVSKAIANGIAYVTEDRKGNGLILMEDIRKNITLSRLGKISNHFVVDENQEIVESERFRDQFKIKTPSVFQKVEALSGGNQQKVVLSKWIFAEPDILILDEPTRGIDVGAKYEIYTIIQQLADAGKGILMISSELPEILGMCDRIYVMSEGRITGEVSREEATQEKLMRLMTKTAIQEGA

SEQ ID NO: 38904 - DNA, 1485 bp, Geobacillus kaustophilus HTA426
  CDS (1)..(1485): transl_table=11
ttgattgacatgcggtcgattcaaaaatcgtttggcgccaatatcgttctgaatggcgttgattttgaagtgcttcctggagaagtgcatgcgttgatgggagagaacggagcggggaaatcgacgctcatcaaggtgttgaccggcatttatgagcgggatgggggaacgattgttgtcaacgggcgcgaagtgcattaccgtcatccgaaagaggcggaacgcgacgggattgtcgtgattcatcaagagttgaatgtcattccaacattgacggtggccgaaaacatttttcttggccgcgagccgaaaatcgggagaacgggtgtcattcgttataaagaaatggagcaacaggccgcttcctatttgcggagattagggatggaccttgacccacgagaactcgccggtcggttgtctgtcggaaaacagcaaatgatcgaaattgccagggccatttcgacgaatgcgaagtgccttattatggatgaaccgacagcggcgctgacggaacgggaaattcaggctttattttctgttattcccaccttgaaacagcaaggcgtcgcggttgtttacatttcacatcggatggaagagatttttaccatttgcgaccggatttcggttctccgcgatggccagttcatcggaacgaaacgagtaaaggaaacgaacttcgatgaaattgttcaaatgatggtcggcaggcaaattggggaacgttttccaaaacggcgcgtcaccattggagaagaacggctgcgcgtagagcggctcacgaaaaaagggttgtttgagaatgtatcgttttccgtgcgagccggtgaagtgcttggtgtggcgggactgatgggatcggggcgaaccgagatcatggaagcgattttcggagccagaccattcgatgaaggagacatctatatcgacgggcgtcctgtgcgcatccgttctccgcgccaggccgtcgaacatggcatcgccatgattaccgaagaccgaaagcaaaaagggctcattctcgagatgagcgtccatgagaatttgaccttgccgaagttggaacaattagcaacagcgggattcatccagtcatcgaaagaacgggacgtggtgttgacatacattcatctgttgaatattaaagcctcttccccagatttacccgtgaaagcattgagcggcgggaatcaacaaaaagtcgtattcggcaaatggctggcgatgaacccgcgcatcctcattttggatgaaccgactcgcggcgtggatgttggggcaaagaaagagatttatgaagtgatcaatgaattggctgcccaaggcgccgcgatcattatgatctcttctgaactgccggaagtattgggcatgagcgaccgcgtcatggtcgtccatgaagggaaagtgcaagcgatcttggaaaacgacgggttggatcaagaaaccatcatgcgggcggcgacaggggggaatcgatga

SEQ ID NO: 38905 - protein, 494 aa, Geobacillus kaustophilus HTA426
MIDMRSIQKSFGANIVLNGVDFEVLPGEVHALMGENGAGKSTLIKVLTGIYERDGGTIVVNGREVHYRHPKEAERDGIVVIHQELNVIPTLTVAENIFLGREPKIGRTGVIRYKEMEQQAASYLRRLGMDLDPRELAGRLSVGKQQMIEIARAISTNAKCLIMDEPTAALTEREIQALFSVIPTLKQQGVAVVYISHRMEEIFTICDRISVLRDGQFIGTKRVKETNFDEIVQMMVGRQIGERFPKRRVTIGEERLRVERLTKKGLFENVSFSVRAGEVLGVAGLMGSGRTEIMEAIFGARPFDEGDIYIDGRPVRIRSPRQAVEHGIAMITEDRKQKGLILEMSVHENLTLPKLEQLATAGFIQSSKERDVVLTYIHLLNIKASSPDLPVKALSGGNQQKVVFGKWLAMNPRILILDEPTRGVDVGAKKEIYEVINELAAQGAAIIMISSELPEVLGMSDRVMVVHEGKVQAILENDGLDQETIMRAATGGNR

SEQ ID NO: 38906 - DNA, 1506 bp, Salmonella enterica subsp. enterica serovar Paratyphi A str. ATCC
  CDS (1)..(1506): transl_table=11
atggacgcattactgcaactcaaagggatcgataaagcgttccccggcgtgaaggctctctccggcgccgcgttaaacgtttatcctggccgcgttatggcgctgatgggggaaaacggcgccggaaaatccaccatgatgaaagtattaaccggcatctatacgcgagatgcgggatcgttgttatggctaggtaaagagaccacctttaatgggcctaaatcgtctcaggaagccgggatcggcattattcatcaggaactgaacctgattccgcagttgaccattgcggaaaatatcttcctgggccgtgagtttgtgaatcgctttggcaaaatcgactggaaaaagatgtatgccgaagccgaccagctcttagccaaactcaatctgcgctttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgaatctctgttccgcgttatccgcgaattaaaatcgcagagacgcggcattgtctatatctcccaccgtatgaaagagatcttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctgaaggtcgataatctgtgcggaccgggcgtgaatgatgtctcttttgtgctgcgaaaaggcgagattcttggcatctccggcctgatgggcgccggtcgcaccgagctgatgaaagtattgtacggcgcgatgcctcgaaccagcggttacgtgacgctcgatggacacgaagtggtgacgcgttctccgcaggacgggctggccaatggcatcgtttatatctctgaagaccgtaagcgcgatggactggtgctcggcatgtcagttaaagagaatatgtcgctgacggcgctggattatttcagccgcgctggcggaagcctgaaacacaaagatgagcagcaggcggtgggggattttatccgtctgttcaacgtcaagacgccgtcaatggaacaggcgataggcctgctttctggcggtaatcagcaaaaagtggcgattgcccgcgggttgatgacgcgcccgaaagtgctcattctcgacgagccgacccgcggcgtggacgtcggcgccaagaaagagatttaccagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 38907 - protein, 501 aa, Salmonella enterica subsp. enterica serovar Paratyphi A str. ATCC
MDALLQLKGIDKAFPGVKALSGAALNVYPGRVMALMGENGAGKSTMMKVLTGIYTRDAGSLLWLGKETTFNGPKSSQEAGIGIIHQELNLIPQLTIAENIFLGREFVNRFGKIDWKKMYAEADQLLAKLNLRFKSDKLVGELSIGDQQMVEIAKVLSFESKVIIMDEPTDALTDTETESLFRVIRELKSQRRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGAGRTELMKVLYGAMPRTSGYVTLDGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 38908 - DNA, 1536 bp, Salmonella enterica subsp. enterica serovar Paratyphi A str. ATCC; identical to SEQ ID NO: 27416
  CDS (1)..(1536): transl_table=11

SEQ ID NO: 38909 - protein, 511 aa, Salmonella enterica subsp. enterica serovar Paratyphi A str. ATCC; identical to SEQ ID NO: 27417

SEQ ID NO: 38910 - DNA, 1530 bp, Silicibacter pomeroyi DSS-3
  CDS (1)..(1530): transl_table=11
atgaccgtccccgccatcgagctcaaagggatttccaaatcctttgggcctgtgcaagcaaacaaggacatctcgatcagcgtcgcccccggcaccattcacggtatcatcggcgaaaacggtgcgggcaagtccaccctgatgagcatcctttacggcttctacaaggccgacaagggcgagatatggatcaacggcaagaagaccgagatcccagacagccaggcggccattgccgccgggatcggcatggtgttccagcatttcaagctggtcgagaattttaccgtgctggaaaacatcattctgggcgccgaggatggcgggttgctgaaaccctcgctggccaaggcccgccgcaccctggccgagctggccgccgaatacgagctgaatgtcgaccccgatgcggtgatcgaagagatcggcgtcggcatgcaacagcgggtcgagatcctcaaggcgctgtatcggcaggccgaaatcctgatcctggacgagccgaccggcgtgctgaccccggctgaggccgatcagctgttccgcatccttcaccggctcaaggacgagggcaagacgatcatcctgatcacccacaagctgcgcgagatcatggaggcgactgacacggtcagcgtcatgcggcggggcgagatgacggccaccgtcaagaccgccgaaaccagccccgaacatctggccgagttgatggtgggccgcaaggtgctgctgcgcgtcgacaaggtgcccgccaaacccggaaaaccgatcctggagatcgagaacctgcgcgtaaccgacgaaaagggcgtcgaacgtgtcaagggcatcgacctgaccgtgcgcgcgggcgagatcctgggcatcgccggcgttgccggaaatggccagtccgaactgctcgaggttctgggcggcatgcgcccgggcagcggcgcgatccggctgaacggcgctccgctgccgctgagcggacccggatccgacgcgcgcgcccgccgcaccgcccatgtggcccatgtgcccgaggatcgccagcgtgaaggtctgatcatggacttccacgcctgggaaaacgtcgcctttggctatcaccacgatccggcctatcaatccggcatcttcatgaacaacgccgccctgcgcgccgataccgagcgcaagatcgagaaattcgatgtccgccccgccgatggttggctggcagccaagaatttctcgggcggcaaccagcaaaagatcgtcgtggcacgcgagatcgagcgcaatcctgacctgctgctggtcggccaaccgacacgcggcgtcgatatcggcgccatcgagttcattcacaagcagatcgtcgccctgcgcgatcagggcaaggcggtgctgctggtctcggtcgagctggaggagatctttggcctcgccgaccggattgcggtgatgttcgacggccatatcatgggcgaacgcctgcccgacgagacggatgaaaaggaacttggcctcttgatggccggtgtcaacggggaggccgcctga

SEQ ID NO: 38911 - protein, 509 aa, Silicibacter pomeroyi DSS-3
MTVPAIELKGISKSFGPVQANKDISISVAPGTIHGIIGENGAGKSTLMSILYGFYKADKGEIWINGKKTEIPDSQAAIAAGIGMVFQHFKLVENFTVLENIILGAEDGGLLKPSLAKARRTLAELAAEYELNVDPDAVIEEIGVGMQQRVEILKALYRQAEILILDEPTGVLTPAEADQLFRILHRLKDEGKTIILITHKLREIMEATDTVSVMRRGEMTATVKTAETSPEHLAELMVGRKVLLRVDKVPAKPGKPILEIENLRVTDEKGVERVKGIDLTVRAGEILGIAGVAGNGQSELLEVLGGMRPGSGAIRLNGAPLPLSGPGSDARARRTAHVAHVPEDRQREGLIMDFHAWENVAFGYHHDPAYQSGIFMNNAALRADTERKIEKFDVRPADGWLAAKNFSGGNQQKIVVAREIERNPDLLLVGQPTRGVDIGAIEFIHKQIVALRDQGKAVLLVSVELEEIFGLADRIAVMFDGHIMGERLPDETDEKELGLLMAGVNGEAA

SEQ ID NO: 38912 - DNA, 1638 bp, Bacillus clausii KSM-K16
  CDS (1)..(1638): transl_table=11
ttgacagcggctactatgaggcgtcacagcttgatcaataacagcggcttgctaatagccgcttgctctaaaaaagaggtgaagcaaatggccgatattttgctggaaatgaaaaacattaccaagacgttttctggtgtaaaggcattaagcaatgtcaatttgaaagtgaaacgaggcgaaatccatgcgctttgcggggaaaatggcgcaggaaagtcgacgttaatgaaagtgctaagcggtgtttacggatacggtacgtacgaaggggacattttgtttgaaggcgatgtttgccgttttaaagacttgaaacaaagcgaagagaaacgaattgtcatcattcatcaagaacttgctctcatcccagagcttagcatcgccgaaaatatctttttaggaaatgaacaaaaacaacgcggcattatcgattgggccgaaaccgcaacgaaagcgcaagaactccttaaaaaagtgaaattggcagaatcaccccagacgctgattaaacatatcggtgttggcaaacaacaactggtggaaatcgccaaagcgctcgctaaaaacgtaaaattgctcatattagatgaaccgacggcttcactaaacgaaagcgacagcgaaaacttgctcaagctgttagcggaattaaaggaacaaggcgtgacgtctattatcatttcccataagttgaatgaaattaaggcaattgctgattcggttacgatcttacgggatggcaaaacaattgaaacacttgatttgcatacggaagatgtgagcgaagaccgcatcattcgagggatggtcggcagagatttaacaaaccgctatccagaagggcaaagtgagatcggcgatatcgtgttttcaatcgaaaattggaatgtgtttcatccagtgcaaagggatcggcaaatcatccatgatgtcaatttgcacgtgaaaaaaggcgagattgttggcattgctggcttaatgggcgctggtcgcacagaactggcgatgagtttatttggcagatcgtatggcacaaacataacgggcacgatcaaaaaagatggcaaagccatctcgatcccttctgtacgggcagcaatcgatcacggcctcgcctacgcgaccgaagaccgaaaatcctatgggctcgtgttgatgaatgatataaaagaaaacatcacactggccaacttgcctgccgtctccaaaaatcaaatcatcgatcaaatgaaagagacacaagtagcagaatcgtttatgaagaaattgcaaattaaagcgcattccattttgcaagaaacaggcaagcttagtggcggcaaccaacaaaaagttgtgttaagcaaatggattttatccgaccccgatgtattaatcttagacgaaccgacgcgtggaattgacgtcggcgcaaaatatgagatttatacgctcattcgcgagcttgctgctaaaggaaaagcaattctattgatttcttctgaactgccagaactacttggcatggccgaccgtgtttatacaatgaacaaagggcgcatcacaggagaactagaaaagaaagacctttcccaagagcttctgatgaggcgaatgacaatggaaatggaggatcaccatgaaagcatttcttaa

SEQ ID NO: 38913 - protein, 545 aa, Bacillus clausii KSM-K16
MTAATMRRHSLINNSGLLIAACSKKEVKQMADILLEMKNITKTFSGVKALSNVNLKVKRGEIHALCGENGAGKSTLMKVLSGVYGYGTYEGDILFEGDVCRFKDLKQSEEKRIVIIHQELALIPELSIAENIFLGNEQKQRGIIDWAETATKAQELLKKVKLAESPQTLIKHIGVGKQQLVEIAKALAKNVKLLILDEPTASLNESDSENLLKLLAELKEQGVTSIIISHKLNEIKAIADSVTILRDGKTIETLDLHTEDVSEDRIIRGMVGRDLTNRYPEGQSEIGDIVFSIENWNVFHPVQRDRQIIHDVNLHVKKGEIVGIAGLMGAGRTELAMSLFGRSYGTNITGTIKKDGKAISIPSVRAAIDHGLAYATEDRKSYGLVLMNDIKENITLANLPAVSKNQIIDQMKETQVAESFMKKLQIKAHSILQETGKLSGGNQQKVVLSKWILSDPDVLILDEPTRGIDVGAKYEIYTLIRELAAKGKAILLISSELPELLGMADRVYTMNKGRITGELEKKDLSQELLMRRMTMEMEDHHESIS

SEQ ID NO: 38914 - DNA, 1500 bp, Bacillus clausii KSM-K16
  CDS (1)..(1500): transl_table=11
atgattgttgaaatgagccagataagcaagtcatttagtggaaaccaagtattgaaaaatgtgtctttcacgcttgaaaaaggagaaattcacgcgttaatgggcgaaaatggtgctggtaagtctacccttatgaaaattttaacgggcatttatccaagggatgaaggggttgtccgtgtgaaagggaaggaggttgcctacacgcatccaaaagatgcggaaaaagacggaattgctgtcattcatcaagaactcaatattttgccagagctgtcagttgcagagaatttgtttcttggcaatgagtacaccgttggaaaaacgggttggcttaaaaccaaaaagatgaacgaatatgctgaacaacagctggccgagcttggtcttaaagtaaaagcttcggaccgggcaggtgctttatcagtcgggaagcagcaattgattgaaattgccaaagcccttatgacaaatgcagacattattattatggacgagccaacagcagcgctaacagaccgggagattgatacattgtttactgttattcgtggcttgcaggagaaaggcgtgactttcgtttatatatcgcaccgaatggaagaaatcttctccttgtgccaacgtattacagtccttcgtgatggaaactatgtgagcacgaaagtcattgccgagacgagttttgatgagatcgtcaaattaatggtcggtcgggagcttggaggtcgctatcctgatcatgatttagaaccaggtgcggtaaaactcgccgttaaaaatgtgagtagaaaaaatgaatttgaaagcgttacctttgaggtgcgggaaggtgaaatctttggtattgctggtttgatgggggcggggcgctcagaagtggtggaaagcatttttggctatcggcatttgcatagtggcacgattgaaattgatcaaaaaccagttgtatttaaacgaccggttgatgcaattgagaatggtattgcctttgtgccagaagaccgaaaaacaaaaggacttatcgttaatttttcagttcgggacaatctctccataacgaacttagcaactgtttcttcgggaaacatgatgtcttctacaaaagaacaggctctttatcaagaacttgtaaagaagttaggtgtccgtacctctggaccacaccaaaaagcgaaatcactgagtggaggaaaccagcaaaaagtggttatcgctaaatggcttggtatgaagccgaaagtgctcattttggatgaaccaactcggggcgttgatgtaggtgcgaaaaaagagatctatacaattatgaatgaactggccaagcaaggtgtggcaattataatggtttcttcagaactgccggaaattatcggcatgagcacacgcgttgccgtgatgtttgaaggcaaattaatgaaagtacttgaccgcaatgagttatcagaagaaacgattatgcactatgcgacgggaggagacaaacatgttcaccaataa

SEQ ID NO: 38915 - protein, 499 aa, Bacillus clausii KSM-K16
MIVEMSQISKSFSGNQVLKNVSFTLEKGEIHALMGENGAGKSTLMKILTGIYPRDEGVVRVKGKEVAYTHPKDAEKDGIAVIHQELNILPELSVAENLFLGNEYTVGKTGWLKTKKMNEYAEQQLAELGLKVKASDRAGALSVGKQQLIEIAKALMTNADIIIMDEPTAALTDREIDTLFTVIRGLQEKGVTFVYISHRMEEIFSLCQRITVLRDGNYVSTKVIAETSFDEIVKLMVGRELGGRYPDHDLEPGAVKLAVKNVSRKNEFESVTFEVREGEIFGIAGLMGAGRSEVVESIFGYRHLHSGTIEIDQKPVVFKRPVDAIENGIAFVPEDRKTKGLIVNFSVRDNLSITNLATVSSGNMMSSTKEQALYQELVKKLGVRTSGPHQKAKSLSGGNQQKVVIAKWLGMKPKVLILDEPTRGVDVGAKKEIYTIMNELAKQGVAIIMVSSELPEIIGMSTRVAVMFEGKLMKVLDRNELSEETIMHYATGGDKHVHQ

SEQ ID NO: 38916 - DNA, 1527 bp, Thermococcus kodakarensis KOD1
  CDS (1)..(1527): transl_table=11
atggaagaaaaaacgccgatacttgagatgagggacatcgtcaaggtttatcccgacggcactaaagcccttcacggggttaccgttcaggtttatgagggcgagatacttggtctcctcggtgagaacggtgctggaaaaacgactcttatgaagatcctctttggaatgctcaaaccaacaaatggtaaaatctttctcagggggaaagaggttcggtttaaaagccccgccgacgccatagcgaacggtatcggcatggttcaccagcatttcacgctcgttgatgtttttacggccctagagaacattatcctaggtatggagggtcacggcttattctccaagatagacctagaaaaagcgcgtggagagatcaaggccctcatggacgagctgaactttcaggtccccctcgatgtcccagtggagaacctccccgtcggcgttcagcagagggtcgagatactgaagatgctctaccgaaacgtggacatactgatcctcgacgagcccacggctgttctaacgccaatagaggtcaaggagctcttcgctgttctaaggaagctaaaggcccagggcaagactataatcttcatcagccacaagctcaatgaggtcatggagataacggaccgcgtcacagttataagaaagggcaaggtgatcgggactgttaagacgagcgaggcaactcctcagcttctagcgagaatgatggtcggcagggacgtagtccttagaatacaaaagcctccaaaggagcctggaaacacggttcttaaagttgagaacctgtgggtcaagggcgatcgcggagaggaagccgtaaggggagtttcctttgaggtcagagcgggggagatatttggaatagcgggtgttgaaggcaacggtcagagcgaactgatagaggccatatctggccttaggagagtcgaaaagggtaggatatacctcaatggagtcgacataaccggcaaaagtcccagggatctctacgacatgggttttgcacacataccggaggatagaacccacatggggctcgtaatcgagatgagcgtaatggagaactcgattctcggaatgcactggagaaaggagttctcacgtggctttgggcttatagactggggcagggtcaagaaacacgctagtgagcttatagaggagtttgagataagtgcccctggtgtgaatgcaccagcgaagagcttaagcggtggaaaccagcagaaactcatcgttgccagagaagtcagcaaaaagccagagtttataatcgcggcacagcctacaagaggcgttgatgtggcttcaaccgagtacatcaggaactacctcgtgaagctcagaaacgagaacaaggcggttctcctcgtctcggctgatctcgacgaggttctccagctgagcgacaggatggcaatcatgtacgaggggcaatttatgggggttgttaagcccgaggaagttaccgaggagcagatcggccttatgatgggaggtgtgaaagcatga

SEQ ID NO: 38917 - protein, 508 aa, Thermococcus kodakarensis KOD1
MEEKTPILEMRDIVKVYPDGTKALHGVTVQVYEGEILGLLGENGAGKTTLMKILFGMLKPTNGKIFLRGKEVRFKSPADAIANGIGMVHQHFTLVDVFTALENIILGMEGHGLFSKIDLEKARGEIKALMDELNFQVPLDVPVENLPVGVQQRVEILKMLYRNVDILILDEPTAVLTPIEVKELFAVLRKLKAQGKTIIFISHKLNEVMEITDRVTVIRKGKVIGTVKTSEATPQLLARMMVGRDVVLRIQKPPKEPGNTVLKVENLWVKGDRGEEAVRGVSFEVRAGEIFGIAGVEGNGQSELIEAISGLRRVEKGRIYLNGVDITGKSPRDLYDMGFAHIPEDRTHMGLVIEMSVMENSILGMHWRKEFSRGFGLIDWGRVKKHASELIEEFEISAPGVNAPAKSLSGGNQQKLIVAREVSKKPEFIIAAQPTRGVDVASTEYIRNYLVKLRNENKAVLLVSADLDEVLQLSDRMAIMYEGQFMGVVKPEEVTEEQIGLMMGGVKA

SEQ ID NO: 38918 - DNA, 1506 bp, Gluconobacter oxydans 621H
  CDS (1)..(1506): transl_table=11
atgacagttcttcagattgaaggcgtccggaagacctatcctggcgtggtggcgctcgatcatgtcgatctgacgctggagcccgggaagatccatattcttgcaggggagaacggcgccggcaaatccacgctcatcaagacgctgaccgggctggtcgtgccggatgagggaaccgtcttgatcgaaggacaggatgcgctgcatgaccggacactgttcgagaaggtcgcctatgtcccgcaggagctgaacctgttcgggccgatgaccgtagccgagaacatgttcatgccgttcaaccgttccgggttcgggcatctgacggtgtcgcgcggggctatggagaaggcggcggcggaactgatcgagcggttcggcattcatgcgaagccggggcagctcgtgaaccgcatcagcgtaccggatcagcagctccttcagattgcgcgcgcggcatgccgtgaagaattcaaggttctgatcctggacgagccgacctcgtcactgacagccaatgagacggagcatctgttccgcatcattcaccggctgcgcgacgagggctgcgcgatcgtgttcgtatcgcacaagatggaagaaatctttgcgctcggagacacggtgacggtgctgcgcaatggtcgcagcgtgggcacctatccgatggcggagatgacggaggggcacctgatccggctgatgtcgggcagttcggtctcgcttgaggagaagttccagccacgcatggctgcgtctgaaactgacgtcatattgagcgttaaagatatgtccgggccggggttctcggatgcgtcttttgtcctgcggcgtggagaaatcctgggctttgctggacttgtgggcgcgggacgctcggagctgatgcagacgatcttcggatatctgcgggcaacaggagggcacgccttcctcgaaggcgaggaaatcccgaaaggccgtaccgatcgggccgtggctctgggcatggtttacctgtccgaggagcgcaagcatcacggcattttcccgcttctgagtgtgcgggaaaatatcagtctctcggttctggatcgcatgaagtgcggcgggatcatttccccggcgcgtgagaatgaggtcgtggccgaaacgatccgccagttcgacgtgcgcacgtcctcggctggcaagaagatcgcacatctgtctggcggaaaccagcagaaggcaatcatcggccgggcgatggcgcggcggccgcgtgtgctgattttcgacgagccgaccaagggtatcgatatcggcacgaagttccagatctaccgcatcatgcagcagctcgcggaagagggcgtggggatcattctcgtctcgtccgaaatgaccgagctccagcgctgcgcttcgcggatcatcaccatgtattccggccggatcacggggtcgttcgatcaggccactactgacgtcaacacacttgtcggcgcgatcatcggcgccccggagaaccgtcatgtcgcttga

SEQ ID NO: 38919 - protein, 501 aa, Gluconobacter oxydans 621H
MTVLQIEGVRKTYPGVVALDHVDLTLEPGKIHILAGENGAGKSTLIKTLTGLVVPDEGTVLIEGQDALHDRTLFEKVAYVPQELNLFGPMTVAENMFMPFNRSGFGHLTVSRGAMEKAAAELIERFGIHAKPGQLVNRISVPDQQLLQIARAACREEFKVLILDEPTSSLTANETEHLFRIIHRLRDEGCAIVFVSHKMEEIFALGDTVTVLRNGRSVGTYPMAEMTEGHLIRLMSGSSVSLEEKFQPRMAASETDVILSVKDMSGPGFSDASFVLRRGEILGFAGLVGAGRSELMQTIFGYLRATGGHAFLEGEEIPKGRTDRAVALGMVYLSEERKHHGIFPLLSVRENISLSVLDRMKCGGIISPARENEVVAETIRQFDVRTSSAGKKIAHLSGGNQQKAIIGRAMARRPRVLIFDEPTKGIDIGTKFQIYRIMQQLAEEGVGIILVSSEMTELQRCASRIITMYSGRITGSFDQATTDVNTLVGAIIGAPENRHVA

SEQ ID NO: 38920 - DNA, 1479 bp, Lactobacillus acidophilus NCFM
  CDS (1)..(1479): transl_table=11
atgaaaattgaattgaatgatattaaaaaaaattttggtactaataaagtattaagaggtgtggattttaaagttaattcaggagaagttcatgctttaatgggagaaaatggtgctggaaaatcaactttaatgaatattttaacaggtctattaaaaaaagatgctggttcaattaaagttgacggacaagaaacaacatatgcgaatgcactggacgctgaacatcatggtatcagttttattcatcaagaaatgaataatttcccagaaatgagcgttgtagataacatttttttaaataaagaaattaaaaataaattcggcttgatgaatcaaaaattaatgaagaagaaggcaaaagcatatttagataaattaggttcggatatagatgtagatatgaagattggcaacttgacagtgggacaacaacaaatgatcgagattgctaaatctttaatgacaaatgcaaaaataataattatggatgaaccaacagcagcattgactgaaaatgaaacagatattttgtttaaaactattcgtgaattaaaaaaacaaaatgtaggatttatatatatttcacatagaatggaagaattatgggaaatatgtgatcgagtaacagttatgcgagatggtatatctatcaatacgtataatacaaaagacgtaaaagaagataaaattgttcatgatatggttggtagagatataggtgattactatccagaaagaaaaccaaaattaggccctgtagccttaaaagctgaaaatttgtcaggggaaaaattccataatatctcttttgaagttcatgagggtgaaattcttggattttctggcttgatgggcgctggtcgtacagaaacaatgagagctttgtttggaatagataaacttactagcggaaaaatttatcttgaaggaaaagaggtaaagctaaatagtcctagtgattctattaaacatggtattggttttttaactgaagatagaaaaaatgagggattagtattagatcaatctttagaagataatattgctttaccaagtattgatggttttagaaaacatggaattattgatcaaaaagcagaagataaatttgctgagatgctgatgaaacgtttaactgtaaaagcacaaagtgcagatgtttctgcaagaagtttatcaggaggtaatcaacaaaaagttgttttagctaaatgggtaggaagcggatcaaaagttttaattttggatgaaccaactcgaggtgtagatgttggtgctaaaaaagaaatttatgaattgatgaatcaattaactgacagacatgtagcaattattatggtttcaagtgatttgcctgaagtgttaagtatgagtgacaggattgaagttctatatgaaggaaaacagatgggagttgttgatgcaaaaggtgccactcaggagcaagtaatgaaactagctacgggaggaaagtaa

SEQ ID NO: 38921 - protein, 492 aa, Lactobacillus acidophilus NCFM
MKIELNDIKKNFGTNKVLRGVDFKVNSGEVHALMGENGAGKSTLMNILTGLLKKDAGSIKVDGQETTYANALDAEHHGISFIHQEMNNFPEMSVVDNIFLNKEIKNKFGLMNQKLMKKKAKAYLDKLGSDIDVDMKIGNLTVGQQQMIEIAKSLMTNAKIIIMDEPTAALTENETDILFKTIRELKKQNVGFIYISHRMEELWEICDRVTVMRDGISINTYNTKDVKEDKIVHDMVGRDIGDYYPERKPKLGPVALKAENLSGEKFHNISFEVHEGEILGFSGLMGAGRTETMRALFGIDKLTSGKIYLEGKEVKLNSPSDSIKHGIGFLTEDRKNEGLVLDQSLEDNIALPSIDGFRKHGIIDQKAEDKFAEMLMKRLTVKAQSADVSARSLSGGNQQKVVLAKWVGSGSKVLILDEPTRGVDVGAKKEIYELMNQLTDRHVAIIMVSSDLPEVLSMSDRIEVLYEGKQMGVVDAKGATQEQVMKLATGGK

SEQ ID NO: 38922 - DNA, 1515 bp, Vibrio fischeri ES114
  CDS (1)..(1515): transl_table=11
atgactcaagctatcttagaattaaacggcattgagaaagccttccccggagtgaaagctctggatggtgcttgtcttaatgtctatcccggcaaagtcatggccctgatgggtgaaaatggcgcgggtaaatcaaccttaatgaagtcactaacgggcatctacgcaatggatgctggcgaaatccgctatgaaggcaaagcggttaactttaatggtcctaaacactctcaagaatctggtattagtattattcaccaagagttgaacctaattcctgaattgaccattgcagaaaacatcttcttaggccgtgaaaaaaccaatgcgtttggcgggatcaaatggtctgaaatgtacaaagatgctgatgccctactcaaacgtttgaatgtaaaacaccactctcgccaactattaggtgaactgagtttaggtgaacaacaaatggttgaaattgccaaagctctatcattcaaatccaaagttatcatcatggatgaaccgacagatgcgttaacggataccgaaaccgaatcgctatttaaagtaattaacgaactacgtgatgaaggttgtggcattgtttatatctcgcaccgtctaaaagagatcttcgagatctgcgatgacattacagtactgcgtgatggtaaattcatcggtgaacgtgtcgttgcggatatcgatgaagacacactaattgaaatgatggtaggccgtcgtcttgatgagcaataccctcgcatcgatgttcaacatggtgaaaaatccctagagctattcgatgtatcaggtcctggtgttcataatgttagcttttcattagaccgtggggaaatccttgggatctcaggtttaatgggcgcaggccgtactgaattgatgaaaatcatctacggtgcactgccaatgacttgtggtgctatcaagctaaacaacaaaatgattaaccctatttcaccacgtgatggattagctaatggcatcgcctacatctcagaagaccgtaaaggtgatggtctggttcttggattatcggttaaagagaacatgtcgatttgttctttagatcaattatcgaaaggcattcaattagatcatcatgcggaagtcaccgcggttgaagactttattcgtttattcaacattaagacccctactcgtgatcaaatcattggtaatttatctggtggtaatcaacaaaaagtagccattgctaaaggattaatgactcgtccaaaagtattgattttagatgaaccaacacgtggcgttgatgttggtgcgaaaaaagagatctaccaattaattaaccaatttaaagcggaaggcatgagcatcattttagtctcatctgaaatgcctgaagttctaggaatgagtgaccgcatcctagttatgcatgaaggccgtattagtggcgaattcatggcaaaagatgccgaccaagaaaaattattggcttgtgcagtaggtaaaactgttgagcaaaatgtagaggtaacagcatga

SEQ ID NO: 38923 - protein, 504 aa, Vibrio fischeri ES114
MTQAILELNGIEKAFPGVKALDGACLNVYPGKVMALMGENGAGKSTLMKSLTGIYAMDAGEIRYEGKAVNFNGPKHSQESGISIIHQELNLIPELTIAENIFLGREKTNAFGGIKWSEMYKDADALLKRLNVKHHSRQLLGELSLGEQQMVEIAKALSFKSKVIIMDEPTDALTDTETESLFKVINELRDEGCGIVYISHRLKEIFEICDDITVLRDGKFIGERVVADIDEDTLIEMMVGRRLDEQYPRIDVQHGEKSLELFDVSGPGVHNVSFSLDRGEILGISGLMGAGRTELMKIIYGALPMTCGAIKLNNKMINPISPRDGLANGIAYISEDRKGDGLVLGLSVKENMSICSLDQLSKGIQLDHHAEVTAVEDFIRLFNIKTPTRDQIIGNLSGGNQQKVAIAKGLMTRPKVLILDEPTRGVDVGAKKEIYQLINQFKAEGMSIILVSSEMPEVLGMSDRILVMHEGRISGEFMAKDADQEKLLACAVGKTVEQNVEVTA

SEQ ID NO: 38924 - DNA, 1551 bp, Salmonella enterica subsp. enterica serovar Choleraesuis str
  CDS (1)..(1551): transl_table=11
atgcgaacgtcattctttgcgctggcgtcactttctgaggccgctatggacgcattactgcaactcaaagggatcgataaagcgttccccggcgtgaaggctctctccggcgccgcgttaaacgtttatcctggccgcgttatggcgctggtgggggaaaacggcgccggaaaatccaccatgatgaaagtattaaccggcatctatacgcgagatgcgggatcgttgttatggctgggtaaagagaccacctttaacgggcctaaatcgtctcaggaagccgggatcggcattattcatcaggaactgaacctgattccgcagttgaccattgcggaaaatatcttcctgggccgtgagtttgtgaatcgctttggcaaaatcgactggaaaaagatgtatgccgaagccgaccagctcttagccaaactcaatctgcgctttaagagcgataagctggtgggcgaactctctatcggcgatcagcaaatggtggaaatcgccaaagtgctgagcttcgaatccaaagtcatcattatggatgaaccgaccgatgcgctgaccgacactgaaaccgactctctgttccgcgttatccgcgaattaaaatcgcaggggcgcggcattgtctatatctcccaccgtatgaaagagatcttcgaaatttgcgatgacgtgacggtcttccgcgatgggcaatttatcgccgagcgtgaagtggccacgttgaccgaagattctcttatcgaaatgatggtgggacgtaagctggaagatcagtacccgcatctggataacgcgccgggtgagattcgcctcaaggtcgataatctgtgcggaccgggcgtgaatgatgtctcttttgtgctgcgaaaaggcgagattcttggcatctccggcctgatgggcgccggtcgcaccgagctgatgaaagtattgtacggcgcgatgccgcgaaccagcggttacgtgacgcttgatggacacgaagtggtgacgcgttctccgcaggacgggctggccaatggcatcgtttatatctctgaagaccgtaagcgcgatggactggtgctcggcatgtcagttaaagagaatatgtcgctgacggcgctggactatttcagccgcgctggcggaagcctgaaacacaaagatgagcaacaggcggtgggggattttatccgtctgttcaacgtcaagacaccgtcaatggaacaggcgataggcctgctttctggcggtaatcagcaaaaagtggcgattgcccgcgggttgatgacgcgcccgaaagtgctcattctcgacgagccgacccgcggtgtggacgtcggcgccaagaaagagatttatcagcttatcaaccagtttaaggccgacggcctgagcatcattctggtctcatctgagatgccagaagtattaggcatgagcgatcgcatcatcgtcatgcatgaagggcatctcagcggtgaatttactcgcgagcaggccacccaggaagtgttaatggctgccgcagtgggcaagcttaatcgcgtgaatcaggagtaa

SEQ ID NO: 38925 - protein, 516 aa, Salmonella enterica subsp. enterica serovar Choleraesuis str
MRTSFFALASLSEAAMDALLQLKGIDKAFPGVKALSGAALNVYPGRVMALVGENGAGKSTMMKVLTGIYTRDAGSLLWLGKETTFNGPKSSQEAGIGIIHQELNLIPQLTIAENIFLGREFVNRFGKIDWKKMYAEADQLLAKLNLRFKSDKLVGELSIGDQQMVEIAKVLSFESKVIIMDEPTDALTDTETDSLFRVIRELKSQGRGIVYISHRMKEIFEICDDVTVFRDGQFIAEREVATLTEDSLIEMMVGRKLEDQYPHLDNAPGEIRLKVDNLCGPGVNDVSFVLRKGEILGISGLMGAGRTELMKVLYGAMPRTSGYVTLDGHEVVTRSPQDGLANGIVYISEDRKRDGLVLGMSVKENMSLTALDYFSRAGGSLKHKDEQQAVGDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 38926 - DNA, 1536 bp, Brucella abortus biovar 1 str. 9-941
  CDS (1)..(1536): transl_table=11
atgactgcgccgcgtcaggctggcgagcctgctcttctggaagccgtttctctgtccaaatcctttgggccggtgcaggttctggaaaatataaatctgcgcgtcaacggtggtgaaattcacgcgatcattggtgaaaatggcgcgggtaaatccacgctcatgaaaattctggccggtaacgaacgccagacgggcggagaaatccgtattgatggcaagccggtttccttttccagcccggcagcagcagaggcacgaggcatcgtgctggtgcatcaggaaatcctgcttgcaccagacctgacagttgcgcagaacatatatctcggtcgtgaacttgggggtaagcggggacgcggactactggtcgatgatcggtcgatgcgcgagggcgcgcgcagggctatccgtgatctcggcgctgaaatagacccggatgccgtggttgcgacgctatcaattgcccaacgccagcttgtgcagattgcacgggtgctgttggtgccgcatcgcctcgtgatcttcgatgagccgacggcttcgctcacgcctttcgagacggaagcccttctgaaagtcatccgtgatattcgagccaagggcgttgcggttctctatatttcgcatcggctgccggaagtgaaggagatagccgaccgtgtgactattctgcgtgacggcaagctggtttccagccatttggcatcctctttgcagccggctgatatggcgcggctgatggttgggcgcgatgtcgccaagctctatcccgatcgcgcaagccggtatgacagcgccgctattctggaagtagaaaacttcagtgtgccgggcttcgtgcgcaatgcaagtttttgtctgaaccgtggcgagatacttggctttgccggtctggttggtgcgggccgaacggagcttatggaaggaatcgtcggtttgcgcccagccaagggagaattgcgccatgatggtaggctggtgcacttcaacaatgcacatgacagccagcaggcgggcatcgtttatctgagcgaagaccgtaaaggcaaagggctgctcctgtcgaaagatctcggcaccaatctcaccctggcttcacttgacaggttcgtgcgcggcctccagatcgaccgcaaccgcgaacgtgtggcgttggatgaggcgatccgtgcattcgacatacgcacgggccgtaaggatatcctggccggtcagctttcaggcggcaaccagcagaaactgcttcttgccaaaatgatgatgcttaccccgtccatcatcatcatagacgagccgacgcgaggcatcgatgtcggcacgaaggagcagatttatcagttcattgccaacctggcggatgaaggaaaatccatcattgttgtatcgtccgaaatgccggaactgatcggtatttgcgaccgtatcgtggtgatgcgggaggggcaaattgccggggaggtgagcggcgcaggcatgacggaacatgaaattgtggcgctcgccaccggcgttggcgccaacgaggctgcatga

SEQ ID NO: 38927 - protein, 511 aa, Brucella abortus biovar 1 str. 9-941
MTAPRQAGEPALLEAVSLSKSFGPVQVLENINLRVNGGEIHAIIGENGAGKSTLMKILAGNERQTGGEIRIDGKPVSFSSPAAAEARGIVLVHQEILLAPDLTVAQNIYLGRELGGKRGRGLLVDDRSMREGARRAIRDLGAEIDPDAVVATLSIAQRQLVQIARVLLVPHRLVIFDEPTASLTPFETEALLKVIRDIRAKGVAVLYISHRLPEVKEIADRVTILRDGKLVSSHLASSLQPADMARLMVGRDVAKLYPDRASRYDSAAILEVENFSVPGFVRNASFCLNRGEILGFAGLVGAGRTELMEGIVGLRPAKGELRHDGRLVHFNNAHDSQQAGIVYLSEDRKGKGLLLSKDLGTNLTLASLDRFVRGLQIDRNRERVALDEAIRAFDIRTGRKDILAGQLSGGNQQKLLLAKMMMLTPSIIIIDEPTRGIDVGTKEQIYQFIANLADEGKSIIVVSSEMPELIGICDRIVVMREGQIAGEVSGAGMTEHEIVALATGVGANEAA

SEQ ID NO: 38928 - DNA, 1479 bp, Brucella abortus biovar 1 str. 9-941
  CDS (1)..(1479): transl_table=11
ttggaatttctgctcgatgtggaggggctcaggaagtcctttggcggtgttgctgccttgcgggatgggcggctgcaattgcgtaccggctcggtacatgcgctgtgcggcggcaatggcgcgggcaaatccacgtttttgaaaatcctgatgggcattcatgcccgcgatggtggacatatccgccggcgtggaaaagaggttacgtattccagccccgccgaagcgttgcaggcgggtatcgcgatcatcgaacaggagctaagccccgttccccatatgaccgtggcggagaatatctatttgggcagggagccgcttcgccgtttcggtggcatcgatttcaagacgatgaacctcaatgcccagaagcttttggaccagcttgagttcaagattcgcgccaaccagttcatgatgaacctgcctgtcgcgcaggtgcagcttgtggaaatagccaaggcgctcagtcacgacgctgaagtcattttcatggacgaaccgacatcggccattggtgaaaaagaagcacagcagctttttgcagcgatagagcgtttgaaagcgagcggaaaaggcattgtctatgtctcccatcgcctgtcggaaatttttcagattgccgatagctataccgtgtttcgcgacggcagttatatcgatagcggcggtctcggtggcatcacccgtgcggaactgatccatatgatcgtcgggcgggaactgggtgaggaatatatcaagacgaatgcgcctacggaaataccgggcgtcgaggtttccggcctcagcgcgcccggcaagataaccgacatttcctttaccgcgcataagggcgagatttttggcatttacgggttgatggggtcaggccgctcggaaatattcaactgtcttttcggattggagaaagcctcccaaggaacaattcggcttgaaggcgaacccgtcaccgtccggcgccccgcggacgccatggctctggggctggcttttgtgacggaagatcgcaagctgaccggcctcaatctcggcgacagcgttcgcaacaatatatgccttgccagccttcccgagatgagtccgcatttttcaatgaatcggcgtgcggaatcggccgccagcagggagatgatcgagcgtttcaggatcaaggttgcgcacgacacgatggccgtttcgggcctttccggcggcaaccagcagaaggtcgtgctcggaaaatggttcctgcgaaagccatgcgttctgctgctcgatgaacccactcgcggtgtcgatgtgggtgcaaaacaggaaatttatcgcatcatttgcgaatttgccgcccaaggcgggaccgtcgtcatggtttcttccgagattgatgaagtcctcggcatgtctgaccgcatcatggtcatgcgtggcggacaatcggtcggcatctaccgcagggcggaaacggacgcgcagtcattggtgcatctttcgacatga

SEQ ID NO: 38929 - protein, 492 aa, Brucella abortus biovar 1 str. 9-941
MEFLLDVEGLRKSFGGVAALRDGRLQLRTGSVHALCGGNGAGKSTFLKILMGIHARDGGHIRRRGKEVTYSSPAEALQAGIAIIEQELSPVPHMTVAENIYLGREPLRRFGGIDFKTMNLNAQKLLDQLEFKIRANQFMMNLPVAQVQLVEIAKALSHDAEVIFMDEPTSAIGEKEAQQLFAAIERLKASGKGIVYVSHRLSEIFQIADSYTVFRDGSYIDSGGLGGITRAELIHMIVGRELGEEYIKTNAPTEIPGVEVSGLSAPGKITDISFTAHKGEIFGIYGLMGSGRSEIFNCLFGLEKASQGTIRLEGEPVTVRRPADAMALGLAFVTEDRKLTGLNLGDSVRNNICLASLPEMSPHFSMNRRAESAASREMIERFRIKVAHDTMAVSGLSGGNQQKVVLGKWFLRKPCVLLLDEPTRGVDVGAKQEIYRIICEFAAQGGTVVMVSSEIDEVLGMSDRIMVMRGGQSVGIYRRAETDAQSLVHLST

SEQ ID NO: 38930 - DNA, 1533 bp, Brucella abortus biovar 1 str. 9-941
  CDS (1)..(1533): transl_table=11
atgcaggtttcatccaggcctgtcgtggacgcgccggctccgctgctcgaagcgcgcaacgtgttcaaggggtttttcggcaacccggtgctgaagggggtcagcatcgccttgcggcccggccgcgtgcacgcactgcttggagaaaacggtgcgggcaagtccacactcatcaatctgctgtccggcgccttgccgccggacagcgggaatattgtgctggaaggtgcagctctttccagattgaacccggcgcaagcgcggaaagcgggcattgctgtcattcagcaggaacttagtctgacgccggaattgtcgattgcagaaaatatcgggcttggcgcctatccgcgccgtttcggcctgatcgactacaaggcccttcacggggaagccttggccgtttgtaaacgtgtcggcctgaccgaaccgctcgaaactccggtcggcacactgtcgctcgggcgcaggcagatggtcgagattgccaaggcgcttttccgcaaaccgcgggtgctcatccttgatgagccgacatcatcgctatctgcgcatgaggcgggcgtattatcatcgctggttctcaaattgcgcgatgagggcgtcgcacttctctatatctctcacaggctcaacgaaattcgctcgctctgttctcatgtgaccgtgctcaaagacggtgtcgtgaccgcagatcagtcattatcaaattcggacccggaggagctagttcgcctgatggtcgggcgtgatactggcgaccttttccccgcttggcgaaccagtgccaccggcgaaaaacggattcatattcgcggcatgagcgcgggtatggtgcagaatgtcgatatggatgccaatgcgggcgagatcatcggtatcggcggtctggttgggcaaggacaggaagattttctgctgggtctctatggtgcgctgccgaccgcagcccgtgaagcgatagtgtgcggaaataacggcctgttcaaatcggttggcgcggcaaacgcggctggccttgcctatgtcccggcggatcggaagcgggaagggctcgtgctgccgcattccattgcgtcaaacctgctcctgccgtcacttgatcgatatacgcggcacggtttgcgcaacacggcaaacgagcagcgtgtcgttgccaaacttgccgaacggctgacgatcaggggagatactgcgcgcccggttcaggcgctgtccggcggcaatcagcaaaaggttgcgcttgccaaatggcttccgctggaacctacaatcctgttgctgaacgatccaacccgcggcgtcgatatcgaaaccaagcgtgaaatctacctgatgctgcgccggtttgccgatgaaggaaagctcgttgtcctgctgagttccgacacgccggagcttgtgcatttgtgtgaccgcgtcatggttttccgcgagggccgcatggtcgcgaccctgaaacacggggatctgtcggaagaggcaattgtaggggctgccatgggcctgaaatcgtcgagaaaggcagcctga

SEQ ID NO: 38931 - protein, 510 aa, Brucella abortus biovar 1 str. 9-941
MQVSSRPVVDAPAPLLEARNVFKGFFGNPVLKGVSIALRPGRVHALLGENGAGKSTLINLLSGALPPDSGNIVLEGAALSRLNPAQARKAGIAVIQQELSLTPELSIAENIGLGAYPRRFGLIDYKALHGEALAVCKRVGLTEPLETPVGTLSLGRRQMVEIAKALFRKPRVLILDEPTSSLSAHEAGVLSSLVLKLRDEGVALLYISHRLNEIRSLCSHVTVLKDGVVTADQSLSNSDPEELVRLMVGRDTGDLFPAWRTSATGEKRIHIRGMSAGMVQNVDMDANAGEIIGIGGLVGQGQEDFLLGLYGALPTAAREAIVCGNNGLFKSVGAANAAGLAYVPADRKREGLVLPHSIASNLLLPSLDRYTRHGLRNTANEQRVVAKLAERLTIRGDTARPVQALSGGNQQKVALAKWLPLEPTILLLNDPTRGVDIETKREIYLMLRRFADEGKLVVLLSSDTPELVHLCDRVMVFREGRMVATLKHGDLSEEAIVGAAMGLKSSRKAA

SEQ ID NO: 38932 - DNA, 1590 bp, Brucella abortus biovar 1 str. 9-941
  CDS (1)..(1590): transl_table=11
atgaacctagccaatcctgtctcgctggacgagcgtggggcactgccggatactttcggaaagcctcttcttgaaatgcgtgggatcaacaagtccttcggtgtcgtgaaggcgctgagcgatgtgaacttcaccgtcatgccgggcgaaatacatgcctttgtgggtgaaaacggcgcgggaaaatccacgctgatgaaggtgctttcgggtgtttatccccatggaagctatgaaggcgcgatctattacgacggggaagagcggcagtttcgggatattaacgattccgaggcgctcggcatcgtcatcattcatcaggaattggccctcattccgctgatgtcgattgccgagaatatttttctcgtcaatcctccggcaagccggggtgtcatcgaccgctccgccgtgcacaagcggacgcgggagctattgaaaaaggtcggtctggcggaaacgcccgatacgctcatcaccgatatcggcattggcaagcagcagcttgttgaaatcgccaaggcgctttccaagcgtgtgcggctgttgatcctcgatgaaccaacagcaagcctcaacgaaaatgacagtgcggcgcttctggcgctgctgcgcgagtttcgcgcgcagggcatcacctcgatcctcatttcgcacaagctcaatgaaatccgcgaagtggccgacaagattaccgttctgcgcgacggcaaggcggttgcgacacttgattgccatgcgggcgaagtggaggaagacgatatcatccgcaagatggtggaccgcgatctggagagccgttatcccaagcgcgatcccaagatcggcaatgtcatcttcgaggtcgataactggtcggtctatcatccgctgcatcccgatcggcattcggtcaagaacgtgtcattcaaggtgcgggcgggcgagatcgtcggcattgccggattgatgggagcggggcgcacggaattcgccatgagcctgtttggccgttcatggggcacgaatatcactggcgaggcgcgcatcaatggcaagacggtggatatttccaccgtggcgcgggcaatcaaggcgggccttgcctatgttaccgaggatcgcaagaagcttggcctggttcttggccagaatatttcgcgcaatatctcgctggcgcacttacgcggcgtgagcccgaaaggcattatcgacgatatccgggaaatgaagatcgcgaattcctatcgcgaccagatgcgtattcgctgtcacaatgtctatcaggaaaccggcacgctttcgggcggcaaccagcagaaggtggtgctgtcgaaatggcttttcactggccccgacgtgctgatcctggacgagccgacacgcggtatcgatgttggcgcgaaatatgacatttacacaatcatcaattcactggcggaaagcggcaagggcgttgtcgtcatttcttcggaaatgccggagctgatcggcatttgcgaccgcatcgtcgtcatgcatgagggcgccttcgtcggcgaagtggcaggcgaggaagcaacgcaggaaaacatcatgcgcgccatcatgcgaaacaagggaaaagggtaa

SEQ ID NO: 38933 - protein, 529 aa, Brucella abortus biovar 1 str. 9-941
MNLANPVSLDERGALPDTFGKPLLEMRGINKSFGVVKALSDVNFTVMPGEIHAFVGENGAGKSTLMKVLSGVYPHGSYEGAIYYDGEERQFRDINDSEALGIVIIHQELALIPLMSIAENIFLVNPPASRGVIDRSAVHKRTRELLKKVGLAETPDTLITDIGIGKQQLVEIAKALSKRVRLLILDEPTASLNENDSAALLALLREFRAQGITSILISHKLNEIREVADKITVLRDGKAVATLDCHAGEVEEDDIIRKMVDRDLESRYPKRDPKIGNVIFEVDNWSVYHPLHPDRHSVKNVSFKVRAGEIVGIAGLMGAGRTEFAMSLFGRSWGTNITGEARINGKTVDISTVARAIKAGLAYVTEDRKKLGLVLGQNISRNISLAHLRGVSPKGIIDDIREMKIANSYRDQMRIRCHNVYQETGTLSGGNQQKVVLSKWLFTGPDVLILDEPTRGIDVGAKYDIYTIINSLAESGKGVVVISSEMPELIGICDRIVVMHEGAFVGEVAGEEATQENIMRAIMRNKGKG

SEQ ID NO: 38934 - DNA, 1545 bp, Brucella abortus biovar 1 str. 9-941
  CDS (1)..(1545): transl_table=11
atgagcctggctgcgaaaatcgaaggcaaaaacggcgatgtcgttcttgccgcgcagaatgtggccaagtcctatggccgcatccatgcgctgaaaggcgtgaatttcgagattcgccgggggcaggtcacgacgcttttcggtgaaaacggtgcgggcaagtccacgctgatgaaagtgctttccggcgtgatccagccgactttgggcacgatcatcctcgatggcaagccggtgacgttcaattcatccaccgaagcgcgcgaccatggcatctcgatcatccatcaggaattaagcctcgcgcccaacatgaatgtgcgcgacaacatcttcatggggcgcgaaatccgcaccgccaccggcgtcgattttgccgaggaagagcggctgacgcgcgaactcatgaaggaactggaagaagatatcgatccgctgacgccggttgaggaattgcgtctcggccagcagcaggtcgttgagatcgcccgtgcgctttcggtcaattcgcgcattctcatcatggatgagccgacttcggcgctcagtgcttcggaagtcgaggttctgttcaaggtgatccgcgacctgacggcgcgcggtgtcgccatcgtctatatttcgcatcatctggaagaggcgctccagatcaccaatcatgcggtggtgctgcgcgacggcaccatgacggcctgtgcgccgcgtgaggaaatcgatctggaatggatcgtgcgcaatatggtcggtgaaaacttcgacctcggttctcctcccactggctatgaatggggcgatgtcgcgctttcggtcgaagacctgaccgttcccgaccccagcggcagtggcttctcgctggtggaccgcatgtcgctcaatgtgcgggcgggcgaaatcgtctgcatctatggtctcatgggtgcgggccgcacggaattgctggaatcggttgccggtcgcttgaaatcgagcggcgggcgtattctcctcaaagggcaggatatttccggcctcaccatcgctgagcgcatcgaaaagggccttgtgctggtgccggaagatcgccagcgcgacggtctcgtccagacgatgacggtcggcaagaacctgtcgcttgccagcattgcggaaatgaccagggggatattcacctcgcgcaagcgcgaaaagcagatcgtcgatcagtcgatcaggaatgtgcacatcaagaccgatggcggcgaggcggcaatcggttcgctttcgggcggcaatcagcagaaagtcgtaattggcaagatgctggcgaccgaaccggatgtgatcctgctcgatgagccgagccgcggcatcgacatcggcgcaaaggcggaagtgttcaagcttctggccgaaaaggcgaagcaggggctggccgtggtctacaccacctcggaagtcggcgaatgcctcagcatcgcgcaccgcatcatcgtcatgcaccgtggacgcatctccgccgaattcggatcggacgtgtccaaggaaaagatcatggccgcctcgggcgaagccatggtcggtcattaa

SEQ ID NO: 38935 - protein, 514 aa, Brucella abortus biovar 1 str. 9-941
MSLAAKIEGKNGDVVLAAQNVAKSYGRIHALKGVNFEIRRGQVTTLFGENGAGKSTLMKVLSGVIQPTLGTIILDGKPVTFNSSTEARDHGISIIHQELSLAPNMNVRDNIFMGREIRTATGVDFAEEERLTRELMKELEEDIDPLTPVEELRLGQQQVVEIARALSVNSRILIMDEPTSALSASEVEVLFKVIRDLTARGVAIVYISHHLEEALQITNHAVVLRDGTMTACAPREEIDLEWIVRNMVGENFDLGSPPTGYEWGDVALSVEDLTVPDPSGSGFSLVDRMSLNVRAGEIVCIYGLMGAGRTELLESVAGRLKSSGGRILLKGQDISGLTIAERIEKGLVLVPEDRQRDGLVQTMTVGKNLSLASIAEMTRGIFTSRKREKQIVDQSIRNVHIKTDGGEAAIGSLSGGNQQKVVIGKMLATEPDVILLDEPSRGIDIGAKAEVFKLLAEKAKQGLAVVYTTSEVGECLSIAHRIIVMHRGRISAEFGSDVSKEKIMAASGEAMVGH

SEQ ID NO: 38936 - DNA, 1536 bp, Brucella abortus biovar 1 str. 9-941
  CDS (1)..(1536): transl_table=11
atgtccgaatatcttttggaaatgcgaaacatcggtaaagagttcaacggcgtcaaggcgctggatggcatttacctgaaagtgcgcgcgggagaatgtgtcgggctgtgcggtgaaaacggggcgggcaagtccaccctgatgaaagtgctgtcgggtgtttatccccatggcacatggactggtgaaattttctgggaaggcaaagaacttaaagccagtggcattcgcgataccgaagctgcgggtattgtcatcatccatcaggaactgatgatggtgccacacctgtcggtcgcggagaatatcttccttggttgcgagccaaccacaggcggtttcattgattatgaccagatgaatgcacgggcagccgaactgctcgctcggctcaagataaacgatatcaatgtcgcattgccggtttatcattactcaggcggcaagcagcagttgatcgagattgcaaaggcaatcaacaaaaatgccaagcttctgatccttgacgagccaacctcggccctgaccgcttcagaaacccgggttctcatcgacctgatcaaggacttcaaaaagcagggcatggcttgcgtttacatctctcacaaactcgatgaagtggcggaaatctccgacacggtaacggttattcgtgatggagcgcatatcgcgacacgtccgatgtccgaactgacaacgcccgatatcatcacgatgatggtcgggcgtgagatgaagaacctcttcccgcgtgaaccccatgacattggcgaggtgatgtttgaagcccgcaatataagttgctgggatgtgaccaatcctggccgcaaggtggtcgacgatgtttcgtttgcgctaaggcgcggtgagattttgggcattgcgggccttgtgggtgccgggcgtacagaactcgtatcgagcttgtttggtgtctggccgggcgcctgtcaggggcaggtttttctggagggcaaggaaatcaaaatccgcacgccgcgcgatgcggtgcgccaaggcatttgcatggtgccggaagatcgcaaacgcgatggcatcctgccgatcatgccagttggccacaatatgacgatctccgtgcttgatcgcttttcgctacgaggcctcatcgataaagacgcggaactcgtggcgatccagcgtgagattttgagactcaaggtcaagaccgccgatccgatgcttgccattgcctcgctatctggcggcaatcagcagaaggccgtgctttcaaagatgatgctgcctgatccgaaagtgctcattcttgatgagcccacacgcggcgtcgatgtcggcgcgaaatatgaaatttacaagctgatattcgcgctcgccaggcagggcgtatcgattttgatggtttcgtcggaaatgccggaagtccttgggatcagtgatcgtgttctcgtcattggcgagggcaaattgcgcggcgatttcccgaatgaaaatcttacacaggagaaggttcttgccgctgcaattggcaagcctgcaaccaacgcggcctag

SEQ ID NO: 38937 - protein, 511 aa, Brucella abortus biovar 1 str. 9-941
MSEYLLEMRNIGKEFNGVKALDGIYLKVRAGECVGLCGENGAGKSTLMKVLSGVYPHGTWTGEIFWEGKELKASGIRDTEAAGIVIIHQELMMVPHLSVAENIFLGCEPTTGGFIDYDQMNARAAELLARLKINDINVALPVYHYSGGKQQLIEIAKAINKNAKLLILDEPTSALTASETRVLIDLIKDFKKQGMACVYISHKLDEVAEISDTVTVIRDGAHIATRPMSELTTPDIITMMVGREMKNLFPREPHDIGEVMFEARNISCWDVTNPGRKVVDDVSFALRRGEILGIAGLVGAGRTELVSSLFGVWPGACQGQVFLEGKEIKIRTPRDAVRQGICMVPEDRKRDGILPIMPVGHNMTISVLDRFSLRGLIDKDAELVAIQREILRLKVKTADPMLAIASLSGGNQQKAVLSKMMLPDPKVLILDEPTRGVDVGAKYEIYKLIFALARQGVSILMVSSEMPEVLGISDRVLVIGEGKLRGDFPNENLTQEKVLAAAIGKPATNAA

SEQ ID NO: 38938 - DNA, 1554 bp, Pseudomonas syringae pv. syringae B728a
  CDS (1)..(1554): transl_table=11
atgtcagcgtctgctcagacagctgttctttcggtcagtggcatcggcaaaacctacgcacagcccgtgctcggggacgtcgacctgacgttgatgcgcggcgaagtgctggctctgaccggggaaaacggtgccggtaaaagcaccttgtcgaaaatcatcggcgggctggtaacgcctaccaccggaaacatggaattccagggccagccttatcagcctgcaagtcgtacccaggccgaaaagctcggcattcgcatggtcatgcaggaactcaacctgctgccgaccctgaccgtggctgaaaacctgtttcttcacgacctgccccgcagggccggctggatcgaccgcaagcgcttgcgcgaaaacgcgaccgaggccatggctcaagtggggctcgacgccattgatcccgacacgctggtcggcgaattggggatcggtcatcaacagatggtcgagatcgcccgcaacctgatcggcgactgtcacgtactgattctcgacgaacccactgccatgctcacctcgcgcgaagtggaaatgctcttcgagcagatcacacggctgcaggcgcggggcgtctcgatcatctacatctcccaccggcttgaagagctggccagggtgtcccagcgcatcgccgtgctgcgcgacggcaagctggtgtgtgtcgagccgattgcccgctacaacagtgagcaactggtgaccctgatggtcggccgtgagctcggcgagcatatcgacatgggcgcccggcagattggcgaggtggcgctgtcagtcaaggggctcagtcgcgccggcaaggttcaggatgtgtccttcgacgtgcgtcgaggtgaaatcttcggtatttccggactgatcggtgccgggcgtaccgagttgttgcgtttgatttacggtgcagacgttgccgacagcggtgacatcgaagtcggaagttcgctgcaaaaagtcagcattcgctcgccagccgacgcggtggcgcagggtatcgcgctgatcacggaagaccgaaagagcgaaggcctgctgatgtcgcaatcgatcagcgccaacattgcgctgggcaacatgcattcgatttccagcgcgggcgtggtcaacagcgaagatgagctgaaactggcgcagcgccaggtggcggccatgcgcattcgcagctccagtccgggccagctggtctccgagttgtcgggtggcaatcagcagaaggtggtgatcggtcgctggctggaacgtgactgcacggtgatgctgttcgacgagccgacacggggcatcgacatcggtgccaagttcgatatctacgcgctgctggccgaattgacccgtcagggcagggcgctggtgatggtgtccagcgatctgcgcgaactgatgcttatctgtgatcgtatcggcgtgctgtctgccggtcgcctgatcgacacgttcgagcgcgatagctggacccaggaccaattgctggccgctgccttcgccggttatcagaaacgtgacgcgctgctcaatgatgcggcgcccaggaacaactcatga

SEQ ID NO: 38939 - protein, 517 aa, Pseudomonas syringae pv. syringae B728a
MSASAQTAVLSVSGIGKTYAQPVLGDVDLTLMRGEVLALTGENGAGKSTLSKIIGGLVTPTTGNMEFQGQPYQPASRTQAEKLGIRMVMQELNLLPTLTVAENLFLHDLPRRAGWIDRKRLRENATEAMAQVGLDAIDPDTLVGELGIGHQQMVEIARNLIGDCHVLILDEPTAMLTSREVEMLFEQITRLQARGVSIIYISHRLEELARVSQRIAVLRDGKLVCVEPIARYNSEQLVTLMVGRELGEHIDMGARQIGEVALSVKGLSRAGKVQDVSFDVRRGEIFGISGLIGAGRTELLRLIYGADVADSGDIEVGSSLQKVSIRSPADAVAQGIALITEDRKSEGLLMSQSISANIALGNMHSISSAGVVNSEDELKLAQRQVAAMRIRSSSPGQLVSELSGGNQQKVVIGRWLERDCTVMLFDEPTRGIDIGAKFDIYALLAELTRQGRALVMVSSDLRELMLICDRIGVLSAGRLIDTFERDSWTQDQLLAAAFAGYQKRDALLNDAAPRNNS

SEQ ID NO: 38940 - DNA, 1524 bp, Pseudomonas syringae pv. syringae B728a
  CDS (1)..(1524): transl_table=11
atgcaacaggctatcgagcaatacgccacaggcggtgccttgcgcttcaacggcatcggcaaggtcttccccggcgtcaaggcgctttcggacatcagtttcgaagcgcgccccggcagtgttcacgcattgatgggagagaacggtgccggcaaatccacgctgctgaaaatccttggcgggtcgtatcagcccaacagcggcaccttgcagatcggcgagcagagctatcagttcaagtccaccgccgagagcatcgcggcgggtgtggcggtgattcaccaggagctgcatctggtgccggaaatgaccgttgccgagaacctgctgctcgggcacatgcccaatcgcttcgggctgatcaatcgcggtgcgatgtatcgccgggccggcgagctgctcaagggtctggctgacgaaattgacccgcacacacgcttgggcgacctttcgctggggcagcggcaattggtcgagatcgccaaggccatgtcgcgcaatgctcatgtcatcgcctttgacgagcccaccagcagcctgtcggcgcgtgagatcgaccgactgatggcgatcatcgtgcgcctgcgcgacgagggccgagtgattctttacgtgtcgcatcgcatggaagaaatcttccgcgtctgtgatgcggtgacggtgttcaaggacggacgcttcgtcaagacgttcgagcaaatggccgatctcgaccatgaccgactggtgacctgcatggtcggtcgcgatatccagaacatctacaactaccgccctcgccagcatcaggggccgagcctgcgggttaccggcctgctggggccgggcctgcacgagccggtcaccttcgccgtgcagaagggcgaagtgctgggcttcttcggcctggtcggcgccgggcgtaccgagctgttccggctgctctcggggcttacccgcagctctgcaggcaccctgcaactggacggcaaaccgctgacactcaagtctccccgagatgccatcgaggctggaattctgctctgcccggaggaccgcaagaaagaaggcatcgtgccgctgtccagcgtcgcagagaacatcaacatcggtgcgcgcccccggcacgtgaacctcggttgcctgattcagggtcgctgggagcgtgacaacgcacgcagccagatcaagtcgatgaacgtcaagacgccatcgcccgagcagcagatcatgttcctctccggcggcaatcaacagaaggcgattcttggccgctggctgtcgatgcccatgaaagtcctgctgctggacgagccgactcgcgggatcgacgtcggggccaagtccgagatttacgagatcattcacaacctggccgcggacggtatcgcggtgattgtggtctccagcgatctgatggaagtgatgggcatttcagaccgcattctggtgatgagcgaaggcgcaatcaccggtgaactcaatcgcgacgaggctgacgagtcgcgactcctgcaattggctctgcctcgcacgcgcggctga

SEQ ID NO: 38941 - protein, 507 aa, Pseudomonas syringae pv. syringae B728a
MQQAIEQYATGGALRFNGIGKVFPGVKALSDISFEARPGSVHALMGENGAGKSTLLKILGGSYQPNSGTLQIGEQSYQFKSTAESIAAGVAVIHQELHLVPEMTVAENLLLGHMPNRFGLINRGAMYRRAGELLKGLADEIDPHTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQNIYNYRPRQHQGPSLRVTGLLGPGLHEPVTFAVQKGEVLGFFGLVGAGRTELFRLLSGLTRSSAGTLQLDGKPLTLKSPRDAIEAGILLCPEDRKKEGIVPLSSVAENINIGARPRHVNLGCLIQGRWERDNARSQIKSMNVKTPSPEQQIMFLSGGNQQKAILGRWLSMPMKVLLLDEPTRGIDVGAKSEIYEIIHNLAADGIAVIVVSSDLMEVMGISDRILVMSEGAITGELNRDEADESRLLQLALPRTRG

SEQ ID NO: 38942 - DNA, 1488 bp, Pseudomonas syringae pv. syringae B728a
  CDS (1)..(1488): transl_table=11
atggccaagccattactgctccaggctgaacacgtcaccaaggcttacgctggcatccccgccctgcgtgacgggcgtctctcgttacgagccgggagcgtgcacgccctgtgcggcggcaatggcgcgggcaagtccactttcctgagcattctgatgggcatcacccagcgcgatgcggggaccatcctgctcaacggcgagccggtgcagttcagtcgtcccggcgatgccctggcagccggcattgcgatgatcacccaagagctggaacccatccccttcatgaccgtcgccgagaacatctggctgggccgcgagccacgtcgggccgggtgcattgtcgacagcaaggaactgaaccgacgcacccgggcactgctggacgagctggaattcgatgtcgacgccaccagccccatgcatttgctgagcgtggcacagatacaactggtggaaatcgccaaggccttcagccatgactgttcggtaatgatcatggacgagcccacttcggccatcggcgagcgtgaggcacaaaccctgttcaaggccatccgccggcttgctgcacggggtgcgggcatcatctacgtatcccaccgcctcagcgagctggcgcagattgccgacgattacagcatcttccgcgatggcgcctttgtcgaaagcggacgtatggccgatatcgaccgggcacacctggtacgcggcatcgtcggccaggagttacagcgtatcgatcacaaggtaggtcgcgaatgcgccgccgaatgctgccttaatgtcgaaggcctgagtcgcaccggcgaattcgaagacatcagcctgcacgtgcgtcatggtgaaattctcggcatctatgggctgatgggctcgggtcgcagcgagtttctcaactgcctgtatggcttgaccataccggattcaggcagcgtcaccctgcaaggcaagctgctgccggtcggcctgcccaaagcgactattcgcgcgggcgtctcactggtcaccgaagaccgcaaggacagcggcctggtacttaatggcagcatcctgtccaacatcgcactgtcggcctaccggcagttgtcgaactggtcgctgatcgacgcccgcaaggagcacaaactggccgaagacatggtcaagcgcctgcagatcaagacgacttctctggatctgcccgtcgcgtcgatgagcggtggcaaccaacagaaggtcgtcctcgccaagtgcctgtcgaccgagccggtgtgcctgctctgcgacgaaccgacccggggcatcgacgaaggcgccaagcaggaaatctatcacctgctggatcagttcgtacgcgctggcggagccgccatcgtggtctcttcggaagcgccggaactgttgcgcctgagtgaccgaatcgccgtgttcaagggtggcaggctggtgaccatcagcagcgatgccgatctttcccaggaagtcctgttgagtcttgcctcatga

SEQ ID NO: 38943 - protein, 495 aa, Pseudomonas syringae pv. syringae B728a
MAKPLLLQAEHVTKAYAGIPALRDGRLSLRAGSVHALCGGNGAGKSTFLSILMGITQRDAGTILLNGEPVQFSRPGDALAAGIAMITQELEPIPFMTVAENIWLGREPRRAGCIVDSKELNRRTRALLDELEFDVDATSPMHLLSVAQIQLVEIAKAFSHDCSVMIMDEPTSAIGEREAQTLFKAIRRLAARGAGIIYVSHRLSELAQIADDYSIFRDGAFVESGRMADIDRAHLVRGIVGQELQRIDHKVGRECAAECCLNVEGLSRTGEFEDISLHVRHGEILGIYGLMGSGRSEFLNCLYGLTIPDSGSVTLQGKLLPVGLPKATIRAGVSLVTEDRKDSGLVLNGSILSNIALSAYRQLSNWSLIDARKEHKLAEDMVKRLQIKTTSLDLPVASMSGGNQQKVVLAKCLSTEPVCLLCDEPTRGIDEGAKQEIYHLLDQFVRAGGAAIVVSSEAPELLRLSDRIAVFKGGRLVTISSDADLSQEVLLSLAS

SEQ ID NO: 38944 - DNA, 1572 bp, Pseudomonas syringae pv. syringae B728a
  CDS (1)..(1572): transl_table=11
atgggatcagcgattacagacgttgcggcggtgccaccggccttgcacctgagaggtatcagcaagcgctttggggccactcaggcgctggatggcgtcaacctgcgggtcgaggccggaacgattcacgggctggtgggggaaaacggggcgggcaagtcgaccctgatcaaggttctcgccggtattcatcgtgccgatgccggccgtttgagtattcatggccagccgttcgacaatttcacgccgcgtcaggtcgaggccgcaggcgtgcacttcattcatcaggagcgactgctgccgggcagcttcagtgtcggcgaagccttgtttttcgggcaggaaatcaagcgtggccccttcctcgatcgccgcgcccaggagcgcgaggcagcaaggcttctggacgattactttgccatgcgcctgcccgccggggcgctagtacgcgatctggacagcgcccagcggcagatactgcaggtcactcgtgcgttgctggccagaccgaaggtgctggtgttcgacgagccgagtgtgtcactggtcaagcaggaggtggaccgcttgctggacatcgtccgccgcctgcgcgatgaagggctgaccattgtctacatttcacactatttgcaggagatcgaatcgctgtgtgatcaggtcaccgtgctgcgtaacggacgcgatgtggcggtgctcgatccggctctcaccagcaccgcgcagatcgcccggctgatggtcaatcgcgaggtaggcgagcaatatttccgtgcccggacattacccggcgcgccagtgcttcaactgcgcggactgggggcagggcgcttctacgacggcgttgacctgagtgtgcggcgtggcgaagtactgggcctgaccgggctggtcggctcgggtgccaaggagctgctcaagagcctgttcgggctgctcaagccggatcgcggcgaattgctcttgaacggtcagcggttgcagctgaaatcaccgcgtgacgcagtacaccatggcatcgcgctggtccccgaggagcgccgcacacacggcgtggcaccggcgctttcggtgctggagaacatcaccctggccagcctgaggcgcttcagccgctggggattgctcgacgctgcggcgcaggccggggaaagccaacagctgatcgatgaactggcaatcaagacctcaggccatgatgcgccggtgcacgcgctcagcggtggcaaccagcagaaggttgcgctgggcaaatggctgagccgccattcgacgttatacctgctggacgagcccagcgtgggtgtcgacatcggcgccaaggtggaaatctaccggttgattgccaagcttgccgagggcggcgcggcggtgctggtgctgtcgtcggacttgccggaactgatcggcatcactcagcgcattgtggtcctgcacagaggacgcgttgcaggcgaattcgactcattgagcaccgacagcgaccagttgctggcctgcgccacgggcgccactgaaagcgaccatgacagccaatcattccctccggaggcccattatgtccgcgcttga

SEQ ID NO: 38945 - protein, 523 aa, Pseudomonas syringae pv. syringae B728a
MGSAITDVAAVPPALHLRGISKRFGATQALDGVNLRVEAGTIHGLVGENGAGKSTLIKVLAGIHRADAGRLSIHGQPFDNFTPRQVEAAGVHFIHQERLLPGSFSVGEALFFGQEIKRGPFLDRRAQEREAARLLDDYFAMRLPAGALVRDLDSAQRQILQVTRALLARPKVLVFDEPSVSLVKQEVDRLLDIVRRLRDEGLTIVYISHYLQEIESLCDQVTVLRNGRDVAVLDPALTSTAQIARLMVNREVGEQYFRARTLPGAPVLQLRGLGAGRFYDGVDLSVRRGEVLGLTGLVGSGAKELLKSLFGLLKPDRGELLLNGQRLQLKSPRDAVHHGIALVPEERRTHGVAPALSVLENITLASLRRFSRWGLLDAAAQAGESQQLIDELAIKTSGHDAPVHALSGGNQQKVALGKWLSRHSTLYLLDEPSVGVDIGAKVEIYRLIAKLAEGGAAVLVLSSDLPELIGITQRIVVLHRGRVAGEFDSLSTDSDQLLACATGATESDHDSQSFPPEAHYVRA

SEQ ID NO: 38946 - DNA, 1557 bp, Pseudomonas syringae pv. syringae B728a
  CDS (1)..(1557): transl_table=11
atgtctgactacctgttgcaaatgaacggcatcgtcaaatcctttggcggtgtaaaagcgctcaacggcatcgatatcacagtgaagcccggcgagtgcgtcggcctgtgcggcgagaacggcgcgggcaaatccaccttgatgaaagtcctgtcggcggtctatccctacggcacctgggagggcgaaatcctgtgggacggccaaccgctcaaggcacagtcgatcagtgaaacggaagcggccgggatcgtcatcatccatcaggaactgacgctggtcccggacctgtcggtggccgaaaacatttttatgggccacgagctgacgctccccggcgggcgcatgaattacccggccatgatgcaccgcgccgagtcgctgatgcgtgaactcaaagtgcctgacatgaacgtggcgctgccggtttcgcagtatggcggcggctaccagcaactggtggaaatcgccaaggcgctgaacaagaaggcgcgcctgttgattctcgacgagccctcctcggccctgacccgctccgaaatcgaggtgttgctggacatcattcacgacctgaaggccaagggggtcgcgtgcgtgtacatctcgcacaaactcgatgaggtggccgccgtgtgcgacaccgtttccgtcatccgcgacggcaaacatatcgccaccactgcaatggcggacatggacattccaaagatcatcacccagatggtcggacgcgaaatgagcaacctctaccccaccgagccgcatgatgtcggcgaggtgattttcgaagcgcggcatatcacctgctacgacgtcgataaccccaggcgcaagcgcgtcgacgacgtgtcattcctcctcaggcgcggggaaatcctcggcatcgccgggctggtgggcgcgggccgtaccgaactggtatccgccctgttcggcgcctaccccggtcggtacagcggtgaagtgtggctgaatggccaggcgatcgacacgcgcacgccgctcaaatcgatccgcgccggcgtgtgcatggtccctgaagaccgcaagcgccagggcatcattccggacctgggcgtcggccagaacatcaccctcgcggtcctcgacagctactcgaacatgacccgcatcgacgctgaagccgaactgggcagtatcgaccgggaaatctcgcgcatgcacctcaagaccgccagcccgtttttgccaatcaccagcctgtcaggcggcaatcagcagaaagccgtgctggcgaagatgctgctcacccgcccgcgcgttctgattctcgacgagcctacccgcggcgtcgatgtcggtgccaagtacgagatctacaagctgatgggcgcgctggcagccgagggcgtgtcgatcatcatggtgtcttcggagctggccgaagtgctgggcgtgtccgaccgtgtgctggtgattggcgacggccagttgcgcggcgacttcatcaaccatgacctgactcaggagcaggtcctcgccgctgcactcagccactccgatgcccctcacaataatgcccggaagaccgcgtag

SEQ ID NO: 38947 - protein, 518 aa, Pseudomonas syringae pv. syringae B728a
MSDYLLQMNGIVKSFGGVKALNGIDITVKPGECVGLCGENGAGKSTLMKVLSAVYPYGTWEGEILWDGQPLKAQSISETEAAGIVIIHQELTLVPDLSVAENIFMGHELTLPGGRMNYPAMMHRAESLMRELKVPDMNVALPVSQYGGGYQQLVEIAKALNKKARLLILDEPSSALTRSEIEVLLDIIHDLKAKGVACVYISHKLDEVAAVCDTVSVIRDGKHIATTAMADMDIPKIITQMVGREMSNLYPTEPHDVGEVIFEARHITCYDVDNPRRKRVDDVSFLLRRGEILGIAGLVGAGRTELVSALFGAYPGRYSGEVWLNGQAIDTRTPLKSIRAGVCMVPEDRKRQGIIPDLGVGQNITLAVLDSYSNMTRIDAEAELGSIDREISRMHLKTASPFLPITSLSGGNQQKAVLAKMLLTRPRVLILDEPTRGVDVGAKYEIYKLMGALAAEGVSIIMVSSELAEVLGVSDRVLVIGDGQLRGDFINHDLTQEQVLAAALSHSDAPHNNARKTA

SEQ ID NO: 38948 - DNA, 1578 bp, Pseudomonas syringae pv. syringae B728a
  CDS (1)..(1578): transl_table=11
atgttcggttctgctactgccaatccgcccgcgcaacgcaatctgccgtccggcgacggggatggcggggcgcctgatgcccaggccccgtatctgctggaaatcagccatgtcagcaagggctttcctggcgtggttgcgctcaatgatgtgcaactgcgtgttcgccctggcagcgtgctggcgctgatgggcgagaacggagccggaaaatcgaccctgatgaaaatcattgcgggcatctatcagccggacgcgggtgaaatccgtctgcggggcaagccggtcagcttcgatacgcctctttccgcgttgcaggcaggcatcgccatgattcatcaggaactgaacctgatgccgttcatgagcattgccgagaacatctggatcggtcgcgagcagctcaacggcctgcacatggtcgatcaccgcgagatgcaccgctgcactgccgagctgctggagcgcctgcgcatcaagctcgatcccgaggaactggtcggcacgctgagtattgccgagcggcagatggtggagatcgccaaggccgtgtcatacaactcggacgtgctgatcatggacgaaccgacctcggccatcaccgaaaccgaagtcgctcacctgttctcgatcatcagcgacctgcgtgcccagggcaaaggcatcatctacatcacccacaagatgaacgaagtcttcgaaatcgccgacgaggtggcggtgttccgcgacggcgcctacatcggtctgcagcgcgccgatagcatggacggcgacagcctgatcaccatgatggtgggccgggaactgacccagctgttccccgagcgggagaaaccggcaggcgatgtgctgctgtccgtcaaccggctgagcctgaacggcattttcaaggacgtgagcttcgacctgcgtgccggggaagtgcttggcattgccgggctgatgggctcggggcgcaccaatgtggccgagacgctgtttggcataacccccagcgacagcggcgaggtgcgcttcgatggcaagacggtgcacatcggcgatccacatcaggccatcgaactgggttttgcgctgctcacggaggatcgcaaattgaccggcctgtttccatgcctgtcggtgatggaaaacatggagatggccgtgctggccaactatgccggtaacggtttcgtgcaacagaaggccttgcgctcccagtgcgaagacatgtgcaaaaagcttcgggtcaagacgccgtcgctggagcagtgcatcgacacattatccggcggcaaccagcagaaggcgctgctggcgcgctggctgatgaccaaccccaaggtactgattctggatgagcccacacgcggtatcgacgtgggtgccaaggtagaaatctaccgcctgatctccctgctggccagtgaaggcatggcagtgatcatgatttcctcggagctgccggaggttctcggcatgagtgaccgggtcatggtcatgcacgaaggcgaaatgatgggcatccttgatcgcagtgaagcgacccaggaaaaagtcatgcatctggcctccggccacaaggttcattga

SEQ ID NO: 38949 - protein, 525 aa, Pseudomonas syringae pv. syringae B728a
MFGSATANPPAQRNLPSGDGDGGAPDAQAPYLLEISHVSKGFPGVVALNDVQLRVRPGSVLALMGENGAGKSTLMKIIAGIYQPDAGEIRLRGKPVSFDTPLSALQAGIAMIHQELNLMPFMSIAENIWIGREQLNGLHMVDHREMHRCTAELLERLRIKLDPEELVGTLSIAERQMVEIAKAVSYNSDVLIMDEPTSAITETEVAHLFSIISDLRAQGKGIIYITHKMNEVFEIADEVAVFRDGAYIGLQRADSMDGDSLITMMVGRELTQLFPEREKPAGDVLLSVNRLSLNGIFKDVSFDLRAGEVLGIAGLMGSGRTNVAETLFGITPSDSGEVRFDGKTVHIGDPHQAIELGFALLTEDRKLTGLFPCLSVMENMEMAVLANYAGNGFVQQKALRSQCEDMCKKLRVKTPSLEQCIDTLSGGNQQKALLARWLMTNPKVLILDEPTRGIDVGAKVEIYRLISLLASEGMAVIMISSELPEVLGMSDRVMVMHEGEMMGILDRSEATQEKVMHLASGHKVH

SEQ ID NO: 38950 - DNA, 1482 bp, Haemophilus influenzae 86-028NP
  CDS (1)..(1482): transl_table=11
atggaaactttactcaaaattagtggtgttgataagtcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacattttccttggtcgtgaatttaaaacctcgtggggagcgattaactggcagaaaatgcaccaagaagcagacaagctacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcattgtggcagaaattacagaagatgatttaattgaaatgatggttggtcgtcgtcttgatgaacaatatccgcatttatcacaagaaaaaggcgaatgtgtattggatgtgaaaaatgtgagcggaagcggtattgatgatgtttccttcaaattgcatgccggtgaaattgttggtgtctcgggcttaatgggtgcgggtagaacggaactcggcaagctactttacggtgctttgccaaaaacggcgggaaaagtgcggttaaaaaatcaagagattgagaatctcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcagtattcgtcatcaagcggaaaaaatgacagtagatgactttattctgatgtttaacattaaaacacctaatcgtgatcaacaagtaggtttgctatctggtggaaatcaacaaaaagtggcaattgctcgtggattaatgactcgcccaaatgtgttgattttagatgaaccaactcgtggcgtagatgttggcgcgaagaaagaaatttatcagttgattaacgaatttaagaaagagggcttgagtattttaatgatctcatctgatatgccagaagtgcttggtatgagcgatagagtgttggtaatgcgtgaaggtaaaattagtgcagaattttctcgcaaagacgcaactcaagaaaaattattagcagcagctattggtaaataa

SEQ ID NO: 38951 - protein, 493 aa, Haemophilus influenzae 86-028NP
METLLKISGVDKSFPGVKALNNACLSVYAGRVMALMGENGAGKSTLMKVLTGIYSKDAGTIEYLNRSVNFNGPKASQEAGISIIHQELNLVGNLTIAENIFLGREFKTSWGAINWQKMHQEADKLLARLGVTHSSKQLCAELSIGEQQMVEIAKALSFESKVIIMDEPTDALTDTETEALFNVIRELKAENRGIVYISHRLKEIFQICDDVTVLRDGQFIGERIVAEITEDDLIEMMVGRRLDEQYPHLSQEKGECVLDVKNVSGSGIDDVSFKLHAGEIVGVSGLMGAGRTELGKLLYGALPKTAGKVRLKNQEIENLSPQDGLDNGIVYISEDRKGDGLVLGMSVKENMSLTSLDHFSQKGSIRHQAEKMTVDDFILMFNIKTPNRDQQVGLLSGGNQQKVAIARGLMTRPNVLILDEPTRGVDVGAKKEIYQLINEFKKEGLSILMISSDMPEVLGMSDRVLVMREGKISAEFSRKDATQEKLLAAAIGK

SEQ ID NO: 38952 - DNA, 1497 bp, Staphylococcus haemolyticus JCSC1435
  CDS (1)..(1497): transl_table=11
atgattcaaatgactaatatccataaagccttcggggacaacgaggttctaaagggagttgattttactctaaagccaggtacagtgcatgcactaatgggagaaaatggggctggtaaatcaacactcatgaaaattttagttgggattcataaaaaagaccaaggtgttatcactaattctgatattgagatcgactataacaatcctaaagaagcggaagaaaaaggattaacatttattcaccaagaactgaatttatatccagaattaacagtgcttgataacttgttcgttggaaaagaaatcagaaacaaaataggaatactaaataaaaaagaaatgaagcaacaagctgagcaagtgtttaaagaattagatttctatattccattaaacaaagtggtcaaagattgctcaattggtgagcaacaaatgatagaaatagctaaagcgatgatgacaaaagcacaaatcattattatggatgaaccaacagcaacattaacagataaagaaatacgacgtttgttcgacatgattcataatttaaaagctaaaggtgtgtcctttgtatacatttcacatagaatggctgaaatttttgagatttcggatgaaataacagtgatgcgtgatggcgtttctgttatgtatgatgaaacgacaaatctaacatacaaccaaattgttaaagcaatggttggacgtgaattagatgaacagtttccagatagaacgtatgaaccacaagatattgttttaaatgtaaagcgacttaataatccgctacatcatattgagaatcaatcattttatcttaaaaaaggtgaaatattgggcgtgagtggtctaatgggggcaggtcgtacagaaatgatgagaagtttgttcggtgtcgataaagcagataatgaaattgaaattaaaggacaaacagtatctataacgtctccaatcgaagcgatgaaacatggacttgcttttataactgagaatcgtaaagaagaagggttaatcttagacttctccattcaagacaatatggtgttaccttcgttatttagtttttcaaaacatggcatcgtagacgataaaagttctgagcaatttgttgatacgatgcgtaaaagacttaatattaaatctccaggtagactgccggctggctcattatcaggtggtaatcaacaaaaggtcgtattagcaaagtggattggtaccggtgcgcaaatcattattttagatgagcctacacgaggtattgatgtcggagcaaaaagagagatttatcaacttatgaatgaacttacggatcgtggtgtgtctattattatggtctcatctgaattgcctgaagtcattggtatgagcgatagagtgatggtcgttcacgaaggtaatatcaaaggggatctaacaggaaatgaaattacagaagaaaatattatgactttagctacagggggaactttaaatgaaacagttaacagctaa

SEQ ID NO: 38953 - protein, 498 aa, Staphylococcus haemolyticus JCSC1435
MIQMTNIHKAFGDNEVLKGVDFTLKPGTVHALMGENGAGKSTLMKILVGIHKKDQGVITNSDIEIDYNNPKEAEEKGLTFIHQELNLYPELTVLDNLFVGKEIRNKIGILNKKEMKQQAEQVFKELDFYIPLNKVVKDCSIGEQQMIEIAKAMMTKAQIIIMDEPTATLTDKEIRRLFDMIHNLKAKGVSFVYISHRMAEIFEISDEITVMRDGVSVMYDETTNLTYNQIVKAMVGRELDEQFPDRTYEPQDIVLNVKRLNNPLHHIENQSFYLKKGEILGVSGLMGAGRTEMMRSLFGVDKADNEIEIKGQTVSITSPIEAMKHGLAFITENRKEEGLILDFSIQDNMVLPSLFSFSKHGIVDDKSSEQFVDTMRKRLNIKSPGRLPAGSLSGGNQQKVVLAKWIGTGAQIIILDEPTRGIDVGAKREIYQLMNELTDRGVSIIMVSSELPEVIGMSDRVMVVHEGNIKGDLTGNEITEENIMTLATGGTLNETVNS

SEQ ID NO: 38954 - DNA, 1554 bp, Pseudomonas fluorescens Pf-5
  CDS (1)..(1554): transl_table=11
atgtcagtttctgctgccaacgctgtcctatcggtcagcggtatcggcaagacttatgcgcaaccggtgttgaccggcatcgacctgacgctgttgcgtggtgaagtgctggcgctcaccggcgagaacggtgccggcaagagcaccctgtcgaagatcatcggtggcctggtcagccccaccacagggcacatgcagttcaatggccaggattatcgtccgggcagtcgcgcccaggccgaggatctgggcattcgcatggtgatgcaggagctcaacctgctgccgaccctgtcggtggccgagaacctgttcctcgacaacctgcccagcagtggtggctggatcagccgccggcaattgcgcaaggcggcgatcggggccatggcccaggtcggtctggatgccatcgaccccgacaccctggtgggcgagctgggcatcggccaccagcagatggtggagatcgcccgtaacctgatcggcgactgccatgtgctgattctcgatgagcccaccgccatgctcacgtcccgcgaggtagaaatgctcttcgagcagatcacccgcctgcaggcccgcggcgtgtcgatcatctatatctcccatcgcctggaagagctggcccgggttgcccagcgcatcgcggtattgcgtgacggctgcctggtctgtgtcgagccgatggccaactacaacagcgagcaactggtgaacctgatggtgggccgcgagctgggcgagcacatcgacctgggcgagcgccggatcggcgcgccggccttgacggtgagcaacctcagccgctcggacaaagtccgcgatgtgtccttcgaggtccgcagtggcgagatcttcggaatttccgggttgatcggggcagggcgcaccgagctgctgcgcctgatcttcggtgccgatgtcgccgacagcggcaccatcgccctgggcaccccggcgcgcccggtgagcatccgctcgccagtggatgcggtggccaacggcatcgccctgattaccgaggaccgcaagggtgaggggctgctgttgacccagtccatcagcgccaatatcgccctgggcaacatgccggcgatttccagcagcggcctggtcaatggccaggacgaggagcatctggcgcggcgccagatcgacgccatgcgtatccgcagctccagcccggcgcaactggtcagcgagctgtccggtggcaaccagcagaaggtggtgatcggccgctggctggagcgcgactgttcggtgctgctgttcgatgagccgacccgtggcatcgatgtcggtgccaagttcgatatctacggcctgttgggggagttgacccggcagggcaaggcccttgtggtggtgtccagcgacctgcgcgagctgatgctgatctgcgatcgcatcggcgtgctctcggccgggcggctgatcgataccttcgagcgcgacagctggacccaggacgaactgcttgccgcggcatttgccggctatcaaaaacgagatgcgctgatcgatgaagcggcgcctaggaatgcatcatga

SEQ ID NO: 38955 - protein, 517 aa, Pseudomonas fluorescens Pf-5
MSVSAANAVLSVSGIGKTYAQPVLTGIDLTLLRGEVLALTGENGAGKSTLSKIIGGLVSPTTGHMQFNGQDYRPGSRAQAEDLGIRMVMQELNLLPTLSVAENLFLDNLPSSGGWISRRQLRKAAIGAMAQVGLDAIDPDTLVGELGIGHQQMVEIARNLIGDCHVLILDEPTAMLTSREVEMLFEQITRLQARGVSIIYISHRLEELARVAQRIAVLRDGCLVCVEPMANYNSEQLVNLMVGRELGEHIDLGERRIGAPALTVSNLSRSDKVRDVSFEVRSGEIFGISGLIGAGRTELLRLIFGADVADSGTIALGTPARPVSIRSPVDAVANGIALITEDRKGEGLLLTQSISANIALGNMPAISSSGLVNGQDEEHLARRQIDAMRIRSSSPAQLVSELSGGNQQKVVIGRWLERDCSVLLFDEPTRGIDVGAKFDIYGLLGELTRQGKALVVVSSDLRELMLICDRIGVLSAGRLIDTFERDSWTQDELLAAAFAGYQKRDALIDEAAPRNAS

SEQ ID NO: 38956 - DNA, 1548 bp, Pseudomonas fluorescens Pf-5
  CDS (1)..(1548): transl_table=11
atgaacgcttgtgcttctgcttcgagcctgcactccctgagcccggccgtggcgccccaggagccctacctgctggaagtgctgaatgtcagcaagggctttcccggggtggtggccctggccaacgtgcaactgcgggtacgccccggcacggtcctggcgctgatgggcgagaacggtgccggcaagtcgaccctgatgaagatcatcgcgggcatctatcagcccgactccggcgaactgcgcctcaagggccggcctgtgaccttcgccacgccgctggcggcgctgcaggcggggatcgccatgatccaccaggaactcaacctgatgccgcacatgagcatcgccgagaacatctggatcggccgcgagcaacagaaccgcctgggcctgatcgaccatcgggaaatgcaccgctgcaccgccgccttgctggcgcgcctgcgcatcgaactggaccccgaggagcaggtgggcaacctgagcatcgccgagcgccagatggtggagatcgccaaggcggtgtcctacgactccgacgtgctgatcatggacgaaccgacctcggccatcaccgacaaggaggtggcgcacctgttctcgatcattgccgacctcaaggcccagggtaagggcatcgtctatatcacccacaagatgaacgaagtgttcgccatcgccgatgaggtggcggtgtttcgcgatggcgcctacatcggcctgcaacgggccgacagcctggacggcgacagcctgatctcgatgatggtggggcgcgagctgagccagttgtttcccctgcgcgagaagcctatcggcgagctgctgctcaaggtccgcgacttgcgcctggacggggtgttcaagggcgtgtcgttcgatctgcatgccggggagatcctcggcattgccgggctgatgggctcggggcggaccaatgtcgccgaaaccctgttcggcatcaccccaagcgatggcggcgagattgtcctcgacggccagcccctgcgcatcggcgacccgcaccgggcgatcgagaagggccttgccctgctgaccgaggatcgcaagctcagtggcttgttcccctgcctgtcggtcctggaaaacatggaagtggcggtactgccgcactacgccggcggcggttttgtccagcagaaggccttgcgcgccttgtgcgaggacatgtgcaggaagctgcgggtcaagaccccgtccctggagcaatgcatcgacaccctgtccgggggcaatcagcagaaggccctgctggcgcgctggctgatgacccagccgcggatcctgattctcgacgagccgacccggggcattgacgtgggggccaaggctgagatctaccgcctgatcgccagtctggccggtgagggcatggcggtgatcatgatttcctcggaactgcccgaggtgctgggcatgagcgaccgggtcatggtcatgcacgaagggcaactgatgggcaccctggaccgcaacgaggcgacccaggaacgggtcatgcaactggcttcgggcctgaactag

SEQ ID NO: 38957 - protein, 515 aa, Pseudomonas fluorescens Pf-5
MNACASASSLHSLSPAVAPQEPYLLEVLNVSKGFPGVVALANVQLRVRPGTVLALMGENGAGKSTLMKIIAGIYQPDSGELRLKGRPVTFATPLAALQAGIAMIHQELNLMPHMSIAENIWIGREQQNRLGLIDHREMHRCTAALLARLRIELDPEEQVGNLSIAERQMVEIAKAVSYDSDVLIMDEPTSAITDKEVAHLFSIIADLKAQGKGIVYITHKMNEVFAIADEVAVFRDGAYIGLQRADSLDGDSLISMMVGRELSQLFPLREKPIGELLLKVRDLRLDGVFKGVSFDLHAGEILGIAGLMGSGRTNVAETLFGITPSDGGEIVLDGQPLRIGDPHRAIEKGLALLTEDRKLSGLFPCLSVLENMEVAVLPHYAGGGFVQQKALRALCEDMCRKLRVKTPSLEQCIDTLSGGNQQKALLARWLMTQPRILILDEPTRGIDVGAKAEIYRLIASLAGEGMAVIMISSELPEVLGMSDRVMVMHEGQLMGTLDRNEATQERVMQLASGLN

SEQ ID NO: 38958 - DNA, 1554 bp, Pseudomonas syringae pv. phaseolicola 1448A
  CDS (1)..(1554): transl_table=11
atgtcagcgtctgttcagacagctgttctttcggtcagtggcatcggtaaaacctacgctcaacccgtgctcggtgacgtcgatctgacgttgatgcgtggcgaagtgctggccctgaccggggaaaacggtgccggtaaaagcaccttgtcgaaaatcattggcggcctggtgacgcccactaccgggcgcatggagtttcaagggcagccttatgaacctgtgagtcgtacccaggccgaaaagctcggggttcgcatggtcatgcaggagctcaacctgctgccggccctgaccgttgccgaaaacctgttccttgacgacctgccacgtcgtgctggctggatcgaccgcaagcgcctgcgtgaaaacgcgatcaaggctatggctcaggtgggtctggacgctattgatcccgatacgctggtcggcgatttggggatcggtcatcagcagatggtcgagatcgctcgcaacctggttggcgactgccatgtgctgatcctcgacgagcctactgccatgctcacctcccgcgaggtggaaatgctgttcgagcagatcacgcggctgcaggctcgtggtgtctcgatcatctacatctcccaccggcttgaggagcttgccagagtgtctcagcgcatagccgtactgcgcgatggcaagctggtgtgcgtcgagccaattgcccgctacaacagcgagcaactggtcacgttgatggtcggccgtgaacttggcgaacacatggacatgggcacccggcagattggcgaagtagcgctgtcagtcaaggggctcagtcgtgccggcaaggttcaggatgtttcgttcgatgtgcgacgaggtgaaatcttcggtatttccgggctgatcggtgccgggcgcaccgagttgctgcgcctgatctacggtgcagatgttgccgacagtggtgcgattgaagttgggcagccactgcaagccgtcaccatccgttcaccctcggacgccgtggagcacggtattgccctgatcacggaagaccgcaagagcgaaggactgctgatgtcgcagtcaatcagcgccaacattgcgctgggtaatatgcattcgatctccagagcaggcctggtcaacaccgatgacgaactgaagctggcgcagcgccaggtggctgccatgcgtattcgcagttccagtccggaccagctggtctccgagctgtcaggcggtaatcagcagaaggtcgtgatcggtcgctggctggaacgtgattgcccggtgatgctgttcgacgagccgacgcgaggcatcgacgtcggtgccaaattcgatatctacgcgctgctggccgaattgacccgtcagggcagggcgctggtggtggtttccagtgatctgcgcgaactgatgttgatctgcgatcgtatcggtgtgctgtctgccggtcgcctgatcgacacgttcgagcgcgacagctggacccaggaccaattgcttgccgctgccttcgccggttatcagaaacgtgacgcgctgctcaatgacgccgcgcccaggaacgactcatga

SEQ ID NO: 38959 - protein, 517 aa, Pseudomonas syringae pv. phaseolicola 1448A
MSASVQTAVLSVSGIGKTYAQPVLGDVDLTLMRGEVLALTGENGAGKSTLSKIIGGLVTPTTGRMEFQGQPYEPVSRTQAEKLGVRMVMQELNLLPALTVAENLFLDDLPRRAGWIDRKRLRENAIKAMAQVGLDAIDPDTLVGDLGIGHQQMVEIARNLVGDCHVLILDEPTAMLTSREVEMLFEQITRLQARGVSIIYISHRLEELARVSQRIAVLRDGKLVCVEPIARYNSEQLVTLMVGRELGEHMDMGTRQIGEVALSVKGLSRAGKVQDVSFDVRRGEIFGISGLIGAGRTELLRLIYGADVADSGAIEVGQPLQAVTIRSPSDAVEHGIALITEDRKSEGLLMSQSISANIALGNMHSISRAGLVNTDDELKLAQRQVAAMRIRSSSPDQLVSELSGGNQQKVVIGRWLERDCPVMLFDEPTRGIDVGAKFDIYALLAELTRQGRALVVVSSDLRELMLICDRIGVLSAGRLIDTFERDSWTQDQLLAAAFAGYQKRDALLNDAAPRNDS

SEQ ID NO: 38960 - DNA, 1557 bp, Pseudomonas syringae pv. phaseolicola 1448A
  CDS (1)..(1557): transl_table=11
atgtccgactatctgttgcaaatgaacggcatcgtcaaaacctttgacggcgtcaaagccctgaacggcattgacataaaggtccggcccggtgaatgcgtcggcctgtgcggcgaaaacggcacgggcaagtccacgctgatgaaggtgctgtcggcggtatacccttacggcacctgggacggcgagattctctgggacggcacccccctcaaggcgcagtcaatcagcgaaacggaagcagccggtatcgtcatcattcatcaggaactcacgctggtgcctgacctgtcggtggccgaaaacatcttcatgggtcatgaactgacgctcccgggtgggcgcatgaactacccggccatgatccatcgcgccgaagtgttgatgcgtgagctcaaagtgccagacatgaacgtggctctgccggtttcccagtacggcggcggttatcagcaactggtggaaatcgccaaggcactgaacaagaaagctcgtctgttgattctcgacgagccgtcctctgccctgacacgctcggaaatcgaggtgctgctggacatcattcgtgacctgaaagccaagggcgtggcgtgcgtgtacatttcgcacaaactcgatgaagtggcggccgtgtgcgacaccatttcggtgatccgcgatggtaagcacatcgccaccaccgcaatgtcggacatggacatcccgaagatcatcacccagatggtcggtcgcgaaatgagcaacctctaccccaccgaaccccatgagatcggcgaggtgattttcgaggcgcgaaacattacctgttacgacgtcgataaccccggacgcaaacgggtcgacgacatttcgtttgctctcaagcgcggggaaattctcggcattgccgggctggtaggcgcgggtcgcaccgaactggtgtccgctctgttcggtgcctacccgggccgatataccggtgaagtgtggctggacggccaacctgtcgacacgcgcacgccgctcaaatcaatccgcgccggcctgtgcatggtcccggaagaccgtaagcgtcagggcattattccggacctgggcgttggtcagaacatcaccctcgcggttctcgatacctactcgaaaatgacccgcatcgatgccgaagccgagctgggcagcatcgaccgggaaatctcgcgcatgcatctcaagacggccagcccgttcctgccgatcaccagcctgtccggtggcaaccagcagaaagccgtgctggcgaagatgctgctgacccgcccgcgcgttctgattctcgacgaaccgacccgcggcgtcgatgtgggtgccaagtacgagatctacaagctgatgggcgcgctggcggccgaaggtgtgtcaatcatcatggtctcttcggagctggccgaagtactgggagtctccgaccgtgtgctggtgattggcgaaggccagttgcgcggcgacttcatcaaccatgaactcactcaggaacaggtgctcgccgctgcgctcagccaccccgatgcccctgacaataatgcccggaagaccgcatag

SEQ ID NO: 38961 - protein, 518 aa, Pseudomonas syringae pv. phaseolicola 1448A
MSDYLLQMNGIVKTFDGVKALNGIDIKVRPGECVGLCGENGTGKSTLMKVLSAVYPYGTWDGEILWDGTPLKAQSISETEAAGIVIIHQELTLVPDLSVAENIFMGHELTLPGGRMNYPAMIHRAEVLMRELKVPDMNVALPVSQYGGGYQQLVEIAKALNKKARLLILDEPSSALTRSEIEVLLDIIRDLKAKGVACVYISHKLDEVAAVCDTISVIRDGKHIATTAMSDMDIPKIITQMVGREMSNLYPTEPHEIGEVIFEARNITCYDVDNPGRKRVDDISFALKRGEILGIAGLVGAGRTELVSALFGAYPGRYTGEVWLDGQPVDTRTPLKSIRAGLCMVPEDRKRQGIIPDLGVGQNITLAVLDTYSKMTRIDAEAELGSIDREISRMHLKTASPFLPITSLSGGNQQKAVLAKMLLTRPRVLILDEPTRGVDVGAKYEIYKLMGALAAEGVSIIMVSSELAEVLGVSDRVLVIGEGQLRGDFINHELTQEQVLAAALSHPDAPDNNARKTA

SEQ ID NO: 38962 - DNA, 1572 bp, Pseudomonas syringae pv. phaseolicola 1448A
  CDS (1)..(1572): transl_table=11
atgagagcagcgattgcagacgttacgagggcaacggcggccttgcacttgcagggtatcagtaagcgctttggtgccactcaggcactggatggggtcaacctgcgggtcgaggccggaacgattcatgggctggttggcgaaaacggcgcaggcaagtcaaccctgatcaaggtcctcgccggtattcatcgtgccgatgcgggcagcttgagtattcatggccagcagttcgacagctttactccgcgccagattgaagccacgggcgtgcatttcattcatcaggagcgcttgctgccgggcagcttcagcgtcggcgaggcgttgtttttcgggcaggaaatcaagcgcggtctgttcgtcgatcgacgcgctcaggagcgcgaagcggcccggttgctggatgattattttgccatgcgcctgccgagcggggcgctggtacgcgatctggacagcgcgcagcgacagatattgcagatcactcgcgcactgctggccaaaccgcaggtgctggtgttcgacgagccgagtgtgtcactggtcaaacaggaggtggaccggttgttggcgattgtccggcgcttgcgcgatgacggtctgaccattgtgtacatctcccactacctgcaggaaatcgaatcgttgtgtgatcaggtcaccgtgctgcgcaatggacgcgatgtggcggtggttgatcccgcgcttgtcagcaccgcgcagatcgcccggctgatggtcaatcgcgacgtgggtgagcaatatttccgggcgcagacgcagcccggcccgccagtgcttcaattgaacgggctgggagcagggcgcttttacaacggcgttgacctgagcgtgcgaagtggcgaggtggtgggcctgaccgggctggtcggctcgggtgccaaggaactgctcaagagcctgttcgggctgctcaagccggatcgtggcgacgtgctgttgaatggtcagccgttgggcctgaaatcccctcgtgatgcggtgcgcaacggtatagcgctggtccccgaagagcgccgcacgcatggcgtagcgccagtgctttcggtgctggagaacattaccctggccagcctcgggcgcttcagccgctggggattgctcgacggtgctgcgcagtcaagggaaagccagcgtctgatcggtgaactggcgatcaagacctcaggccatgatgcggcggttcaattgctcagcggtggcaaccagcaaaaggtcgccctggccaagtggctgagtcgacactcgacgttgtacctgctggatgagcccagtgtgggtgtcgacattggtgccaaggtggaaatctaccggctgattgcccggctggctgaaggcggtgcagcagtgctggtgctgtcgtcggacctgccggaactgatcggcatcacccagcgcattgtggtgctgcacagggggcgtattgcgggcgaattcgattcgtcgagcaccgacagtgaccagttgctggcctgcgccaccggtgccagcgaaagccgtcatgacggtaaaaatactctccaggagacccgccatgtccacgcttga

SEQ ID NO: 38963 - protein, 523 aa, Pseudomonas syringae pv. phaseolicola 1448A
MRAAIADVTRATAALHLQGISKRFGATQALDGVNLRVEAGTIHGLVGENGAGKSTLIKVLAGIHRADAGSLSIHGQQFDSFTPRQIEATGVHFIHQERLLPGSFSVGEALFFGQEIKRGLFVDRRAQEREAARLLDDYFAMRLPSGALVRDLDSAQRQILQITRALLAKPQVLVFDEPSVSLVKQEVDRLLAIVRRLRDDGLTIVYISHYLQEIESLCDQVTVLRNGRDVAVVDPALVSTAQIARLMVNRDVGEQYFRAQTQPGPPVLQLNGLGAGRFYNGVDLSVRSGEVVGLTGLVGSGAKELLKSLFGLLKPDRGDVLLNGQPLGLKSPRDAVRNGIALVPEERRTHGVAPVLSVLENITLASLGRFSRWGLLDGAAQSRESQRLIGELAIKTSGHDAAVQLLSGGNQQKVALAKWLSRHSTLYLLDEPSVGVDIGAKVEIYRLIARLAEGGAAVLVLSSDLPELIGITQRIVVLHRGRIAGEFDSSSTDSDQLLACATGASESRHDGKNTLQETRHVHA

SEQ ID NO: 38964 - DNA, 1524 bp, Pseudomonas syringae pv. phaseolicola 1448A
  CDS (1)..(1524): transl_table=11
atgcaacaggctatcgagcaaacatccataaacggtgccttgcgcttcaatggcatcggcaaggtcttccccggcgtaaaggcgctttcggacatcagcttcgaagcgcgccccggcagtgttcacgccttgatgggcgagaacggtgccggtaaatccacgctgctgaaaatcctcggcggctcttatcagcccaatagcggcaccttgcagatcggtgagcagagctaccagttcaaatccaccgccgagagtattgcggcgggtgtggcggtgattcaccaggaattgcatctggtgccggaaatgaccgtcgccgagaacctgctgcttgggcacatgcccaatcgtttcggtttgatcaatcgtggcgcgatgtaccgtcgggcaggtgagctgctcaaaggcctggctgacgaaatcgacccgcgcactcgcctgggtgatctttcactgggccagcggcaattggtggagatcgccaaggccatgtcacgcaatgcgcacgtcatcgcctttgacgaacccaccagcagcctgtcggcacgtgaaattgaccggttgatggcgattatcgtgcggctgcgcgacgaggggcgggtgattctctacgtgtctcatcgcatggaagaaatcttccgtgtctgtgatgccgtaacagtgttcaaggacggtcgttttgtaaaaacctttgagcagatggctgatctggatcatgaccggctggtgacctgcatggtcggccgggatattcagaacatctacaattatcgtccgcgccagcatcaagggcctagcctgcgagtgaccgggttactggggccggggctgcacgaacccgtgagttttgccgtagagaaaggtgaagtgctgggtttcttcgggctggtgggcgccgggcgtaccgagctgttccgtctgctgtcggggttgacgcgcagcacggcaggcacgttgcagctggacggcaagccattgacgctcaagtccccacgcgattcgatcgaagcaggcattctgctctgcccggaggaccgcaagaaggaaggtatcgtgccgctgtccagcgtcgcggagaacatcaacatcggtgcacggccccggcatgtgaatctcggctgcctgattcagggccgctgggagcgcgacaacgcacgcagccagatcaagtcgatgaacgtcaagacaccatcgcctgagcaacagatcatgttcctctccggcggcaatcagcagaaggcgattctcggtcgctggctgtcgatgccgatgaaggtcctgttgctggacgagcccacccgcgggattgacgtcggtgccaagtccgagatctacgagatcattcacaacctggccgccgacgggattgcggtcattgtggtgtccagtgacctgatggaagtcatgggtatttccgaccgcattctggtgatgagcgaaggcgcgatcactggtgaactcaaccgcgatgaggctgatgagtcgcgactcctgcaattggctctgcctcgcacgcgtagctga

SEQ ID NO: 38965 - protein, 507 aa, Pseudomonas syringae pv. phaseolicola 1448A
MQQAIEQTSINGALRFNGIGKVFPGVKALSDISFEARPGSVHALMGENGAGKSTLLKILGGSYQPNSGTLQIGEQSYQFKSTAESIAAGVAVIHQELHLVPEMTVAENLLLGHMPNRFGLINRGAMYRRAGELLKGLADEIDPRTRLGDLSLGQRQLVEIAKAMSRNAHVIAFDEPTSSLSAREIDRLMAIIVRLRDEGRVILYVSHRMEEIFRVCDAVTVFKDGRFVKTFEQMADLDHDRLVTCMVGRDIQNIYNYRPRQHQGPSLRVTGLLGPGLHEPVSFAVEKGEVLGFFGLVGAGRTELFRLLSGLTRSTAGTLQLDGKPLTLKSPRDSIEAGILLCPEDRKKEGIVPLSSVAENINIGARPRHVNLGCLIQGRWERDNARSQIKSMNVKTPSPEQQIMFLSGGNQQKAILGRWLSMPMKVLLLDEPTRGIDVGAKSEIYEIIHNLAADGIAVIVVSSDLMEVMGISDRILVMSEGAITGELNRDEADESRLLQLALPRTRS

SEQ ID NO: 38966 - DNA, 1578 bp, Pseudomonas syringae pv. phaseolicola 1448A
  CDS (1)..(1578): transl_table=11
atgttcggttcagctactgccaacccgcccgcacaacgcgatctgccgtccagtgacagcgatagcccgacgccggatgcccagccgccttatctgcttgaaatcagccatatcagcaagggcttccccggtgtcatcgcgctcaacgacgtccaactgcgtgtgcgccctggcagcgtgctggcgctgatgggcgagaacggtgccggaaagtcaacgctgatgaaaatcatcgctggcatctaccagccggactcgggcgaaatccgcttgcgtggcaagccgattcgcttcgagacgccactttcggccttgcaggccggcattgcgatgatccatcaggagctgaacctgatgccgttcatgagcatcgccgagaacatctggatcggtcgcgaacagctcaacggtctgcacatggtcgatcaccgggaaatgcaccgctgcactaccgaactgctggagcgcctgcgcatcaggctcgatcccgaagacctggtgggcaacctgagtatcgccgagcggcagatggtcgagatcgccaaagctgtgtcatataactcggacgtgctgatcatggatgagccgacttcggccatcaccgaaaccgaagtcgctcacctgttttcgatcatcaacgacctgcgcgctcagggtaaaggcatcatctacatcacccacaagatgaacgaagtcttcgagattgccgacgaagtagcggtttttcgcgacggcgcctatatcggcctgcagcgcgccgaaagtatggacggcgacagcctgatcaccatgatggtggggcgtgagttgacccaactgtttcccgagcgggaaaagccgccaggcgaagtgctgctttcagtcagcaacctgtgcctgaacggcattttcaaggacgtgagtttcgatttgcgtgccggagagattcttggcattgccggattgatggggtcgggccggaccaatgtggccgagaccctgttcggcataacccccagcgacagcggcgaggtacgctttgatggcactacggtacacattgccgacccgcatcaggccattgaactgggttttgcgctgttgacggaagaccgcaagttgactgggctgtttccatgcctgtcggtgatggaaaacatggaaatggccgtgcttgccaactatgccggcaacggtttcgtgcaacagaaggcactgcgtgcgctgtgcgaggacatgtgcaaaaaacttcgggtcaagaccccgtcactggagcagtgcatcgacaccttgtcgggcggtaaccagcagaaggcgttgctggcacgctggctgatgaccaatccccggctactgattctggatgagcccacccgcggcatcgacgtaggggccaaggcggaaatctatcgcctgatctccctgctcgccagtgaaggcatggccgtcatcatgatctcttcagagctgccggaagtcctcggtatgagcgaccgggtgatggtcatgcacgaaggcgaaatgatgggcatcctcgatcgaggcgaagcgacccaggaaaaagtcatgcatctggcctccggccacaaggttcattga

SEQ ID NO: 38967 - protein, 525 aa, Pseudomonas syringae pv. phaseolicola 1448A
MFGSATANPPAQRDLPSSDSDSPTPDAQPPYLLEISHISKGFPGVIALNDVQLRVRPGSVLALMGENGAGKSTLMKIIAGIYQPDSGEIRLRGKPIRFETPLSALQAGIAMIHQELNLMPFMSIAENIWIGREQLNGLHMVDHREMHRCTTELLERLRIRLDPEDLVGNLSIAERQMVEIAKAVSYNSDVLIMDEPTSAITETEVAHLFSIINDLRAQGKGIIYITHKMNEVFEIADEVAVFRDGAYIGLQRAESMDGDSLITMMVGRELTQLFPEREKPPGEVLLSVSNLCLNGIFKDVSFDLRAGEILGIAGLMGSGRTNVAETLFGITPSDSGEVRFDGTTVHIADPHQAIELGFALLTEDRKLTGLFPCLSVMENMEMAVLANYAGNGFVQQKALRALCEDMCKKLRVKTPSLEQCIDTLSGGNQQKALLARWLMTNPRLLILDEPTRGIDVGAKAEIYRLISLLASEGMAVIMISSELPEVLGMSDRVMVMHEGEMMGILDRGEATQEKVMHLASGHKVH

SEQ ID NO: 38968 - DNA, 1506 bp, Mycoplasma hyopneumoniae J
  CDS (1)..(1506): transl_table=4
ttattttttaaacttgagaaaatcaatttaagttttggccctgttaaagttctaaaaaatatgaatttagaactttataaaggcgcagcagtcgccctaattggcgaaaatggggcgggaaaatcaagtctgatgaaagttttaagtggggtttatcaacctgattcagggaaaatgaacttttgtagtgataatatttgcaatcaaaaagttgaattttccggggtaattaattcccaaaaacaaggaattgccattattcaccaagagcaaaatttagttgaaagcctaagtgtttcccagaacattttcctgggacgggaatttcggaattcctttggacttttagattataaaaaacaagatgaagaagcaaaaaaacttttagatactttaggggctgaatttagtccaaaagcacttgtttcttcgctttcgatctcacaaaagcaatttatcgaaatcgccaaagctttatcccaaaaaccggaaattatcatttttgatgaaccgacttcggttctaaccgaaaaagatacccaaaaactttatctgcttgttgaaaaacttaaaaaacaaggaattgcaatcgtctgaattacccatagaatggaagaaattaagaaaacttgtgaatttatcactgtgattcgaaacggaatgtatattgaaagtaagccaataaatgaatttaaaaacgaagatgagattatttctttaatggtcggttttgatatcgagcagcgctatcccgaaaaaacgccggttagaagtaaaaaaccatcgtttttagttagaaatttatcaaatgataaagtttctaatatcagttttgaaatcaaaccaggtgaaattttagttttttatggccttgtaagttcaggtcgaactgaattagctagaactttaattggcgatatgccttatttaaatggtcatattgaactaaatggtcaagaatttcgcccaaaaaatattaaggacagtcttgatcatggaatttattatctttctgaaaataggaaacaaattggtctaaatgttaatttaccaattaattttaatatcacaatttcttctcttggctcaaatcagattttttctttccttccttttgtctcaaaagcaaaaataactaaaactacaaatcattatattaaacaattaaagatcaaaacaacttcacaagatacgccattaacttctttatcaggtggaaatcaacaaaaagtttcacttgcaaaagggcttgcaacccaaccgcaagttttcatcctcgatgaaccaactcgcggagtcgatgttggcgcaagaaaggaaatttataatttaattcaccaattaaaacaagaaaataaaacaattatgataatttcttcggatatgcaagaggttatcggaatcgctgatcgggtaattacaatgtatgaaggcagaattacaagtgaattagttggcccgcaaattaccgatcaaaatataatgaaatattcacttaatttatag

SEQ ID NO: 38969 - protein, 501 aa, Mycoplasma hyopneumoniae J
MFFKLEKINLSFGPVKVLKNMNLELYKGAAVALIGENGAGKSSLMKVLSGVYQPDSGKMNFCSDNICNQKVEFSGVINSQKQGIAIIHQEQNLVESLSVSQNIFLGREFRNSFGLLDYKKQDEEAKKLLDTLGAEFSPKALVSSLSISQKQFIEIAKALSQKPEIIIFDEPTSVLTEKDTQKLYLLVEKLKKQGIAIVWITHRMEEIKKTCEFITVIRNGMYIESKPINEFKNEDEIISLMVGFDIEQRYPEKTPVRSKKPSFLVRNLSNDKVSNISFEIKPGEILVFYGLVSSGRTELARTLIGDMPYLNGHIELNGQEFRPKNIKDSLDHGIYYLSENRKQIGLNVNLPINFNITISSLGSNQIFSFLPFVSKAKITKTTNHYIKQLKIKTTSQDTPLTSLSGGNQQKVSLAKGLATQPQVFILDEPTRGVDVGARKEIYNLIHQLKQENKTIMIISSDMQEVIGIADRVITMYEGRITSELVGPQITDQNIMKYSLNL

SEQ ID NO: 38970 - DNA, 1545 bp, Mycoplasma hyopneumoniae J
  CDS (1)..(1545): transl_table=4
attaaattgaaaaaaactaatattctatcactaaaaaaaataaaaaaagtttatggtcctgtaattgctctttctgatgtgacttttgttgttccaaaaggggaaataactagcctagttggtgaaaatggcgcgggaaaatcgacacttttaaaaattttatcaggagtgattcctgctggacaatatgaaggtgatctaatttttgaagataaaattatggcttttgcaaatacaaaagcctccgaacgtgtcggaattgcaataattcatcaagaactttcaatttcaccttatttatcaatttgcgagaacatgtatatcggtaattatccgactaaatttggcaaagttaactgaaataagatgatttccgaatgcaaaaaatatctagaaatggtcggtcttgatgaagatccaacaacaattgctggctctctttcgattgcaaaacagcaaatggttgagatcgcaaaagcactttcaaaaaatgcaaaactactaattttagatgaaccgacttcctctttaaatgatgaaaatgcttttcgcttacttgatattatgaaaagtttaaaaagtaaaggaattacttcgatttttgtctcccataaattaaatgaagtcaaatatgtctctgataatattgttgtaatccgcgatggtaaattcatttcccagtataataaaaatgaagaaataattgatgaaaaccggctaattcaggacattgttggccggcctttaaagtccaaatttcctcctagggatttagatcgaaaaatcggggaaattatttttgagatcaaagatatagttattcctcatgctagtattgcaaattataatgttgtcaaaaatgcttcccttgatgtaaaacaaggcgaaattgtcggaatttccggacttgttggatcgggtcgaaccgaattaatgctttcactttttgggcagtattataacaaaccttcaagtggcaaagttttctataaaggtaaagaagtaaaatttactaacacaaaacaggcaatcaaatcgggaattatgtatgcttccgaagatcgaaaaaatgttggtctaatccaaattttttcgattcaaaataatatcacttccgccgctttgcatttattttcaaaatgaggaattctaaataaaaataaggaaataattaatgcccaaaaactaaaaaaagatgtaagtattaaaacaaaaaatattctaaataatgtcgaatccctttctgggggaaatcagcaaaaagttgtaattgccaaagctttaagcaccaaatttgaccttctaattatcgatgagccaacaaaaggtattgatgttggctcaaaatacgaaatttataaaattttactagacctttcatcacaaggtaaaacaattattgtaatctcttcggaaattgaagaacttttaggaatcaccgatcgaatttttgtcatgtcccagggaattatcaaaggtcagataaaaacttctgaggcaaatcaagaaaaaattatgcaactaagtattgggggtcttatctaa

SEQ ID NO: 38971 - protein, 514 aa, Mycoplasma hyopneumoniae J
MKLKKTNILSLKKIKKVYGPVIALSDVTFVVPKGEITSLVGENGAGKSTLLKILSGVIPAGQYEGDLIFEDKIMAFANTKASERVGIAIIHQELSISPYLSICENMYIGNYPTKFGKVNWNKMISECKKYLEMVGLDEDPTTIAGSLSIAKQQMVEIAKALSKNAKLLILDEPTSSLNDENAFRLLDIMKSLKSKGITSIFVSHKLNEVKYVSDNIVVIRDGKFISQYNKNEEIIDENRLIQDIVGRPLKSKFPPRDLDRKIGEIIFEIKDIVIPHASIANYNVVKNASLDVKQGEIVGISGLVGSGRTELMLSLFGQYYNKPSSGKVFYKGKEVKFTNTKQAIKSGIMYASEDRKNVGLIQIFSIQNNITSAALHLFSKWGILNKNKEIINAQKLKKDVSIKTKNILNNVESLSGGNQQKVVIAKALSTKFDLLIIDEPTKGIDVGSKYEIYKILLDLSSQGKTIIVISSEIEELLGITDRIFVMSQGIIKGQIKTSEANQEKIMQLSIGGLI

SEQ ID NO: 38972 - DNA, 1506 bp, Mycoplasma hyopneumoniae 7448
  CDS (1)..(1506): transl_table=4
ttattttttaaacttgagaaaatcaatttaagttttggccctgttaaagttctaaaaaatatgaatttagaactttataaaggcgcagcagtcgctctaattggcgaaaatggagctggaaaatcaagtctgatgaaagttttaagtggggtttatcaacctgattcagggaagatgaacttttgtagtgataatatttgtaatcaaaaagttgaattttccggggtaattaattcccaaaaacaaggaatcgccattattcaccaagagcaaaatttagttgaaagcctaagtgtttcccagaacattttcctgggccgtgaatttcggaattcctttggacttttagattataaaaaacaagatgaagaagcaaaaaaacttttagatactttaggggctgaatttagtccaaaagcacttgtttcttcgctttcgatctcacaaaagcaatttatcgaaatcgccaaagctttatcccaaaaaccggaaattatcatttttgatgaaccgacttcggttctaaccgaaaaagatacccaaaaactttatctgcttgttgaaaaacttaaaaaacaaggaattgcaatcgtctgaattacccatagaatggaagaaattaagaaaacttgtgaatttatcactgtgattcgaaacggaatgtatattgaaagtaagccaataaatgaatttaaaaacgaagatgagattatttctttaatgttcggttttgatatcgagcagcgttatcccgaaaaaacgccggttagaagtaaaaaaccatcgtttttagttagaaatttatcaaatgataaagtttctaatatcagttttgaaatcaaaccaggtgaaattttagttttttatggccttgtaagttcaggtcgaactgaattagctagaactttaattggcgatatgccttatttaaatggtcatattgaactaaatggtcaagaatttcgcccaaaaaatattaaggacagtcttgatcatggaatttattatctttctgaaaataggaaacaaattggtctaaatgttaatttaccaattaattttaatatcacaatttcttctcttggctcaaatcagattttttctttccttccttttgtctcaaaagcaaaaataactaaaactacaaatcattatattaaacaattaaagatcaaaacaacttcacaagatactccattaacttctttatcaggtggaaatcaacaaaaagtctcacttgcaaaagggcttgcaactcaaccgcaagttttcatcctcgatgaaccaactcgcggagtcgatgttggagcaagaaaggaaatttataatttaattcaccaattaaaacaagaaaataaaacaattatgataatttcttcggatatgcaagaagttatcggaatcgctgatcgggtaattacaatgtatgaaggcagaattacaagtgaattagttggcccgcaaattaccgatcaaaatataatgaaatattcacttaatttatag

SEQ ID NO: 38973 - protein, 501 aa, Mycoplasma hyopneumoniae 7448
MFFKLEKINLSFGPVKVLKNMNLELYKGAAVALIGENGAGKSSLMKVLSGVYQPDSGKMNFCSDNICNQKVEFSGVINSQKQGIAIIHQEQNLVESLSVSQNIFLGREFRNSFGLLDYKKQDEEAKKLLDTLGAEFSPKALVSSLSISQKQFIEIAKALSQKPEIIIFDEPTSVLTEKDTQKLYLLVEKLKKQGIAIVWITHRMEEIKKTCEFITVIRNGMYIESKPINEFKNEDEIISLMFGFDIEQRYPEKTPVRSKKPSFLVRNLSNDKVSNISFEIKPGEILVFYGLVSSGRTELARTLIGDMPYLNGHIELNGQEFRPKNIKDSLDHGIYYLSENRKQIGLNVNLPINFNITISSLGSNQIFSFLPFVSKAKITKTTNHYIKQLKIKTTSQDTPLTSLSGGNQQKVSLAKGLATQPQVFILDEPTRGVDVGARKEIYNLIHQLKQENKTIMIISSDMQEVIGIADRVITMYEGRITSELVGPQITDQNIMKYSLNL

SEQ ID NO: 38974 - DNA, 1545 bp, Mycoplasma hyopneumoniae 7448
  CDS (1)..(1545): transl_table=4
attaaattgaaaaaaactaatattctatcactaaaaaaaataaagaaagtttatggtcctgtaattgctctttctgatgtgacttttgttattccaaaaggggaaataactagcctagttggtgaaaatggcgcgggaaaatcgacacttttaaaaattttatcaggagtgattcctgctggacaatatgaaggtgatctaatttttgaagataaaattatggcttttgcaaatacaaaagcctccgaacgtgtcggaattgcaataattcatcaagaactttcaatttcaccttatttatcaatttgtgagaatatgtatatcggtaattatccgactaaatttggcaaagttaactgaaataagatgatttccgaatgcaaaaaatatctagaaatggtcggtcttgatgaagatccaacaacaattgctggctccctttcgattgcaaaacagcaaatggttgagatcgcaaaagcactttcaaaaaatgcaaaactactaattttagatgaacccacttcttctttaaatgatgaaaatgcttttcgcttacttgatattatgaaaagtttaaaaagtaaaggaattacttcgatttttgtctcccataaattaaatgaagtcaaatatgtctctgataatattgttgtaatccgcgatggtaaattcatttcccagtataataaaaatgaagaaataattgatgaaaaccggctaattcaagacattgttggccggcctttaaagtccaaatttcctcctagggatttagatcgaaaaatcggggaaattatttttgagatcaaagatatagtcattcctcatgctagtattgcaaattataatgttgtcaaaaatgcctcacttgatgtaaaacaaggcgaaattgtcggaatttccggacttgttggatcgggtcgaaccgaattaatgctttcactttttgggcaatattataacaaaccttcaagtggcaaagttttctataaaggtaaagaagtaaaatttactaacacaaaacaggcaatcaaatcgggaattatgtatgcttccgaagatcgaaaaaatgttggtctaatccaaattttttcgattcaaaataatatcacttccgcggccttgcatttattttcaaaatgaggaattctaaataaaaataaagaaataattaatgcccaaaaactaaaaaaagatgtaagtattaaaacaaaaaatattctaaataatgtcgaatccctttctgggggaaatcagcaaaaagttgtaattgccaaagctttaagtaccaaatttgaccttctaattatcgatgagccaacaaaaggtattgatgttggctcaaaatacgaaatttataaaattttactagacctttcatcacaaggtaaaacaattattgtaatctcttcggaaattgaagaacttttaggaatcaccgatcgaatttttgtcatgtcccagggaattatcaaaggtcagataaaaacttctgaggcaaatcaagaaaaaattatgcaactaagtattgggggttttatctaa

SEQ ID NO: 38975 - protein, 514 aa, Mycoplasma hyopneumoniae 7448
MKLKKTNILSLKKIKKVYGPVIALSDVTFVIPKGEITSLVGENGAGKSTLLKILSGVIPAGQYEGDLIFEDKIMAFANTKASERVGIAIIHQELSISPYLSICENMYIGNYPTKFGKVNWNKMISECKKYLEMVGLDEDPTTIAGSLSIAKQQMVEIAKALSKNAKLLILDEPTSSLNDENAFRLLDIMKSLKSKGITSIFVSHKLNEVKYVSDNIVVIRDGKFISQYNKNEEIIDENRLIQDIVGRPLKSKFPPRDLDRKIGEIIFEIKDIVIPHASIANYNVVKNASLDVKQGEIVGISGLVGSGRTELMLSLFGQYYNKPSSGKVFYKGKEVKFTNTKQAIKSGIMYASEDRKNVGLIQIFSIQNNITSAALHLFSKWGILNKNKEIINAQKLKKDVSIKTKNILNNVESLSGGNQQKVVIAKALSTKFDLLIIDEPTKGIDVGSKYEIYKILLDLSSQGKTIIVISSEIEELLGITDRIFVMSQGIIKGQIKTSEANQEKIMQLSIGGFI

SEQ ID NO: 38976 - DNA, 1560 bp, Ralstonia eutropha JMP134
  CDS (1)..(1560): transl_table=11
atgccactgtctgaagccactgccgccgcggcgccgctgctggaaatgcgcaacatttccaagactttcccgggtgtgaaggcactcagcaatgtccagctcacgatcttcccgggcgaagtccacgcgttgatgggcgaaaacggcgcgggcaaatccacgctgatgaagatactctccggcgcctatatcgccgatgagggcgctgagtgccgcatcggcagccggcccgtggtcatcgacggcccgctcgcggcccgcgcgcatggtgtggcggtgatctaccaggagctgagcctggcccccaacctgagtgtggccgagaacatctatctgggacggcacctgcaccgccacggcatggtggaccgcgccgcaatggcgcgcgcctgcgaaggcacgctagccaggcttggtgctgacttcacgccgcagacgctggtcgagcgcctgtcgatcgcccagcgccaactggtggaaatcgcacgcgcggtgcatttcgagactcgcattctggtgatggacgaacccaccacgccactgtccacccgcgaaaccgaccgcctgttcgcgctgatccgccagctgcgggccgacggcatggccatcatctacatcagccaccgcatggccgagatcgacgaactcgcggatcgcgtcaccgtgctgcgcgacggctactacgtcggcacgctggaaaaggcccagctgacccaggcggggctggtcaagatgatggtcggccgcgacctgtcgggcttctacaccaagacgcatggcgagacgcaggtcggcgacatggtgctgtcggtgcgcaatatgtcggacggccgccgcgtgcgcgattgcagcttcgacctgcatgccggagaggtcctgggcctggctggcctcgtcggcgcgggccgcacggaactggcgaggctggtgtttggcgcggatgcgcgcagcagcggcgcggtgttcctcgccggctcgccactggcgatcagccagccgcgccaggccatcgacgcgggcattgcctacctgacggaagaccgcaagctgcagggcctgttcctcgaccagagcgtgcacgagaacatcaacctgatcgttgccgcgcgcgatgcgctgcgcggcggccggctcaaccgtgcctgcgcacgccggcgtacggccgatgccgtcagttcgctgggcatccgcgtggcgcatccgcgcgtcaatgtcggtgcgctgtcgggcggcaaccagcagaaggtgatgctgtcgcgcctgctggaaaccaagccgcgtgtgctgattctggacgagcccacgcgtggcgtggacatcggtgccaaggcggagatctaccgcctgatcgacgccctcgcccgctccggcgtggccgtcctgctgatctccagcgaattgccggaagtggtaggcctctgcgaccgcgtgctggtgatgcgtgaaggccggctggtgggcgaggtgcaagcctgcccggatgccgcagccacgcaggaacgcatcatcgcactcgccaccggcgcggatgagccggcacaggccaccgtactgcactga

SEQ ID NO: 38977 - protein, 519 aa, Ralstonia eutropha JMP134
MPLSEATAAAAPLLEMRNISKTFPGVKALSNVQLTIFPGEVHALMGENGAGKSTLMKILSGAYIADEGAECRIGSRPVVIDGPLAARAHGVAVIYQELSLAPNLSVAENIYLGRHLHRHGMVDRAAMARACEGTLARLGADFTPQTLVERLSIAQRQLVEIARAVHFETRILVMDEPTTPLSTRETDRLFALIRQLRADGMAIIYISHRMAEIDELADRVTVLRDGYYVGTLEKAQLTQAGLVKMMVGRDLSGFYTKTHGETQVGDMVLSVRNMSDGRRVRDCSFDLHAGEVLGLAGLVGAGRTELARLVFGADARSSGAVFLAGSPLAISQPRQAIDAGIAYLTEDRKLQGLFLDQSVHENINLIVAARDALRGGRLNRACARRRTADAVSSLGIRVAHPRVNVGALSGGNQQKVMLSRLLETKPRVLILDEPTRGVDIGAKAEIYRLIDALARSGVAVLLISSELPEVVGLCDRVLVMREGRLVGEVQACPDAAATQERIIALATGADEPAQATVLH

SEQ ID NO: 38978 - DNA, 1509 bp, Ralstonia eutropha JMP134
  CDS (1)..(1509): transl_table=11
atgaacgcgatgacccaggtcagcccactgctcgagatgcgtggcatctgcaaaacttttccaggcgtcaaggcgctggacgacgtctccttcgacatctatcccggcgaggtgcacatgctccttggcgagaacggcgcaggcaagtcgtcgctgatgaaggtgctgtgcggcgtttatgtggccgatgccggcgagttccaccatcagggccagcgcgtcgaggtatcggggccggcggacacgatgcggctcggcatcgccgtgatcttccaggaattctcgctggtgccctacctcgacatcgcgcagaacatttttcttggccgtgagccgcgcggacgggtgccgggctcggtggaccatgcaaagatgcatgccgaagcgcggcgcctgctggacacgctcggcatggacatcagcacgcatacgcccgtgcatcgcctgggcgtggcgcagcagcagatgatcgagattgccaaggcgctgtcgcagaacgcacgcatcctcgtgctggatgagcccacggccgctctctccgagcgcgagaccgaaaagctgttcggcgtcatcgcacgcctcaaggccgacggcgtgtcgatgatctatatctcgcaccgcatggcggaagtcttcgcgctcggtgaccgcatcaccgtcatgcgagacggccgcaaggtcggcagctacatgcccggcgatgccacgcctgatgaactggtggcgcgcatggtcggccgcaaggtggacatgggctacacccgcacacgcggcggcccggtcggcgaggtggcgctcgacatgcaaggcgtcagcgctgacaacggcattgacgacatcacgctgcaggtgcgtgccggtgagatcgtcgggctggccgggctcgtcggctcagggcgcagcgaggtcgcgcgggctgtgtttggcgcggacccggtgcgcgcgggcgaaatccgcattttcggcaagtccatgcgcggcggtcccgacaaggcacgcgcgctcggcgcggcgctgatccccgaaagtcgcaagaccgaagggctcgcgctgatccgctcggtgcgcgacaacctgctcctggccggcctgcgccgcgcctttcccgcacactggtatcgcagcggcaaggcggcgcagctgtccacgcgcgagattggacggctgcgcattgccacgccgagcggcgaccagctcgcgcagttcctgtcgggcggtaaccagcagaagatcgtgatcggcaagtggctggtcgccgaatcgcgcctgttcattttcgacgagcctacgcgcggcatcgacgttggcgccaaggccgaaatcttcgcgctgatcgacgggctggtgaagcaaggcgccgccgtgctgctgatcagttccgagctgccagagatcatcaacgtatgcgaccgcacctatgtcatgcgcggcggccgcgtcgccggcgagcttgcgcatgacgccatgaccgaggaaagcattctgcaactggggatgaacgatgcctga

SEQ ID NO: 38979 - protein, 502 aa, Ralstonia eutropha JMP134
MNAMTQVSPLLEMRGICKTFPGVKALDDVSFDIYPGEVHMLLGENGAGKSSLMKVLCGVYVADAGEFHHQGQRVEVSGPADTMRLGIAVIFQEFSLVPYLDIAQNIFLGREPRGRVPGSVDHAKMHAEARRLLDTLGMDISTHTPVHRLGVAQQQMIEIAKALSQNARILVLDEPTAALSERETEKLFGVIARLKADGVSMIYISHRMAEVFALGDRITVMRDGRKVGSYMPGDATPDELVARMVGRKVDMGYTRTRGGPVGEVALDMQGVSADNGIDDITLQVRAGEIVGLAGLVGSGRSEVARAVFGADPVRAGEIRIFGKSMRGGPDKARALGAALIPESRKTEGLALIRSVRDNLLLAGLRRAFPAHWYRSGKAAQLSTREIGRLRIATPSGDQLAQFLSGGNQQKIVIGKWLVAESRLFIFDEPTRGIDVGAKAEIFALIDGLVKQGAAVLLISSELPEIINVCDRTYVMRGGRVAGELAHDAMTEESILQLGMNDA

SEQ ID NO: 38980 - DNA, 1491 bp, Staphylococcus saprophyticus subsp. saprophyticus ATCC 15305
  CDS (1)..(1491): transl_table=11
atgattgaaatgaagaatatttataaatcttttggtcagaatgatgttcttagaggtgtggattttgatattgcggatgccgaagttcatgcattgatgggggagaatggtgccggcaaaagtacgttaatgaaaattttaaccggcgtttatgaagcaaatggtggacaaattttagaagatggtaaaccacttcaatttaaaaatacaaaagacgctgagcaacatggtgtgtcatttattcaacaagaattaaatatttggcctaatttaacggttttagaaaacctatttttaggtaaagaaccaacgaagtttttagggataattaatcataaagtgatgagaaaacaagcgttggaaatatttaacaatttaaatatacagcttgatttgaatcaaatggctgggacgttatcagtaggtatgcaacaaatgttagaaattagtaaagcattaatgcaagattctaaagtcattattatggacgaaccaacggcagctttaacgactagtgagattgaagtgttattcacacaaattaataaattaaaatctaaaggtgtttcatttatttatatttcacatagaatggaagaaatttttaatattgcagaccgtattacagtgatgagagacggccggtctatattaacttcgaacacgcaagagacctctaatgcaaaaattgtaaaagccatgattggtagagatttggataaccagtatccagaaagaaattataagcaagatgaattagtgctgtcagttaatcagttaagttctacggtatatgacttaaatgatgtacattttgagttacacaagggtgagatttttggattcagtggacttatgggtgctggtagatctgaaatcatgcgcgtgttatttggcctagacaaaggacaaatgcaagtaacacttaatggtaaaaccattcacatgaataatcctaagacggccataaagcacgggttagcgtttattactgaaaatagaaaagaagaaggtttagttctacaagattctattatagaaaatatttcattacctgcattgaaaagtttttcaaagggtggttttttaacaccaacagcgatgaacaattatacagaacagatgattcagcgtttgaatatcaaaggtggaaaagatgatagttgtatggatttatctggaggaaatcaacaaaaggttgttttggctaaatggattgctactgcaccacacgttttgattttagacgaaccaactaggggaattgacgttggcgcaaaacgtgaaatttatcaattaatgaatgaactgacagaacgtggtatgtctatcattatgatttcatcagaattaccagaagtgataggaatgagtgatagagttgccgttgtacatgaaggtaatattgcaggtgttttaaataaaaaagatctaactgaggaacgtattatgacattagctacaggagggaatatcaatgaaacaatctag

SEQ ID NO: 38981 - protein, 496 aa, Staphylococcus saprophyticus subsp. saprophyticus ATCC 15305
MIEMKNIYKSFGQNDVLRGVDFDIADAEVHALMGENGAGKSTLMKILTGVYEANGGQILEDGKPLQFKNTKDAEQHGVSFIQQELNIWPNLTVLENLFLGKEPTKFLGIINHKVMRKQALEIFNNLNIQLDLNQMAGTLSVGMQQMLEISKALMQDSKVIIMDEPTAALTTSEIEVLFTQINKLKSKGVSFIYISHRMEEIFNIADRITVMRDGRSILTSNTQETSNAKIVKAMIGRDLDNQYPERNYKQDELVLSVNQLSSTVYDLNDVHFELHKGEIFGFSGLMGAGRSEIMRVLFGLDKGQMQVTLNGKTIHMNNPKTAIKHGLAFITENRKEEGLVLQDSIIENISLPALKSFSKGGFLTPTAMNNYTEQMIQRLNIKGGKDDSCMDLSGGNQQKVVLAKWIATAPHVLILDEPTRGIDVGAKREIYQLMNELTERGMSIIMISSELPEVIGMSDRVAVVHEGNIAGVLNKKDLTEERIMTLATGGNINETI

SEQ ID NO: 38982 - DNA, 1512 bp, Shigella sonnei Ss046
  CDS (1)..(1512): transl_table=11
atgttcacggcaacagaggcagtcccggtagcaaaagtggtggcaggaaataagcgttaccccggcgtcgttgcgctggataacgttaacttcacgctcaataaaggcgaagttcgtgcgctgttaggtaaaaacggcgcgggcaaatcgactctcattcgaatgcttaccggcagcgaacgcccggatagcggtgatatctggattggcgagacgcgactggaaggtgacgaagctacgttgactcgccgtgccgctgaactgggggttcgtgcggtttatcaggaattaagtctggtggaagggctgacggtggcagaaaacctctgccttggtcaatggcctcgccgcaacggcatgattgattacctgcaaatggcgcaggatgcccaacgttgcttacaggcgctgggcgttgacgttagtcctgaacaacttgtttcaacgctaagcccggcgcaaaagcaactggtggaaattgcacgggtgatgaagggcgagccgcgcgtggtcattcttgatgaacccaccagctcgcttgccagtgcagaagttgaactggtgatcagtgcggtgaaaaagatgtcggcactgggcgtggcggtgatttatgtcagccaccggatggaagaaatccgccgcattgcctcctgtgccaccgttatgcgcgatggtcaggtggcgggcgatgtgatgctcgaaaacacctccacgcatcatattgtgtcgctaatgctagggcgtgatcacgttgatattgcgccggttgcccctcaggaaattgtggatcaggccgtactggaagtccgtgcgttacgccataagcccaagctggaggatatcagctttacgttacgtcgcggcgaagtgcttggcattgctggcctgctgggggcagggcgcagtgaattgctgaaggcgattgttgggctggagacgtatgaacagggcgaaattgttatcaacggcgagaaaatcacgcgccccgattacggcgacatgctgaaacgcggcattggctatacgccagaaaaccgcaaagaagcggggatcattccctggttgggcgttgacgaaaatacagtgctgaccaatcggcaaaaaatcagcgccaacggagtgctgcaatggtccaccatccgccgcctgaccgaagaggtgatgcagcggatgacggtcaaggccgctagtagcgaaacgcccatcggcacgctttctggtggcaatcagcaaaaagtggtgatcggtcgttgggtctatgccgccagccagattttgttgctcgacgagccaacgcgcggcgtcgatatcgaagccaaacagcagatttaccgtattgtccgtgagctggctgccgaaggaaaaagcgtggtgtttatctccagtgaagtggaggagttgccgctggtgtgtgaccgcatcctgttattacagcacggcacgttctcgcaggagtttcactcgccggtcaatgtggatgagctgatgtccgccattctgtctgtgcactga

SEQ ID NO: 38983 - protein, 503 aa, Shigella sonnei Ss046
MFTATEAVPVAKVVAGNKRYPGVVALDNVNFTLNKGEVRALLGKNGAGKSTLIRMLTGSERPDSGDIWIGETRLEGDEATLTRRAAELGVRAVYQELSLVEGLTVAENLCLGQWPRRNGMIDYLQMAQDAQRCLQALGVDVSPEQLVSTLSPAQKQLVEIARVMKGEPRVVILDEPTSSLASAEVELVISAVKKMSALGVAVIYVSHRMEEIRRIASCATVMRDGQVAGDVMLENTSTHHIVSLMLGRDHVDIAPVAPQEIVDQAVLEVRALRHKPKLEDISFTLRRGEVLGIAGLLGAGRSELLKAIVGLETYEQGEIVINGEKITRPDYGDMLKRGIGYTPENRKEAGIIPWLGVDENTVLTNRQKISANGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHSPVNVDELMSAILSVH

SEQ ID NO: 38984 - DNA, 1506 bp, Shigella sonnei Ss046
  CDS (1)..(1506): transl_table=11
atggaagcattacttcagcttaaaggcatcgataaagccttcccgggcgtaaaagccctctcgggcgctgcgttaaatgtctatccgggccgcgtgatagcgctggtgggcgaaaacggcgcgggtaaatccaccatgatgaaagtgcttactggtatctatactcgcgatgccggcacgcttttatggctggggaaagaaacgacatttaccgggccgaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgtgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgacgggcaatttattgctgagcgcgaagtggcatcactgaccgaagattcgctgattgagatgatggtgggccgcaagctggaagatcaatatccacacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcacagccgcgcaccagcggttacgtcaccctggatgggcatgaagtcgttacccgttcaccgcaggatggcctggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggcagtgagtgatttcattcgtctgtttaatgtgaaaacaccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 38985 - protein, 501 aa, Shigella sonnei Ss046
MEALLQLKGIDKAFPGVKALSGAALNVYPGRVIALVGENGAGKSTMMKVLTGIYTRDAGTLLWLGKETTFTGPKSSQEAGIGIIHQELNLIPQLTIAENIFLGREFVNRFGKIDWKTMYAEADKLLAKLNLCFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLDKAPGDIRLKVDNLCGPGVNDVSFTLRKGEILGVSGLMGAGRTELMKVLYGAQPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 38986 - DNA, 1503 bp, Shigella sonnei Ss046
  CDS (1)..(1503): transl_table=11
atgacgaccgaccaacaccaggagatcctccgcaccgaaggattaagtaaatttttccccggcgtcaaagcgttagacaacgttgatttcagcctgcgccgtggcgaaatcatggcgctgcttggtgaaaacggggcgggaaaatcaacgctaatcaaagcattaactggtgtataccacgccgatcgcggcaccatctggctggaaggccaggctatctcaccgaaaaataccgcccatgcacaacaactcggtattggcaccgtctatcaggaagtcaacctgctacccaatatgtcggttgctgataatctattcataggtcgcgaacccaaacgtttcggccttctacgccgtaaagagatggaaaagcgcgccaccgaactgatggcatcttacggtttcttcctcgacgtgcgcgaaccgcttaaccgcttttcagtcgcgatgcagcaaatcgtcgccatttgccgggctatcgatctctccgccaaagtgctgatcctcgatgaacccaccgccagcctcgacacccaggaagtggagctattatttggcctgatgcgtcagttgcgcgatcgcggcgtcagcctgatctttgtcactcactttctcgatcaggtctatcaggtcagcgatcggatcactgtcttacgcaacggcagtttcgtaggctgtcgggaaacgcgcgagctaccgcagatcgaactggtaaaaatgatgctggggcgcgagctggatacccacgtgctacagcgtgccgggcgaacattgttgagcgacaaacccgttgccgcgttcaaaaattacggcaaaaaaggaacgatagcaccgtttgatctcgaagtgcgccccggcgagatcgtcggtctggctggcttgctgggatccggacgtaccgaaaccgccgaagtgatcttcggtatcaaacctgctgacagcggcacggcgttgatcaaaggcaaaccgcaaaccctgcgatcgccacatcaggcttcagtactgggcatcggattctgcccggaagacaggaaaaccgatggcatcatcgccgccgcctcggtgcgggaaaatatcatcctcgctctccaggcccagcgcggctggctacgacccatttcccgcaaagagcagcaagagattgccgaacgctttatccgccagcttggcattcgcacaccttcaactgaacaaccgattgaatttctctccggtggcaatcagcaaaaagtgctgctttcacgttggctactgacccgaccgcaatttctgatccttgatgagccaacccgtggcattgatgttggtgcccacgccgagatcatccgcctgattgaaacgctgtgtgctgacggtctggcgctgctggtgatctcctccgaactggaagagctggtgggctatgccgaccgggtgatcatcatgcgcgatcgcaaacaggtggcggagatcccgctggcacagctttccgttccggcgatcatgaacgccattgcggcgtaa

SEQ ID NO: 38987 - protein, 500 aa, Shigella sonnei Ss046
MTTDQHQEILRTEGLSKFFPGVKALDNVDFSLRRGEIMALLGENGAGKSTLIKALTGVYHADRGTIWLEGQAISPKNTAHAQQLGIGTVYQEVNLLPNMSVADNLFIGREPKRFGLLRRKEMEKRATELMASYGFFLDVREPLNRFSVAMQQIVAICRAIDLSAKVLILDEPTASLDTQEVELLFGLMRQLRDRGVSLIFVTHFLDQVYQVSDRITVLRNGSFVGCRETRELPQIELVKMMLGRELDTHVLQRAGRTLLSDKPVAAFKNYGKKGTIAPFDLEVRPGEIVGLAGLLGSGRTETAEVIFGIKPADSGTALIKGKPQTLRSPHQASVLGIGFCPEDRKTDGIIAAASVRENIILALQAQRGWLRPISRKEQQEIAERFIRQLGIRTPSTEQPIEFLSGGNQQKVLLSRWLLTRPQFLILDEPTRGIDVGAHAEIIRLIETLCADGLALLVISSELEELVGYADRVIIMRDRKQVAEIPLAQLSVPAIMNAIAA

SEQ ID NO: 38988 - DNA, 1557 bp, Nostoc punctiforme PCC 73102
  CDS (1)..(1557)
atggcaacaagtatagaaacctcatttcctgatgcaccaagcaccacccctgtattagaaatgcaagggattaccaaacgatttcatggtgtatctgcgctccaaaatgttaatctcacgatttatccgggagaagttcatgccctgatgggtgaaaacggggcaggcaaaagcacattgatgaaaatcttggctggagcttacattgctgatgaaggagaaattcgcatcaatggtcaacccttgaaaattaccgatccggcgacagcacgcaaggcgggtattaatcttatttatcaagaactgaatgttgcacctaatttaaccgttaccgaaaatatgtttatgggtagcgagttgcgtcggggtcagtttttagaccgcaaagccatgcaacttgaagcagagcaagtgttagatagcttgggagccaattttacagcgcagactatagttgggactttatccatcgcagaacagcagcaagtcgaaattgccagagcgctgaaagataaaagccgggttttggtgatggatgagccaacagcagcattatctgaccgcgagagcgaccatttattcgaagtaattcgcaaactacggagtgatggcattgcgattatttacatcagtcatcgtatggaagaaatctatgctttagctgaccggattagcgtactgcgcgatggtcaatatattggtagtcttacacgcagcgaaatttctccacagcgattggtgcagatgatggttggtcgctccatgcaagacttttacgaacatcaacggcaaatgaatcctggccctgtggtgctggaagtcagaaacatgagtgatgctcgcaaaaagattgagcctgctagctttgaacttcatgcaggggaaattctcggtttagcggggttagttggtgcaggacgcacagaattatcccggctaatttttggtgctgaccgtaaagctagtggcgaagtatttttaaatggcaaaaaactagaaattaatacgcccagtgatgcgatcgctgccggaattggctatgtcccggaagaccgcaaagaccaaggtttatttctagagatgagcgcccgcaagaatattgctatcaacacactcaagcaggatgctaaaggtggaattgttaactggccttcagtgaatcggctgtcaacagaagcggtggaaaactttaatatccgcctggccaatttggaaattagagcattggatctttctggtgggaatcaacagaagctactgctagcgcgttggttagccattaaacctagagtactgatgttagatgagccgacacgcggcgtagatattggtgccaaaagcgaaatttaccgaattatgagtgaattggcagcacaaggtgttgctattttaatggtttccagcgaactatcagagattgtcggtatgagcgatcgcgtcttagtgatgcgagaaggacaactggtaggcgaactagacggcagccttggcaaagaaatcaaacaagaaaagattatgcactacgcaactggagcatcggaggtatcagcattatga

SEQ ID NO: 38989 - protein, 518 aa, Nostoc punctiforme PCC 73102
MATSIETSFPDAPSTTPVLEMQGITKRFHGVSALQNVNLTIYPGEVHALMGENGAGKSTLMKILAGAYIADEGEIRINGQPLKITDPATARKAGINLIYQELNVAPNLTVTENMFMGSELRRGQFLDRKAMQLEAEQVLDSLGANFTAQTIVGTLSIAEQQQVEIARALKDKSRVLVMDEPTAALSDRESDHLFEVIRKLRSDGIAIIYISHRMEEIYALADRISVLRDGQYIGSLTRSEISPQRLVQMMVGRSMQDFYEHQRQMNPGPVVLEVRNMSDARKKIEPASFELHAGEILGLAGLVGAGRTELSRLIFGADRKASGEVFLNGKKLEINTPSDAIAAGIGYVPEDRKDQGLFLEMSARKNIAINTLKQDAKGGIVNWPSVNRLSTEAVENFNIRLANLEIRALDLSGGNQQKLLLARWLAIKPRVLMLDEPTRGVDIGAKSEIYRIMSELAAQGVAILMVSSELSEIVGMSDRVLVMREGQLVGELDGSLGKEIKQEKIMHYATGASEVSAL

SEQ ID NO: 38990 - DNA, 1539 bp, Burkholderia cepacia R18194
  CDS (1)..(1539)
atgcaacccgacctgactccgaaccccgcgccgccgctgatcgcattgaccggtatcggcaagcgcttccccggcgtacaggcgctcgacgattgccatttcgacctgcgtgccggcgaagtgcatgcgctgatgggcgagaacggcgccggcaagtcgacactgatgaagatcctggcgggcgtctaccagcgcgacgacggcgagatccggatggacggccgtgcagtggaaatcgccgatccgcgcgccgcgcaggcgctcgggatcggcatcatccatcaggaactgaacctgatgaaccacctgagcgtcgcgcagaacatcttcatcggccgcgagccgcgcggccgcttcggcgtgttcgtcgacgaagcggcactcaaccgcgacgcggccgcgatcttcgcgcggatgcggctcgatctcgacccgcgtacaccggtcggacagctcacggtggcgaagcagcagatggtcgagatcgcgaaggcgctgtcgttcgactcgcgcgtgctgatcatggacgaaccgaccgccgcgctcaacaacgcggagatagccgagctgttccgcatcatcggcgacctgcgcgcacacggtgtcggcatcgtctacatctcgcacaagatggacgagctgcgccagatcgccgatcgcgtgaccgtgatgcgcgacggcaagtatgtcgcgaccgtgccgatggcggacacgtcgatggacgcgatcatcgcgatgatggtcggccgccagctcgccaccgaattccgcacgccgcccgatacgtccgcgaacgacgtcgcgctcgaagtgcgcgggctgtcgcgcggccgtgcgattcgcgatgtcggcttcacgctgcggcgcggcgagatcctcggcttcgcggggctgatgggcgcgggccgcaccgaggtcgcgcgagcggtgttcggtgcggacccggtcgacgcgggcgagatccgcgtgcatggcaagaccgtgtcgatccgctcgccggccgacgcggtgaggcacggcatcggctacctgtccgaggatcgcaagcacttcgggctcgcggtcgggatggacgtgcagaacaacatcgcgttgtcgagcatgcgccgcttcgtgcgccgcggcttgttcctcgacgcgcgtgcgctgcgcgacaccgcgcaatcgtacgtgcggcagctcgcgatccgcacgccgtcggtgacgcagccggcgcggctgctgtcgggcggcaaccagcagaagatcgtgatcgcgaagtggctgctgcgcgactgcgacatcctgttcttcgacgaaccgacgcgcggcatcgacgtcggcgcgaaaagcgagatctacaagctgctcgacgcgctcgccgccgacggcaaggcgatcgtgatgatctcgtcggagctgcccgaagtgctgcgcatgagccaccggattctcgtgatgtgcgaagggcgcgtgaccggcgaattgcgcgcggccgacgccacgcaggaaaagatcatgcagctcgcgacgcagcgcgagtcgaccgtattgtcctga

SEQ ID NO: 38991 - protein, 512 aa, Burkholderia cepacia R18194
MQPDLTPNPAPPLIALTGIGKRFPGVQALDDCHFDLRAGEVHALMGENGAGKSTLMKILAGVYQRDDGEIRMDGRAVEIADPRAAQALGIGIIHQELNLMNHLSVAQNIFIGREPRGRFGVFVDEAALNRDAAAIFARMRLDLDPRTPVGQLTVAKQQMVEIAKALSFDSRVLIMDEPTAALNNAEIAELFRIIGDLRAHGVGIVYISHKMDELRQIADRVTVMRDGKYVATVPMADTSMDAIIAMMVGRQLATEFRTPPDTSANDVALEVRGLSRGRAIRDVGFTLRRGEILGFAGLMGAGRTEVARAVFGADPVDAGEIRVHGKTVSIRSPADAVRHGIGYLSEDRKHFGLAVGMDVQNNIALSSMRRFVRRGLFLDARALRDTAQSYVRQLAIRTPSVTQPARLLSGGNQQKIVIAKWLLRDCDILFFDEPTRGIDVGAKSEIYKLLDALAADGKAIVMISSELPEVLRMSHRILVMCEGRVTGELRAADATQEKIMQLATQRESTVLS

SEQ ID NO: 38992 - DNA, 1545 bp, Pseudomonas fluorescens PfO-1
  CDS (1)..(1545)
atgcacgcgcaagtacagacacaagaacacagcgccagcggcagcctgcgtttcaacgggatcggcaagaccttcccgggcgtgaaggcgctggacggcatcagtttcgtcgcgcatcccgggcaggttcacgccttgatgggcgagaacggcgccggcaaatcgaccctgctgaaaatcctcggtggcgcctacattccgagcagcggcgagctgcagatcggcgagcagacgatggccttcaagtccactgccgacagcatcggcagcggcgtggcggtgattcaccaggaactgcatctggtgccggaaatgaccgtggcggagaacctgtttctcggtcacctgccggccagtttcggcctgatcaatcgcggcgcgctgcgccagcaagccttggcttgcctcaaaggcctggccgatgaaatcgacccgcagaccaaggtcggacgcctgtccctcggtcagcggcaactggtggaaatcgccaaggcgctgtcccgtggcgcgcacgtgattgccttcgacgaaccgaccagcagcctctcggctcgggaaatcgaccggttgatggcgatcatcggccggctgcgtgacgagggcaaagtagtgctctacgtctcccatcgcatggaagaagtgttccgcatctgcgacgcggtgacggtgttcaaggacggtcgctacgtgcgcaccttcgacgacatgagccagttgacccacgatcaactggtgacctgcatggtcggtcgcgacattcaggacatctacgattatcgcggtcgcccgcgcggtgccgtggcgctgagagtcgatggcttgctcggcccgggcctgcgcgagccgatcagtttcgatgcgcacaagggcgagattctgggcctgttcgggctggtcggggcagggcgcaccgagctgttccggctgctcagcggtctggagcgcaacaccgccggacgcctggaattgcgcggccatgaactgaagctgcgttcgccccgcgatgcgattgccgccgggattctgctatgcccggaggatcgcaagaaggaaggcatcattccgctcgccagtgtcgccgagaacatcaacatcagtgcgcgcggtgcgcattccgggctcggctgcctgctgcgcgggatttgggaaaagggcaacgccgagaaacagatcaaggccctgaaagtgaaaacgccccacgccgggcaacagatcaagttcctgtccggcggcaatcagcagaaggcgattctcggccgctggctgtcgatgccgatgaaagtcctgctgctcgacgagccgacccggggtatcgacatcggcgccaaggccgagatctaccagatcatccataacctggccgccgacggtatttcggtaatcgtggtgtccagcgatctgatggaagtgatgggtatttccgaccgcattctggtgctgtgcgagggcgccttgcgtggcgaagtcagccgcgaccaggccaacgaatccaacctgctgcaactggctttgccgcgccaccgcgctgacggcgtggcgaactga

SEQ ID NO: 38993 - protein, 514 aa, Pseudomonas fluorescens PfO-1
MHAQVQTQEHSASGSLRFNGIGKTFPGVKALDGISFVAHPGQVHALMGENGAGKSTLLKILGGAYIPSSGELQIGEQTMAFKSTADSIGSGVAVIHQELHLVPEMTVAENLFLGHLPASFGLINRGALRQQALACLKGLADEIDPQTKVGRLSLGQRQLVEIAKALSRGAHVIAFDEPTSSLSAREIDRLMAIIGRLRDEGKVVLYVSHRMEEVFRICDAVTVFKDGRYVRTFDDMSQLTHDQLVTCMVGRDIQDIYDYRGRPRGAVALRVDGLLGPGLREPISFDAHKGEILGLFGLVGAGRTELFRLLSGLERNTAGRLELRGHELKLRSPRDAIAAGILLCPEDRKKEGIIPLASVAENINISARGAHSGLGCLLRGIWEKGNAEKQIKALKVKTPHAGQQIKFLSGGNQQKAILGRWLSMPMKVLLLDEPTRGIDIGAKAEIYQIIHNLAADGISVIVVSSDLMEVMGISDRILVLCEGALRGEVSRDQANESNLLQLALPRHRADGVAN

SEQ ID NO: 38994 - DNA, 1902 bp, Burkholderia vietnamiensis G4
  CDS (1)..(1902): transl_table=11
atgggtcgtctacgcgctcaacgaggagaccgtgctcggcgcggtgcgcgcgaccgaacagctgcacatcccggccgcggacgtgatcggcgtcggcatcaacggtgcgggcgaggcgttcgccgagttccagaagaaggagccgaccggcttctacgggacgatcgcggtcagctcgacgaaccacggcaaggacagcacgcagaacctcgtcgactggatccgcaacggcaagatgccgccggccgacacgcagacgagcggcaagctgatgacgcgcgcgaactggcaggccgtgcgcgccgagctgggcatctgagcgtgcggggcgacgacgcgatgacgatgcagacgatcacggccgtgcccggcaacggcgccgcggccacgcccggcgccgcgacgccgctcgccggcggcgcgctgctcgcgctcgacggcatcacggtgacgttcccgggcgtgcgcgcgctcgacggcgtgtcgctggcggtgcgcgcgggcgaggtgcacgggctgatgggcgagaacggcgccggcaagtcgacgctgctgaaggtgctgtccggcgtgaaccagccgcaggccggcacgttgacgctgaacggcaccgagcagcgcttcgcgtcgacgcgcgcggcgctcgaggccggcatcgcgatcatctatcaggaactgcacctggtgccggagctgacggtcgcggaaaacctgatgctcggccaactgccgagccggctcggcgtggtcgacgaacgcgcgctcgccgtgcgcgcgctcgacgcgctggagcggctcggcgagcacatcgatcccgacatcccggtgaagtacctgtcgatcggccagcgccagatgatcgagatcggcaaggcgctgatgcgcgacgcgcgcgtgatcgcattcgacgaaccgaccagctcgctgtcggcgcgcgagacgacgcagctgttccgcatcatccgctcgctgcgcgaacagggccgcgcgatcatctacgtgacgcaccggatggaggaggtcgacgcgctgtgcgatcgcgtgacggtgttccgcgacggccggcggatcgagacgttcgagtcggtcgccgatctcgaccgcgaccggctgatcggctgcatggtcggccgctcgatcgaggacgtctacggctaccggccgcgcgcggccggcgacgtgatgatcgaggcgaaggccttgaccggccccggcctgtccgagccggtgtcgttcgccgcgcggcgcggcgagatcgtcggcttcttcgggctggtcggcgcaggccgctcggagctgatgaagctgctgtacggcgccgtgcgtccgaccggcgggcacgtcgagctgggcggcgcgcgcgtcgcgttcaggagcccgcgcgacgcggtgcgcgccggtatcgcgctgtgtccggaggaccgcaagcacgagggcatcgtcgcgatcgcgtcggtggccgacaacctgaacatcagcgcgcgccgccacttcagcccggcgcgcatgctgctcgacgggcggcgcgagcgcgagctcgcgcagaagtacatcgagcggctcgcgatcaagacgcgcgacggcgacacgccgatcggcgcgctgtcgggcggcaaccagcagaaggtcgtgctcgcgcgctggctggccgagcgcatcgacgtgttcctgatggacgagccgacgcgcggcatcgacgtcggcgcgcgcgccgaaatctacaacctgttttacgaactcgcggaagcgggccgcaccgtgatcatcgtgtcgagcgatctcgccgaagtgatcggcgtggcggaccgcatcatcgtgatgaaggaagggcgcatcgcgggcgaggtcgcgaaggcgcaggcgacgcccgacacgctgatcaagctcgcgctgccgcgctag

SEQ ID NO: 38995 - protein, 633 aa, Burkholderia vietnamiensis G4
MGRLRAQRGDRARRGARDRTAAHPGRGRDRRRHQRCGRGVRRVPEEGADRLLRDDRGQLDEPRQGQHAEPRRLDPQRQDAAGRHADERQADDARELAGRARRAGHLSVRGDDAMTMQTITAVPGNGAAATPGAATPLAGGALLALDGITVTFPGVRALDGVSLAVRAGEVHGLMGENGAGKSTLLKVLSGVNQPQAGTLTLNGTEQRFASTRAALEAGIAIIYQELHLVPELTVAENLMLGQLPSRLGVVDERALAVRALDALERLGEHIDPDIPVKYLSIGQRQMIEIGKALMRDARVIAFDEPTSSLSARETTQLFRIIRSLREQGRAIIYVTHRMEEVDALCDRVTVFRDGRRIETFESVADLDRDRLIGCMVGRSIEDVYGYRPRAAGDVMIEAKALTGPGLSEPVSFAARRGEIVGFFGLVGAGRSELMKLLYGAVRPTGGHVELGGARVAFRSPRDAVRAGIALCPEDRKHEGIVAIASVADNLNISARRHFSPARMLLDGRRERELAQKYIERLAIKTRDGDTPIGALSGGNQQKVVLARWLAERIDVFLMDEPTRGIDVGARAEIYNLFYELAEAGRTVIIVSSDLAEVIGVADRIIVMKEGRIAGEVAKAQATPDTLIKLALPR

SEQ ID NO: 38996 - DNA, 1545 bp, Burkholderia cenocepacia AU 1054
  CDS (1)..(1545): transl_table=11
atggcaatgcctcgcaatctgcccggtcaggccgcgcacgacgaagccgaccaggagatcctgcgcctggacgggattcgcaagcgcttcccgggcgtcctcgcgctcgacgggattcgcctcgacctgcgccgcggcgaggtgcatgcggtgtgcggcgaaaacggcgcgggcaaatcgacgctgatgaagatcatcagcggccaatacctgcccgacgagggtgccgttcactatcgcggcgcgccggtgcggtttcgttcggcttccgaagcgcaggcggccggcatctcgatcatccaccaggaactcaatctcgtcccgcacctgagcgtggcggagaacctgttccttgcgcgcgagccgcggcgcgggccgttcgtcgatacgaaacgcatgaacgcggaggcggcgcgctgcatcgcgcgcatcggcctgaacgtcgcgccgacgacgaaggtcggcgtgctgtccatcgcgcagcagcaaatggtcgagatcgcgaaggcgctgtcgcacgatgcgcgcgtgctgatcatggacgagcccacgtcgtcgctgacggaagcggaaacggtgcaactctttcgcatcatcgaggagctgcgcgccgacggcgtggcgattctgtatatctcgcaccggctcgacgaaatggcgcagatcgtcgatcgcgtgacggtgctgcgcgacgggcgccacatttcgacggacgatttcgccgacgtgagcatcgacgacatcgtcgcgcgcatggtggggcggacgctcgacgacgcctatccgtcgcggcaatcggtgccgaccgacgacgtgctgctcgacgtgcgggacctgcgtcgcgacggcgtgttcgggccggtgtcgttcgcgctgcgccgtggcgagatcctcggtttcgcgggattgatgggcgccgggcgcaccgagatcgcgcgcgcgatcttcggcgccgatcgtcccgacggcggcacgatcgcgctgcacggccggcccgtgacgatccgctcgccgcgcgaggcgatccggcacggcatcgcgtacctgtcggaggaccgcaagaaggaggggctcgcgctgccgatgccggtcgcggcgaatctcacgctcgcgaacgtgcgcggcatcgcgtcgcgcttcggattcctgcgtttcgacgacgagatcgacgtggcgcgccgctacgtgcaggacctggcgattcgcacgccgtccgtgcaccagcgcgtgcgcaacctgtccggcggcaaccagcagaaggtcgtcatcggcaaatggctgtaccgcggctcgaagatcctgttcttcgacgagccgacgcgcgggatcgacgtcggcgccaaattcgcgatctacgggctgatggaccggctcgccgccgacggcgtcggcgtggtgctgatcagttcggaactgccggagctgctcggcatgaccgaccggatcgccgtttttcatgaaggtcgaatgaccgccattctcgatacgaaacacaccagtcaggaggagatcatgcactacgcgtcggggcgttcccatgcttga

SEQ ID NO: 38997 - protein, 514 aa, Burkholderia cenocepacia AU 1054
MAMPRNLPGQAAHDEADQEILRLDGIRKRFPGVLALDGIRLDLRRGEVHAVCGENGAGKSTLMKIISGQYLPDEGAVHYRGAPVRFRSASEAQAAGISIIHQELNLVPHLSVAENLFLAREPRRGPFVDTKRMNAEAARCIARIGLNVAPTTKVGVLSIAQQQMVEIAKALSHDARVLIMDEPTSSLTEAETVQLFRIIEELRADGVAILYISHRLDEMAQIVDRVTVLRDGRHISTDDFADVSIDDIVARMVGRTLDDAYPSRQSVPTDDVLLDVRDLRRDGVFGPVSFALRRGEILGFAGLMGAGRTEIARAIFGADRPDGGTIALHGRPVTIRSPREAIRHGIAYLSEDRKKEGLALPMPVAANLTLANVRGIASRFGFLRFDDEIDVARRYVQDLAIRTPSVHQRVRNLSGGNQQKVVIGKWLYRGSKILFFDEPTRGIDVGAKFAIYGLMDRLAADGVGVVLISSELPELLGMTDRIAVFHEGRMTAILDTKHTSQEEIMHYASGRSHA

SEQ ID NO: 38998 - DNA, 1512 bp, Burkholderia cenocepacia AU 1054
  CDS (1)..(1512): transl_table=11
gtgtcagcggcactgcgttttgacaatatcggcaaggtatttcccggcgtgcgcgcactcgacggcatttcgttcgacgtgcatgcgggcgaggtgcatggcctgatgggcgagaacggcgcgggcaagtcgacgctgctgaagattctcggcggcgaataccagcccgatgcgggcagcgtgctggtcgacggccggcccgtgcagttcgcgaatgcggccgcgtcgatcgcggccggcatcgcggtgattcaccaggaattgcagtacgtgcccgacctgacggtcgcggagaacctgctgctcggccgcctgccgaacgcgttcggctgggtcaagaaacgcgaggcgaagcgttacgtgcgcgagcggctcgccgagatgggcgtcgatctcgatcctgacgcgcggctcgggcggctgtcgatcgcgcagcggcagatggtcgagatctgcaaggcgctgatgcgcaacgcccgcgtgatcgcgctcgacgaaccgacgagttcgctgtcgcatcgcgagacggaagtgctgttcaagctggtcgacgatctgcgcgcgcagggccgcgcgctgatctacatctcgcaccggatggacgagatctaccggctgtgcgacgcgtgcacgatcttccgcgacgggcgcaagatcgcgtcgcacgacgcgctggccgacgtgccgcgcgagcgactcgtcgccgagatggtcgggcgcgagatcgcggacatctaccattacgcgccgcgcacgctcggcgacgtgcggttttccgccgaaggcgtcgacggcccggcgctgcgcgaaccggcgagcttctcggtgcgcgcgggcgagatcgtcggcttcttcgggctcgtcggcgcgggccgcagcgagctgatgcggctcgtgtacggcgcggaccgccggcgcgcgggcgcgctgacgctcgacggcaagcgcatcgacgtgaagcgcaccggcgacgcgatccgccacggcatcgtgctgtgcccggaggaccgcaaggaagaagggatcatcgcgatcgcgtcggtcgccgagaacatcaacatcagctgccgccgccattcgctgcgtgcggggttgttcatcaacggcaagaccgaaagcgaaacggccgaccgcttcatccagcggctgaagatcaagacgccgaaccggcgccagaagatccgcttcctgtcgggcggcaaccagcagaaggcgatcctgtcgcgctggctcgcggagcccgacctgaaggtcgtgatcctcgacgagccgacgcgcgggatcgacgtcggcgcgaagcacgagatctacgacgtgatctaccggctcgcggagcgcggctgcgcgatcgtgatggtgtcgtcggaactgccggaagtgctcggcgtgtccgaccgcatcgtcgtgatgcgcgaaggccggatcgccggcgagctgccgcgcgccgacgcgaacgaacatgcggtgctgaacctcgcgctgccgcagacgagcgcggtcgaggcggcctga

SEQ ID NO: 38999 - protein, 503 aa, Burkholderia cenocepacia AU 1054
MSAALRFDNIGKVFPGVRALDGISFDVHAGEVHGLMGENGAGKSTLLKILGGEYQPDAGSVLVDGRPVQFANAAASIAAGIAVIHQELQYVPDLTVAENLLLGRLPNAFGWVKKREAKRYVRERLAEMGVDLDPDARLGRLSIAQRQMVEICKALMRNARVIALDEPTSSLSHRETEVLFKLVDDLRAQGRALIYISHRMDEIYRLCDACTIFRDGRKIASHDALADVPRERLVAEMVGREIADIYHYAPRTLGDVRFSAEGVDGPALREPASFSVRAGEIVGFFGLVGAGRSELMRLVYGADRRRAGALTLDGKRIDVKRTGDAIRHGIVLCPEDRKEEGIIAIASVAENINISCRRHSLRAGLFINGKTESETADRFIQRLKIKTPNRRQKIRFLSGGNQQKAILSRWLAEPDLKVVILDEPTRGIDVGAKHEIYDVIYRLAERGCAIVMVSSELPEVLGVSDRIVVMREGRIAGELPRADANEHAVLNLALPQTSAVEAA

SEQ ID NO: 39000 - DNA, 1560 bp, Burkholderia ambifaria AMMD
  CDS (1)..(1560): transl_table=11
atgacgatgcagacgatcacggccgtgtccggcaacgacgacgcggccacgcacggcgccgccgcgccgcccggcggcgcgctgctctcgctcgacgggatcacggtgacattcccgggcgtgcgcgcgctcgatgccgtgtcgctgtcggtgcgcgcgggcgaagtgcacgggctgatgggcgagaacggcgcgggcaagtcgacgctgttgaaggtgctgtccggcgtgaaccagccgcaggccggcacgctgacgctgaacggcacggtgcagcgcttcgcgtcgacgcgcgccgcgctcgaggccggcatcgcgatcatctaccaggagctgcatctggtgccggagctgacggtcgcggagaacctgatgctcgggcagttgccgagccggctcggcgtggtcgacgagcgcgcgctcgcggtgcgtgcgctcgatgcgctggagcgcctcggcgagcacatcgatccggacatcccggtgaagtatctgtcgatcggccagcgccagatgatcgagatcggcaaggcgctgatgcgcgacgcgcgcgtgatcgcgttcgacgaaccgacgagttcgctgtccgcgcgcgagacgacgcagctgttccgcatcatccgctcgctgcgcgcggaagggcgagcgatcatctacgtcacgcaccggatggaggaagtcgacgcgctgtgcgaccgcgtgacggtgttccgcgacggccgccggatcgagacgttcgaatcggtcgccgagctcgatcgcgaccagctgatcggctgcatggtcggccgctcgatcgaggacgtgtacggctaccggccgcgcgcggccggcgacgtgatgatcgaggcgaaggggctgaccgggcccggcttgtccgagccggtgtcgttcgccgcgcgccgcggcgagatcgtcggcttcttcgggctcgtcggcgcgggccgctcggagctgatgaagctgctgtacggcgcgacgcgcccgagcggcggccacgtcgagctgggcggcaagcgcgtcgcgttttcgagcccgcgccacgcggtgcgcgccggcatcgcgctgtgcccggaggatcgcaagcaggaaggcatcgtcgcgatcgcgtcggtggccgacaacctgaacatcagcgcgcgccgtcatttcagcccggcgcgcgtgctgctcgacgcgcggcgcgaacgcgacctcgcgcaacgctacatcgagcggctcgcgatcaagacgcccgacggcgacacgccgatcggcgcgctgtcgggcggcaaccagcagaaggtcgtgctcgcgcgctggctggccgagcgcatcgacgtgttcctgatggacgagccgacgcgcggcatcgacgtcggcgcgcgcgcggaaatctacaacctgttctacgaactcgcggaagcgggccgcacggtgatcctcgtgtcgagcgacctggccgaggtgatcggcgtgtcggaccggatcatcgtgatgaaggaaggacggatcgcgggcgaagtggcgaaggcgcaggcgacgcccgacgcgctgatcaagctcgcgctgccgcgttag

SEQ ID NO: 39001 - protein, 519 aa, Burkholderia ambifaria AMMD
MTMQTITAVSGNDDAATHGAAAPPGGALLSLDGITVTFPGVRALDAVSLSVRAGEVHGLMGENGAGKSTLLKVLSGVNQPQAGTLTLNGTVQRFASTRAALEAGIAIIYQELHLVPELTVAENLMLGQLPSRLGVVDERALAVRALDALERLGEHIDPDIPVKYLSIGQRQMIEIGKALMRDARVIAFDEPTSSLSARETTQLFRIIRSLRAEGRAIIYVTHRMEEVDALCDRVTVFRDGRRIETFESVAELDRDQLIGCMVGRSIEDVYGYRPRAAGDVMIEAKGLTGPGLSEPVSFAARRGEIVGFFGLVGAGRSELMKLLYGATRPSGGHVELGGKRVAFSSPRHAVRAGIALCPEDRKQEGIVAIASVADNLNISARRHFSPARVLLDARRERDLAQRYIERLAIKTPDGDTPIGALSGGNQQKVVLARWLAERIDVFLMDEPTRGIDVGARAEIYNLFYELAEAGRTVILVSSDLAEVIGVSDRIIVMKEGRIAGEVAKAQATPDALIKLALPR

SEQ ID NO: 39002 - DNA, 1692 bp, Burkholderia ambifaria AMMD
  CDS (1)..(1692): transl_table=11
atggatcacgcagggcaaggcaccgccggcgctgacgctgacgacgggcatgctcgcgacgcgcgacaacgtgtcgaaggtgcgcgacgagatggggctcgcatcgaagtaagcggcttgccggctgccgcggcgatgcggcagccggcgatcgatggatctgcaaagtggggagacgacgtgtcagcggcactgcgttttgacaatatcggcaaggtatttcccggcgtgcgcgcactcgacggcatctcgttcgacgtgcatgcgggcgaggtgcatggcctgatgggcgagaacggcgcgggcaagtcgacgctgctgaagattctcggcggcgaataccagcccgatgcgggcagcgtgctggtcgacggccagcccgtgcatttttcgagtgcggccgcgtcgatcgcggccggcattgcggtgattcaccaggaactgcagtacgtgcccgacctgacggtcgcggagaacctgctgctcggccgcctgccgaacgcgctcggctgggtgaagaagggcgaggcgaagcgccatgtgcgcgaacggctcaccgcgatgggcgtcgatctcgatcccgacgcgaagctcgggcggctgtcgatcgcgcagcggcagatggtcgagatctgcaaggcgctgatgcgcaacgcgcgcgtgatcgcgctcgacgagccgacgagctcgctgtcgcatcgcgagaccgaggtgctgttcaagctcgtcgacgacctgcgcgcgcagggccgcgcgctgatctacatctcgcaccggatggacgagatctaccggctgtgcgatgcatgcaccatcttccgcgacgggcgcaagatcgcgtcgcacgaatcgctcgccgacgtgccgcgcgagcagctcgtcgccgagatggtcgggcgcgagatttcggacatctaccattacgcgccgcgcgcgctcggcgacgtgcggttttcggccgaaggcgtcgacggcccggcgctgcgcgaaccggcgagcttctcggtgcgcgcgggcgagatcgtcgggttcttcgggctggtcggcgcggggcgcagcgaactgatgcggctcgtgtacggcgcggatcgccggcgcgcgggcgagctgacgctcgacggcaagcgcatcgacgtgaagcgcaccggcgacgcgatccgccacggcatcgtgctgtgtccggaggaccgcaaggaagaagggatcatcgcgatggcgtcggtcgcggagaacatcaacatcagctgccgccgccattcgctgcgcgccgggctcttcatcgaccgcaagaccgaaatcgagacggccgaccgcttcatccagcggctgaagatcaagacgccgaaccgccggcagaagatccgcttcctgtcgggcggcaaccagcagaaggcgatcctgtcgcgctggctcgcggagcccgacctgaaggtcgtgatcctcgacgagccgacgcgcgggatcgacgtcggcgcgaagcacgagatctacgacgtgatctaccggctcgcggagcgcggctgcgcgatcgtgatggtgtcgtcggaactgccggaagtgctcggcgtgtccgaccgcatcgtcgtgatgcgcgaaggccgcatcgcgggcgagctggcgcgcgcgcaggcgaacgagcatgcggtgctcagcctcgcgctgccgcagacgagcgtcgccgaggcggcctga

SEQ ID NO: 39003 - protein, 563 aa, Burkholderia ambifaria AMMD
MDHAGQGTAGADADDGHARDARQRVEGARRDGARIEVSGLPAAAAMRQPAIDGSAKWGDDVSAALRFDNIGKVFPGVRALDGISFDVHAGEVHGLMGENGAGKSTLLKILGGEYQPDAGSVLVDGQPVHFSSAAASIAAGIAVIHQELQYVPDLTVAENLLLGRLPNALGWVKKGEAKRHVRERLTAMGVDLDPDAKLGRLSIAQRQMVEICKALMRNARVIALDEPTSSLSHRETEVLFKLVDDLRAQGRALIYISHRMDEIYRLCDACTIFRDGRKIASHESLADVPREQLVAEMVGREISDIYHYAPRALGDVRFSAEGVDGPALREPASFSVRAGEIVGFFGLVGAGRSELMRLVYGADRRRAGELTLDGKRIDVKRTGDAIRHGIVLCPEDRKEEGIIAMASVAENINISCRRHSLRAGLFIDRKTEIETADRFIQRLKIKTPNRRQKIRFLSGGNQQKAILSRWLAEPDLKVVILDEPTRGIDVGAKHEIYDVIYRLAERGCAIVMVSSELPEVLGVSDRIVVMREGRIAGELARAQANEHAVLSLALPQTSVAEAA

SEQ ID NO: 39004 - DNA, 1527 bp, Rhizobium tropici
  CDS (1)..(1527): transl_table=11
atgagtatgcttgtcgagatggtcagcatcaacaagtcctttggtgcgaccaaagtcctgtcgaatgttcaattttcgcttgaacgcggctccgtccacgcgttgatgggcgagaacggggcgggaaaatccacgctgatgcgaattctggccggcgtctatcaacagaccgctggacgcatccgtctgcgaggagaagaagtgaccttccggtcccccaaggaagcgcgtctcgccggggtgtcgacagtgtttcaggagttcaccctgatccccaatctcacggtcgccgaaaacatgtttcttggacacgaaccgcggcgtgccgatgggtcgatagacaccgccgaggtcgtcgagcgatcccgcaagctgcttgccgacgttttccctcaactggacgcgacggcgattgtggaaacgctgacggttgcccagcagcaggcagtggaaatcgccaaaggcctgacatccaatgccgatgtcttcattttcgatgaaccgaccgcggcactaaactcaacggacgtcgctcatctcttcaaggtcatccgcgatctgaaggcgcaaaacaaggctgtcgtctacatctcgcatcggatgaacgaggtgttcgaactgtgcgacaccatcaccgtcatgaaggacggggcttgggtaaagacagccagggcagaagactttaatctccaaacgctcgtggcaaccatggttggacgcgaacttcagagtttctttccgccgagggcacaggccattggatcggcgatgctcgtcgtggcagggcttcgtctcaatgaccatggcccgccagtcggtttttccgtacgcacgggcgagatcatcgggctcgccgggctggagggccaggggcagcgtgaaatcatgcgtgcggtcgtcggggtcgaacccgccgcagctgcgagcgtccagcgtcgccgcgacgacagcatgatcgatgtgaacgtatcctcaggcttttcgagtgccatctcagcgggcattggtttcattcctgaagaccgcaagcaggaaggcctgtttcttcggcttccgatctacgacaacatcgcacttggcaagcaattgaaccggaacatggcgagcgttgcatggcgttccatctccagggttcacgatgtcataaagtcgctccgtgttgcggctgccgaccccgcctcgcccgtcggcaaactttcgggcggaaaccagcaaaaggtgcttctgtgccgctggctgctttcgggggtcgatatccttgtcatcgaggagccgacacggggcgtcgatgtcggcgcgaaagcggaaatctacaagctgcttcgcgattttgccgatcgtggcggtgcagtgatcgtctcgtcgcgcgagcacgccgaactgatcgggctgtgtgacaacatcctggtcgttcacgacaaaaagatcgtcgggcagatgcccgcgctcgatgccacagaggaaaccatcctgggaaccgcactaggttcgaacttcgcgcacgatccgcgcgccgctgttcattga

SEQ ID NO: 39005 - protein, 508 aa, Rhizobium tropici
MSMLVEMVSINKSFGATKVLSNVQFSLERGSVHALMGENGAGKSTLMRILAGVYQQTAGRIRLRGEEVTFRSPKEARLAGVSTVFQEFTLIPNLTVAENMFLGHEPRRADGSIDTAEVVERSRKLLADVFPQLDATAIVETLTVAQQQAVEIAKGLTSNADVFIFDEPTAALNSTDVAHLFKVIRDLKAQNKAVVYISHRMNEVFELCDTITVMKDGAWVKTARAEDFNLQTLVATMVGRELQSFFPPRAQAIGSAMLVVAGLRLNDHGPPVGFSVRTGEIIGLAGLEGQGQREIMRAVVGVEPAAAASVQRRRDDSMIDVNVSSGFSSAISAGIGFIPEDRKQEGLFLRLPIYDNIALGKQLNRNMASVAWRSISRVHDVIKSLRVAAADPASPVGKLSGGNQQKVLLCRWLLSGVDILVIEEPTRGVDVGAKAEIYKLLRDFADRGGAVIVSSREHAELIGLCDNILVVHDKKIVGQMPALDATEETILGTALGSNFAHDPRAAVH

SEQ ID NO: 39006 - DNA, 1536 bp, Chlorobium tepidum
  CDS (1)..(1536): transl_table=11
atggcgacagcagtaaagctctccggaatctccaaaaccttcggcagcctcaaggccaacgacaacgtttcgctttcgatcgaagcggggtcgatccacgcgctcgtcggcgaaaacggcgcgggcaaaagcaccttgtcgaacatcatctatggcctgctgcatcctgactccgggacgattgaaatcgatggcaaggcggtgaaattcagctccgtgcggcaagccatcgaggccggaatcggcatggtgcaccagcacttcatgctggtgccgaccctctcggtgacggaaaacatcattctcggcaaggaggagagccgcctagcactgccaacccggcgcatcggcaaggaaattcgccagctcagccagcagcacggactcgaagtcgatccggacgcactggtttcaaccctgtcggtcggcgaacagcagcgcgtggaaattctcaagctgctctaccgacgtgccaagctcctgattctcgacgagccgaccgccgtgctctcgccgcccgaaaccgcgcgactctttgccacgctgcgctcgctcgccgccgaagggcgtaccgtcctgctcatcacccacaagctcgacgaagtactcaccgtctcggactcggtgagcgtcatgcgcaaagggtcgctggtcggcaccgtgccgaccacatcgaccagcaaggaggatttggcgagaatgatggtcgggcgcgatgttctgctcagaaccgccaatgcgccgcagactccgggtaaaacagtgctctcgatcgacaagctgacctaccgctcgccgcttggcatcgacaaactcaccggcctgacgctgcacgtgagagcaggagaaatctacggcatcgccggagtggagggcaacggccagagcgagctgctctcgttgttgtggggaacgttcgatcgcagcggcaaaaccggcggatcgatcaccatcgacgcccaggagacgcttggcaagaatccgtcggaaatcgctgcactcggcgtttcgatgatacccgaagaccggcacaaatcggcgatcatcgctgaatatggcatcgaggaaaacctgatcctcggcaggcatcgcgaaaaagcattccatcgcggcatcggatttgatcgtgacgccgttcacaaaaatgctacggccatgatcgagcaatacgacatccggtgtgcggcgggaaccaatccgcccatcgcctctctctctggcggtaaccagcagaagatcgtggtggcgcgtgaaatggaacgcccccaactgaagctgcttgtgctggcgcagccaacgcgcggcgtcgatatcggcgctatcgagcagattcacaagcgcatcatcgacgctcgcaaaagcggtctggcgatcctgctcatttcgtcggaactcgaagagattgtcgctctttcgactcgaatcggttgcctctacaaaggcgcgatccgccacgaattcagcgaaacggaggtctggcggggacgcgatcacgagtcgggcttcgagaaagagatcggtatgcacatcacctga

SEQ ID NO: 39007 - protein, 511 aa, Chlorobium tepidum
MATAVKLSGISKTFGSLKANDNVSLSIEAGSIHALVGENGAGKSTLSNIIYGLLHPDSGTIEIDGKAVKFSSVRQAIEAGIGMVHQHFMLVPTLSVTENIILGKEESRLALPTRRIGKEIRQLSQQHGLEVDPDALVSTLSVGEQQRVEILKLLYRRAKLLILDEPTAVLSPPETARLFATLRSLAAEGRTVLLITHKLDEVLTVSDSVSVMRKGSLVGTVPTTSTSKEDLARMMVGRDVLLRTANAPQTPGKTVLSIDKLTYRSPLGIDKLTGLTLHVRAGEIYGIAGVEGNGQSELLSLLWGTFDRSGKTGGSITIDAQETLGKNPSEIAALGVSMIPEDRHKSAIIAEYGIEENLILGRHREKAFHRGIGFDRDAVHKNATAMIEQYDIRCAAGTNPPIASLSGGNQQKIVVAREMERPQLKLLVLAQPTRGVDIGAIEQIHKRIIDARKSGLAILLISSELEEIVALSTRIGCLYKGAIRHEFSETEVWRGRDHESGFEKEIGMHIT

SEQ ID NO: 39008 - DNA, 1491 bp, Treponema pallidum
  CDS (1)..(1491): transl_table=11
atgtgcgatgtactcaccataagggatctttctaagtcttttgcgaggaacagggttctcaacggggtgaacttccgtatgggaaagggtgccgtggtggggcttatgggagaaaatggtgcgggaaaatccacgcttatgaagtgcctctttggaatgtacgctaaggacactggtcagattctcgtggatggaagcccggtggactttcagtctcccaaagaagcgctagaaaacggtgtcgccatggtccatcaggagctcaatcaatgccttgatcgcactgtcatggacaatttgtttctcggcaggtaccctgcccgtttcgggatagttgacgagaaacgcatgctcgacgactccctcactctgttcgcttccttgaaaatggacgtaaacccgcgggccgtcatgcgcagcatgtctgtctctcagcggcagatggtagagattgccaaggcgatgtcctataacgcgaagattatagtcctcgacgagcctacttcctctctcacggagagggagattgtcaggctctttgccattatacgagacctgagcaaaaaaggagtggcattcatctatatctcccacaaaatggatgagatctttcagatctgcagcgaggtgattgtgctgcgggatggtgtcctcacgctctcacaatccataggggaagtggaaatgagcgacctcatcaccgctatggtcgggcgcactttggacaagcgctttcccgacgctgacaataccgtcggtgacgattatcttgaaatacgaggtctttctacaaggtatgctccgcagctgcgggatatttccctttctgtgaaaaggggcgagatttttggcttgtacgggctggtcggtgcggggaggagtgaactgcttgaagcgattttcggcctacgtaccatcgcagacggtgagatctctttagcaggaaaaaaaattcgcttgaagagcagcagggacgcaatgaaactcaatttcgcctttgtgcccgaggaacgtaagctcaacggaatgttcgcaaaggggagcatagagtataacaccacgattgcaaatctccctgcgtataagcgttacggtctactctcaaagaaaaagctgcaggaggcagcggagcgggaaataaaggccatgcgcgtgaagtgcgtttctccaagcgagcttatcagtgcgctcagcgggggtaatcagcagaaagtcattattggaaagtggctcgaacgcgatcccgacgtcctcttgcttgatgagccgaccagggggatcgacgtgggtgcgaaatatgaaatttatcagctcatcattcgtatggcgcgtgagggaaagacaatcattgtggtttctagtgaaatgcctgaaattcttggaatcaccaacaggatcgcagtcatgtccaattatcgattggctgggattgtggatacaaagagtaccgatcaggaagccttgctcagactttctgcgcgatacctgtag

SEQ ID NO: 39009 - protein, 496 aa, Treponema pallidum
MCDVLTIRDLSKSFARNRVLNGVNFRMGKGAVVGLMGENGAGKSTLMKCLFGMYAKDTGQILVDGSPVDFQSPKEALENGVAMVHQELNQCLDRTVMDNLFLGRYPARFGIVDEKRMLDDSLTLFASLKMDVNPRAVMRSMSVSQRQMVEIAKAMSYNAKIIVLDEPTSSLTEREIVRLFAIIRDLSKKGVAFIYISHKMDEIFQICSEVIVLRDGVLTLSQSIGEVEMSDLITAMVGRTLDKRFPDADNTVGDDYLEIRGLSTRYAPQLRDISLSVKRGEIFGLYGLVGAGRSELLEAIFGLRTIADGEISLAGKKIRLKSSRDAMKLNFAFVPEERKLNGMFAKGSIEYNTTIANLPAYKRYGLLSKKKLQEAAEREIKAMRVKCVSPSELISALSGGNQQKVIIGKWLERDPDVLLLDEPTRGIDVGAKYEIYQLIIRMAREGKTIIVVSSEMPEILGITNRIAVMSNYRLAGIVDTKSTDQEALLRLSARYL

SEQ ID NO: 39010 - DNA, 1518 bp, Thermoanaerobacter ethanolicus; identical to SEQ ID NO: 27588
  CDS (1)..(1518): transl_table=11

SEQ ID NO: 39011 - protein, 505 aa, Thermoanaerobacter ethanolicus; identical to SEQ ID NO: 27589

SEQ ID NO: 39012 - DNA, 1449 bp, Rhizobium sp
  CDS (1)..(1449): transl_table=11
atggagttgcgggaaaatgagatcctcggcctgatcggccagaacggctctggaaagtcgacgctactgaagattttcactggcgtcgaacaaccaacggaaggctcgctgctgctgaggggtcagcaaactatcatccgctctcctcttgcagcggccgccctcggcatcggcatggtgcatcaggaacaatcattgattacaaacctgacggtcgccgaaaacatcttcttcgacaagcacgcacttggcaaacggtatggtttctacaactggaggagcctgaacaaggccgctgagcgccagcttgcgaagcttgaatgcgaaattccaccggacctcaaagtggaaaagctcagcttcccggaacgacagcttgtggaattcgcaaaggtcctcgctgttgaagagttaattgacgaccaactcgtcatccttttcgacgagccgacgtcccttctcagcccatctgaaattgaggggctttttcggcagatccggcggctcaaagagcgcgcatctatcgtatttgtttcgcatcgcatggacgaagtccttgaaatctccgaccgcgttcacgtcatgagcaatggggaaaacgttgccgaacgcactccgtcggaaacagatcacaaggaactctatcacctgatggtcggttcgcgtcgatccgaggactactttctcgaggagcgccgccgccctacgagcgcagcgccgccgcggctcgaaacccatagactatcggcgcccggggcttttaaggatgtttcctttgccatccgccaaggtgagatactggctctaacaggtgttgccgggtccggcgccgaagaattctgccgcgctcttttcgggctcgaagagggcgtcacgggcaaaatcatcttcaatggcaaggaacatcctgttgatgcgcgtcccagtgacttaatcgcggagggtatcggctatgtcgctgcagaacgaaagcttgagggagtggttaccgggcgaaccattgttgacaacatcgtactgtcattcggaagcaaacttgggaagggactgtttatcgacagagatcgtgaaatcagctcggcgcttcactggatcgcgcgcctcaaggtaaaaactccgaacgcggccgaatatgtcgagaggttaagcggcgggaaccagcagaaggtgtcgctggcgaaatggctcctgtcagaaaacttgcagttactgatactcgatcatccaacccgcggacttgatcccggtgcaaaggccgatttgttcgaagcaatacgtgatctctcagatcagggaatatcgattctatttgtgtcggaaacgctggaggaaaccttaggaatggccgatacgatcgtcgtcatgcgtgatggacaagtctctgccacgttctccgatctcttccatgcgaaaccggcgcctgaggctatagtggaggctatggtatga

SEQ ID NO: 39013 - protein, 482 aa, Rhizobium sp
MELRENEILGLIGQNGSGKSTLLKIFTGVEQPTEGSLLLRGQQTIIRSPLAAAALGIGMVHQEQSLITNLTVAENIFFDKHALGKRYGFYNWRSLNKAAERQLAKLECEIPPDLKVEKLSFPERQLVEFAKVLAVEELIDDQLVILFDEPTSLLSPSEIEGLFRQIRRLKERASIVFVSHRMDEVLEISDRVHVMSNGENVAERTPSETDHKELYHLMVGSRRSEDYFLEERRRPTSAAPPRLETHRLSAPGAFKDVSFAIRQGEILALTGVAGSGAEEFCRALFGLEEGVTGKIIFNGKEHPVDARPSDLIAEGIGYVAAERKLEGVVTGRTIVDNIVLSFGSKLGKGLFIDRDREISSALHWIARLKVKTPNAAEYVERLSGGNQQKVSLAKWLLSENLQLLILDHPTRGLDPGAKADLFEAIRDLSDQGISILFVSETLEETLGMADTIVVMRDGQVSATFSDLFHAKPAPEAIVEAMV

SEQ ID NO: 39014 - DNA, 1539 bp, Rhizobium leguminosarum bv
  CDS (1)..(1539): transl_table=11
atgaacgccgcctttcaacaacccgtcacggacagcaaaaccggcgatgcccccgccattctggaaatgcgcggcatctcccagatctttcctggtgtgaaggcgctggacaatgtcagcattgcccttcatcccggcacggtcaccgctttgatcggcgaaaacggcgccggcaaatcgacgctcgtcaagatcctgaccggcatctaccgcccgaacgaaggcgagattctggtcgacggccggccgacgacctttgccagcgcccaggccgcgatcgatgccggcgtcaccgccatccatcaggaaaccgtgcttttcgacgagctgacggtggccgagaacattttcctcggccacgcgccgcgcacgcgctttcgcaccatcgactggcagacgatgaacagccggtcgaaggcgctgctgaccgcgctcgaaagcaatatcgatccgaccatccggctaaaggacctgtcgatcgcgcagcgtcacctggtggcgatcgcgcgcgctttgtcgatcgaggcccgcatcgtcatcatggacgagccgaccgccgcactctcccggaaggaaatcgacgatctcttccgcattgtccggggcctgaaagaacagggcaaggcgatcctcttcatcagccacaagttcgacgagctttacgaaatcgccgatgatttcgtcgtcttcccgcgacggtcgcgccgtccggtcaggggcgtctcaaggaaaacgccgcaggacgagatcgtccggatgatggtcggccgcgacgtcgagaacgtctttccgaagatcgacgtcgccatcggcggcccggtcctggagatccgcaattacagccaccgcaccgaattccgcgacatttccttcacgttgcgcaagggcgagattctcggcgtttacggcctgatcggcgccggccgctcggaactgtcgcaatcgctcttcggcatcaccaagccgctttcgggcaagatggtgctcgaaggccaggagatcaccatccattcgccgcaggatgctatccgcgccggcatcgtctacgtgccggaggagcgcggccgccatggcctggcgctgccaatgccgatcttccagaacatgacgctgccttcgctcgcccgcacctcgcgccgcggtttcctgcgggccgcaaacgaattcgcgctcgcgcgcaaatatgccgagcggctggatctgcgcgccgccgccctttccgtgccggtcggcacgctctccggcggcaaccagcagaaggtcgtcatcggcaaatggctggcgacggcgccgaaggtcatcatcctcgacgagccgaccaagggcatcgacatcggctcgaaggccgccgtgcacggcttcatcagcgaactcgccgccgagggcctgtcgatcatcatggtttcctccgaactgccggagatcatcggcatgtcggatcgcgttctcgtcatgaaagaaggcctgtcggcggggattttcgaacgcgccgaactgtcgccggaagcgctggtgcgcgccgccaccggcaatgcgtga

SEQ ID NO: 39015 - protein, 512 aa, Rhizobium leguminosarum bv
MNAAFQQPVTDSKTGDAPAILEMRGISQIFPGVKALDNVSIALHPGTVTALIGENGAGKSTLVKILTGIYRPNEGEILVDGRPTTFASAQAAIDAGVTAIHQETVLFDELTVAENIFLGHAPRTRFRTIDWQTMNSRSKALLTALESNIDPTIRLKDLSIAQRHLVAIARALSIEARIVIMDEPTAALSRKEIDDLFRIVRGLKEQGKAILFISHKFDELYEIADDFVVFPRRSRRPVRGVSRKTPQDEIVRMMVGRDVENVFPKIDVAIGGPVLEIRNYSHRTEFRDISFTLRKGEILGVYGLIGAGRSELSQSLFGITKPLSGKMVLEGQEITIHSPQDAIRAGIVYVPEERGRHGLALPMPIFQNMTLPSLARTSRRGFLRAANEFALARKYAERLDLRAAALSVPVGTLSGGNQQKVVIGKWLATAPKVIILDEPTKGIDIGSKAAVHGFISELAAEGLSIIMVSSELPEIIGMSDRVLVMKEGLSAGIFERAELSPEALVRAATGNA

SEQ ID NO: 39016 - DNA, 1515 bp, Bifidobacterium longum bv; identical to SEQ ID NO: 27590
  CDS (1)..(1515): transl_table=11

SEQ ID NO: 39017 - protein, 504 aa, Bifidobacterium longum bv; identical to SEQ ID NO: 27591

SEQ ID NO: 39018 - DNA, 1491 bp, Arthrobacter nicotinovorans
  CDS (1)..(1491): transl_table=11
gtgttagcacttgaagtacggggagtgagcaaatcattcttcggattcccggtactgaccggcgtagaccttgagataaggccgggagaggtgcacgggctcgtaggagagaacggcgccgggaaatctacattgatgaagattcttgcgggagtctacacaagggacgagggcaaggttgttctaggtggcaaggatgttatgttcagccatcctgtgcaggctcagctggcaggcatttccacggtattccaggaattcaacctgttgccggaccggtccgtagccgaaaatatctatctcggccgcgaaccgcgtgtgcgaggtttcatctcgcaacgaaagatgaacgcagcgactgcagagcttttttcatcccttggagttgactccattaacccggcagcgcatgtgcggacactatctgtggcgcagcaacagctcgtggaaattgccaaggccctcagctttgacgcccgggtcatctccatggacgagccaaccgctgcgcttgcggatcacgaagtggagctcctgtacagcatcattgaaaacctcaagaagcgcggcgttgccgttctctacgtttcccacagattgcgggaaatttttaagctttgtgaccgcatcacggttctcaaggatggcgcccttgtagccacgaagccggcagaagaactcaacgagcaggaactggtccggcttatggtcgggcgccccctatcctcgttcttcccgcccaagaccgaaggaacagtagttggagacacagcgctctcccttcaaaacgccgggaaccatgtagtaaacaacgtgacgctgaaactccgtcgcggggaaatcctgggaatagccggactgcaagggtcaggccgcacagaagttttggatgctatctccggatcggcaccattcacccgcggcgagatacacgtcaatggggcacccacgaccatcaaaacaacccgccaagcaattcgagccgggattgctcacgtcacggaggacaggaaagctacgggactgctcctgaatcaatcagtcattgataacgctctgacagtaatccgagcctgctatcccaaacgcacttcaactgcccgtcaggctgcaaccgacctgtttctggagctgcaactctcagcacggggaccggatcaggagatcaggtacctttccggcggcaatcaacaaaaggtgattctcaccaagtggctgcttatggaaccacaaatcgtccttctcgatgagccaaccagagggattgatgttggtgcgaagtttgccctgtacgtcctcatgcgacgtttggctgccgccggacacgccatcctcatggtttccagcgaattgcctgaactcatcgggatggccgacagagttctcgttatgcgtgacggggaactggtctccgagcttcctgccgggtccagcgaagaaagcattttgcaggcagcggccggcataaccgacgcggcggtggcagcatga

SEQ ID NO: 39019 - protein, 496 aa, Arthrobacter nicotinovorans
MLALEVRGVSKSFFGFPVLTGVDLEIRPGEVHGLVGENGAGKSTLMKILAGVYTRDEGKVVLGGKDVMFSHPVQAQLAGISTVFQEFNLLPDRSVAENIYLGREPRVRGFISQRKMNAATAELFSSLGVDSINPAAHVRTLSVAQQQLVEIAKALSFDARVISMDEPTAALADHEVELLYSIIENLKKRGVAVLYVSHRLREIFKLCDRITVLKDGALVATKPAEELNEQELVRLMVGRPLSSFFPPKTEGTVVGDTALSLQNAGNHVVNNVTLKLRRGEILGIAGLQGSGRTEVLDAISGSAPFTRGEIHVNGAPTTIKTTRQAIRAGIAHVTEDRKATGLLLNQSVIDNALTVIRACYPKRTSTARQAATDLFLELQLSARGPDQEIRYLSGGNQQKVILTKWLLMEPQIVLLDEPTRGIDVGAKFALYVLMRRLAAAGHAILMVSSELPELIGMADRVLVMRDGELVSELPAGSSEESILQAAAGITDAAVAA

SEQ ID NO: 39020 - DNA, 1590 bp, Brucella suis
  CDS (1)..(1590): transl_table=11
atgaacctagccaatcctgtctcgctggacaagcgtggggcactgccggatactttcggaaagcctcttcttgaaatgcgtgggatcaacaagtccttcggtgtcgtgaaggcgctgagcgatgtgaacttcaccgtcatgccgggcgaaatacatgcctttgtgggtgaaaacggcgcgggaaaatccacgctgatgaaggtgctttcgggtgtttatccccatggaagctatgaaggcgcgatctattacgacggggaagagcggcagtttcgggatattaacgattccgaggcgctcggcatcgtcatcattcatcaggaattggccctcattccgctgatgtcgattgccgagaatatttttctcgtcaatcctccggcaagccggggtgtcatcgaccgctccgccgtgcacaagcggacgcgggagctattgaaaaaggtcggtctggcggaaacgcccgatacgctcatcaccgatatcggcattggcaagcagcagcttgttgaaatcgccaaggcgctttccaagcgtgtgcggctgttgatcctcgatgaaccaacagcaagcctcaacgaaaatgacagtgcggcgcttctggcgctgctgcgcgagtttcgcgcgcagggcatcacctcgatcctcatttcgcacaagctcaatgaaatccgcgaagtggccgacaagattaccgttctgcgcgacggcaaggcggttgcgacacttgattgccatgcgggcgaagtggaggaagacgatatcatccgcaagatggtggaccgcgatctggagagccgttatcccaagcgcgatcccaagatcggcaatgtcatcttcgaggtcgataactggtcggtctatcatccgctgcatcccgatcggcattcggtcaagaacgtgtcattcaaggtgcgggcgggcgagatcgtcggcattgccggattgatgggagcggggcgcacggaattcgccatgagcctgtttggccgttcatggggcacgaatatcactggcgaggcgcgcatcaatggcaagacggtggatatttccaccgtggcgcgggcaatcaaggcgggccttgcctatgttaccgaggatcgcaagaagcttggcctggttcttggccagaatatttcgcgcaatatctcgctggcgcacttacgcggcgtgagcccgaaaggcattatcgacgatatccgggaaatgaagatcgcgaattcctatcgcgaccagatgcgtattcgctgtcacaatgtctatcaggaaaccggcacgctttcgggcggcaaccagcagaaggtggtgctgtcgaaatggcttttcactggccccgacgtgctgatcctggacgagccgacacgcggtatcgatgttggcgcgaaatatgacatttacacaatcatcaattcactggcggaaagcggcaagggcgttgtcgtcatttcttcggaaatgccggagctgatcggcatttgcgaccgcatcgtcgtcatgcatgagggcgccttcgtcggcgaagtggcaggcgaggaagcaacgcaggaaaacatcatgcgcgccatcatgcgaaacaagggaaaagggtaa

SEQ ID NO: 39021 - protein, 529 aa, Brucella suis
MNLANPVSLDKRGALPDTFGKPLLEMRGINKSFGVVKALSDVNFTVMPGEIHAFVGENGAGKSTLMKVLSGVYPHGSYEGAIYYDGEERQFRDINDSEALGIVIIHQELALIPLMSIAENIFLVNPPASRGVIDRSAVHKRTRELLKKVGLAETPDTLITDIGIGKQQLVEIAKALSKRVRLLILDEPTASLNENDSAALLALLREFRAQGITSILISHKLNEIREVADKITVLRDGKAVATLDCHAGEVEEDDIIRKMVDRDLESRYPKRDPKIGNVIFEVDNWSVYHPLHPDRHSVKNVSFKVRAGEIVGIAGLMGAGRTEFAMSLFGRSWGTNITGEARINGKTVDISTVARAIKAGLAYVTEDRKKLGLVLGQNISRNISLAHLRGVSPKGIIDDIREMKIANSYRDQMRIRCHNVYQETGTLSGGNQQKVVLSKWLFTGPDVLILDEPTRGIDVGAKYDIYTIINSLAESGKGVVVISSEMPELIGICDRIVVMHEGAFVGEVAGEEATQENIMRAIMRNKGKG

SEQ ID NO: 39022 - DNA, 1494 bp, Treponema denticola
  CDS (1)..(1494): transl_table=11
atgagtgatgtagttcttgaaataaagaacctttcaaaatctttcggaaagaataaggttttggacggtataaatctgactgtaagacaaggctccgtaatgggactcatgggcgaaaacggagcaggaaaatctaccatgatgaagtgccttttcggtatatatacacgggatgagggcgccatttctttattaaataaatcgatcgaatttaaaaatcctaaagaagctcttgaaagcggagttgctatggttcatcaagaactgaatctttgtcttgacagaaccgttacagataatttatttttaggacgctatccgaccaacttcgggattgttgacgaaataaaaatgtttgaatctgcaagctctcttttttcttcgctcaatatgaatgtcaatcccaaaacaataatgcgtaccatgtccgtttcgcagcggcagatggttgaaatagcaaaggctgtttcctacaacgcaaagctcatcgtattggatgagccgacctcttctttaaccgagagggaggtaaaaaaacttttttcgataataagagccttacaaaaaaaaggcgtttcatttatttatatttcgcataagatggatgaggtttttgaggtttgcgatgaggtcgccgttttacgggacggtaagatgattctttcaaagcccgtagccggaacaaatatgaacgaaattatttcggccatggtaggccgctctctggataagcgtttccccgatgtggataatgtccccggagaagattttttaaaaatagaaaacttaaaaacaaaatatgctcccgtgcttgaagatatttcctttaccgtaaggaagggagaaatcttaggcctttacgggcttgtaggggcagggaggagtgagcttttgggagccctcttcggtatccgcactatagaatccgggagcataagtataaacgataaatatcttaaatttaagagcagtaaagaagccatggctcatggctttgctctgttgaccgaagagcgtaaactaaacgggatgttcggcaaggatacaatagaatttaacacggtaattaccaatttgaataattataaaaccatcggcgtcttgtcaaagcgtaaaatacgggaggccgcaaacagggaaattgaaactatgaggacgaggtgcctttcggctgatcagggtatttcggctttgagcggaggaaatcagcaaaaggttataataggaaaatggctggagcgttcacccgatgtgtttttgatggatgagcctacccgcggtatcgatgtaggggccaaatatgaaatatatcagctcattattaagatggcaaaagagggaaaaaccataatagttgtttcgagcgagatgcccgaaattttaggtatcacgaaccgcatagccgtcatgtccaaccgtcgccttgctggtatcgtaaacacaaaagaaaccgatcaggaaactctgctcaggctttcggctaagtatttgtag

SEQ ID NO: 39023 - protein, 497 aa, Treponema denticola
MSDVVLEIKNLSKSFGKNKVLDGINLTVRQGSVMGLMGENGAGKSTMMKCLFGIYTRDEGAISLLNKSIEFKNPKEALESGVAMVHQELNLCLDRTVTDNLFLGRYPTNFGIVDEIKMFESASSLFSSLNMNVNPKTIMRTMSVSQRQMVEIAKAVSYNAKLIVLDEPTSSLTEREVKKLFSIIRALQKKGVSFIYISHKMDEVFEVCDEVAVLRDGKMILSKPVAGTNMNEIISAMVGRSLDKRFPDVDNVPGEDFLKIENLKTKYAPVLEDISFTVRKGEILGLYGLVGAGRSELLGALFGIRTIESGSISINDKYLKFKSSKEAMAHGFALLTEERKLNGMFGKDTIEFNTVITNLNNYKTIGVLSKRKIREAANREIETMRTRCLSADQGISALSGGNQQKVIIGKWLERSPDVFLMDEPTRGIDVGAKYEIYQLIIKMAKEGKTIIVVSSEMPEILGITNRIAVMSNRRLAGIVNTKETDQETLLRLSAKYL

SEQ ID NO: 39024 - DNA, 1533 bp, Escherichia coli
  CDS (1)..(1533): transl_table=11
atggccacgccatatatatcgatggcggggatcggcaagtcctttggtccggttcacgcattaaagtcggttaatttaacggtttatcctggtgaaatacatgcattactaggagaaaatggcgcgggtaaatccacgctaatgaaagttttatccggaatacatgagccgaccaaaggcaccattaccattaataacattagctataacaagctggatcataaattagcggcacaactcggtatcgggattatttatcaggaactcagcgttattgatgaattaaccgtactggaaaatttatatattggtcgtcatctgacgaaaaaaatctgtggcgtcaatattatcgactggcgagaaatgcgtgtccgcgccgccatgatgttattacgcgtgggcttgaaagttgatctagatgagaaagtggcgaatttatctatcagccacaagcagatgctagaaattgccaaaacgctgatgctcgatgccaaagtcatcatcatggatgaacccacctcctcactcaccaataaagaggtggactatctgtttctgatcatgaatcagttgcgtaaagagggtacggccatcgtctatatctcgcataagttggcggaaattcgccgtatttgcgaccgctatacggtgatgaaagacggcagcagcgtttgcagcggcatagtaagcgatgtgtcaaatgacgatatcgtccgtctgatggtaggccgcgaactgcaaaaccgttttaacgcgatgaaggagaatgtcagcaaccttgcgcacgaaacggtttttgaggtgcggaacgtcaccagtcgtgacagaaaaaaggtccgggatatctcatttagcgtctgccggggagaaatattaggctttgccggactggtcggttccggacgtactgaactgatgaattgtctgtttggcgtggataaacgcgctggcggagaaatccgtcttaatggcaaagatatctctccacgttcacccctggatgccgtgaaaaaagggatggcttacatcactgaaagccgccgggataacggttttttccccaacttttccatcgctcagaacatggcgatcagccgcagtctgaaagacggcggctataaaggcgcgatgggcttgtttcatgaagttgacgagcaacgtaccgctgaaaatcaacgcgaactgctggcgctgaaatgtcattcggtaaaccagaatatcaccgaactctccgggggaaatcagcagaaagtcctgatctccaaatggctgtgctgttgcccggaagtgattattttcgatgaacctacccgcggcatcgacgttggcgcgaaagccgaaatttacaaagtgatgcgccaactggcggacgacggaaaagtcatcctgatggtgtcatctgaactacctgaaattatcaccgtctgcgaccgcatcgccgtgttctgcgaaggacgactgacgcaaatcctgacgaatcgcgatgacatgagcgaagaggagattatggcatgggctttaccacaagagtaa

SEQ ID NO: 39025 - protein, 510 aa, Escherichia coli
MATPYISMAGIGKSFGPVHALKSVNLTVYPGEIHALLGENGAGKSTLMKVLSGIHEPTKGTITINNISYNKLDHKLAAQLGIGIIYQELSVIDELTVLENLYIGRHLTKKICGVNIIDWREMRVRAAMMLLRVGLKVDLDEKVANLSISHKQMLEIAKTLMLDAKVIIMDEPTSSLTNKEVDYLFLIMNQLRKEGTAIVYISHKLAEIRRICDRYTVMKDGSSVCSGIVSDVSNDDIVRLMVGRELQNRFNAMKENVSNLAHETVFEVRNVTSRDRKKVRDISFSVCRGEILGFAGLVGSGRTELMNCLFGVDKRAGGEIRLNGKDISPRSPLDAVKKGMAYITESRRDNGFFPNFSIAQNMAISRSLKDGGYKGAMGLFHEVDEQRTAENQRELLALKCHSVNQNITELSGGNQQKVLISKWLCCCPEVIIFDEPTRGIDVGAKAEIYKVMRQLADDGKVILMVSSELPEIITVCDRIAVFCEGRLTQILTNRDDMSEEEIMAWALPQE

SEQ ID NO: 39026 - DNA, 1554 bp, Bacillus halodurans
  CDS (1)..(1554): transl_table=11
atgaacatgcctaattgtttgttggaaatgcggaacataacgaaagcctttcctggtgtgaaggcactaaataacgttaatctgaaagtcgaacaaggggagattcatgcattagtaggtgaaaacggagcgggaaagtctacgttaatgaaagtacttagcggtgtttatccccatgggacgtacgagggcgatattttatttgaaggtagagtttgtcaatttaaggatattaaagaaagcgaacagctcggaatcgttattattcaccaggagctagccttagttcccgaattatcgattgcagaaaatatttttttagggaatgaacaagcgaagaatggagtgattgactggaatcaaacgattactgaggcagcgaaactgctaaaaaaagtcggattatctgattcgccgagaacgttagcaatgaacatcggggtcggtaagcaacagcttgtggaaattgctaaagcattgtctaagaaagtgaagctactcattctggatgaaccgaccgccgccttgaatgaagaagatagtcaaaatttattacatttgctgctggagtttaagaagcaaggaatgacgtcgatcatcatttctcataagttaaatgaaatatcgtatgtggcagatcatttaacgattttgagagacggtcaatcgattgaaacactgtcgctacagagcggagaagtaacagaggatcggatcattaaaggaatggtcggacgagacctcgagaaccggtttccgccgcgggagccaaagattggcgacgtgattttagaagtgaaccattggcacgtggacgacccgctccatccagatcggtcgctaatcaaagatgttaacctttacttgaaacgaggggaaattgttggggttgcaggtttaatgggggctggaaggaccgagctagcgatgagcatctttggtaaatcttatggaaagaacattcgcggtcagctgataaaggatggaaaagaaataaaggtccattcagtaaaggatgccattgatcacggtctcgcctatgtaaccgaggatcgtaaaacctatggattgattttaatcgatgatattaaacacaatatttccttaacgagcttagagaagctatcaaaaaacggtgtcgttgataaaacacgagaagtaaaagaagctgaggacttccgaaaaaaaatgaacatccgtacccctagcattgaccagaaaacgggaaatttaagtggtggcaaccaacagaaggtcgttttaagtaaatggatcttatcagggcctgacattttgatattggatgagcccactcggggaatcgatgtaggggcgaaatacgagatttatagtgtcattcatgagttggctgcccaaggcaaagccgttctggttatttcttcagagcttccagagctactcggtttaagcgatcggatttacgcactatgtgaagggcgaataactggggaggttactcgagaagaggccaatcaagagatcttaatgaagtacatgacgaggacaggaggaaatgggcatgaagttagctga

SEQ ID NO: 39027 - protein, 517 aa, Bacillus halodurans
MNMPNCLLEMRNITKAFPGVKALNNVNLKVEQGEIHALVGENGAGKSTLMKVLSGVYPHGTYEGDILFEGRVCQFKDIKESEQLGIVIIHQELALVPELSIAENIFLGNEQAKNGVIDWNQTITEAAKLLKKVGLSDSPRTLAMNIGVGKQQLVEIAKALSKKVKLLILDEPTAALNEEDSQNLLHLLLEFKKQGMTSIIISHKLNEISYVADHLTILRDGQSIETLSLQSGEVTEDRIIKGMVGRDLENRFPPREPKIGDVILEVNHWHVDDPLHPDRSLIKDVNLYLKRGEIVGVAGLMGAGRTELAMSIFGKSYGKNIRGQLIKDGKEIKVHSVKDAIDHGLAYVTEDRKTYGLILIDDIKHNISLTSLEKLSKNGVVDKTREVKEAEDFRKKMNIRTPSIDQKTGNLSGGNQQKVVLSKWILSGPDILILDEPTRGIDVGAKYEIYSVIHELAAQGKAVLVISSELPELLGLSDRIYALCEGRITGEVTREEANQEILMKYMTRTGGNGHEVS

SEQ ID NO: 39028 - DNA, 1542 bp, Bacillus stearothermophilus
  CDS (1)..(1542): transl_table=11
atgtctgaattcattttagagatgagggggattacgaaacagttcccgggagtcaaagcacttgataatgtcaattttaaggtgcgtgaaggcgaaattcatgcgctttgcggggaaaacggggcaggaaagtcaacgttgatgaaagtattaagcggtgtttatccgtatgggacgtatgatggggaaattgtatttaagggagaggtatgcaagtttaagaacattaaacagagcgaacaattagggattgtcatcatccaccaagagttggccttgattccctatctatccattgccgaaaatatttttttaggaaatgaacgggcgaaaaaaggcatcattaactggaatgaaacgatcgctcaaacaaaaaagctgttgcagaaagtcggattagaggagtcgccgcatacattggtcggccaacttggcgtcggcaagcagcaacttgtagaaattgcgaaggcgttggctaaagatgtgaaattgcttattttggatgagccgactgcagcgttgaatgaggatgacagcgaaaatttactgaatttgcttttggaattgaaaaaacaggggttatcggccattattatttcccataaattaaatgaaattacaaaagtcgctgattcgatcacgattttacgggatggaaaaaccattgaaacgttggatatgaaacatgatgaggtgaccgaagaccggattatccgtggaatggttgggcgtgacttaactaatcgttatccggcaaggacgccgaagattggtgaagtcatatttgaagtgaagaactggactgtgtatcaccccatttattctgagcgcaaggtgcttgatcacatcaatctgtcgattcgtcgaggggaaattgttgggatcgcaggcctcatgggggcgggacgaaccgaattggccatgagcatctttggtcggtcatacggaaagaaaattagcggagagatatggaaaaacggagtcaaaatcgatgtcagcgatgtcagcaaggccattgccaacgggattgcctatgtaacagaagatcgaaaaggaaatggcctcatcctaatggaagacattcggaaaaatattacactttcccgcttagggaaaatctcaaatcattttgtggtcgatgaaaatcaagaaattgttgaatcggagcgattccgtgaccaattcaaaattaaaacgccaagcgtatttcaaaaagtagaagcccttagtggcgggaatcaacaaaaagtggtgttaagcaaatggatttttgctgagccagatattttgattctcgacgaaccaacacgggggattgacgtcggcgcgaaatatgaaatttacacgatcattcagcagctagccgatgcaggaaaaggtattttaatgatttcgtccgaactcccagaaattcttggcatgtgcgatcgaatttatgtgatgagtgaagggagaatcactggagaggtgtcgcgggaagaagcgacacaggaaaaactaatgaggcttatgacgaaaacagcgattcaggagggggcatga

SEQ ID NO: 39029 - protein, 513 aa, Bacillus stearothermophilus
MSEFILEMRGITKQFPGVKALDNVNFKVREGEIHALCGENGAGKSTLMKVLSGVYPYGTYDGEIVFKGEVCKFKNIKQSEQLGIVIIHQELALIPYLSIAENIFLGNERAKKGIINWNETIAQTKKLLQKVGLEESPHTLVGQLGVGKQQLVEIAKALAKDVKLLILDEPTAALNEDDSENLLNLLLELKKQGLSAIIISHKLNEITKVADSITILRDGKTIETLDMKHDEVTEDRIIRGMVGRDLTNRYPARTPKIGEVIFEVKNWTVYHPIYSERKVLDHINLSIRRGEIVGIAGLMGAGRTELAMSIFGRSYGKKISGEIWKNGVKIDVSDVSKAIANGIAYVTEDRKGNGLILMEDIRKNITLSRLGKISNHFVVDENQEIVESERFRDQFKIKTPSVFQKVEALSGGNQQKVVLSKWIFAEPDILILDEPTRGIDVGAKYEIYTIIQQLADAGKGILMISSELPEILGMCDRIYVMSEGRITGEVSREEATQEKLMRLMTKTAIQEGA

SEQ ID NO: 39030 - DNA, 1521 bp, Escherichia coli
  CDS (1)..(1521): transl_table=11
atggtcagctcaacgactccgtcctccggggaatacttgttggaaatgagcggtatcaacaagtcctttcctggtgttaaggcacttgataacgttaatttaaaagtccggccacattctatccatgcattaatgggggaaaacggtgcaggaaaatcgacattattaaaatgcctgtttggtatttatcaaaaagactccggcaccattttattccagggtaaagagatcgatttccattctgcaaaagaagccctggaaaatggtatttcgatggtacaccaggagttaaacctggtattacaacgttcggtgatggataacatgtggctggggcgatatcccaccaaaggcatgtttgtcgatcaggacaaaatgtaccgcgaaaccaaagcgatttttgacgaactggatattgatatcgatccgcgtgcgcgcgtcggcacattatccgtttcgcaaatgcagatgatcgaaatcgccaaagcgttttcctataacgcgaaaattgtgattatggatgaaccgacttcttcgttaaccgaaaaagaggtcaatcatctgttcactattattcgtaaattaaaagagcgcggctgcggtattgtttatatctcgcataaaatggaagaaatcttccagttatgtgatgaagttaccgtattgcgcgacggtcagtggatcgccaccgaaccgctggcaggactgacgatggacaagatcatcgccatgatggttgggcgttctcttaaccagcgtttccctgacaaagaaaacaaaccgggcgaagtcatcctcgaggtacgtaacctgacgtcactgcgccagccgtcgattcgcgatgtctcgtttgatctgcataaaggggagatcctcggtattgccggtctggtgggggcgaaacgtaccgatattgttgagacgttatttggtattcgcgagaaatcggctggcaccataacgttgcacggcaaacagatcaataaccataatgccaacgaagccataaaccatggatttgcactggtaactgaggagcgccgctcaacgggaatttatgcctatctggatattggttttaactcgttaatttccaatattcgcaactacaaaaataaagttggtttactggataactcgcggatgaaaagcgatacccagtgggtgattgattcgatgcgggtaaaaacgccgggtcatcggacgcaaattggttcgctctccggtggtaatcagcaaaaggtgattattggtcgctggctactaacgcaaccagaaatattaatgctcgatgaaccgacgcgcggtattgatgtcggggcgaagtttgaaatttatcagttaattgccgaactggcgaagaaaggcaaggggattattattatctcctctgaaatgcctgagttgttagggataacagaccgtattctggtcatgagcaatggtctcgtttccggaattgtcgatacaaaaacaacaacgcaaaacgaaattctgcgtcttgcgtctttgcacctttaa

SEQ ID NO: 39031 - protein, 506 aa, Escherichia coli [sequence omitted]

SEQ ID NO: 39032 - DNA, 1521 bp, Haemophilus influenzae
  CDS (1)..(1521): transl_table=11
atgacagctcaaactcaatgtcaagacagccaagtgctgctcacaatgaccaatgtctgcaagtcctttccgggcgtaaaagccttagataacgccaacttaacggttcgatcacattctgttcatgccttaatgggcgagaacggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaacctcgtgcgtcaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaaaatctgtgatgaaattactattttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcagggcttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgccagaattactgggtgtgactgatcgcattttagtaatgagtaacggtaaattagcaggtatcgttgaaagcgcaaaaacatcgcaagaagaaattttgcaactcgcggcaaaatatttataa

SEQ ID NO: 39033 - protein, 506 aa, Haemophilus influenzae
MTAQTQCQDSQVLLTMTNVCKSFPGVKALDNANLTVRSHSVHALMGENGAGKSTLLKCLFGIYAKDEGEILFLGEPVNFKTSKEALENGISMVHQELNLVRQTSVMDNLWLGRYPLKGPFVDHAKMYRDTKAIFDELDIDVDPKEKVAKLSVSQMQMIEIAKAFSYNAKIVIMDEPTSSLSEKEVEHLFKIIDKLKQRGCGIIYISHKMDEIFKICDEITILRDGKWINTVNVKESTMEQIVGMMVGRELTQRFPEKTNVPKEVILQVENLTAKNQPSIQDVSFELRKGEILGIAGLVGAKRTDIVEAIFGVRELIEGTIKLHGKTVKNHTALEAINNGFALVTEERRSTGIYSNLSIEFNSLISNMKSYLTPWKLLSTKKMKSDTQWVIDSMNVKTPSHRTTIGSLSGGNQQKVIIGRWLLTQPEILMLDEPTRGIDIGAKFEIYQLIQELAKKDKGIIMISSEMPELLGVTDRILVMSNGKLAGIVESAKTSQEEILQLAAKYL

SEQ ID NO: 39034 - DNA, 1521 bp, Salmonella typhimurium
  CDS (1)..(1521): transl_table=11
atgggcagcacgatttctccgccgtcgggtgaatatttgttggaaatgcgtggcattaacaaatcatttcccggcgtgaaagcgcttgataatgtcaacttaaacgttcgtccgcactctattcatgcattaatgggcgaaaacggcgcaggcaaatcaacattattaaaatgtcttttcggtatttaccaaaaagattccggcagcattgtatttcagggaaaagaagtggacttccattcggcgaaagaagcgctggagaatgggatttcgatggtacaccaggagttaaacctggtattacaacgttcggtcatggataacatgtggctgggacgttatcccaccaaaggtatgtttgtcgaccaggataaaatgtaccaggataccaaagcgatatttgatgaactggatatcgatattgacccacgcgcgcgcgtaggaacgttatccgtttcgcaaatgcagatgatcgaaattgcgaaggcgttttcctataacgctaagatcgttattatggatgaaccgacctcatcgttaactgagaaagaggttaatcatctgttcacgattattcgcaagctgaaagaacgcggctgcggtattgtttatatctcgcataaaatggaagaaatttttcaattgtgcgatgaaattactattttgcgcgacggtcagtggattgccacccagccgctggaagggctggatatggataagatcattgcgatgatggtcgggcgttccctgaaccagcgtttcccggataaagaaaataagccgggcgacgtgattctggaggtccgtcacctgacctcgctgcgtcagccttccattcgcgatgtctcctttgatttgcacaagggcgaaattctgggcattgccggtctggttggggcaaagcgtaccgatatcgtcgaaacgctgtttggcattcgtgagaagtcgtccgggacaatcactttacatggcaagaaaattaataatcacactgcgaacgaagcgattaaccacggttttgcgctggtgacggaagagcgtcgttccaccggaatttacgcctatctggatatcggatttaactcattaatttcgaatatccgtaattataaaaataaagtggggttactggataattcccggatgaaaagcgacacccaatgggtcattgattccatgcgggtaaaaacgccggggcatcgcacgcaaattggttcgctttccggcggcaatcagcaaaaggtgatcattggtcgctggctattaacgcagccggaaatattaatgctggacgaaccgacccgcggcattgatgtcggcgcaaaatttgaaatttatcagcttattgcggaactggcgaaaaaaggcaaggggatcatcattatctcttctgaaatgccggagctgttagggattaccgatcgtatcctggtgatgagtaacggtctcgtttccggcattgtcgatactaaaacaacaacgcaaaacgaaattttgcgtcttgcttctttgcacctttaa

SEQ ID NO: 39035 - protein, 506 aa, Salmonella typhimurium
MGSTISPPSGEYLLEMRGINKSFPGVKALDNVNLNVRPHSIHALMGENGAGKSTLLKCLFGIYQKDSGSIVFQGKEVDFHSAKEALENGISMVHQELNLVLQRSVMDNMWLGRYPTKGMFVDQDKMYQDTKAIFDELDIDIDPRARVGTLSVSQMQMIEIAKAFSYNAKIVIMDEPTSSLTEKEVNHLFTIIRKLKERGCGIVYISHKMEEIFQLCDEITILRDGQWIATQPLEGLDMDKIIAMMVGRSLNQRFPDKENKPGDVILEVRHLTSLRQPSIRDVSFDLHKGEILGIAGLVGAKRTDIVETLFGIREKSSGTITLHGKKINNHTANEAINHGFALVTEERRSTGIYAYLDIGFNSLISNIRNYKNKVGLLDNSRMKSDTQWVIDSMRVKTPGHRTQIGSLSGGNQQKVIIGRWLLTQPEILMLDEPTRGIDVGAKFEIYQLIAELAKKGKGIIIISSEMPELLGITDRILVMSNGLVSGIVDTKTTTQNEILRLASLHL

SEQ ID NO: 39036 - DNA, 1491 bp, Treponema pallidum
  CDS (1)..(1491): transl_table=11
atgtgcgatgtactcaccataagggatctttctaagtcttttgcgaggaacagggttctcaacggggtgaacttccgtatgggaaagggtgccgtggtggggcttatgggagaaaatggtgcgggaaaatccacgcttatgaagtgcctctttggaatgtacgctaaggacactggtcagattctcgtggatggaagcccggtggactttcagtctcccaaagaagcgctagaaaacggtgtcgccatggtccatcaggagctcaatcaatgccttgatcgcactgtcatggacaatttgtttctcggcaggtaccctgcccgtttcgggatagttgacgagaaacgcatgttcgacgactccctcactctgttcgcttccttgaaaatggacgtaaacccgcgggccgtcatgcgcagcatgtctgtctctcagcggcagatggtagagattgccaaggcgatgtcctataacgcgaagattatagtcctcgacgagcctacttcctctctcacggagagggagattgtcaggctctttgccattatacgagacctgagcaaaaaaggagtggcattcatctatatctcccacaaaatggatgagatctttcagatctgcagcgaggtgattgtgctgcgggatggtgtcctcacgctctcacaatccataggggaagtggaaatgagcgacctcatcaccgctatggtcgggcgcactttggacaagcgctttcccgacgctgacaataccgtcggtgacgattatcttgaaatacgaggtctttctacaaggtatgctccgcagctgcgggatatttccctttctgtgaaaaggggcgagatttttggcttgtacgggctggtcggtgcggggaggagtgaactgcttgaagcgattttcggcctgcgtaccatcgcagacggtgagatctctttagcaggaaaaaaaattcgcttgaagagcagcagggacgcaatgaaactcaatttcgcctttgtgcccgaggaacgtaagctcaacggaatgttcgcaaaggggagcatagagtataacaccacgattgcaaatctccctgcgtataagcgttacggtctactctcaaagaaaaagctgcaggaggcagcggagcgggaaataaaggccatgcgcgtgaagtgcgtttctccaagcgagcttatcagtgcgctcagcgggggtaatcagcagaaagtcattattggaaagtggctcgaacgcgatcccgacgtcctcttgcttgatgagccgaccagggggatcgacgtgggtgcgaaatatgaaatttatcagctcatcattcgtatggcgcgtgagggaaagacaatcattgtggtttctagtgaaatgcctgaaattcttggaatcaccaacaggatcgcagtcatgtccaattatcgattggctgggattgtggatacaaagagtaccgatcaggaagccttgctcagactttctgcgcgatacctgtag

SEQ ID NO: 39037 - protein, 496 aa, Treponema pallidum
MCDVLTIRDLSKSFARNRVLNGVNFRMGKGAVVGLMGENGAGKSTLMKCLFGMYAKDTGQILVDGSPVDFQSPKEALENGVAMVHQELNQCLDRTVMDNLFLGRYPARFGIVDEKRMFDDSLTLFASLKMDVNPRAVMRSMSVSQRQMVEIAKAMSYNAKIIVLDEPTSSLTEREIVRLFAIIRDLSKKGVAFIYISHKMDEIFQICSEVIVLRDGVLTLSQSIGEVEMSDLITAMVGRTLDKRFPDADNTVGDDYLEIRGLSTRYAPQLRDISLSVKRGEIFGLYGLVGAGRSELLEAIFGLRTIADGEISLAGKKIRLKSSRDAMKLNFAFVPEERKLNGMFAKGSIEYNTTIANLPAYKRYGLLSKKKLQEAAEREIKAMRVKCVSPSELISALSGGNQQKVIIGKWLERDPDVLLLDEPTRGIDVGAKYEIYQLIIRMAREGKTIIVVSSEMPEILGITNRIAVMSNYRLAGIVDTKSTDQEALLRLSARYL

SEQ ID NO: 39038 - DNA, 1482 bp, Bacillus subtilis
  CDS (1)..(1482): transl_table=11
atgcagattgaaatgaaagacattcataaaacattcggaaaaaatcaggtgctgtcaggcgtttcctttcagctcatgcctggcgaggttcacgcattaatgggagaaaacggcgccggcaagtccacgcttatgaacattttgacaggcctgcacaaagcagataaaggtcaaatcagcataaacggaaacgaaacgtatttttccaatccgaaagaagcggaacagcatggaatagcctttatccatcaggaattgaatatctggccggaaatgaccgttcttgagaatctatttatcggtaaagagatatcctccaagctgggcgttttacaaacaagaaaaatgaaagcgctagcaaaagagcaatttgacaaactttccgtctctctttctcttgatcaagaagccggcgaatgttccgtcggacagcagcaaatgatcgaaattgcaaaagcgcttatgacaaatgccgaggtaatcattatggatgaaccgaccgcagcgttgactgaacgtgaaatcagcaagctctttgaggtcattacagcgttaaaaaagaacggcgtctccattgtctatatttcgcatcgcatggaagaaatttttgcgatttgcgacagaattaccatcatgcgtgacggaaaaacggtagatacaacaaacatctcagaaactgattttgatgaagtcgtcaaaaaaatggtcggacgggagctgactgaacgatatccaaaacgcactccttctctcggtgacaaagtattcgaggtgaaaaatgcttccgtaaaagggagttttgaggacgtcagcttttatgtgcgttccggtgagatcgtcggtgtttcaggattaatgggagccggccggacagaaatgatgagagcgctgttcggcgttgacaggctggacacgggtgagatatggatcgctgggaaaaaaacggctattaagaacccgcaggaagccgtgaaaaaaggtctcggctttattacagagaatcgcaaggatgaagggctcctgctcgacacctcgatccgcgaaaatattgccctgcccaatctgtccagcttctcaccaaagggtctcattgatcataagcgggaggctgaatttgtcgatctgttaatcaagcgcctcactatcaaaacagcatcaccggaaacgcacgcacgccatttatcaggaggaaaccagcaaaaagtggtgatagccaagtggatcggcatcggaccgaaagtgcttatcttggatgagccaaccagaggtgtggatgttggcgccaaacgagagatttatacgctgatgaatgagctgaccgaacgcggtgtcgctatcatcatggtgtcatcagagcttcctgaaattctgggaatgagcgatcggattatcgttgtccatgaaggcagaatcagcggcgaaatccatgcgcgagaagcaacacaagaacgaattatgacacttgccacgggagggcggtaa

SEQ ID NO: 39039 - protein, 493 aa, Bacillus subtilis
MQIEMKDIHKTFGKNQVLSGVSFQLMPGEVHALMGENGAGKSTLMNILTGLHKADKGQISINGNETYFSNPKEAEQHGIAFIHQELNIWPEMTVLENLFIGKEISSKLGVLQTRKMKALAKEQFDKLSVSLSLDQEAGECSVGQQQMIEIAKALMTNAEVIIMDEPTAALTEREISKLFEVITALKKNGVSIVYISHRMEEIFAICDRITIMRDGKTVDTTNISETDFDEVVKKMVGRELTERYPKRTPSLGDKVFEVKNASVKGSFEDVSFYVRSGEIVGVSGLMGAGRTEMMRALFGVDRLDTGEIWIAGKKTAIKNPQEAVKKGLGFITENRKDEGLLLDTSIRENIALPNLSSFSPKGLIDHKREAEFVDLLIKRLTIKTASPETHARHLSGGNQQKVVIAKWIGIGPKVLILDEPTRGVDVGAKREIYTLMNELTERGVAIIMVSSELPEILGMSDRIIVVHEGRISGEIHAREATQERIMTLATGGR

SEQ ID NO: 39040 - DNA, 1506 bp, Escherichia coli
  CDS (1)..(1506): transl_table=11
atggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggcatctatactcgcgatgccggtacgcttttatggctggggaaagaaacgacatttaccgggccaaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcctggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgatttcattcgtctgtttaatgtgaaaactccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaa

SEQ ID NO: 39041 - protein, 501 aa, Escherichia coli
MEALLQLKGIDKAFPGVKALSGAALNVYPGRVMALVGENGAGKSTMMKVLTGIYTRDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 39042 - DNA, 1482 bp, Haemophilus influenzae
  CDS (1)..(1482): transl_table=11
atggaaactttactcaaaattagtggtgttgataaatcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacatttttcttggtcgtgaatttaaaacctcgtggggagcgattaactggcagaaaatgcaccaagaagcagacaagttacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcgttatggcagagattacagaagatgatttaattgaaatgatggttggtcgtcgtcttgatgaacaatatccgcatttatcacaagaaaaaggcgaatgtgtattggatgtgaaacatgtgagcggaagcggcattgatgatgtttccttcaaattgcatgccggtgaaattgttggtgtctcgggcttaatgggcgcgggtagaacggaactcggcaagctactttacggtgctttgccaaaaacggcgggaaaagtgcggttaaaaaatcaagagattgagaatcgcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcggtattcgtcatcaagcggaaaaaatggcagtagatgactttattctgatgtttaacattaaaacacctaatcgtgatcaacaagtaggtttgctatctggtggaaatcaacaaaaagtggcaattgctcgtggattaatgactcgcccaaatgtgttaattttagatgaaccaactcgtggcgtagatgttggcgcgaagaaagaaatttatcagttgattaacgaatttaagaaagagggcttgagtattttaatgatctcatctgatatgccagaagtgcttggtatgagcgatcgagtgttggtaatgcgtgaaggtaaaattagtgcagaattttctcgtgaagaggcaacacaagaaaagttattagcagcagctattggtaaataa

SEQ ID NO: 39043 - protein, 493 aa, Haemophilus influenzae
METLLKISGVDKSFPGVKALNNACLSVYAGRVMALMGENGAGKSTLMKVLTGIYSKDAGTIEYLNRSVNFNGPKASQEAGISIIHQELNLVGNLTIAENIFLGREFKTSWGAINWQKMHQEADKLLARLGVTHSSKQLCAELSIGEQQMVEIAKALSFESKVIIMDEPTDALTDTETEALFNVIRELKAENRGIVYISHRLKEIFQICDDVTVLRDGQFIGERVMAEITEDDLIEMMVGRRLDEQYPHLSQEKGECVLDVKHVSGSGIDDVSFKLHAGEIVGVSGLMGAGRTELGKLLYGALPKTAGKVRLKNQEIENRSPQDGLDNGIVYISEDRKGDGLVLGMSVKENMSLTSLDHFSQKGGIRHQAEKMAVDDFILMFNIKTPNRDQQVGLLSGGNQQKVAIARGLMTRPNVLILDEPTRGVDVGAKKEIYQLINEFKKEGLSILMISSDMPEVLGMSDRVLVMREGKISAEFSREEATQEKLLAAAIGK

SEQ ID NO: 39044 - DNA, 1542 bp, Escherichia coli
  CDS (1)..(1542): transl_table=11
atgccttatctacttgaaatgaagaacattaccaaaaccttcggcagtgtgaaggcgattgataacgtctgcttgcggttgaatgctggcgaaatcgtctcactttgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcatcaggaattggccctggtgaaagaattgaccgtgctggaaaatatcttcctgggtaacgaaataacccacaatggcattatggattatgacctgatgacgctacgctgtcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcgattttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgggcgagagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatattgggtattgccggactcgttggtgccggacgtaccgagaccattcagtgcctgtttggtgtgtggcccggacaatgggaaggaaaaatttatattgatggcaaacaggtagatattcgtaactgtcagcaagccatcgcccaggggattgcgatggtccccgaagacagaaagcgcgacggcatcgttccggtaatggcggttggtaaaaatattaccctcgccgcactcaataaatttaccggtggcattagccagcttgatgacgcggcagagcaaaaatgtattctggaatcaatccagcaactcaaagttaaaacgtcgtcccccgaccttgctattggacgtttgagcggcggcaatcagcaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctga

SEQ ID NO: 39045 - protein, 513 aa, Escherichia coli
MPYLLEMKNITKTFGSVKAIDNVCLRLNAGEIVSLCGENGSGKSTLMKVLCGIYPHGSYEGEIIFAGEEIQASHIRDTERKGIAIIHQELALVKELTVLENIFLGNEITHNGIMDYDLMTLRCQKLLAQVSLSISPDTRVGDLGLGQQQLVEIAKALNKQVRLLILDEPTASLTEQETSILLDIIRDLQQHGIACIYISHKLNEVKAISDTICVIRDGQHIGTRDAAGMSEDDIITMMVGRELTALYPNEPHTTGDEILRIEHLTAWHPVNRHIKRVNDVSFSLKRGEILGIAGLVGAGRTETIQCLFGVWPGQWEGKIYIDGKQVDIRNCQQAIAQGIAMVPEDRKRDGIVPVMAVGKNITLAALNKFTGGISQLDDAAEQKCILESIQQLKVKTSSPDLAIGRLSGGNQQKAILARCLLLNPRILILDEPTRGIDIGAKYEIYKLINQLVQQGIAVIVISSELPEVLGLSDRVLVMHEGKLKANLINHNLTQEQVMEAALRSEHHVEKQSV

SEQ ID NO: 39046 - DNA, 1512 bp, Haemophilus influenzae
  CDS (1)..(1512): transl_table=11
atggcattgttggaaatgaaacatatcacaaaaaaatttggtgatgtgaccgcacttcataatatatccattgaattagaagcgggggaaattttatctttatgtggtgaaaatggatctggaaaatctacattaatgaaaatactttgcggtatttatccttgtggagattacagcggtgatatttacttttcagaaagtgaactaaaagcaaggaatattagagatactgaagaaaaaggcatttcaattattcatcaagaacttactctcgtaaagaatatgtctgtattggagaatatttttttgggtaacgaaataactcataaaggtttgacagcagataatgaaatgtacttacgttgcaaaaatttattacagcaggtgcaattagatgccgatcccaatacacgagtaggagaattaggtttagggcaacagcaattagttgaaatagctaaggctttgaataaacaagtaagacttcttatcttagatgaaccaacggcttcacttactgaaaaagaaacggaaattttgttaaatcttattaaggatcttaaagcacacaatatcgcttgtatctatatttcccataaactcaatgaagttaaggctatctctgacaaaatttgcgtcattcgtgatggtgaacatgttggtacgaaagacgcttcaacaatgacagaagatgacattatcaccatgatggtaggtcgggaaattacctcactttatccacatgaacctcatgaaatcaaagatgaaattttacgagtagaaaatctctctgcttggcatccaatcaatacacatattaagcgtgttgataacgtaagttttagtcttcatgagggggaaattttaggtgttgcaggtttagttggttcaggtcgtacagacatggtgcaatgcttatttgggtcttatgaaggtaagtttgaaggaaatatttttatcaatcaaaaacaagtaaatatcaaaaattgtgcccaagcgattgaacataaaattgtgatggttcctgaagatcggaagaaacacggcattgtttctattatgggagttggcaaaaacattacgctttcttctttgaaatcttattgtttcggaaaaatggtagttaatgaagcaaaagaagagcaaataattggctcagccatcaaacgactaaaggtgaaaactttttcaccagatttgccaataggacgacttagtggcggtaatcaacagaaagcgatcctagcaaaatgtttatcgttaaatcctaaaatactgattttagatgaaccaacaagaggaattgatgttggtgcgaaatatgaaatttataagttaattaaccaattagcacaagaagggattgctattattgtcatttcatcagaactaccagaagttttaggcattagtgatagagttcttgttatgcaccaaggtaaacttaaagctagtcttatcaatactgctcttactcaagaacaagttatggaaacagcacttaaggagtaa

SEQ ID NO: 39047 - protein, 503 aa, Haemophilus influenzae
MALLEMKHITKKFGDVTALHNISIELEAGEILSLCGENGSGKSTLMKILCGIYPCGDYSGDIYFSESELKARNIRDTEEKGISIIHQELTLVKNMSVLENIFLGNEITHKGLTADNEMYLRCKNLLQQVQLDADPNTRVGELGLGQQQLVEIAKALNKQVRLLILDEPTASLTEKETEILLNLIKDLKAHNIACIYISHKLNEVKAISDKICVIRDGEHVGTKDASTMTEDDIITMMVGREITSLYPHEPHEIKDEILRVENLSAWHPINTHIKRVDNVSFSLHEGEILGVAGLVGSGRTDMVQCLFGSYEGKFEGNIFINQKQVNIKNCAQAIEHKIVMVPEDRKKHGIVSIMGVGKNITLSSLKSYCFGKMVVNEAKEEQIIGSAIKRLKVKTFSPDLPIGRLSGGNQQKAILAKCLSLNPKILILDEPTRGIDVGAKYEIYKLINQLAQEGIAIIVISSELPEVLGISDRVLVMHQGKLKASLINTALTQEQVMETALKE

SEQ ID NO: 39048 - DNA, 1512 bp, Escherichia coli; identical to SEQ ID NO: 27632
  CDS (1)..(1512): transl_table=11

SEQ ID NO: 39049 - protein, 503 aa, Escherichia coli; identical to SEQ ID NO: 27633

SEQ ID NO: 39050 - DNA, 1503 bp, Escherichia coli O157
  CDS (1)..(1503): transl_table=11
atgacgaccgaccaacaccaggagatcctccgcaccgaaggattaagtaaatttttccccggcgtcaaagcgttagacaacgttgatttcagcctgcgccgtggcgaaatcatggcgctgctcggtgaaaacggggcgggaaaatcaacgctaatcaaagcattaactggtgtataccacgctgatcgcggcaccatctggctggaaggccaggctatctcaccgaaaaataccgcccacgcgcaacaactcggcattggcaccgtctatcaggaagtcaacctgctacccaatatgtcggtcgctgataatctatttataggccgcgaacccaaacgcttcggccttctacgccgcaaagagatggaaaagcgcgccaccgaactgatggcatcttacggtttctccctcgacgtgcgcgaaccgctcaaccgcttttcagtcgcgatgcagcaaatcgtcgctatttgccgggctatcgatctctctgccaaagtgctgatcctcgatgaacccaccgccagtctcgacacccaggaagtggagttactgtttgacctgatgcgtcagttgcgcgatcgcggcgtcagcctgatctttgtcactcactttctcgatcaggtctatcaggtcagcgatcggatcaccgtcttacgcaacggcagtttcgtaggctgtcgggaaacgtgcgagctaccgcagatcgaactggtaaaaatgatgctggggcgcgagctggatacccacgcgctacagcgtgccgggcgaacattgttgagcgacaaacccgttgccgcgttcaaaaattacggcaaaaaaggaacgatcgcaccgtttgatctcgaagtacgccccggcgagatcgtcggtctggctggattgctgggatcaggacgtaccgaaaccgccgaagtgatcttcggtatcaaacctgctgacagcggcacggcgttgatcaaaggcaaaccgcaaaacctgcgatcgccacatcaggcttcggtacttggcattggcttctgcccggaagacaggaaaaccgatggcatcatcgctgccgcctcggtgcgggaaaatatcatcctcgctctccaggcccggcgcggctggctacgtcccatttcccgcaaagaacagcaagagattgccgaacgctttatccgccagcttggcattcgcacaccttcaactgaacaaccgattgaatttctctccggcggcaatcagcaaaaagtgttgctttcacgttggctactgacccgaccgcaatttctgatcctcgatgagccaacccgcggcattgatgttggtgcccacgccgagatcatccgcctgattgaaacgctatgcgccgatggtctggcgctgctggtgatctcctccgaactggaagaactggtgggctatgccgaccgggtgatcatcatgcgcgatcgcaaacaggtggcggagatcccgctggcagagctttccgttccggcgatcatgaatgccattgcggcgtaa

SEQ ID NO: 39051 - protein, 500 aa, Escherichia coli O157
MTTDQHQEILRTEGLSKFFPGVKALDNVDFSLRRGEIMALLGENGAGKSTLIKALTGVYHADRGTIWLEGQAISPKNTAHAQQLGIGTVYQEVNLLPNMSVADNLFIGREPKRFGLLRRKEMEKRATELMASYGFSLDVREPLNRFSVAMQQIVAICRAIDLSAKVLILDEPTASLDTQEVELLFDLMRQLRDRGVSLIFVTHFLDQVYQVSDRITVLRNGSFVGCRETCELPQIELVKMMLGRELDTHALQRAGRTLLSDKPVAAFKNYGKKGTIAPFDLEVRPGEIVGLAGLLGSGRTETAEVIFGIKPADSGTALIKGKPQNLRSPHQASVLGIGFCPEDRKTDGIIAAASVRENIILALQARRGWLRPISRKEQQEIAERFIRQLGIRTPSTEQPIEFLSGGNQQKVLLSRWLLTRPQFLILDEPTRGIDVGAHAEIIRLIETLCADGLALLVISSELEELVGYADRVIIMRDRKQVAEIPLAELSVPAIMNAIAA

SEQ ID NO: 39052 - DNA, 23 bp, Artificial sequence
  (1)..(23): primer
atgcaacagtctaccccgtatct

SEQ ID NO: 39053 - DNA, 24 bp, Artificial sequence
  (1)..(24): primer
ttaggcaacagcctggctgacttt

SEQ ID NO: 39054 - protein, 556 aa, Artificial sequence
  Variant (2)..(5): xaa in position 2 to 5 is any amino acid
  Variant (7)..(7): xaa in position 7 is any amino acid
  Variant (9)..(9): xaa in position 9 is any amino acid
  Variant (11)..(14): xaa in position 11 to 14 is any amino acid
  Variant (15)..(16): xaa in position 15 to 16 is any or no amino acid
  Variant (18)..(19): xaa in position 18 to 19 is any amino acid
  Variant (21)..(23): xaa in position 21 to 23 is any amino acid
  Variant (25)..(26): xaa in position 25 to 26 is any amino acid
  Variant (28)..(28): xaa in position 28 is any amino acid
  Variant (30)..(30): xaa in position 30 is any amino acid
  Variant (33)..(33): xaa in position 33 is any amino acid
  Variant (48)..(48): xaa in position 48 is any amino acid
  Variant (50)..(55): xaa in position 50 to 55 is any amino acid
  Variant (56)..(60): xaa in position 56 to 60 is any or no amino acid
  Variant (62)..(62): xaa in position 62 is any amino acid
  Variant (64)..(66): xaa in position 64 to 66 is any amino acid
  Variant (68)..(77): xaa in position 68 to 77 is any amino acid
  Variant (79)..(79): xaa in position 79 is any amino acid
  Variant (80)..(84): xaa in position 80 to 84 is any or no amino acid
  Variant (87)..(88): xaa in position 87 to 88 is any amino acid
  Variant (94)..(94): xaa in position 94 is any amino acid
  Variant (96)..(98): xaa in position 96 to 98 is any amino acid
  Variant (102)..(102): xaa in position 102 is any amino acid
  Variant (106)..(106): xaa in position 106 is any amino acid
  Variant (109)..(113): xaa in position 109 to 113 is any amino acid
  Variant (114)..(122): xaa in position 114 to 122 is any or no amino acid
  Variant (124)..(130): xaa in position 124 to 130 is any amino acid
  Variant (131)..(135): xaa in position 131 to 135 is any or no amino acid
  Variant (137)..(138): xaa in position 137 to 138 is any amino acid
  Variant (140)..(147): xaa in position 140 to 147 is any amino acid
  Variant (148)..(152): xaa in position 148 to 152 is any or no amino acid
  Variant (154)..(155): xaa in position 154 to 155 is any amino acid
  Variant (157)..(157): xaa in position 157 is any amino acid
  Variant (160)..(161): xaa in position 160 to 161 is any amino acid
  Variant (171)..(175): xaa in position 171 to 175 is any amino acid
  Variant (176)..(180): xaa in position 176 to 180 is any or no amino acid
  Variant (192)..(194): xaa in position 192 to 194 is any amino acid
  Variant (196)..(198): xaa in position 196 to 198 is any amino acid
  Variant (200)..(201): xaa in position 200 to 201 is any amino acid
  Variant (204)..(205): xaa in position 204 to 205 is any amino acid
  Variant (207)..(209): xaa in position 207 to 209 is any amino acid
  Variant (210)..(210): xaa in position 210 is any or no amino acid
  Variant (212)..(213): xaa in position 212 to 213 is any amino acid
  Variant (222)..(222): xaa in position 222 is any amino acid
  Variant (225)..(226): xaa in position 225 to 226 is any amino acid
  Variant (228)..(228): xaa in position 228 is any amino acid
  Variant (230)..(230): xaa in position 230 is any amino acid
  Variant (238)..(239): xaa in position 238 to 239 is any amino acid
  Variant (241)..(251): xaa in position 241 to 251 is any amino acid
  Variant (252)..(257): xaa in position 252 to 257 is any or no amino acid
  Variant (260)..(261): xaa in position 260 to 261 is any amino acid
  Variant (266)..(266): xaa in position 266 is any amino acid
  Variant (268)..(281): xaa in position 268 to 281 is any amino acid
  Variant (282)..(294): xaa in position 282 to 294 is any or no amino acid
  Variant (296)..(296): xaa in position 296 is any amino acid
  Variant (298)..(299): xaa in position 298 to 299 is any amino acid
  Variant (301)..(305): xaa in position 301 to 305 is any amino acid
  Variant (306)..(318): xaa in position 306 to 318 is any or no amino acid
  Variant (320)..(322): xaa in position 320 to 322 is any amino acid
  Variant (324)..(325): xaa in position 324 to 325 is any amino acid
  Variant (332)..(332): xaa in position 332 is any amino acid
  Variant (343)..(345): xaa in position 343 to 345 is any amino acid
  Variant (347)..(347): xaa in position 347 is any amino acid
  Variant (349)..(353): xaa in position 349 to 353 is any amino acid
  Variant (354)..(357): xaa in position 354 to 357 is any or no amino acid
  Variant (359)..(359): xaa in position 359 is any amino acid
  Variant (361)..(361): xaa in position 361 is any amino acid
  Variant (363)..(363): xaa in position 363 is any amino acid
  Variant (365)..(366): xaa in position 365 to 366 is any amino acid
  Variant (368)..(372): xaa in position 368 to 372 is any amino acid
  Variant (373)..(380): xaa in position 373 to 380 is any or no amino acid
  Variant (383)..(384): xaa in position 383 to 384 is any amino acid
  Variant (387)..(388): xaa in position 387 to 388 is any amino acid
  Variant (390)..(390): xaa in position 390 is any amino acid
  Variant (395)..(395): xaa in position 395 is any amino acid
  Variant (396)..(396): xaa in position 396 is any or no amino acid
  Variant (399)..(403): xaa in position 399 to 403 is any amino acid
  Variant (405)..(406): xaa in position 405 to 406 is any amino acid
  Variant (409)..(409): xaa in position 409 is any amino acid
  Variant (411)..(419): xaa in position 411 to 419 is any amino acid
  Variant (420)..(426): xaa in position 420 to 426 is any or no amino acid
  Variant (428)..(441): xaa in position 428 to 441 is any amino acid
  Variant (442)..(442): xaa in position 442 is any or no amino acid
  Variant (444)..(444): xaa in position 444 is any amino acid
  Variant (447)..(452): xaa in position 447 to 452 is any amino acid
  Variant (453)..(454): xaa in position 453 to 454 is any or no amino acid
  Variant (456)..(457): xaa in position 456 to 457 is any amino acid
  Variant (471)..(471): xaa in position 471 is any amino acid
  Variant (473)..(477): xaa in position 473 to 477 is any amino acid
  Variant (478)..(478): xaa in position 478 is any or no amino acid
  Variant (495)..(495): xaa in position 495 is any amino acid
  Variant (499)..(499): xaa in position 499 is any amino acid
  Variant (502)..(503): xaa in position 502 to 503 is any amino acid
  Variant (505)..(507): xaa in position 505 to 507 is any amino acid
  Variant (508)..(508): xaa in position 508 is any or no amino acid
  Variant (510)..(511): xaa in position 510 to 511 is any amino acid
  Variant (520)..(520): xaa in position 520 is any amino acid
  Variant (524)..(524): xaa in position 524 is any amino acid
  Variant (526)..(526): xaa in position 526 is any amino acid
  Variant (530)..(530): xaa in position 530 is any amino acid
  Variant (533)..(534): xaa in position 533 to 534 is any amino acid
  Variant (536)..(536): xaa in position 536 is any amino acid
  Variant (538)..(538): xaa in position 538 is any amino acid
  Variant (540)..(549): xaa in position 540 to 549 is any amino acid
  Variant (550)..(554): xaa in position 550 to 554 is any or no amino acid
LXXXXIXKXFXXXXXXLXXVXXXVXXGXVXALXGENGAGKSTLMKILXGXXXXXXXXXXXGXIXXXGXXXXXXXXXXAXXXXXXGIXXIHQELXLXXXLTVXENIXLGXXXXXXXXXXXXXXIXXXXXXXXXXXXLXXLXXXXXXXXXXXXXVXXLXVAXXQMVEIAKALXXXXXXXXXXVLIMDEPTAALXXXEXXXLXXIIXXLXXXXGXXIIYISHRLXEIXXIXDXITVLRDGXXVXXXXXXXXXXXXXXXXXLVXXMVGRXLXXXXXXXXXXXXXXXXXXXXXXXXXXXLXVXXLXXXXXXXXXXXXXXXXXXVXXXVXXGEILGIXGLVGAGRTELXXXLXGXXXXXXXXXGXIXLXGXXVXXXXXXXXXXXXXAIXXGIXXVXEDRKXXGLXXXXXVXXNIXLXXXXXXXXXXXXXXXXLXXXXXXXXXXXXXXXLXIKXXXXXXXXIXXLSGGNQQKVVLAKXLXXXXXXVLILDEPTRGIDVGAKXEIYXLIXXLXXXXGXXIIMISSELXEVLXMXDRIXVMXXGXIXGXXXXXXXXXXXXXXXIM

SEQ ID NO: 39055 - protein, 23 aa, Artificial sequence
  Variant (2)..(5): xaa in position 2 to 5 is any amino acid
  Variant (6)..(6): xaa in position 6 is Ile, Leu or Val
  Variant (7)..(7): xaa in position 7 is any amino acid
  Variant (12)..(12): xaa in position 12 is Ala, Cys, Ser or Thr
  Variant (16)..(16): xaa in position 16 is Ser or Thr
  Variant (17)..(17): xaa in position 17 is Phe, Leu, Met or Val
  Variant (18)..(22): xaa in position 18 to 22 is any amino acid
  Variant (23)..(23): xaa in position 23 is Ala or Gly
GXXXXXXGENGXGKSXXXXXXXX

SEQ ID NO: 39056 - protein, 25 aa, Artificial sequence
  Variant (2)..(2): xaa in position 2 is Ile or Val
  Variant (3)..(4): xaa in position 3 to 4 is any amino acid
  Variant (5)..(5): xaa in position 5 is Ile or Val
  Variant (6)..(6): xaa in position 6 is any amino acid
  Variant (9)..(10): xaa in position 9 to 10 is any or no amino acid
  Variant (12)..(19): xaa in position 12 to 19 is any amino acid
  Variant (20)..(21): xaa in position 20 to 21 is any or no amino acid
  Variant (23)..(23): xaa in position 23 is Ile, Leu or Met
  Variant (24)..(24): xaa in position 24 is any amino acid
  Variant (25)..(25): xaa in position 25 is Phe, Ile, Leu, Met or Val
GXXXXXQEXXLXXXXXXXXXXNXXX

SEQ ID NO: 39057 - protein, 16 aa, Artificial sequence
  Variant (2)..(6): xaa in position 2 to 6 is any amino acid
  Variant (7)..(9): xaa in position 7 to 9 is any or no amino acid
  Variant (11)..(11): xaa in position 11 is any amino acid
  Variant (12)..(12): xaa in position 12 is Ile, Leu or Val
  Variant (13)..(13): xaa in position 13 is Ala, Glu or Gln
  Variant (15)..(15): xaa in position 15 is any amino acid
  Variant (16)..(16): xaa in position 16 is Lys or Arg
LXXXXXXXXQXXXIXX

SEQ ID NO: 39058 - protein, 56 aa, Artificial sequence
  Variant (2)..(2): xaa in position 2 is any amino acid
  Variant (3)..(4): xaa in position 3 to 4 is any or no amino acid
  Variant (9)..(9): xaa in position 9 is any amino acid
  Variant (10)..(10): xaa in position 10 is any or no amino acid
  Variant (12)..(12): xaa in position 12 is Ala, Asp, Gly, Asn, Ser or Thr
  Variant (13)..(14): xaa in position 13 to 14 is any amino acid
  Variant (15)..(15): xaa in position 15 is Asp or Glu
  Variant (16)..(18): xaa in position 16 to 18 is any amino acid
  Variant (19)..(19): xaa in position 19 is Phe, Leu or Val
  Variant (20)..(22): xaa in position 20 to 22 is any amino acid
  Variant (23)..(23): xaa in position 23 is Ile, Leu, Met or Val
  Variant (24)..(25): xaa in position 24 to 25 is any amino acid
  Variant (26)..(26): xaa in position 26 is Phe, Ile, Leu, Met or Val
  Variant (27)..(33): xaa in position 27 to 33 is any amino acid
  Variant (34)..(34): xaa in position 34 is Ile, Leu, Met or Val
  Variant (35)..(35): xaa in position 35 is any amino acid
  Variant (36)..(36): xaa in position 36 is Ile or Val
  Variant (37)..(37): xaa in position 37 is Gly, Ser or Thr
  Variant (39)..(39): xaa in position 39 is any amino acid
  Variant (40)..(40): xaa in position 40 is Phe, Ile, Leu or Met
  Variant (41)..(41): xaa in position 41 is any amino acid
  Variant (42)..(42): xaa in position 42 is Asp, Glu or Gln
  Variant (43)..(46): xaa in position 43 to 46 is any amino acid
  Variant (47)..(47): xaa in position 47 is Ala, Cys, Gly, Ser, Thr or Val
  Variant (48)..(52): xaa in position 48 to 52 is any amino acid
  Variant (53)..(53): xaa in position 53 is Phe, Ile, Leu, Met or Val
  Variant (54)..(54): xaa in position 54 is Lys or Arg
  Variant (55)..(55): xaa in position 55 is any amino acid
IXXXDEPTXXLXXXXXXXXXXXXXXXXXXXXXXXXXXHXXXXXXXXXXXXXXXXXG

SEQ ID NO: 39059 - protein, 23 aa, Artificial sequence
  Variant (2)..(2): xaa in position 2 is Glu or Gln
  Variant (3)..(4): xaa in position 3 to 4 is any amino acid
  Variant (5)..(5): xaa in position 5 is Ala, Cys or Gly
  Variant (6)..(6): xaa in position 6 is Phe, Ile, Leu, Met or Val
  Variant (7)..(7): xaa in position 7 is any amino acid
  Variant (10)..(10): xaa in position 10 is any amino acid
  Variant (12)..(12): xaa in position 12 is Ala, Ser or Thr
  Variant (15)..(15): xaa in position 15 is Ser or Thr
  Variant (16)..(16): xaa in position 16 is Asp, Glu, Asn or Ser
  Variant (17)..(22): xaa in position 17 to 22 is any amino acid
GXXXXXXGLXGXGRXXXXXXXXG

SEQ ID NO: 39060 - protein, 13 aa, Artificial sequence
  Variant (9)..(9): xaa in position 9 is Ala or Val
  Variant (10)..(10): xaa in position 10 is Ala, Ile, Leu or Val
  Variant (11)..(11): xaa in position 11 is Phe, Ile, Leu or Val
  Variant (12)..(12): xaa in position 12 is Ala, Gly or Ser
  Variant (13)..(13): xaa in position 13 is Lys or Arg
LSGGNQQKXXXXX

SEQ ID NO: 39061 - protein, 19 aa, Artificial sequence
  Variant (5)..(5): xaa in position 5 is Lys or Arg
  Variant (7)..(7): xaa in position 7 is Ile or Val
  Variant (9)..(9): xaa in position 9 is Ile or Val
  Variant (10)..(10): xaa in position 10 is Ala, Glu, Gly, Asn or Ser
  Variant (11)..(11): xaa in position 11 is Ala, Gly, Asn, Ser or Thr
  Variant (12)..(13): xaa in position 12 to 13 is any amino acid
  Variant (14)..(14): xaa in position 14 is Ala, Asp, Glu, Gly, Gln or Thr
  Variant (15)..(15): xaa in position 15 is Phe, Ile, Leu or Val
  Variant (16)..(18): xaa in position 16 to 18 is any amino acid
  Variant (19)..(19): xaa in position 19 is Phe, Ile, Leu, Met or Val
DEPTXGXDXXXXXXXXXXX

SEQ ID NO: 39062 - protein, 24 aa, Artificial sequence
  Variant (2)..(5): xaa in position 2 to 5 is any amino acid
  Variant (6)..(7): xaa in position 6 to 7 is any or no amino acid
  Variant (10)..(10): xaa in position 10 is Asp or Glu
  Variant (11)..(12): xaa in position 11 to 12 is any amino acid
  Variant (14)..(14): xaa in position 14 is Ile, Leu or Val
  Variant (15)..(17): xaa in position 15 to 17 is any amino acid
  Variant (18)..(18): xaa in position 18 is Ala, Cys, Ser or Thr
  Variant (19)..(19): xaa in position 19 is any amino acid
  Variant (21)..(21): xaa in position 21 is Ala, Ile, Leu or Val
  Variant (22)..(23): xaa in position 22 to 23 is any amino acid
  Variant (24)..(24): xaa in position 24 is Phe, Ile, Leu, Met or Val
GXXXXXXSSXXXEXXXXXXRXXXX

SEQ ID NO: 39063 - DNA, 192 bp, Escherichia coli; identical to SEQ ID NO: 14760
  CDS (1)..(192)

SEQ ID NO: 39064 - protein, 63 aa, Escherichia coli; identical to SEQ ID NO: 14761

SEQ ID NO: 39065 - DNA, 1140 bp, Escherichia coli O157:H7 EDL933; identical to SEQ ID NO: 14762
  CDS (1)..(1140): transl_table=11

SEQ ID NO: 39066 - protein, 379 aa, Escherichia coli O157:H7 EDL933; identical to SEQ ID NO: 14763

SEQ ID NO: 39067 - DNA, 1140 bp, Escherichia coli O157; identical to SEQ ID NO: 14764
  CDS (1)..(1140): transl_table=11

SEQ ID NO: 39068 - protein, 379 aa, Escherichia coli O157; identical to SEQ ID NO: 14765

SEQ ID NO: 39069 - DNA, 24 bp, Artificial sequence
  (1)..(24): primer
atgcctgagactactaagctgttt

SEQ ID NO: 39070 - DNA, 28 bp, Artificial sequence
  (1)..(28): primer
ttaaagtccatgatataaaaatgtctct

SEQ ID NO: 39071 - protein, 59 aa, Artificial sequence; identical to SEQ ID NO: 14768
  Variant (10)..(10): xaa in position 10 is Gly or Ser
  Variant (11)..(11): xaa in position 11 is any amino acid
  Variant (13)..(13): xaa in position 13 is any amino acid
  Variant (15)..(15): xaa in position 15 is any amino acid
  Variant (19)..(19): xaa in position 19 is Trp or Tyr
  Variant (28)..(28): xaa in position 28 is any amino acid
  Variant (30)..(30): xaa in position 30 is Glu or Gly
  Variant (33)..(33): xaa in position 33 is any amino acid
  Variant (37)..(37): xaa in position 37 is Ile or Val
  Variant (46)..(46): xaa in position 46 is Ile or Leu
  Variant (48)..(48): xaa in position 48 is any amino acid
  Variant (50)..(50): xaa in position 50 is Glu or Lys

SEQ ID NO: 39072 - DNA, 705 bp, Escherichia coli; identical to SEQ ID NO: 20641
  CDS (1)..(705)

SEQ ID NO: 39073 - protein, 234 aa, Escherichia coli; identical to SEQ ID NO: 20642

SEQ ID NO: 39074 - DNA, 26 bp, Artificial sequence
  (1)..(26): primer
atgtttttagcatcattgttgagacg

SEQ ID NO: 39075 - DNA, 28 bp, Artificial sequence
  (1)..(28): primer
ttaaatttttgctattagattttctgca

SEQ ID NO: 39076 - DNA, 1338 bp, Escherichia coli
  CDS (1)..(1338)
atgaaaaacattatccgtactcccgaaacgcatccgctgacctggcgtctgcgcgatgacaaacagccagtgtggctggacgaataccgcagcaaaaacggttacgaaggcgcgcgtaaggcgctgaccgggctgtctccggacgaaatcgttaatcaggtaaaagacgctggtctgaaagggcgcggcggcgcgggcttctcgactggcctgaaatggagcctgatgccgaaagacgaatccatgaacatccgttacctgctgtgtaatgccgatgaaatggagccgggcacctataaagaccgcctgttgatggagcaactgccgcacctgctggtggaaggtatgctcatctccgcgtttgcgctgaaagcttaccgtggctacatcttcctgcgtggcgaatatatcgaagcggcagttaatctgcgccgtgccattgccgaagccaccgaagcgggtctgcttggcaaaaacattatgggaacaggtttcgatttcgaactgttcgtccataccggggcagggcgctacatctgcggggaagaaacagcgttaatcaactccctggaaggacgtcgtgctaacccacgctcgaagccacccttcccggcaacctccggcgcatggggtaaaccgacctgtgtcaacaacgtcgaaaccctgtgtaacgttccggcgatcctcgctaacggcgtggagtggtatcagaacatctcgaaaagtaaagatgctggcaccaagctgatgggcttctccggtcgggtgaaaaatccgggactgtgggaactgccgttcggcaccaccgcacgcgagatcctcgaagattacgccggtggtatgcgtgatggtctgaaatttaaagcctggcagccaggcggcgcggggactgacttcctgaccgaagcgcaccttgatctgccgatggaattcgaaagtatcggtaaagcgggcagccgtctgggtacggcgctggcgatggcggttgaccatgagatcaacatggtgtcgctggtgcgtaacctggaagagtttttcgcccgtgagtcctgcggctggtgtacgccgtgccgcgacggtctgccgtggagcgtgaaaattctgcgtgcgctggagcgtggtgaaggtcagccgggcgatatcgaaacacttgagcaactgtgtcgattcttaggcccgggtaaaactttctgtgcccacgcacctggtgcagtggagccgttacagagcgccatcaaatatttccgcgaagaatttgaggcgggaatcaaacagccgttcagcaatacccatttgattaatgggattcagccgaacctgctgaaagagcgctggtaa

SEQ ID NO: 39077 - protein, 445 aa, Escherichia coli
MKNIIRTPETHPLTWRLRDDKQPVWLDEYRSKNGYEGARKALTGLSPDEIVNQVKDAGLKGRGGAGFSTGLKWSLMPKDESMNIRYLLCNADEMEPGTYKDRLLMEQLPHLLVEGMLISAFALKAYRGYIFLRGEYIEAAVNLRRAIAEATEAGLLGKNIMGTGFDFELFVHTGAGRYICGEETALINSLEGRRANPRSKPPFPATSGAWGKPTCVNNVETLCNVPAILANGVEWYQNISKSKDAGTKLMGFSGRVKNPGLWELPFGTTAREILEDYAGGMRDGLKFKAWQPGGAGTDFLTEAHLDLPMEFESIGKAGSRLGTALAMAVDHEINMVSLVRNLEEFFARESCGWCTPCRDGLPWSVKILRALERGEGQPGDIETLEQLCRFLGPGKTFCAHAPGAVEPLQSAIKYFREEFEAGIKQPFSNTHLINGIQPNLLKERW

SEQ ID NO: 39078 - DNA, 1479 bp, Danio rerio
  CDS (1)..(1479)
atgttgtcgtgtctcggctctccagctcttagccgggttctgagcagcggggcgtctcgtgctcctgtggcagtggctgtagctggagcctctcgcacctctgtgtcctccaactctgctccacaatgcaggactctgctccgctacagcagcacagctcaacaggaaacacccaagaagaccaagtttgggcctcttgctgaccaggacagaatattcactaacctgtatggacgccatgactggaggctgaagggtgccctgaggagaggcgactggtacaagaccaaggagattctggataaaggagtggactggatcctgaatgagattaagacctccgggctgcggggccgaggtggtgctggattcccaacagggatgaagtggagcttcatgaacaagcccagtgatggcaggcctaaatatctggtggtgaatgctgacgaaggagagcctgggacctgtaaggacagagagatcatgcgtaatgatccgcacaagctaatcgagggctgtctggtcgccggcagggccatgggcgctcgagctgcctacatctacatccgcggagagttttacaatgagtcctccaacctgcaggtggccattaatgaggcttatgctgccggtctgatcggtaaaaacgcatgcggctctggttatgattttgacgtgttcgtgatgcgtggagcaggagcttacatttgtggcgaggagacggctctgatcgagtccatcgaggggaaacagggaaaacctcgtctcaaaccccctttccctgctgatgtgggcgtgtttggctgtcccacgactgttgctaatgttgagaccgtagcggtggcaccaaccatctgccgtcgcggtggcacatggtttgcaggtttcggccgagaaagaaactccggcaccaagctcttcaacatttcaggccacgttaacaacccctgtacagtggaagaagagatgtccattccccttaaagagcttatcgaaagacatgcaggtggtgtccggggtggttgggataatctcctgtgtgtcattcctggaggatcgtccacaccactcatcccacaacacgtgtgcgacaccgttctcatggatttcgatgccctcattcaggctcagactggtctcggcactgcagcacttattgtcatggataaatcaactgacgttatccgagctatcgcccgtttgattgagttctacaagcatgagagctgcgggcagtgcactccttgcagagagggagtggactggatgaacaagatgatgtggcgctttgtgaaaggtgatgcgcggtcagcagagatcgacatgatctgggagatcagcaagcagattgagggacacaccatctgcgctttaggagacggagccgcatggcctgttcagggcttgattcgtcacttccgtcctttgatggagagcagaatcgcagacttccaacagaaacagcaggcacgcgcttga

SEQ ID NO: 39079 - protein, 492 aa, Danio rerio
MLSCLGSPALSRVLSSGASRAPVAVAVAGASRTSVSSNSAPQCRTLLRYSSTAQQETPKKTKFGPLADQDRIFTNLYGRHDWRLKGALRRGDWYKTKEILDKGVDWILNEIKTSGLRGRGGAGFPTGMKWSFMNKPSDGRPKYLVVNADEGEPGTCKDREIMRNDPHKLIEGCLVAGRAMGARAAYIYIRGEFYNESSNLQVAINEAYAAGLIGKNACGSGYDFDVFVMRGAGAYICGEETALIESIEGKQGKPRLKPPFPADVGVFGCPTTVANVETVAVAPTICRRGGTWFAGFGRERNSGTKLFNISGHVNNPCTVEEEMSIPLKELIERHAGGVRGGWDNLLCVIPGGSSTPLIPQHVCDTVLMDFDALIQAQTGLGTAALIVMDKSTDVIRAIARLIEFYKHESCGQCTPCREGVDWMNKMMWRFVKGDARSAEIDMIWEISKQIEGHTICALGDGAAWPVQGLIRHFRPLMESRIADFQQKQQARA

SEQ ID NO: 39080 - DNA, 1395 bp, Rattus norvegicus
  CDS (1)..(1395)
atgctagcagcacggcattttctcggcgggtcggttcccgtgcgggtatctgtgcgtctcagcagcggcacgacagcacccaagaaaacctcatttggctcgctgaaggatgaagaccggatcttcaccaacctgtatgggcgccatgactggaggctgaagggtgcccagaggcggggtgattggtacaagacaaaggagatcctgctgaaggggcctgactggatcttgggtgaaatgaagacatcgggtttacggggccgtggtggtgctggcttccccactggcctcaaatggagctttatgaataagccctcggatggcaggcccaagtacctggtggtgaatgctgacgagggtgagcccggcacctgtaaggaccgagagatcatgcgccatgaccctcacaagctggtggaaggctgcctggtgggaggccgggccatgggggcccgggctgcctatatctacatccgaggggaattctacaatgaggcctccaatttgcaggtagctatccgagaggcctatgaagcaggtctgattggcaaaaatgcctgtgactctgattatgattttgatgtgtttgtggtgcgtggggctggggcctacatctgtggagaagagactgcgcttattgagtccattgaaggcaagcagggaaagccacgcctgaagccgccctttccagcagatgtgggagtatttggatgccccacaactgtggccaatgtggagacggtggctgtgtcccccaccatctgccgtcgtggcggcacctggtttgctggctttggccgagaacgcaactcaggtaccaaactgttcaacatctctggccatgtcaaccacccctgcactgtggaggaagagatgtctgtgccactcaaagaactgattgagaaacatgctggtggtgtcttaggtggctgggacaacctccttgctgtgattcctggtggctcatccactccactgatccccaaatctgtgtgtgagacagtgctgatggactttgatgccctggtgcaggctcagacgggcctgggcacagctgcggttattgttatgaacagctcgacagacattgtgaaagccatcgctcgtctcattgagttctacaagcatgagagctgtggccagtgcaccccgtgccgggagggcgttgattggatgaacaaggtgatggcccgatttgtgaagggggatgcccggccagctgagatcgactccctgtgggagatcagcaagcagatagaaggccacaccatttgtgctctgggtgatggggccgcctggccagtacagggtctgatccgacatttccggcccgagcttgaggatcggatgcaacgatttgcccagcagcaccaggccaggcaggcggcctcctga

SEQ ID NO: 39081 - protein, 464 aa, Rattus norvegicus
MLAARHFLGGSVPVRVSVRLSSGTTAPKKTSFGSLKDEDRIFTNLYGRHDWRLKGAQRRGDWYKTKEILLKGPDWILGEMKTSGLRGRGGAGFPTGLKWSFMNKPSDGRPKYLVVNADEGEPGTCKDREIMRHDPHKLVEGCLVGGRAMGARAAYIYIRGEFYNEASNLQVAIREAYEAGLIGKNACDSDYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVLGGWDNLLAVIPGGSSTPLIPKSVCETVLMDFDALVQAQTGLGTAAVIVMNSSTDIVKAIARLIEFYKHESCGQCTPCREGVDWMNKVMARFVKGDARPAEIDSLWEISKQIEGHTICALGDGAAWPVQGLIRHFRPELEDRMQRFAQQHQARQAAS

SEQ ID NO: 39082 - DNA, 1407 bp, Xenopus tropicalis
  CDS (1)..(1407)
atgctttccctaagacatatgctgagaattcctccttctactgcttccaccattgttattgccagattaaactctagtgggccagaacagactccaaaaaagtcaaaatttggacctcttagtgatgaagatcgaatatttactaacttatatggacgtcatgactggggattgaaaggtgctttaagtagaggagactggtacaagaccaaggagattttgttgaagggtgtagactggattctgggtgagattaaagcatctggcctgcgtggcagaggaggagctggattcccaacaggtcttaaatggagctttatgaataaaccatcagatgggaggcccaagtatcttgtagtcaatgcagatgaaggtgaacctggaacatgtaaggatcgggagatcatgagacacgacccccacaaacttgtggagggttgtctggttgctggacgtagcatgggagcacgtgcagcatacatctacattcggggagaattttacaatgaagcatccaatttacaggtagctgtgcgggaagcatattctgcagggcttattgggcgtaatgcctgtggctcggggtatgattttgatgtgtttgtggtgagaggtgctggggcatacatctgtggtgaagagactgcattgattgagagcattgaaggaaaacaaggaaaaccccgccttaagcctccttttcctgctgatgttggtgtcttcggttgtccaacaacagttgccaatgtggaaactgttgcagttgcaccaaccatttgcaggcgtggaggttcttggtttgctagctttggtcgtgaaagaaacgctggcaccaaactgttcaacatatcgggacatgtaaacaatccctgtactgtggaggaagagatgtctatacctcttaaagagcttattgaaaggcatgcaggaggagttactggtggctgggataatctgcttgcggtgatccctggaggctcctccacaccacttataccacaatctgtgtgtgaaacagttcttatggattttgatgctctagtccaggctcagactggtcttggtacagcagccattattgtcatgaataaatcaactgacattgtccgcgctattgctcgccttattgagttctacaaacatgagagctgtggtcagtgtactccctgcagggaaggtgttgactggatgaacaaagttatgtggcgtatgtgtcaaggtgatgcccgtgtagatgagattgacatgttgtgggagattagcaagcagattgaaggccacactatctgtgcacttggagatggggctgcctggcctgtccagggtttgattcgtcatttccgccctgagttggagaagcgtatgaaactttttgatacagtaaagagacagctagctagcagctga

SEQ ID NO: 39083 - protein, 468 aa, Xenopus tropicalis
MLSLRHMLRIPPSTASTIVIARLNSSGPEQTPKKSKFGPLSDEDRIFTNLYGRHDWGLKGALSRGDWYKTKEILLKGVDWILGEIKASGLRGRGGAGFPTGLKWSFMNKPSDGRPKYLVVNADEGEPGTCKDREIMRHDPHKLVEGCLVAGRSMGARAAYIYIRGEFYNEASNLQVAVREAYSAGLIGRNACGSGYDFDVFVVRGAGAYICGEETALIESIEGKQGKPRLKPPFPADVGVFGCPTTVANVETVAVAPTICRRGGSWFASFGRERNAGTKLFNISGHVNNPCTVEEEMSIPLKELIERHAGGVTGGWDNLLAVIPGGSSTPLIPQSVCETVLMDFDALVQAQTGLGTAAIIVMNKSTDIVRAIARLIEFYKHESCGQCTPCREGVDWMNKVMWRMCQGDARVDEIDMLWEISKQIEGHTICALGDGAAWPVQGLIRHFRPELEKRMKLFDTVKRQLASS

SEQ ID NO: 39084 - DNA, 1380 bp, Gallus gallus
  CDS (1)..(1380)
atggccgcctggcagctgagggcactgcgccgcctccccgccgccaccgccggcttctcgacagcgccgaagaagacgcagttcggctctctgaaggatgaggaccgcatcttcaccaacctctatgggcggcacgagtggaggctgcagggagcgctgcggcggggcgactggtacaagacaaaggagatcctgctgaagggcgtcgactggatcctgggtgagatcaaggcctcggggctgcggggccgcgggggggccggcttccccaccggcctcaagtggagcttcatgaacaaaccgcctgacggcagacccaagtacctggtggtgaacgcagatgagggggaacccggcacctgcaaggaccgtgagatcatgcggcacgacccgcacaagctggtggagggctgcctggtggccggccgtgccatgggcgcccgggccgcctacatctacatccgcggcgagttctacaatgaggcctccaacctgcaggtggccatcagggaagcgtacgaggctgggcttctggggaagaatgcctgcggttccgactatgcctttgatgtcttcgtggtgaggggtgccggggcgtacatctgtggcgaggagacggcactcatcgagtccatcgagggcaagcagggcaagccgcgcctcaagccgccctttcccgctgacgtgggagtcttcggctgtcccaccacggtggccaacgtggagacggtggctgtggcccccaccatctgccggcgcggtggtgcgtggttcgccggctttgggcgcgagcgcaactccgggacaaagcttttcaacatctctggccacgtcaaccacccctgcacagtggaggaggagatgtcagtgccgctgaaggagctcattgagaagcatgctgggggtgtccgtggtggctgggacaacctgctggctgtcatcccggggggctcctccaccccgctgctccccaagtcggtgtgtgagaccgtgttgatggactttgattccctggtgcaggcgcagagcgggctcggcacggctgccgtcatcgtcatggataaatcgaccgacatcgtcaaagcgatcgctcgtctcatcgagttctacaagcacgagagctgtgggcagtgcaccccgtgccgggaaggagtcgactggatgaacaaggtgatggcacgcttcgtgcggggcgacgcgcaggcagccgagatcgatgcactgtgggagatcagcaagcagatcgagggccacaccatctgtgcgctgggcgacggtgccgcgtggcccgtgcagggcctcatccgccactttcggccggagctggaggacaggatgcggcgctttggagaggccaaagcccgagcggcctcagcatga

SEQ ID NO: 39085 - protein, 459 aa, Gallus gallus
MAAWQLRALRRLPAATAGFSTAPKKTQFGSLKDEDRIFTNLYGRHEWRLQGALRRGDWYKTKEILLKGVDWILGEIKASGLRGRGGAGFPTGLKWSFMNKPPDGRPKYLVVNADEGEPGTCKDREIMRHDPHKLVEGCLVAGRAMGARAAYIYIRGEFYNEASNLQVAIREAYEAGLLGKNACGSDYAFDVFVVRGAGAYICGEETALIESIEGKQGKPRLKPPFPADVGVFGCPTTVANVETVAVAPTICRRGGAWFAGFGRERNSGTKLFNISGHVNHPCTVEEEMSVPLKELIEKHAGGVRGGWDNLLAVIPGGSSTPLLPKSVCETVLMDFDSLVQAQSGLGTAAVIVMDKSTDIVKAIARLIEFYKHESCGQCTPCREGVDWMNKVMARFVRGDAQAAEIDALWEISKQIEGHTICALGDGAAWPVQGLIRHFRPELEDRMRRFGEAKARAASA

SEQ ID NO: 39086 - DNA, 1305 bp, Mesorhizobium loti MAFF303099
  CDS (1)..(1305): transl_table=11
atgcttcaggataaagaccgcatcttcaccaacatctacggcctcttcgacaagtcgctggccggcgccatggctcgcggcgcctgggacaacacgcccggcatcgtcgccaaggggcgcgagtggatcgtcaacgagatgaaggcgtccggcctgcgcggccgtggcggcgcaggcttcccgacgggcctcaaatggtcgttcatgcccaagcagagcgacggccggccaagctacctcgtcatcaatgccgacgaatccgagcctggcacctgcaaggaccgcgacatcctgcgcaacgacccgcacacgctggtcgagggcgcgctgctcgccggcttcgccatgggcgcgattgccgcctacatctatgtgcgcggcgaattcatccgcgagcgcgaggcgctgcagcgtgccatcgacgaggcctatgaggccaagctgatcggcaagggcaacacgtcaggctacgatttcgacgtctacatgcatcacggcgccggcgcctatatctgcggcgaggagacggcgctgctcgaaagcctggaaggcaagaagggccagcccaggctgaagccgccattcccggccaatgtcggcctctatggctgcccgaccaccgtcaacaatgtcgagtcgatcgcagtggcgccaaccatcctgcgccggggcgcggcctggttctcgtccttcggccggcccaacaatgtcggcaccaagctgttctgcgtctccggccacgtcaacaatccgtgcaccgtcgaagaggcgatgtcgatcccgttccgcgagctgatcgagacgcattgcggcggcattcgcggcggctgggacaatctgctggcggtcattcccggcggtgcctcggtgccgctggtgccggccgagcagatcatcgacacgccgatggatttcgacgcgctgcgcgacctcaaatccggcctcggcaccgcggccgtcatcgtcatggacaagtcgaccgatgtcgtgaaggcgatcgcgcggctgtcctacttctacaagcatgagagctgcggccagtgcacgccgtgccgcgaaggcaccggatggatgtggcgggtgatggaacggctggtgcgcggcgaggcgcagaagcgcgagatcgacatgctgctcgacgtcaccaagcaggtcgagggccacacgatctgcgcgctgggcgatgcggcggcatggccgatccagggcctgatgcggcatttccgcggcgaggtggagcggcgcatcgacgagttttcgcgcaacgcgcatcgggccgaaccggtgatggtggcggcggaataa

SEQ ID NO: 39087 - protein, 434 aa, Mesorhizobium loti MAFF303099
MLQDKDRIFTNIYGLFDKSLAGAMARGAWDNTPGIVAKGREWIVNEMKASGLRGRGGAGFPTGLKWSFMPKQSDGRPSYLVINADESEPGTCKDRDILRNDPHTLVEGALLAGFAMGAIAAYIYVRGEFIREREALQRAIDEAYEAKLIGKGNTSGYDFDVYMHHGAGAYICGEETALLESLEGKKGQPRLKPPFPANVGLYGCPTTVNNVESIAVAPTILRRGAAWFSSFGRPNNVGTKLFCVSGHVNNPCTVEEAMSIPFRELIETHCGGIRGGWDNLLAVIPGGASVPLVPAEQIIDTPMDFDALRDLKSGLGTAAVIVMDKSTDVVKAIARLSYFYKHESCGQCTPCREGTGWMWRVMERLVRGEAQKREIDMLLDVTKQVEGHTICALGDAAAWPIQGLMRHFRGEVERRIDEFSRNAHRAEPVMVAAE

SEQ ID NO: 39088 - DNA, 1557 bp, Mesorhizobium loti MAFF303099
  CDS (1)..(1557): transl_table=11
atgatcccccgtatctacattcccggcgattccggcgcgttggcgcttggcgccgaaaaggtcgccaaggcgatcgccaaggaactcgcggagcgtggcatcgaggccaagatcgtgcgcaacgggtcgcgtggcgcctatttcctcgagccgatggtggaagtggcgaccgccaacggccgcgtcgcctacggaccggtcaagccttccgacgtcaagagcctgttcgacagcggcttcctcaccggtggccaccacaagcgctggctcggcgcgcccgacaagatcccgttcctggccaagcagacgcggctgacctttgcccgctgcggcatcaacgacccgctgtcgctcgacgcctacaagtcacttggcgggctcaagggcctgcagaacgccgtcgccatggcgccggccgacatcgtcaagcaggtgaccgagtcaggcctgcgtggccgtggtggcgccggcttcccgaccggcatcaaatggaagacggtgctggatacgacatccgagcgcaaatacatcgtctgcaacgccgacgagggcgacagcgcgactttcgccgaccgcatgatcatggaaggcgaccccttcgtgctgatcgaaggcatggcgatcgccggcatcgccaccggggcgaccaagggcttcgtttatatccgctcggaatatccgcatgccgtggcgacaatgaacaaggccgtcgagatcgcccgcaaggccggcgtcctcggcgtcaacgtgctgggttcgcccaatgccttcgacatggaaatccgcgtcggcgccggcgcctatgtctgcggcgaagaaacctcgctgttgaacagcctggaaggcaaacgcggcgtggtgcgcgccaagccgccgctgccggccattcagggcctgttcggcaagccgacggtgatcaacaacgtcatcagcctggcctcggtgccgatcatcatggacaagggcgccgccttctacaaggatttcggcatgggccgctcgcgcggcacgatcccgatccagatcgccggcaatgtcaggaacggcggcctgttcgagaccgccttcggcctgacgctgggcgagatcgtcgatgacatcggcggcggcacggcgactggccgtccagtgaaggcagtacaggtcggcggtccgcttggcgcctatttcccgcgcgccctgttcgacacgccgttcgactacgaggaattcgccaagcgcgacgggctgatcggccatgccggcatcaccgtgttcgacgacacggccgacatgctgaagcaggcgcgcttcgccatggagttctgcgccatcgaaagctgcggcaagtgcacgccctgccgcatcggctcgacgcgcggcattgagaccatcgacaggcttgccgccggcatcgagccggaaaagaacctcgctctggtcaccgacctctgcaacacgatgaagttcggttcgctgtgcgcactgggcggcttcacgccttatccggtgatgagttcgatcacgcatttccccgaagatttcaagcccgcgccagcgcgcgtggctgctgaatag

SEQ ID NO: 39089 - protein, 518 aa, Mesorhizobium loti MAFF303099
MIPRIYIPGDSGALALGAEKVAKAIAKELAERGIEAKIVRNGSRGAYFLEPMVEVATANGRVAYGPVKPSDVKSLFDSGFLTGGHHKRWLGAPDKIPFLAKQTRLTFARCGINDPLSLDAYKSLGGLKGLQNAVAMAPADIVKQVTESGLRGRGGAGFPTGIKWKTVLDTTSERKYIVCNADEGDSATFADRMIMEGDPFVLIEGMAIAGIATGATKGFVYIRSEYPHAVATMNKAVEIARKAGVLGVNVLGSPNAFDMEIRVGAGAYVCGEETSLLNSLEGKRGVVRAKPPLPAIQGLFGKPTVINNVISLASVPIIMDKGAAFYKDFGMGRSRGTIPIQIAGNVRNGGLFETAFGLTLGEIVDDIGGGTATGRPVKAVQVGGPLGAYFPRALFDTPFDYEEFAKRDGLIGHAGITVFDDTADMLKQARFAMEFCAIESCGKCTPCRIGSTRGIETIDRLAAGIEPEKNLALVTDLCNTMKFGSLCALGGFTPYPVMSSITHFPEDFKPAPARVAAE

SEQ ID NO: 39090 - DNA, 1461 bp, Arabidopsis thaliana
  CDS (1)..(1461)
atggcacccgtgagggggattcttggcttgcaaagggcagtgtccatttggaaggaaagtaacagactgactccagctttgagatcattcagcactcaagctgcatccacttccaccactccacagcctcctccacctcctccgcctccggaaaagactcatttcggtggtctcaaggatgaagatcggatttttactaatctctatggtctgcatgacccatttctcaaaggcgcgatgaagagaggtgattggcataggaccaaagatttggtgctcaagggtactgattggattgtcaatgaaatgaagaaatctggacttcgtggacgtggtggtgctggtttcccttctggtcttaagtggtcctttatgcctaaagtttctgatggccgtccctcctatttggttgtcaatgctgatgagagtgagcctggaacttgtaaagatagggagatcatgcgtcatgaccctcacaaattgttggaagggtgtttgattgctggtgttggaatgagagctagtgctgcgtatatttacatcaggggtgaatatgtgaatgagcgtttgaatctagagaaggctagaagagaagcgtatgcagctggtctcttggggaagaatgcatgtggttctggttatgattttgaagtttatatccactttggtgctggtgcgtacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttcgcctaccattttaaggcgtggacctgagtggttttctagtttcggtaggaagaataacgctgggacaaagctcttttgtatatcaggccatgtaaacaagccatgcacggtggaagaggagatgagtatacctctcaaggaactgattgagaggcattgtggaggtgttaggggtggatgggacaatctacttgctatcatccctggtggttcatctgttcctctgatccctaagaacatttgcgaggatgtgctgatggatttcgatgcgctcaaggctgtccaatcagggttaggaactgcagcagtcattgtgatggataaatcaaccgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcctgtgcaaggtctgataagacactttaggccagagctcgagagaaggatcagggaacgcgctgaaagggagttgctacaggctgctgcttaa

SEQ ID NO: 39091 - protein, 486 aa, Arabidopsis thaliana
MAPVRGILGLQRAVSIWKESNRLTPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFEVYIHFGAGAYICGEETALLESLEGKQGKPRLKPPFPANAGLYGCPTTVTNVETVAVSPTILRRGPEWFSSFGRKNNAGTKLFCISGHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLQAAA

SEQ ID NO: 39092 - DNA, 1824 bp, Thermotoga maritima MSB8
  CDS (1)..(1824): transl_table=11
gtgccgctcacaacgaacacgatccttatctgtgcaggtggagcgtgtatttccgccggcgaaaagagtgtcaaagatgccttcgaagaagaattgagaaagtacggcctcgatgaagttgtcagggtgatagagaccggttgtatgggagcgtgtacattgggaccgattgccgtgatctacccggaaagtgtgttttaccagaaactcacaccagacgcagcaagagagatcgtcgaagaacacattttgaagggaaggatcgtggagaagtacctttacaaggcttccgaaggaaaacctgttccaagagttcatgaggaagtgcctttcttcaagaaacaggttaggatcgtcacaaggaatctcggtgtcatagatcccacgaagatagaggagtacatcgcaagagacggatattttgcccttgcgaaggctcttcagatgaaaccggaagacgtgataaaggagataaaggacagcggactcagaggaagaggaggagcgggttttccaacagggctcaagtgggaactcgcggcaaggcaaaaggccgagaagaaattcgttgtctgtaacgcggacgaaggagacccgggtgctttcatggacagatcggttcttgaaggagatccacacgccgtcatagaggggatggcaatagccgcctacgcgataggtgctcagaaggggttcgtttatgtcagggcggagtatcctctcgccattgaaaggctcaacatagcgctgaatcaggcaagagagtacggtttccttggaggaaacataatgggaacggatttttccttcgatatagagatcagaatcggtgcgggtgcgttcgtttgtggtgaggaaaccgctttgatggcctccatagagggtgagagaggccaaccgaaggtgaagcctccctatcccgttgagaagggactctggggataccccacagtgatcaacaacgttgaaacacttgcgaacgtaccctggatcatcagaaacggtgcgaaagagttcagaaaatacgggacggagaactctccgggaacgaaagtattcgctctcgccggtaaagtgaagaacacaggtcttgtggaagttcccatgggaatcacactcagagagctcatatacgagattggaggaggaatagccggagacaaaaagctgaaagccatccagactgggggaccgagcggagggtgtatccccgctgagtacgtagacacacctgttgatttcgaatccctccagaaactcggtgcaatcatgggttctggtggaatgatagtgatggacgaagacgactgtatggttgacgtcgcaaggttcttcctcgagttcaccgtggaagaatcctgtggaaaatgtacgccctgtagagaaggaacgaagaagatgctcgaaatcctggagaagatcacttccggagagggaacagaggaggacatagaagagctcgaaaagctggcgcatgtggtaaaggacacttccctctgtggacttggtcaaaccgcaccgaatcctgttctttccacactcagatacttcagagacgagtatctggcgcatgtcaaagagaagaggtgtccatccaagaagtgtaaagcgttgatcagctacgtgattgatcctgaaaaatgtgttggatgtaccgcgtgtgcgagggtctgtccggttcagtgtataagcggtcaggtgagacagcctcacgtgatagatcaggcggagtgtgtcaggtgtggtagctgtatcgaagtctgtagatttggagctataagcaaggttactccagctctgccggtggaggaggcggtagaatga

SEQ ID NO: 39093 - protein, 607 aa, Thermotoga maritima MSB8
MPLTTNTILICAGGACISAGEKSVKDAFEEELRKYGLDEVVRVIETGCMGACTLGPIAVIYPESVFYQKLTPDAAREIVEEHILKGRIVEKYLYKASEGKPVPRVHEEVPFFKKQVRIVTRNLGVIDPTKIEEYIARDGYFALAKALQMKPEDVIKEIKDSGLRGRGGAGFPTGLKWELAARQKAEKKFVVCNADEGDPGAFMDRSVLEGDPHAVIEGMAIAAYAIGAQKGFVYVRAEYPLAIERLNIALNQAREYGFLGGNIMGTDFSFDIEIRIGAGAFVCGEETALMASIEGERGQPKVKPPYPVEKGLWGYPTVINNVETLANVPWIIRNGAKEFRKYGTENSPGTKVFALAGKVKNTGLVEVPMGITLRELIYEIGGGIAGDKKLKAIQTGGPSGGCIPAEYVDTPVDFESLQKLGAIMGSGGMIVMDEDDCMVDVARFFLEFTVEESCGKCTPCREGTKKMLEILEKITSGEGTEEDIEELEKLAHVVKDTSLCGLGQTAPNPVLSTLRYFRDEYLAHVKEKRCPSKKCKALISYVIDPEKCVGCTACARVCPVQCISGQVRQPHVIDQAECVRCGSCIEVCRFGAISKVTPALPVEEAVE

SEQ ID NO: 39094 - DNA, 1638 bp, Thermotoga maritima MSB8
  CDS (1)..(1638): transl_table=11
atgaaaccgataacagttctggtttcggtggattcaaacagtgtgttgatgggtgctcgtcactttctcaattacttcagagatcttgtgaaggaacacaatctcgaagataccgtcgatgtgctggaaacgggcagcatgggaatttatccagaaggagtgattgtttccgttcttcccgacggtgttttctacgttgtgaggaatgaattggatgtgaggaggatcttcgaagagcacattctcaagggaaggagagtgctcgatcttgaaattcccgagagtcaaataaaaggaaccgttgaggtagagaaggtggccgaagaaactcgtatcgttctaaagaacgtaggagagatagatcccactcgtatagaggaatacatcgcaagagacggttactttgccctcgccaaggcgctccagatggaaccaggagagataatcgaagagataaagcgaagtgggctgagaggaagaggtggagccggttttccaacgggtctgaaatgggaattcacctacaaagcttctgccgaccagaaatatgttctgtgcaacgccgatgaaggagagcccggtacctttaaagacaggctcatcatggagggtgatcctcattctttgatagagggcatgatcatagcggggtacgcggttggtgcaacgaagggttacatatacataaggggagagtatcacagttcgatagaaatcttgaaaaaagctgtagaacaggcctacgagtacggattcctcggtgagaacatcctcggaagtggattcaacttcgatctgaaaataaggctcggggcgggagcttacgtggcgggagaggagacggcgttgatagagtccatagaggggaaacccgctcgacccaggctgaaacctccttaccctcccacttttggcctctttggaaaacccaccgttgtgaacaacgtggaaacttttgtgaacgttccaaggataataatgaacggtgcggagtggttcaaaaagttcggcaccgagtcttctcctgggacgaaagtgttctccctcgtgggtaatgtggtgagaaagggaatcgtggaagtgccaatgggagtgacggtgagagatctcattttcaaatttggtggggggattgagggtggcaggaagttgaaagtggtgcaaacgggtggtagtgcaggaacgttcatcggaccagacaaactcgacgttccactcgattttgattcttacgcaaagtacggagtttctctcggatcaggagtgattctcgttgctgacgagactcactgtgtggtggatctcgcactcaccgttatgaggttcttcgaacacgagtcgtgtgggaagtgtacaccgtgtcgggaaggtacgaggatgatcgtcaatattttggagagaataagcagaggagaaggcaaaaaagaggatctcgatacgttgagggagattgctcgaaacgcgggggaaacttctttctgcggactgggtcaaagcattccggttcctctgctctccatcgttgacaacttcgaggaagagttcaaagcccacataggtgctgataaatgtccagtgggtgtgtgtgagttcaagaagaagaaggaaaagaagaaaattggtgttagaaaaccataa

SEQ ID NO: 39095 - protein, 545 aa, Thermotoga maritima MSB8
MKPITVLVSVDSNSVLMGARHFLNYFRDLVKEHNLEDTVDVLETGSMGIYPEGVIVSVLPDGVFYVVRNELDVRRIFEEHILKGRRVLDLEIPESQIKGTVEVEKVAEETRIVLKNVGEIDPTRIEEYIARDGYFALAKALQMEPGEIIEEIKRSGLRGRGGAGFPTGLKWEFTYKASADQKYVLCNADEGEPGTFKDRLIMEGDPHSLIEGMIIAGYAVGATKGYIYIRGEYHSSIEILKKAVEQAYEYGFLGENILGSGFNFDLKIRLGAGAYVAGEETALIESIEGKPARPRLKPPYPPTFGLFGKPTVVNNVETFVNVPRIIMNGAEWFKKFGTESSPGTKVFSLVGNVVRKGIVEVPMGVTVRDLIFKFGGGIEGGRKLKVVQTGGSAGTFIGPDKLDVPLDFDSYAKYGVSLGSGVILVADETHCVVDLALTVMRFFEHESCGKCTPCREGTRMIVNILERISRGEGKKEDLDTLREIARNAGETSFCGLGQSIPVPLLSIVDNFEEEFKAHIGADKCPVGVCEFKKKKEKKKIGVRKP

SEQ ID NO: 39096 - DNA, 1881 bp, Thermotoga maritima MSB8
  CDS (1)..(1881): transl_table=11
atgtttaagaacgcgaaagagttcgtccagtacgcaaacaaactgaaaaccctgagagagaaaaaactgaacggtgtctctatatacgtctgcgtcggaactggctgtaccgcgaaaggtgctctcaaagtttacagcgctttcgaagaagagctcaaaaagagaaacctcctcggacaggtcacgctggaaaagatcgatgatgacaaagtcacgttgaacagaacagggtgctgtggaaggtgttcttccggtcccctcgtgaagatcatgccctacaggttcttctattcaaacgttgcacctgaagacgtcccggagatcgtggacagaaccgtcctcaagggtgaacccatagaaagactctttctgacggatcccctcacgggggaaaaggttcccagaatagaggacaccacgcttttcaaaaatcaggatttctacatcatggaggccataggtgagtccgagtgtgacagcatagaagactacatcgcacggagtggatacgaatctctcgtcaaagccctcacttcaatgacaccggaagaaatcatagaaacggtgaaggcatccggtctcagaggaagaggtggaggaggatttccaacaggtctcaaatgggaattcaccagaaaagcgcagggtgatataaagttcgtcgtctgcaacggtgacgaaggagatcccggagcgttcatgaacagaacccttctcgagagagacccccatctcgttctcgagggaatgataatagcgggttacgcggttggtgcacagaaaggctacgcttacataagggctgagtatccgttcgcagtcaaaatgttcaaaaaagccatagaagatgccagaaaactcggtcttcttggggaaaacatactcggtactggattctctttcgacctcgaggtgaaggaaggtgccggcgcgttcgtctgcggtgaagaaacagcactgctcgcttccatagaagggaaaagaggtatgcccagaccaaagccaccgttcccggctcagtctggtctctggggtaaacccaccctcataaacaacgtggaaacatacgcgaacataccaagaatactcagagacggtgtagaaaactacagaaaacgcggaacggaaaattcaccgggaaccaagatgttctccgttgccggtcccctcaaagccaccggtatcatcgaagttgaattcggcaccaccctgagagatatcatctacaacatatgtggaggattcgttgaaggagaagagttcaaagcggttcagattggaggaccgtccggagcgtgtctttccgaagatttcatcgacatgcccctcgattacgacacactgaaaaaagctgatgcgatggtaggatccggtggaatagtcgtgattacaaagaaaacgtgtatggtagaggttgcaaggttcttcctcgatttcaccaagagggaatcctgtggaaagtgcgtgccgtgcagggaaggaaccatgcaggcgtacaacatattggagaagttcacccacggaaaagccacatacgaggatctcaaaactctcgaacacctttcaaaaacaataaagaccgcttctctctgtggactcggaaagaccgctcccaaccccattctcagtacactgaagctcttcagagaggagtacattgcacacatcgaaggagaatgtccaagcggaatgtgcacggcgttcaagaaatacgtcatcaatccagatatctgtaaaggttgtggactctgtgccagatcctgtccacagaacgccataaccggagaaagaggaaaaccgtacacgatagatcaggaaaagtgtgtaaagtgcggtctctgtgcgagtaaatgtccgttcaaagccatagagcttgtctga

SEQ ID NO: 39097 - protein, 626 aa, Thermotoga maritima MSB8
MFKNAKEFVQYANKLKTLREKKLNGVSIYVCVGTGCTAKGALKVYSAFEEELKKRNLLGQVTLEKIDDDKVTLNRTGCCGRCSSGPLVKIMPYRFFYSNVAPEDVPEIVDRTVLKGEPIERLFLTDPLTGEKVPRIEDTTLFKNQDFYIMEAIGESECDSIEDYIARSGYESLVKALTSMTPEEIIETVKASGLRGRGGGGFPTGLKWEFTRKAQGDIKFVVCNGDEGDPGAFMNRTLLERDPHLVLEGMIIAGYAVGAQKGYAYIRAEYPFAVKMFKKAIEDARKLGLLGENILGTGFSFDLEVKEGAGAFVCGEETALLASIEGKRGMPRPKPPFPAQSGLWGKPTLINNVETYANIPRILRDGVENYRKRGTENSPGTKMFSVAGPLKATGIIEVEFGTTLRDIIYNICGGFVEGEEFKAVQIGGPSGACLSEDFIDMPLDYDTLKKADAMVGSGGIVVITKKTCMVEVARFFLDFTKRESCGKCVPCREGTMQAYNILEKFTHGKATYEDLKTLEHLSKTIKTASLCGLGKTAPNPILSTLKLFREEYIAHIEGECPSGMCTAFKKYVINPDICKGCGLCARSCPQNAITGERGKPYTIDQEKCVKCGLCASKCPFKAIELV

SEQ ID NO: 39098 - DNA, 1347 bp, Pseudomonas aeruginosa PAO1
  CDS (1)..(1347): transl_table=11
atgacccttacctccattggtccggccaaccgcatggcgcgttcggcggaaacccatccgctgacctggcgcctgcgcgaagacgcccagcccgtctggctcgaggaatatcagagcaaggacggctatgccgcggcgcgcaaggcgctgacccagatggcccaggacgacatcgtccagaccgtcaaggactccggcctcaagggccgcggcggcgcgggcttccccaccggagtgaagtggggcctgatgccgaaggacgagtcgctgaacatccgctacctgctgtgcaacgcggacgagatggagccgaacacctggaaggaccgcatgctcatggagcagctgccgcacctgctggtggaaggcatgctgatttccgcgcgcgcgctgaaggcctaccgcggctacatcttcctgcgcggcgaatacgtcgacgcggcgcgcaacctcaaccgcgccatcgacgaagccaaggccgccggcctgctcggcaagaacatcctcggcagcggcttcgatttcgagctgttcgtccacaccggtgccggccgctacatctgcggcgaagagaccgcgctgatcaactcgctggaaggccgccgcgccaacccgcgttccaaaccgcccttccctgccgccgtcggcgtctggggcaagccgacctgcgtgaacaacgtggagacgctgtgcaacgtgccggccatcgtcggcaacggcgtggactggtacaagaccctggcccgccccggcagcgaagacatgggcaccaagctgatgggcttctccggcaaggtgaagaaccccggcctgtgggaactgccgttcggcgtcagcgcccgcgagctgttcgaggactacgccggcggcatgcgcgacggcttccagctcaaggcctggcagcccggcggcgccggtaccggcttcctgctcccggagcacctggatgcgcagatgttcgccggcggcatcgccaaggtcggcacccggatgggcaccggcctggccatggcggtggacgacagcatcaacatggtttccctgctgcgcaacatggaagagttcttcgcccgcgagtcctgcggctggtgcaccccctgccgcgatggcctgccgtggagcgtgaagctgctgcgtgccctggagcggggcgaaggccagcccggcgacctcgagaccctcgagcagctggtcaacttcctcggcccaggcaagaccttctgcgcccacgcgccgggagccgtcgagccgctgggcagcgccctcaagtatttccgtgccgaattcgaggcgggcatctcccgccagccttcggccgcgccgcgcccggcaacggtcggcgcctga

SEQ ID NO: 39099 - protein, 448 aa, Pseudomonas aeruginosa PAO1
MTLTSIGPANRMARSAETHPLTWRLREDAQPVWLEEYQSKDGYAAARKALTQMAQDDIVQTVKDSGLKGRGGAGFPTGVKWGLMPKDESLNIRYLLCNADEMEPNTWKDRMLMEQLPHLLVEGMLISARALKAYRGYIFLRGEYVDAARNLNRAIDEAKAAGLLGKNILGSGFDFELFVHTGAGRYICGEETALINSLEGRRANPRSKPPFPAAVGVWGKPTCVNNVETLCNVPAIVGNGVDWYKTLARPGSEDMGTKLMGFSGKVKNPGLWELPFGVSARELFEDYAGGMRDGFQLKAWQPGGAGTGFLLPEHLDAQMFAGGIAKVGTRMGTGLAMAVDDSINMVSLLRNMEEFFARESCGWCTPCRDGLPWSVKLLRALERGEGQPGDLETLEQLVNFLGPGKTFCAHAPGAVEPLGSALKYFRAEFEAGISRQPSAAPRPATVGA

SEQ ID NO: 39100 - DNA, 1893 bp, Methanothermobacter thermautotrophicus str. Delta H
  CDS (1)..(1893): transl_table=11
atgatagaaaaaattgcaggggcttccctgaaggaatacatgtccctcttcaggggtgaaccgacaatatttataggctcagccacctgtggaaggtctgcaggggcccagaagatagaggagataatggggcagagggcagccgaactctcagttgagtgcaggatgatacacacaggctgcatgggtctctgctacgccgaacccatggtggtcgtcttcaatggtgacagccgtggttacatctacggtccggtgaaccgtaaactcgcaaagaggataatccaggagcacatcgtggagggcagggaggttgaacccattggttatgtggacatagccttcaatggcgactcatttgaaccagtttacgctctggaattcatggagggacagtcaaggaggatacttcgaagatgcggccttatagaccctgaaaacatgggacactatctggcaaccggaggctacaggggcctcatgagggcccttgaaatggaacccgatgaggtaattgaggaggtgaaggactccggcctgaggggccgcggaggcgcaggattcccgacatggcttaaatggagtctctgtcgccaggaggcctcagaggtgaagtacctcatatgcaacgccgatgagggagaccctggcgcattcatgaaccgttcactcatagagggggacccccatgcactgcttgaggggatactaatcgcctcatacgcggtgggggccagggaggcctacatctactgcagggcagagtacccacttgcccttgagaggctcagggtggccatatctgatctgaggaatctgggacttctcggtaaggatatcctcgggtcagggttcgacctggatataaagataaaggagggtgcaggggcatttgtctgtggagaggaaacagccctgatatcctcaattgagggtaagaggggaatgccaaggacaagacccccattcccaacaacacggggcctctggggcaagcccaccgttataaacaatgttgagacccttgcagctgtttcaatgataatgcagcacggcgcagactacttcaactcccttggcacccctgaaagtaggggaaccaagacattctcccttgtgggcgatgtcaggaggaccggcctcattgaggtccccctgggcacaaccctgagggaggtcatctttgatattggagggggggttgtggatggagagctgaaagctgtacagatagggggaccttcagggggatgcctccctgctgaacttatcgatacaggtatagactatgactccctcacatctgcaggggcaataatgggttcaggcggccttgttgttttatcggaccgcacatgcatggttgaacttgcaaggtacttccttgagttcacacagagggagtcctgtggaaaatgcgtaccctgccgcgtggggacaaggcagatgctcatgatactcaatgacatcgtagagggttcaggaagacctgaagaccctgatatactcagggatgtagctgaaagtgtcagggcagcctcactatgcggcctcggccagacatcaccaaacccggttctgacgacactcagatactttgaggacgagtaccatgaccacataaaaggcaggtgcacagccgcagcatgcagtgaactgatgcactacatgatagaccctgagaaatgtgatggatgcatggcatgcatcaagacgtgcccggcggaggccataaatggttcaagggacgaggtccatgttatagaccaggatgggtgcctcaagtgcgggtcctgtcttgatatatgtaagagggatgctgtcaggagggttcccggtgcctaccgtcagggaacctattcagcaaggattcctgagaaggatgggtggtag

SEQ ID NO: 39101 - protein, 630 aa, Methanothermobacter thermautotrophicus str. Delta H
MIEKIAGASLKEYMSLFRGEPTIFIGSATCGRSAGAQKIEEIMGQRAAELSVECRMIHTGCMGLCYAEPMVVVFNGDSRGYIYGPVNRKLAKRIIQEHIVEGREVEPIGYVDIAFNGDSFEPVYALEFMEGQSRRILRRCGLIDPENMGHYLATGGYRGLMRALEMEPDEVIEEVKDSGLRGRGGAGFPTWLKWSLCRQEASEVKYLICNADEGDPGAFMNRSLIEGDPHALLEGILIASYAVGAREAYIYCRAEYPLALERLRVAISDLRNLGLLGKDILGSGFDLDIKIKEGAGAFVCGEETALISSIEGKRGMPRTRPPFPTTRGLWGKPTVINNVETLAAVSMIMQHGADYFNSLGTPESRGTKTFSLVGDVRRTGLIEVPLGTTLREVIFDIGGGVVDGELKAVQIGGPSGGCLPAELIDTGIDYDSLTSAGAIMGSGGLVVLSDRTCMVELARYFLEFTQRESCGKCVPCRVGTRQMLMILNDIVEGSGRPEDPDILRDVAESVRAASLCGLGQTSPNPVLTTLRYFEDEYHDHIKGRCTAAACSELMHYMIDPEKCDGCMACIKTCPAEAINGSRDEVHVIDQDGCLKCGSCLDICKRDAVRRVPGAYRQGTYSARIPEKDGW

SEQ ID NO: 39102 - DNA, 1335 bp, Deinococcus radiodurans R1
  CDS (1)..(1335): transl_table=11
gtgaccgcgcccaccgccgaaaaaccgatcaccagtgcgctcgaccaccgctttgcgcccacgctctacgcgcaggtggggcagccacgaagctggacgctggacacctaccagcggggcggaggctaccagggcgtgcgccgggcctttgcgctcggtcccgacgccgtgattgaggaggtcaagaaatccggcctgcgcggacgcggcggcgcgggcttcgccactggcctgaaatggtcgttcatgccgctcaacgacggcaaaccgcacctcatcatctgcaacgccgacgagtccgagccgggcaccttcaaggaccgctacctgatgtcggaagacccgcaccagctcatcgaagggatgctcatcggcggatacgcgatgcgggcgagccgggggtacatctacattcgcggcgagtatgtgctggccgccgagcgcctctgggctgccattcacgaggcgcgggcggcgggactgctcggcaaggacattctgggcagcggcttcgacttcgacctgcaagttcaccggggcgcgggcgcctacatctgcggcgaggaaaccgcgctgatgaactcgctggaaggtctgcgggccaatccgcgcctcaagccgccctttcccgccgccgccgggctttacgggctgccgaccaccatcaacaacgtcgagaccttttgcgccgcgacgcacatcctcaagtacggcgccgactggcacgcgggcatgggcaccgagaagtccaagggcatgaaactctttcagatttccggccccgtcgcccggcccggcgtgtacgaactgccgctcggcacgccgtttcgcgaactcatctacgactgggcgggtggccccaccgaggacatcaaggcgattatccccggcgggatttcctgccaactcctgaagtggagcgaagacatcctcgacacgccgatggactacgagtcgctggcggcggcgggcagcagcctggggaccgggggcgtcaccctgattccggcggcggcgtccatcgtggacacgacctggaacgcggtgcgcttttacggccacgagtcgtgcggcaaatgcacgccctgccgcgaagggatttcgggctggatggttcgcatgtacgaaaaactcgctcgcgggcacgggcaacccggcgacaccaatctcattctggacatggccgacaacatcggcggcagaagcttctgcgccctggccgacgcctgtctggggccggtcctgagttccatccggctgttccgcgaggaatacgacgcggcggagcgcggagaggtgccgcgcgagctcgcggggcgctggagggacgcatga

SEQ ID NO: 39103 - protein, 444 aa, Deinococcus radiodurans R1
MTAPTAEKPITSALDHRFAPTLYAQVGQPRSWTLDTYQRGGGYQGVRRAFALGPDAVIEEVKKSGLRGRGGAGFATGLKWSFMPLNDGKPHLIICNADESEPGTFKDRYLMSEDPHQLIEGMLIGGYAMRASRGYIYIRGEYVLAAERLWAAIHEARAAGLLGKDILGSGFDFDLQVHRGAGAYICGEETALMNSLEGLRANPRLKPPFPAAAGLYGLPTTINNVETFCAATHILKYGADWHAGMGTEKSKGMKLFQISGPVARPGVYELPLGTPFRELIYDWAGGPTEDIKAIIPGGISCQLLKWSEDILDTPMDYESLAAAGSSLGTGGVTLIPAAASIVDTTWNAVRFYGHESCGKCTPCREGISGWMVRMYEKLARGHGQPGDTNLILDMADNIGGRSFCALADACLGPVLSSIRLFREEYDAAERGEVPRELAGRWRDA

SEQ ID NO: 39104 - DNA, 1335 bp, Xylella fastidiosa 9a5c
  CDS (1)..(1335): transl_table=11
atgggacatcctcacgtatccaagggaccggttggcccgacacctcagccgcaccaagtgatctataccacgttgcattatgaaattccgtggtcgtatgaaagctatttgaagaccggcggctacactgcgttacgcaagatttttgaggaaaagatccctccggagcaggtcatagacatggtcaagcagtcgaatctgcggggccgtggtggtgcaggttttccgacgggtctcaaatggtccttcatgccgaagggcaccatgcaaaaatatattctgtgtaactcggacgagtccgaaccggggacctgtaaagatcgtgacatcctgcgctataacccgcattccgtggtggaggggatggcgattgcatgttatgccactggttccactgtggcttacaactatttgcgtggggagttccaccacgagccgttcgaacattttgaacaggcgctggccgatgcttacacacatggttggcttggtaagaacgttttgggaagtggcgtagatatcgatatctacgcggtgcttggtgctggtgcctacatctgtggtgaagagactgcgctcatggagtctctggaaggcaagaaggggcagcctcgctacaagcccccctttcctgccaattttggcttgtacggcaagccatcaacgatcaacaacactgagacgtatgccgcagtgccagccattattcgcaatggtccggagtggtttttgtctctgagcaagactaaaaacggtggctctaagatcttctcggtctcggggtgcgtgcagcaagggggtaacttcgaggtacccttaggcaccacctttgatgaattgctggagatggccggtggcctgcggccaggtcgcgctctgaaagctgcaattccggggggtgtatccatgccggtattgaaagcggagcagttgcatggccttcagatggactacgacacactgcgtgtgctgggtagcggtttaggctcgggggggattgtggtgcttgatgacagtgtctgttgtgtccgttttgcctgccgcatctcgcagttttttcataaggaatcgtgtggccagtgtactccgtgccgtgaggggaccggttggatgcaccgcgttttggagcgtatcgttgctggccaggccacgatggaggatctgcaccagcttaaagtagtggcggggcagattgaggggcataccatttgtgcgtttggtgaagctgcagcttggccaatccaagggttcctgcgccaattctgggatgaatttgagtactacattgttcatggtcggtcgattgtggatgacaaggcgagagtggctgcatga

SEQ ID NO: 39105 - protein, 444 aa, Xylella fastidiosa 9a5c
MGHPHVSKGPVGPTPQPHQVIYTTLHYEIPWSYESYLKTGGYTALRKIFEEKIPPEQVIDMVKQSNLRGRGGAGFPTGLKWSFMPKGTMQKYILCNSDESEPGTCKDRDILRYNPHSVVEGMAIACYATGSTVAYNYLRGEFHHEPFEHFEQALADAYTHGWLGKNVLGSGVDIDIYAVLGAGAYICGEETALMESLEGKKGQPRYKPPFPANFGLYGKPSTINNTETYAAVPAIIRNGPEWFLSLSKTKNGGSKIFSVSGCVQQGGNFEVPLGTTFDELLEMAGGLRPGRALKAAIPGGVSMPVLKAEQLHGLQMDYDTLRVLGSGLGSGGIVVLDDSVCCVRFACRISQFFHKESCGQCTPCREGTGWMHRVLERIVAGQATMEDLHQLKVVAGQIEGHTICAFGEAAAWPIQGFLRQFWDEFEYYIVHGRSIVDDKARVAA

SEQ ID NO: 39106 - DNA, 1557 bp, Sinorhizobium meliloti 1021
  CDS (1)..(1557): transl_table=11
atgaccgtcaggatctacattccccgggatgcggcggcccttgcgcttggcgccgaaaaggtggtggaggcgatggccggcgagattgccgcacgcgggctcgacgccacgatcgtccgcaacggctcgcgcggcatgcactggcttgagccgctggtcgaagtcgaaacggccggagggcgcgtcgcctacggcccggtgaaggcgagcgacgtcgcctcgcttctcgatgccgggctgatttcgggtggcgcgcatccgctctgcctcggcaagaccgaggagattccatttctcaagcgacagacgcggcttacctttgcccgctgcggcgtcatcgatcctctctcgctcgaagattatcgcgctcatcggggcttgctcggtctcgagcgggcgatcgcaatgcaaccagcggcgatcgttgccgaggtcaccgaaagcggccttcgcggccgcggcggcgccggcttcccgaccggcatcaaatggaagaccgtcctggaggcgcgagggccgcggaaatacatcgtctgcaatgccgacgagggcgacagcgggacttttgccgaccggatgatcatggaaggtgatcccttcgtgctgatcgaaggcatggcgatcgccggtatcgcgaccggtgcgaccaagggctacatctatacccgttcggaatatccgcatgcgatcgcggtgatgagcgcggcgatcgagatcgcccgggccgccggtgtgctcggcgcttcggtgctcggctcggcgcacgccttcgacatggaagtgcgcaccggcgccggcgcctatgtctgcggcgaggagacctcgctcctgaacagcctcgaaggcaagcgcgggctcgtgcgcgccaagccgccgctgccggcacacaagggtcttttcgaccgcccgaccgtcatcaacaacgtcatctcgcttgcttccgtgccggtgatcctcgacaagggcgccggttactatcgcgatttcggcatgggccggtcgcgcggaacgatcccgctgcagatcgccggcaacgtcaagcatggagggctcttcgagaccgcattcggcctgacgctcggcgagatcgtcgacgagatcggcggcggcacggcgagcgcccggccggtcaaggccgtccaggtcggcggcccgctcggcgcctatttcccgcgggcgctgttcgatacgcccttcgactacgaggcatttgccgccagagacgggctcatcggtcatgccggcatcgtcgtcttcgacgacacggcagacatgctgaagcaggcgcgtttcgcgatggaattctgtgccgtcgaaagctgcggcaagtgcaccccctgccgcatcggttcgacacgcggcgtcgaggtggccgacaggattgccgccggcatcgagccggagaagaaccgcgaactgctcgccgatctctgcaacacgatgaagttcggttccctctgcgcccttggcggcttcacgccctatccggtgatgagcgcgatgacgcacttcccggaggatttttcaccggtgccggtggtggaggctgcggaatga

SEQ ID NO: 39107 - protein, 518 aa, Sinorhizobium meliloti 1021
MTVRIYIPRDAAALALGAEKVVEAMAGEIAARGLDATIVRNGSRGMHWLEPLVEVETAGGRVAYGPVKASDVASLLDAGLISGGAHPLCLGKTEEIPFLKRQTRLTFARCGVIDPLSLEDYRAHRGLLGLERAIAMQPAAIVAEVTESGLRGRGGAGFPTGIKWKTVLEARGPRKYIVCNADEGDSGTFADRMIMEGDPFVLIEGMAIAGIATGATKGYIYTRSEYPHAIAVMSAAIEIARAAGVLGASVLGSAHAFDMEVRTGAGAYVCGEETSLLNSLEGKRGLVRAKPPLPAHKGLFDRPTVINNVISLASVPVILDKGAGYYRDFGMGRSRGTIPLQIAGNVKHGGLFETAFGLTLGEIVDEIGGGTASARPVKAVQVGGPLGAYFPRALFDTPFDYEAFAARDGLIGHAGIVVFDDTADMLKQARFAMEFCAVESCGKCTPCRIGSTRGVEVADRIAAGIEPEKNRELLADLCNTMKFGSLCALGGFTPYPVMSAMTHFPEDFSPVPVVEAAE

SEQ ID NO: 39108 - DNA, 1320 bp, Caulobacter crescentus CB15
  CDS (1)..(1320): transl_table=11
atggtcggtatcctcgaagacaaggaccgcatcttcacgaacctctacggtctccacgattggggcctcgagggcgcgaagaagcgcggctgctggaatggcaccaaggacatcctggacgccgggcgcgactggatcatcgagaacatgaagaactccggcctgcgcggtcggggcggcgcgggtttctcgaccggcctgaagtggtcgttcatgcccaaggaagtgaaggacggtcgtcctcactacctggtggtcaacgccgatgagtccgagccgggcacctgcaaggaccgggagatcatgcggcatgacccgcacctcctgatcgagggctgcctgatcgcctcgcgcgcgatgctggcccacgcctgctacatctacatccgcggcgagtacgtcttcgagcgcgagcgcctggaagcggcgatcaagcaggcctacgaggccaagctggtcggcaagaacaatgtccacggctgggacttcgatatctacgtccaccacggcgccggcgcctatatctgcggcgaagagacggccctgctggaaagcctggaaggcaagaagggccagccgcgcctgaagccgccgttcccggcgggcgcaggcctctatggcatgccgaccacggtcaacaacgtcgagagcatcgccgtcgcgggcacgatcctgcgtcgcggcgcggcctggttcgcgggctttggccgtccgaacaacgccggcaccaagctcttctgcgtctcgggccatgtgaacctgccctgcaacgtcgaagaggcgatgagcatcccgttccgccagctggtcgaggaccactgcggcggcatccggggcggctggggcaaccttaaggccgtcattccgggcggctcgtcggtgccgatgatccccgccgagcagtgcgaagacctgccgatggacttcgacgccctgcggaacctgaaatcgggcctgggcacggctgcggtcatcgtcatggacaaggacaccgaccttgttcgcgccatcgcccgcctgtcgtacttctataagcacgagagctgcggccagtgcacgccgtgccgtgaaggcaccggctggatgtggcgcgtcatggagcgcatggtcaccggcgaggccgatcccaaagagatcgacacgctgctggacgtcacgacccaggtcgagggtcacaccatctgcgccctgggcgacgcggccgcctggccgatccagggtctgttccgccacttccgccacgaggtggaggagcggatcgcttcctatcgtagcggtcgcctgcacgtgcagggcgccaagctgatcgcggcggagtaa

SEQ ID NO: 39109 - protein, 439 aa, Caulobacter crescentus CB15
MVGILEDKDRIFTNLYGLHDWGLEGAKKRGCWNGTKDILDAGRDWIIENMKNSGLRGRGGAGFSTGLKWSFMPKEVKDGRPHYLVVNADESEPGTCKDREIMRHDPHLLIEGCLIASRAMLAHACYIYIRGEYVFERERLEAAIKQAYEAKLVGKNNVHGWDFDIYVHHGAGAYICGEETALLESLEGKKGQPRLKPPFPAGAGLYGMPTTVNNVESIAVAGTILRRGAAWFAGFGRPNNAGTKLFCVSGHVNLPCNVEEAMSIPFRQLVEDHCGGIRGGWGNLKAVIPGGSSVPMIPAEQCEDLPMDFDALRNLKSGLGTAAVIVMDKDTDLVRAIARLSYFYKHESCGQCTPCREGTGWMWRVMERMVTGEADPKEIDTLLDVTTQVEGHTICALGDAAAWPIQGLFRHFRHEVEERIASYRSGRLHVQGAKLIAAE

SEQ ID NO: 39110 - DNA, 1602 bp, Synechocystis sp. PCC 6803
  CDS (1)..(1602): transl_table=11
atggacattaaagaattaaaggaaattgccaccaaaagccgtgagaaacaaacaaaaattcgcattcgttgttgtagtgctgccggttgtctttcttctgaaggggagacggtgaaaaaaaatctcaccacggcgatcgccgcagcaggattggaagaaaaagtggaagtctgtggggtaggctgtatgaagttttgtggccggggccccctagtggcggtggatgaccggaatcaactctacgaatttgttaccccagaccaggtgggggatattgtcaaaaaattgcagaaacccgatgcagttgcagaaacaggcttaatcagtggtgatccccaccatcccttctacgccctgcaaaggaatattgctttggaaaattcaggccggattgatcccgaatccattgatgaatacatcgccctagggggctacgaacagcttcataaggttgtctatgaaatgaccccagaggaagtgatcgtggaaatgaacaaaagtggtctgcggggtcggggtgggggcggttatcccaccggcttgaaatgggccacagtggccaaaatgcccggccagcaaaaatatgtcatctgcaatgctgacgaaggcgatcccggtgctttcatggaccgcagtgtgttggaaagtgatccccatcgcatcctcgaaggtatggcgatcgccgcctatgcagtgggggctaaccatggttacatttatgtgcgggcggaataccccctagctatccaacgactgcaaaaagcgatccaacaggctaaacgttatggcctgatgggcacccaaatttttgactctcccattgatttcaagattgatatacgagtaggagccggtgcctttgtctgcggtgaagaaacagcattaattgcctcagtggaaggaaaacggggaacgccccgaccaagaccaccctatccagcccaatcgggtttgtggcaaagtcccaccctgattaacaatgtggaaacctacgccaacgttgtacccatcattcgggaagggggagattggtatggctccattggtacggaaaaaagtaaaggcaccaaggtttttgccctcacaggaaaagtggaaaacgctggtctgattgaagtgcccatgggaaccaccgtgcgacaagtggtggaggaaatggggggcggtgtacccaatggtggccaagtcaaagcagtgcaaactgggggcccttccggaggctgtatccccgccgataaattggatactcccatcgaatatgacaccctattagccctgggcaccatgatgggttccgggggcatgattgtcatggatgaaagcaccaatatggtggacgtggcccagttttatatggatttttgcaaatcggaatcctgtggcaaatgtattccctgccgagcgggcacagtgcaactttatgaccttttaacccgctttttagaaggggaagctacccaagaagacttgatcaaactagaaaatctttgccatatggttaaggaaactagcctttgtggattggggatgagtgcgcctaatccggtaataagtaccctgcgctattttcgtcatgaatatgaagaattactcaaagtctag

SEQ ID NO: 39111 - protein, 533 aa, Synechocystis sp. PCC 6803
MDIKELKEIATKSREKQTKIRIRCCSAAGCLSSEGETVKKNLTTAIAAAGLEEKVEVCGVGCMKFCGRGPLVAVDDRNQLYEFVTPDQVGDIVKKLQKPDAVAETGLISGDPHHPFYALQRNIALENSGRIDPESIDEYIALGGYEQLHKVVYEMTPEEVIVEMNKSGLRGRGGGGYPTGLKWATVAKMPGQQKYVICNADEGDPGAFMDRSVLESDPHRILEGMAIAAYAVGANHGYIYVRAEYPLAIQRLQKAIQQAKRYGLMGTQIFDSPIDFKIDIRVGAGAFVCGEETALIASVEGKRGTPRPRPPYPAQSGLWQSPTLINNVETYANVVPIIREGGDWYGSIGTEKSKGTKVFALTGKVENAGLIEVPMGTTVRQVVEEMGGGVPNGGQVKAVQTGGPSGGCIPADKLDTPIEYDTLLALGTMMGSGGMIVMDESTNMVDVAQFYMDFCKSESCGKCIPCRAGTVQLYDLLTRFLEGEATQEDLIKLENLCHMVKETSLCGLGMSAPNPVISTLRYFRHEYEELLKV

SEQ ID NO: 39112 - DNA, 1635 bp, Nostoc sp. PCC 7120
  CDS (1)..(1635): transl_table=11
atggaactgactgaattactagacattggcagacaagaacgctctcaacagaaacctgtgcagattcgctgctgtacggcggctggttgtctgtctgcgaattcgcaagcggttcaacaacagttagagcaggccgtcaaggctgaaggtttagagggagaggtacaagtctctggtgttggttgtatgcgcttgtgttgtcaggggcctttggttgaggtagaggggagtggggaagaaaaaacaaaacaaaggctttatgagaaggttacgcctgaagatgcgtcagcaattattggtgctttgaaggggaaagaggcacaattgtcagttgttaacttagaacagccattttttacttatcaagcaccaattgttttagagaatagtggcaaaattgacccagaaaggattcaagcttatattgcggctcagggttatcaggggctttaccaagtgttgcgggagatgacaccggcggcagttgtagacagtgttagtcgtagtggtttgcgggggcgtggtggtgctggttatcccacgggcttgaaatgggcgacggtggctaaggcgaagggagagcgcaaatttgtcatctgtaacgcagatgagggagatccaggggctttcatggataggagtgtgttggaaagtgatccgcatcgggtattggaaggaatggcgatcgctgcctatgctgtcggtgctagtcaaggttatatttatgtcagggcagaatatcccattgccatcaaacgcctacacactgccattcatcaagcccaaaggctcggtttgttaggtagtaatatatttgagtctccctttgattttaaaatcgatatccgcatcggtgcaggggcttatgtatgcggcgaagaaacagccttgatggcttccattgaaggtaaacgcggtgtccctcatccccgtcctccctacccggctgaatctggtttatggggttatcctactttaattaataacgtcgaaacattcgccaatattgcccccattattcgtaaaggtgcggactggtttgctagtatcggcacggctaaaagtaaagggacaaaagtatttgctctcgctggcaaaatccgcaacacaggcttaattgaagtgccaatgggtacatccttgcggcaaatagtggcagaaatgggtggtggtattcccgatggtggtgttgccaaagctgtacaaacaggtggcccttctgggggatgtattcccgcttcggcttttgatactcctgtagactacgaatctttaactaacttgggttccatgatgggttctggtgggatgattgtcatggatgacaccaccaacatggtagatgttgcccgattttttatggaattttgtatggatgaatcctgcggtaagtgtattccttgccgggtggggacggtacaactacatggattattgagcaagattcgggaaggtaaggcttcacttgctgacttagaactgttagaagaactgtgcgatatggtaaaaaataccagcttgtgcggtctaggtcagtctgcgcctaatccggtatttagtacattgcactatttccgcgatgaatatttggcgttgatagctgtaggagccgtttctctaaattcaacagattaa

SEQ ID NO: 39113 - protein, 544 aa, Nostoc sp. PCC 7120
MELTELLDIGRQERSQQKPVQIRCCTAAGCLSANSQAVQQQLEQAVKAEGLEGEVQVSGVGCMRLCCQGPLVEVEGSGEEKTKQRLYEKVTPEDASAIIGALKGKEAQLSVVNLEQPFFTYQAPIVLENSGKIDPERIQAYIAAQGYQGLYQVLREMTPAAVVDSVSRSGLRGRGGAGYPTGLKWATVAKAKGERKFVICNADEGDPGAFMDRSVLESDPHRVLEGMAIAAYAVGASQGYIYVRAEYPIAIKRLHTAIHQAQRLGLLGSNIFESPFDFKIDIRIGAGAYVCGEETALMASIEGKRGVPHPRPPYPAESGLWGYPTLINNVETFANIAPIIRKGADWFASIGTAKSKGTKVFALAGKIRNTGLIEVPMGTSLRQIVAEMGGGIPDGGVAKAVQTGGPSGGCIPASAFDTPVDYESLTNLGSMMGSGGMIVMDDTTNMVDVARFFMEFCMDESCGKCIPCRVGTVQLHGLLSKIREGKASLADLELLEELCDMVKNTSLCGLGQSAPNPVFSTLHYFRDEYLALIAVGAVSLNSTD

SEQ ID NO: 39114 - DNA, 1440 bp, Caenorhabditis elegans
  CDS (1)..(1440)
atggcttcggcagcagtctctcttggggctaggctaattggacagaacgtgccgaaggtggctgtgcgcggagtcgtgacatcagcccagaatgcgaacgctcaagtgaaacaagagaagacatcgttcggaaatttgaaggacagtgatcgtatcttcaccaatttgtatggtcgccatgattatcgattgaaaggagccatggctcgtggagactggcacaagacgaaggaaatcattctaaaaggatctgattggattctcggagaactcaaaacttctggtctccgtggaagaggaggagccggtttcccatccggaatgaagtggggattcatgaacaaaccattcgatggacgtccgaaatatctcgttgttaacgctgatgaaggagagccaggaacttgtaaagatcgtgaaattatgcgtcacgacccacataagctcatcgaaggatgcttgatcggaggagttgcaatgggagctcgtgccgcctatatttacatccgtggagagttctacaatgaagcttgtattcttcaagaggccatcaacgaggcctacaaggccggatatctcggaaaagactgcctcggaactggatacaactttgacgtcttcgttcatcgtggagctggagcctacatttgcggtgaagagactgctcttattgaatcgctcgaaggaaagcaaggaaaaccacgtctgaagcctccattcccagctgacattggacttttcggttgtccaacaactgtgaccaatgttgaaactgtagctgtggctccaacaatttgtcgtcgtggtggtgactggttcgcttcgtttggacgtgagagaaatcgcggaaccaagcttttctgcatctccggtcaagtcaacaatccatgcacggtcgaagaagagatgtccgttccattgaaagatcttatcgagcgtcattgtggtggagtcatcggtggatgggataaccttcttgccatcattccaggaggatcttctgtcccacttatgccaaagaacgtttgcgacacagttctcatggatttcgatgccctggttgctgctcaatctggtcttggaaccgccgcggttattgtgatgaacaagcaaactgatatcgttaaatgcatcgcccgattgtcacttttctataaacacgaatcttgcggacagtgtactccatgccgtgagggatgcaattggttgaacaagatgatgtggcgtttcgttgatggaaaagccaagccatcggagatcgatatgatgtgggaacttagtaaacagatcgagggacacactatttgtgctcttggagacgctgctgcatggccagttcagggactcattcgccacttccgaccagaactcgaacgccgaatggccgagttccacaagcaagttttggccgagcagggagccaagcagatcagtcaatga

SEQ ID NO: 39115 - protein, 479 aa, Caenorhabditis elegans
MASAAVSLGARLIGQNVPKVAVRGVVTSAQNANAQVKQEKTSFGNLKDSDRIFTNLYGRHDYRLKGAMARGDWHKTKEIILKGSDWILGELKTSGLRGRGGAGFPSGMKWGFMNKPFDGRPKYLVVNADEGEPGTCKDREIMRHDPHKLIEGCLIGGVAMGARAAYIYIRGEFYNEACILQEAINEAYKAGYLGKDCLGTGYNFDVFVHRGAGAYICGEETALIESLEGKQGKPRLKPPFPADIGLFGCPTTVTNVETVAVAPTICRRGGDWFASFGRERNRGTKLFCISGQVNNPCTVEEEMSVPLKDLIERHCGGVIGGWDNLLAIIPGGSSVPLMPKNVCDTVLMDFDALVAAQSGLGTAAVIVMNKQTDIVKCIARLSLFYKHESCGQCTPCREGCNWLNKMMWRFVDGKAKPSEIDMMWELSKQIEGHTICALGDAAAWPVQGLIRHFRPELERRMAEFHKQVLAEQGAKQISQ

SEQ ID NO: 39116 - DNA, 1296 bp, Ralstonia solanacearum GMI1000
  CDS (1)..(1296): transl_table=11
atgacctccctgcacgatcgacacatccagccgctgattctcgccggcctgaacggcgacaactggcacctcgaagactatgtcaagcgcggcggttaccagcagctcaagcgcatcctgacggaaaagatttcgcctgaacagatcatcgccgacgtgaaggcctcgggcctgcgcggccgtggcggcgcgggcttcccgaccggcctgaagtggagcttcatgccgcgccagttcccgggccagaagtacctggtctgcaacacggacgagggcgagcccggcacgttcaaggatcgcgacatcatccgctacaacccgcacgccttgatcgaaggcatggccatcggcggctacgcgatgggcatcaccgtgggctacaactacatccacggcgagatctggaacgagtacaagctcttcgagcaggcgctcgaagaggcgcgtgccgcaggtttgctgggcgacaacattctcggctccggcttcaacttccagctgcatgcgcaccatggctatggcgcgtacatctgcggcgaggaaaccgcgctgctcgaatcgctggaaggcaagaagggccagccgcgcttcaagccgccgttcccggccagcttcggcctgtacggcaagccgaccaccatcaacaacaccgaaacctttgccgcggtgccgttcctgctgtccatcggtccggacaactacctgaagatgggcaagccgaacaacggcggctcgaagatcttctcggtgtccggcgacgtggagcgcccgggcaactacgagattccgctcggcacgccgttctccaagctgctggaactggccggcggcatgcgtggcggcaagaagctcaaggcggtcatcccgggtggctcgtcggcgccggtggtgccggccgacctgatgatggcctccgacatggactacgactcgatcgccaaggccggctcgatgctgggttcgggcgccgtgatcgtgatggacgagacgcgctgcatggtgaagtcgctgctgcgcctgtcgtacttctacttcgaggagtcgtgcggccagtgcacgccgtgccgtgagggcaccggctggctgtaccgcgtggtcgatcgcatcgagcacggcaagggccgccaggaagatctggacctgctcaacaacgtggccgagaacatcatgggccggaccatctgcgcgctgggcgatgccgccgcgatgccggtccgcggcatgctcaagcactactgggacgagttcgcgtatcacgtcgagcacaagcagtgcatggtgcccacctacatctaa

SEQ ID NO: 39117 - protein, 431 aa, Ralstonia solanacearum GMI1000
MTSLHDRHIQPLILAGLNGDNWHLEDYVKRGGYQQLKRILTEKISPEQIIADVKASGLRGRGGAGFPTGLKWSFMPRQFPGQKYLVCNTDEGEPGTFKDRDIIRYNPHALIEGMAIGGYAMGITVGYNYIHGEIWNEYKLFEQALEEARAAGLLGDNILGSGFNFQLHAHHGYGAYICGEETALLESLEGKKGQPRFKPPFPASFGLYGKPTTINNTETFAAVPFLLSIGPDNYLKMGKPNNGGSKIFSVSGDVERPGNYEIPLGTPFSKLLELAGGMRGGKKLKAVIPGGSSAPVVPADLMMASDMDYDSIAKAGSMLGSGAVIVMDETRCMVKSLLRLSYFYFEESCGQCTPCREGTGWLYRVVDRIEHGKGRQEDLDLLNNVAENIMGRTICALGDAAAMPVRGMLKHYWDEFAYHVEHKQCMVPTYI

SEQ ID NO: 39118 - DNA, 1305 bp, Agrobacterium tumefaciens str. C58
  CDS (1)..(1305): transl_table=11
atgttaaaagatcaggatcgcatctttaccaatctctacggcctcaaggacaagtccctgaagggcgtgatggcgcgcggccactgggacggcaccaagcagatcatcgaaaagggccgtgactggatcatcaacgagatgaaggcttccggccttcgcggtcgcggcggcgctggcttcccgacgggtctcaaatggtccttcatgccgaaggaaaatgacggccgtccgcattacctcgtcgtcaacgccgacgaatccgaacccggcacctgcaaggaccgcgaaatcctgcgcaacgatccgcatacgctgatcgaaggctgcgtgatcgccggtttcgccatgggcgcgcacaccgcttacatttatgtgcgcggcgaatatatgcgcgaacgtgaagcgctgcaggcagctatcgacgaatgttacgatgccggcctgctcggcaagaacaacaagaacggctgggactacgacatctacgtccatcatggcgcgggtgcctatatctgcggcgaagagacggcgctgctcgaaagcctcgagggcaagaagggccagccacgtctgaaaccgccgttcccggccaatatgggtctctatggctgcccgacgaccgtcaacaacgtcgaatcgatcgccgttgcgccaaccatcctgcgccgcggtgcatcctggttctcgtccatcggccgtccgaacaatgtcggcaccaagctgttcatggtgtccggtcatgtcgagcgtccatgcaccttcgaagatgcgctgggcctgtccttccgcgagctgatcgagcaccattgcggtggcattcgcggcggctgggacaatctgctcggcgtcatcccgggcggcgcttcctgccccatcgttcgcggtgaggacatgaaggacgccatcatggactttgacggcatgcgcgaagtgaagtcttccttcggcaccggcggcatgatcgtcatggacaagtccactgacgtcatcaaggcgattgcgcgcatcgcggccttcttcaagcacgaaagctgtggccagtgcacgccgtgccgtgaaggcaccggctggatgtggcgcgtgctggaacgcatggtcaagggtaacgcccagaagcgtgaaatcgacatgctgttcgaggtgaccaagcagatcgagggccacaccatctgtgcgctcggcgacgccgccgcatggccggtacaggcgctgatccgcaatttccgtccggaaatcgaaaagcgcatcgaccaatatacctacagggccatggatgatggcgctgttctggaagccgctgaataa

SEQ ID NO: 39119 - protein, 434 aa, Agrobacterium tumefaciens str. C58
MLKDQDRIFTNLYGLKDKSLKGVMARGHWDGTKQIIEKGRDWIINEMKASGLRGRGGAGFPTGLKWSFMPKENDGRPHYLVVNADESEPGTCKDREILRNDPHTLIEGCVIAGFAMGAHTAYIYVRGEYMREREALQAAIDECYDAGLLGKNNKNGWDYDIYVHHGAGAYICGEETALLESLEGKKGQPRLKPPFPANMGLYGCPTTVNNVESIAVAPTILRRGASWFSSIGRPNNVGTKLFMVSGHVERPCTFEDALGLSFRELIEHHCGGIRGGWDNLLGVIPGGASCPIVRGEDMKDAIMDFDGMREVKSSFGTGGMIVMDKSTDVIKAIARIAAFFKHESCGQCTPCREGTGWMWRVLERMVKGNAQKREIDMLFEVTKQIEGHTICALGDAAAWPVQALIRNFRPEIEKRIDQYTYRAMDDGAVLEAAE

SEQ ID NO: 39120 - DNA, 1557 bp, Agrobacterium tumefaciens str. C58
  CDS (1)..(1557): transl_table=11
atgagtgtcaccgtttttattcccggcgattccgccgcacttgccgttggcgcaaaccgtgttgccgaagcgatcgctcgagaggcggccagccgcaacctcgacgtccagatcgtccgtaacggttcgcgcggcatgctctggctcgaggtgctggtggaagtgcgcaccgagcatggccgtatcgcctacgggccggtaaaggccgccgatgtcacgtcacttttcgatgcggattttcttgacggtggcgatcaccgtctctgtcttgggccgacgaaggacatccccttcctgaaaaaccagacgcgcctgacatttgcccggtgcggcgttaccgacccgctgtcgctagaggattaccgcaactatcagggcatgaaaggcctcgaaaaagccgtcaccatggagccgctcgccatcgttgcgcaggtgactgaaagcggcctgcgtggacgcggcggcgcgggtttcccgaccggcatcaaatggaagaccgtcgcagatgcgagggcagatcagaaatatatcgtctgcaatgccgatgaaggcgatagcggcaccttcgccgaccgcatgatcatggaaggcgaccccttcgtgctgatcgagggcatggcgattgccggccttgccgttggtgccaccaagggcttcatctacacccggtcggaatatccatacgccatcaaggtcatggaaaaggcgatcgagatcgcgaggcgtgagggcattcttgggtcctccgtcctcggttcaggccgcgctttcgatatggaagtacgcatgggcgccggcgcctatgtctgcggcgaggagacgtcgctcctgaacagcctcgaaggcaaacgcggcacggtgcgcgccaaaccgccgctgccggcattgcagggcctgttcggcaagccgaccgtcgtcaacaacgtgatttcgctggcgtccatcccggtcatcatggatcgcggtgccgctttctatcgcgatttcggcgtcggccggtcgcatggcaccatccccatccagctcgccggaaacatcagatatggcgggctttacgaaaccgccttcggtctgacgctcgggcaactggtgaacgatatcggcggcggcacgatcaccggccgccccgttaaggcggtgcaggtgggcggcccgcttggcgcctattttccggtgtcgttgttcgatacgatcttcgactacgaagcgttcacggcggctggcggtcttatcggacacgccgggatcgtggttttcgacgacaccgccgatatgctgcatcaggctcggttcgcccttgaattctgcgcggtcgaaagctgcggcaagtgcacgccctgtcgtatcggctcgacgcgcggcgtcgagactgtcgacaagatcgcgcttggcatcgagcgggagaaaaacacggcgctgctcgaagatctctgcgaaacgatgaaatttgggtcgctttgcgcgctgggcggtttcacgccctatcccgttatgagcgcgctcagacatttcccgcaagattttgcccccatcccacgtgttgaagcggcggagtaa

SEQ ID NO: 39121 - protein, 518 aa, Agrobacterium tumefaciens str. C58
MSVTVFIPGDSAALAVGANRVAEAIAREAASRNLDVQIVRNGSRGMLWLEVLVEVRTEHGRIAYGPVKAADVTSLFDADFLDGGDHRLCLGPTKDIPFLKNQTRLTFARCGVTDPLSLEDYRNYQGMKGLEKAVTMEPLAIVAQVTESGLRGRGGAGFPTGIKWKTVADARADQKYIVCNADEGDSGTFADRMIMEGDPFVLIEGMAIAGLAVGATKGFIYTRSEYPYAIKVMEKAIEIARREGILGSSVLGSGRAFDMEVRMGAGAYVCGEETSLLNSLEGKRGTVRAKPPLPALQGLFGKPTVVNNVISLASIPVIMDRGAAFYRDFGVGRSHGTIPIQLAGNIRYGGLYETAFGLTLGQLVNDIGGGTITGRPVKAVQVGGPLGAYFPVSLFDTIFDYEAFTAAGGLIGHAGIVVFDDTADMLHQARFALEFCAVESCGKCTPCRIGSTRGVETVDKIALGIEREKNTALLEDLCETMKFGSLCALGGFTPYPVMSALRHFPQDFAPIPRVEAAE

SEQ ID NO: 39122 - DNA, 1425 bp, Drosophila melanogaster
  CDS (1)..(1425)
atggctgcaattgtgcgatttaatttgttaacaaagccgcagattgttgcgactttgccggccagcctgcatgtgcagcgcttccagagcacccaggccccacctccgggcactcctccgccacagacgaagaccaaattcggtccgctggcggacgaagatcgcatcttcaccaacctctatggacgacatgactggaggctgaagggagctttgaagcgcggcgactggtacaaaaccaaggagattgtgctgaagggggcagactggatcgttaacgagatcaagacgtccggcctgcgcggacgtggaggagctggcttccccagcggtatgaagtggtccttcatgaacaagcccggagatggacgccccaagtacttggtggtgaatgccgatgagggagagcctggcacctgcaaggatcgcgagatcatgcgccacgatccacacaagctggtggagggctgtctgattgccggacgcgccatgggcgcccaggctgcctacatctacattcgtggcgagttctacaacgaggcttccaacatgcaactggccattgccgaggcctaccaggctggtctgattggaaagaatgcgtgcggaacaggctacgacttcgacgtcttcatgcaccgcggcgctggagcttacatttgcggcgaggagaccgctctgatcgaatcgctggaaggaaagcagggaaagccacgcttgaagccgccattcccagctgatgtgggtgtgttcggttgcccaaccacagttaccaatgtggagaccgtggccgttgcaccaaccatttgccgtcgtggcggtgtatggttcgccagcttcggtcgcacccgtaactcgggcaccaagctcttcaacatttcgggacatgtcaacaggccctgcactgtggaggaggaaatgtccatcccactcaaggagttgattgagcgccactgcggaggcgtcactggtggatgggataatctgctaggcgtcattcccggcggctcttccacccccatcatacccaaaaatgtctgcgacgatgttatcatggacttcgatggcctaattgccgctcagacttcgctgggtactgcggctatcatcgtaatggacaagtcgacggatgtgataaaggctattgccaggctaatttcattctataagcatgagagctgtggccagtgcacgccatgccgagagggaatcggttggatgaacaaaatcatgactcgatttgttaagggtgacgcccagcccgctgagatcgatatgctgtgggagatttccaaacaaattgagggacacactatttgtgcgcttggtgatggtgccgcctggccagtccagggcctcattcgtcacttccggcccgagatcgagaaacgtatgcaactgcatgcaaagcgcgtcagcaattaa

SEQ ID NO: 39123 - protein, 474 aa, Drosophila melanogaster
MAAIVRFNLLTKPQIVATLPASLHVQRFQSTQAPPPGTPPPQTKTKFGPLADEDRIFTNLYGRHDWRLKGALKRGDWYKTKEIVLKGADWIVNEIKTSGLRGRGGAGFPSGMKWSFMNKPGDGRPKYLVVNADEGEPGTCKDREIMRHDPHKLVEGCLIAGRAMGAQAAYIYIRGEFYNEASNMQLAIAEAYQAGLIGKNACGTGYDFDVFMHRGAGAYICGEETALIESLEGKQGKPRLKPPFPADVGVFGCPTTVTNVETVAVAPTICRRGGVWFASFGRTRNSGTKLFNISGHVNRPCTVEEEMSIPLKELIERHCGGVTGGWDNLLGVIPGGSSTPIIPKNVCDDVIMDFDGLIAAQTSLGTAAIIVMDKSTDVIKAIARLISFYKHESCGQCTPCREGIGWMNKIMTRFVKGDAQPAEIDMLWEISKQIEGHTICALGDGAAWPVQGLIRHFRPEIEKRMQLHAKRVSN

SEQ ID NO: 39124 - DNA, 2109 bp, Drosophila melanogaster
  CDS (1)..(2109)
atgatatcgtttctgttaaaacgccgagcttgtgatgcttacaagatttcattaggactaactcgtgcatatagagccttaacagaagtaaaaagccttcaaaatgccttacgacctggtaataaaactggaaatatcaagctggtaaacatataccgaacttctagcatacaaaatgtgaagaagaaccaactaagtgacgctgaaagcgttattccactcttattgcggccagccaaacctgtgctgattatgagagaaggatctcaaaccgattgtaacgacgatttgctgtcctctgagcaaagagccaaaaaaagggaaagcataaaaaaatccgaagtagattgcccaaaatttccagctgagaaacttccgcccacaacgaaatttcctattaatgaaaatgccaagaaggttttagatccagccgaccaaagagaactcgaggccaatttgttaaaaaggcttaaagatatggctaaaagaaagaaatctcgactagatgagaaagttgacgagctgagggataattttataggctggaattatgctgctctacaaggaagaactattgtgactgtggatgccaaggaatcaactccaccgaaaggatctgggccggccaccccggcaggctctcctccacctaaaaatgtttctgcaccgccgacgggcggttctccgcctgccaaaagcggcgctccaccacccccaaaggggccaccgcccggaactccaccaccgcagacgaaaactacttttggaccacttgctgatgctgatcgaatctttaccaatttatacggacggcacgattggcgattgaaggcagcaatgaagcgcggtgactggtacaagacgaaggagatcatagccaagggtgacaagtggatagtcaacgagattaagacatctggactgcgaggacgcggtggcgccggatttcccagtggacttaagtggtcatttatgcataaaccgcctgatggaagacccaagtttctggtggtcaatgcggatgaaggagagcccggtacttgcaaggatcgtgagataatgcgccatgatccacacaaactggtagagggatgtctcattgctggacgggctatgggtgccaacactggttttatttacattcgcggagagttttacaacgaagcttgcaatcttcagtatgccattattgaggcctataaggctggctacctgggaaagaatgcctgcggttctgggttcgatttcgatctttatgtgcaacgtggagcaggagcctatatttgcggtgaggaaacctctctgattgaatccctggagggcaaggcgggtaagccaaggaacaagcctccctttccggctgatatcggcgtctttggctgtccgtctacggtgaccaatgtggaaacggtggccgtgtctcccactatttgccggcgtggtggcaattggtttgccagctttggacgtacccgaaactctggcaccaagctgtttaatatctctggtcatgtttgcaacccttgtaccgtcgaggaggagatgtccatgccaaccagagagcttatcgaacgccatgctggcggagtgatcgggggctgggacaatctactggccatcattccgggtggctcctccactccctgcattaccaaggagcacgcctcgagtgcgattcacgactacgatgggctgatggcagtgcgttcgtccatgggaacgggtgccttaattgttatgaataaggatacggacattatcaaggccattgcccgattatcggctttctataagcacgagagctgcggccagtgcactccttgccgcgagggtctccactgggtgaacatgatcatgcatagatttgtgacaggacaggcgcaaattgcagagatcgatatgctgttcgaactgacgaagcagatcgagggacataccatttgtgccctggccgatggtgctgcttggccgccccaaggactcatccggaacttccgaccggtcatcgaggagaggatcaagaagcgggcggccgaggaccaagctaaagctgaagcactcgaagccgaacgtttcccttgtcaaacggtgactccttgtccagaataa

SEQ ID NO: 39125 - protein, 702 aa, Drosophila melanogaster
MISFLLKRRACDAYKISLGLTRAYRALTEVKSLQNALRPGNKTGNIKLVNIYRTSSIQNVKKNQLSDAESVIPLLLRPAKPVLIMREGSQTDCNDDLLSSEQRAKKRESIKKSEVDCPKFPAEKLPPTTKFPINENAKKVLDPADQRELEANLLKRLKDMAKRKKSRLDEKVDELRDNFIGWNYAALQGRTIVTVDAKESTPPKGSGPATPAGSPPPKNVSAPPTGGSPPAKSGAPPPPKGPPPGTPPPQTKTTFGPLADADRIFTNLYGRHDWRLKAAMKRGDWYKTKEIIAKGDKWIVNEIKTSGLRGRGGAGFPSGLKWSFMHKPPDGRPKFLVVNADEGEPGTCKDREIMRHDPHKLVEGCLIAGRAMGANTGFIYIRGEFYNEACNLQYAIIEAYKAGYLGKNACGSGFDFDLYVQRGAGAYICGEETSLIESLEGKAGKPRNKPPFPADIGVFGCPSTVTNVETVAVSPTICRRGGNWFASFGRTRNSGTKLFNISGHVCNPCTVEEEMSMPTRELIERHAGGVIGGWDNLLAIIPGGSSTPCITKEHASSAIHDYDGLMAVRSSMGTGALIVMNKDTDIIKAIARLSAFYKHESCGQCTPCREGLHWVNMIMHRFVTGQAQIAEIDMLFELTKQIEGHTICALADGAAWPPQGLIRNFRPVIEERIKKRAAEDQAKAEALEAERFPCQTVTPCPE

SEQ ID NO: 39126 - DNA, 1791 bp, Thermoanaerobacter tengcongensis MB4
  CDS (1)..(1791): transl_table=11
atgctttacaggtctcacgtaatggtatgtggtggaactggctgtacttcatcaggttctgacgaggtagctgaacgtttcatagaagagattaaaaaagcgggtttggacaaagaaatactggttgtgaggacaggatgctttggactctgcgagctgggtcctgttgtggtagtttacccggaaggggttttttacagcagagtaaagccagagtatgtgcctgagatcgtagaggagcatcttttaaagggaagacctgtcagaaagtacatctacggtgagagcctagaagaaaaggctataaagccgttggaggagacacctttcttcagaaaacagagaagaattgctcttagaaactgcggtgtgataaaccctgaagacataagagaagctattgcttttgacgggtataaagcgcttgcgaaggttcttacagagatgactcctgagcaagtaattgaagaggtcaaaaaatcaggattaaggggaagaggcggtggcggattcccaacaggtgtgaaatgggaatttgcttacaagcagaaagaaacccctaaatatgttgtgtgcaatgctgatgaaggagaccctggcgctttcatggatagaagcatactggaaggagacccccacagtgttttagaagcaatggcaatagctggatatgcaataggtgcaaatcacggttatatatacgtgagagcagagtatcctctggctgtaaaaaggcttaagattgcgattcagcaggcgagagagtacggacttttaggaaaggatatatttggcacagggtttgactttgacattgaaataaggcttggagcaggtgcttttgtctgcggtgaagagacagctcttttaaactctattatgggtaaaagaggagagccgaggccaagaccccccttcccggcggtgaagggtgtatggggcaaacccacaattataaataacgtggagacttttgcaaatattcctcccatcatattaaacggcggagaatggttcgcaagcattggaacagaaaaatctaaaggaacgaaagtttttgctctcaccggtaaggtgaataacaccggactcattgaagtgcctatgggtacaactttaagagaaatcatatacgaaataggcggaggaatacccggaggaaagaaattcaaagctgttcagataggcggtccttctggcggatgcataccggcagagcttttagatactccgattgattatgattctttaaccagtgcaggtgcgatgatgggttctggcggacttgttgtgatggatgaagacacatgtatggtcaatgtggcgaagttcttcctcgagtttactgtcgatgaatcctgcggtaagtgtgctccttgtaggattggtacgaagaggatgctggagcttttggataagataacttccggaaaaggagaagaaggagatattgaaaagttagaagaactggcaaagaccataaaggcaacggctctatgtggtcttggacagacagcacccaatcctgtactttctactttgagatatttcaggcacgaatatgaggcccacataaaagaaaaaaggtgccctgccggtgtatgtacagcgcttttaagctttgttatagatcctgaaaagtgcaaagcctgtggaatttgtgcaaagaactgtcctgttggagctatttctggtaagccaaagacgccttatgtgattgaccaagagaagtgtattaagtgcggaacatgtattgataagtgtccgtttggcgcaatatacaaaaaataa

SEQ ID NO: 39127 - protein, 596 aa, Thermoanaerobacter tengcongensis MB4
MLYRSHVMVCGGTGCTSSGSDEVAERFIEEIKKAGLDKEILVVRTGCFGLCELGPVVVVYPEGVFYSRVKPEYVPEIVEEHLLKGRPVRKYIYGESLEEKAIKPLEETPFFRKQRRIALRNCGVINPEDIREAIAFDGYKALAKVLTEMTPEQVIEEVKKSGLRGRGGGGFPTGVKWEFAYKQKETPKYVVCNADEGDPGAFMDRSILEGDPHSVLEAMAIAGYAIGANHGYIYVRAEYPLAVKRLKIAIQQAREYGLLGKDIFGTGFDFDIEIRLGAGAFVCGEETALLNSIMGKRGEPRPRPPFPAVKGVWGKPTIINNVETFANIPPIILNGGEWFASIGTEKSKGTKVFALTGKVNNTGLIEVPMGTTLREIIYEIGGGIPGGKKFKAVQIGGPSGGCIPAELLDTPIDYDSLTSAGAMMGSGGLVVMDEDTCMVNVAKFFLEFTVDESCGKCAPCRIGTKRMLELLDKITSGKGEEGDIEKLEELAKTIKATALCGLGQTAPNPVLSTLRYFRHEYEAHIKEKRCPAGVCTALLSFVIDPEKCKACGICAKNCPVGAISGKPKTPYVIDQEKCIKCGTCIDKCPFGAIYKK

SEQ ID NO: 39128 - DNA, 1941 bp, Streptomyces coelicolor A3(2)
  CDS (1)..(1941): transl_table=11
gtggacgccctgctcggcccgcccgagtcctcctgggagggcgcggaccgctccgacgcggacctcagatgggcccgcggcggccgggaggcccgggaccgccgcgaccagctcctgccggccctgcacgcgctcaacgaccgcgtcggatggatcagcgagggcgccctggactacgtgtgccgccgcctgaccgtccccccggcggaggcctacggcgtggccaccttctacgccatgttctccgtccgcccccgcccggccaccgtcctgcacgtctgcaccgacctggcctgcacggcggcgggggcgagccggctgtgcgcggccgtggagtcacgcctcggcccggagagcggggtgaagctcgagcgcagcccgtgcctgggcctgtgcgagcgtgccccggcgactttggtgatccgggcgggcgaatcagcccgtccggcgcaggaggacactccagcccgtccggcgtttgaggacgaggccgtccaggccgaaggggggtccgggggcgcagcccccggggacggtgggggcacctcccgctcgagcgaagccgagagtgggggagggaaggggcggcgggggcgaaacaccctccacgcgacggcgatatgcgcccccgcaacccccgacagggcgatcgcggcggccaccgcccccgaatccgcccccaccgagcccgcccccgaagccgccgtcccccaggccggcgaccccaccctcaccctcctccaccgcatcggcaccaccgaccccacctccctggacgactaccgcgcccacggcggctacaccgccctgcgccgcgccttcgccctcggccccgccgccgtcatccgcgaggtcaccgacgccggcctggtcggccgcggcggcgccgccttccccaccggccgcaagtggcaggccacggccgcccagcccgaccacccgcactacctcgtctgcaacgccgacgaatccgaaccgggcaccttcaaggaccgcgtcctgatggagggcgacccgtacgccctggtcgaggccatgacgatcgcggcctacgcgaccggcgcccaccggggctatctctacctccgcggcgagtacccccgcgccctcgcccgcctcacccacgccatcgagcaggcccgcacccgcggcctgctcggtgacgacgtcctcggccagggctacgccttcgacatcgagatccggcgcggcgcgggcgcgtacatctgcggcgaggagacggccctgttcaactccatcgagggccgccgcggcgagccacgctccaagccgccgttcccggtcgagaagggcctgttcggcaaacccacggtggagaacaacgtcgagacgctggtcaacgtcctgcccatcctcacgatgggcgcggaggcgtacgccgcgatcggcactccgacgtccaccggccccaagctgttctgcgtgtccggcacggtggcccgccccggcgtctacgaactccccttcggcgccacgctcggcgaactgctcgcactcgccggggtccgcgacaacctccgcgcggtcctgctcggcggcgccgccggcggtttcgtccgccccgacgaactggacatcccgctcaccttcgaaggcacccgcgaggcgggcacgaccctgggctccggcgtcgtcatggccttcgacgacacggtcccgctcccccgcctgctgctgcggatcgccgagttcttccgcgacgagtcgtgcggccagtgcgtgccgtgccgggtcgggaccgtccgccaggaggaggcgctgcaccggatcgccgaccgcacgggcgccgcggcggccgacgacatcgccctgctccgcgaggtgggccgcgcgatgcgggacgcctcgatctgcggtctggggcagaccgcgtggaacgccgtggaatccgccatcgaccgtctgggggcgtacgaatga

SEQ ID NO: 39129 - protein, 646 aa, Streptomyces coelicolor A3(2)
MDALLGPPESSWEGADRSDADLRWARGGREARDRRDQLLPALHALNDRVGWISEGALDYVCRRLTVPPAEAYGVATFYAMFSVRPRPATVLHVCTDLACTAAGASRLCAAVESRLGPESGVKLERSPCLGLCERAPATLVIRAGESARPAQEDTPARPAFEDEAVQAEGGSGGAAPGDGGGTSRSSEAESGGGKGRRGRNTLHATAICAPATPDRAIAAATAPESAPTEPAPEAAVPQAGDPTLTLLHRIGTTDPTSLDDYRAHGGYTALRRAFALGPAAVIREVTDAGLVGRGGAAFPTGRKWQATAAQPDHPHYLVCNADESEPGTFKDRVLMEGDPYALVEAMTIAAYATGAHRGYLYLRGEYPRALARLTHAIEQARTRGLLGDDVLGQGYAFDIEIRRGAGAYICGEETALFNSIEGRRGEPRSKPPFPVEKGLFGKPTVENNVETLVNVLPILTMGAEAYAAIGTPTSTGPKLFCVSGTVARPGVYELPFGATLGELLALAGVRDNLRAVLLGGAAGGFVRPDELDIPLTFEGTREAGTTLGSGVVMAFDDTVPLPRLLLRIAEFFRDESCGQCVPCRVGTVRQEEALHRIADRTGAAAADDIALLREVGRAMRDASICGLGQTAWNAVESAIDRLGAYE

SEQ ID NO: 39130 - DNA, 1335 bp, Xanthomonas axonopodis pv. citri str. 306
  CDS (1)..(1335): transl_table=11
atggcacatcatcacgcaccctcaggcccggtcggtccggcgccgcagccgcatcaggtcgtctacacgaccttgcactacgacactccgtggtcgtatgagagctatctgaaaaccggtggctacgccgcgctgcgcaagatcctcgaagagaagatcccgcccgccgatgtcatcgagatggtcaaggcgtccaacctgcgcggccgtggcggcgcaggcttcccgaccgggttgaagtggtcgttcatgcccaagggcacgatgcagaagtacatcctttgcaactcggacgaatccgagccgggcacctgcaaggaccgcgacatcctgcgttacaacccgcattcggtggtggagggcatggcgatcgcctgctacgccaccggttcgaccgtgggctacaactacctgcgtggcgaattccaccacgagccgttcgagaacttcgagctggcgctggccgacgcgtacgccaacggttggttgggcaagaacatcctcggcagcggcgtggatatcgacatctacggtgcgctgggtgccggcgcctacatctgcggcgaagaaaccgcattgatggagtcgctggaaggcaagaaaggccagccgcgctacaagccgccgttcccggcgaatttcggcctgtacggcaagccgaccaccatcaacaacaccgagacctacgcgtcggtgccggcgatcattcgcaacggcccggagtggttcctcggtttgagcaagaccaagaacggcggcccgaagatcttctcggtgtccggctgcgtgcagaagggcggcaacttcgaggtgccactcggcaccaccttcgacgaactgctggaaatggccggcgggctgcgcccgggtcgcaagctcaagggtgtggtgcccggcggcgtgtcgatgccggtgctgaaggccgaccaggtcgcgggcctgcagatggactacgacaccttgcgcgcgctcggcaccggtctgggttcgggtgccatcgtggtactggacgacagcgtctgctgcgtccgctttgcctgccgcatctcgcagttcttccacaaggaatcctgcggccagtgcaccccgtgccgcgagggcaccggctggatgcaccgcgtgctggagcgcatcgtcgccggcaaggccacgatggaagacctgcatcagctgcgcaccgtcgccggccagatcgaaggccacaccatctgtgcgttcggcgaagcggcggcatggccgattcagggctttctgcgccagttctgggacgagttcgagtactacatcgtcaacggtcgttcgatcgtcgatacgcaagtcggagtggctgcatga

SEQ ID NO: 39131 - protein, 444 aa, Xanthomonas axonopodis pv. citri str. 306
MAHHHAPSGPVGPAPQPHQVVYTTLHYDTPWSYESYLKTGGYAALRKILEEKIPPADVIEMVKASNLRGRGGAGFPTGLKWSFMPKGTMQKYILCNSDESEPGTCKDRDILRYNPHSVVEGMAIACYATGSTVGYNYLRGEFHHEPFENFELALADAYANGWLGKNILGSGVDIDIYGALGAGAYICGEETALMESLEGKKGQPRYKPPFPANFGLYGKPTTINNTETYASVPAIIRNGPEWFLGLSKTKNGGPKIFSVSGCVQKGGNFEVPLGTTFDELLEMAGGLRPGRKLKGVVPGGVSMPVLKADQVAGLQMDYDTLRALGTGLGSGAIVVLDDSVCCVRFACRISQFFHKESCGQCTPCREGTGWMHRVLERIVAGKATMEDLHQLRTVAGQIEGHTICAFGEAAAWPIQGFLRQFWDEFEYYIVNGRSIVDTQVGVAA

SEQ ID NO: 39132 - DNA, 1386 bp, Yersinia pestis KIM
  CDS (1)..(1386): transl_table=11
atgaccatcaattcaggaacgaccaaggaaattatccggacgccagaaatgcacccgctgacctggcgtttgcgcgatgacaaacagcccgtgtggctggatgagtatcgcagcaaaaacggctatgccggggcagaaaaagcgttaaaaggcatggcgcccactgatgttgttaacgttgtcaaagacgctggcctgaaagggcgtggcggcgcaggtttctccactggtttgaagtggagcctgatgcccaaagacgacagtatgaacatccgctatctgctgtgtaacgctgatgagatggagccaggcacctataaagaccgtctgctgatggagcaattgcctcatctgctggtggaggggatgctgatcagtgccttcgcgctgaaagcctaccgtggctatatcttcctgcgtggcgaatatattgaagcggcagtgcatttacgtcgggcgattgctgaggccaccgaagccggcttgctgggcaaaaacatcatgggcagtggttttgatttcgaactgattgtccataccggtgcgggtcgttatatctgtggtgaagaaacggcgctgattaactcactggaaggccgccgtgctaacccgcgttctaagccgccgttcccggcctcttccggtgtctggggcaaaccgacttgcgtgaataacgttgaaaccctgtgtaacgtaccggccattattgaacatggcgttgagtggtatcaggggatcactgccggtaagagtaacgatgccggaaccaaactgatgggcttctcgggtcgggtgaaaaatccgggtctgtgggaattgccgtttgggatcaccgcccgtgagattctggaagattacgctggcggtatgcgcgatggcttgaaatttaaagcctggcagccgggcggggcgggtaccgatttcctgactgctgaccatctggatttgccgatggattttgagaatattgctaaagcaggtagccggttaggcaccgcgttggcgatggcggtagatcacgaaatcggcatggtgtctttggtgcgcaatctggaagagttcttctcccgtgagtcttgtggctggtgtacaccgtgtcgcgatggtttgccatggagtgtgaagatcttacgtgcattagagcgtggtgaaggccagccgggtgatatcgaaacgctagagcaactgtgccgcttcttagggccgggtaaaaccttctgtgctcatgcgccaggtgcggttgaacccctacaaagtgcgattaaatatttccgggacgaattcgaagccgggatcgccgttaaggcctatgaatctggaatgacgagcggcaacacccgagccatagccggtattcaacctaatctattaaaagcgcgctggtag

SEQ ID NO: 39133 - protein, 461 aa, Yersinia pestis KIM
MTINSGTTKEIIRTPEMHPLTWRLRDDKQPVWLDEYRSKNGYAGAEKALKGMAPTDVVNVVKDAGLKGRGGAGFSTGLKWSLMPKDDSMNIRYLLCNADEMEPGTYKDRLLMEQLPHLLVEGMLISAFALKAYRGYIFLRGEYIEAAVHLRRAIAEATEAGLLGKNIMGSGFDFELIVHTGAGRYICGEETALINSLEGRRANPRSKPPFPASSGVWGKPTCVNNVETLCNVPAIIEHGVEWYQGITAGKSNDAGTKLMGFSGRVKNPGLWELPFGITAREILEDYAGGMRDGLKFKAWQPGGAGTDFLTADHLDLPMDFENIAKAGSRLGTALAMAVDHEIGMVSLVRNLEEFFSRESCGWCTPCRDGLPWSVKILRALERGEGQPGDIETLEQLCRFLGPGKTFCAHAPGAVEPLQSAIKYFRDEFEAGIAVKAYESGMTSGNTRAIAGIQPNLLKARW

SEQ ID NO: 39134 - DNA, 1308 bp, Brucella suis 1330
  CDS (1)..(1308): transl_table=11
atgctggctgacaaagatcgcatcttcaccaatatttacggcttcaaggatcagtccctgaagggtgccatggctcgtggccattgggacaataccaagggcctgatcgagaagggctgcgactggatcatcgaggagatgaaggcgtcgggcctgcgtggccgtggcggcgctggcttcccgacgggtctcaaatggtcgttcatgcccaagcagagcgatggtcgcccgcattacctcgtcgtcaatgccgacgaatcggagccgggcacctgcaaggaccgcgaaatcctgcgccacgatccgcatacgctgatcgaaggctgcgtgattgccggttgcgcgatgggcgcacacaccgcttatatttatattcgcggcgagttcatgcgtgagcgtgaggtgcttcaggctgcaatcgacgagtgctacgaagccggccttctcggcaagaacaacaagtgcggctgggatatggacatttatgtcacccacggcgctggcgcttatatctgcggtgaagaaacggctttgctcgaaagcctcgaaggcaagaagggtcagccgcgcctcaagcctccattcccggccaatatgggcctctacggttgcccgacgacggtcaacaacgtggaatcgattgccgttgcgccgacgatcctgcgtcgtggcgcggcatggttctcgtccatcggacgtccgaacaatgtcggcaccaagctgttccagatgtccggccatgtgaacacgccgtgcgtcgtggaagaggggctcggcattccgttccgcgagctgatcgaaaagcatggcggcggtatccgtggcggctgggacaatctgctggcggtcattcccggcggcgcgtcgtgcccggtcatcaaggccgaggacatgatggacgccgtcatggattttgatggcatgcgtgagaagaagtcgtccttcggcaccggcggcttgatcgtcatggacaagtccaccgacatcatcaaggcgattgcgcgcctgtctgccttcttcaagcatgagagctgcggccagtgcacgccgtgccgcgaaggcactggctggatgtggcgcgtgatggagcgcatggtcaagggtaacgcgcagaagcgtgaaatcgacatgctgttcgacgtcaccaagcagatcgaaggtcacacgatctgcgcgctcggtgatgcggccgcatggccgatccaggggctgattcgcaatttccgtccggaaattgaaaagcgcattgatgaatatactcgcaacgccgttcagagccgtaatatccgtctggaagcggctgaataa

SEQ ID NO: 39135 - protein, 435 aa, Brucella suis 1330
MLADKDRIFTNIYGFKDQSLKGAMARGHWDNTKGLIEKGCDWIIEEMKASGLRGRGGAGFPTGLKWSFMPKQSDGRPHYLVVNADESEPGTCKDREILRHDPHTLIEGCVIAGCAMGAHTAYIYIRGEFMREREVLQAAIDECYEAGLLGKNNKCGWDMDIYVTHGAGAYICGEETALLESLEGKKGQPRLKPPFPANMGLYGCPTTVNNVESIAVAPTILRRGAAWFSSIGRPNNVGTKLFQMSGHVNTPCVVEEGLGIPFRELIEKHGGGIRGGWDNLLAVIPGGASCPVIKAEDMMDAVMDFDGMREKKSSFGTGGLIVMDKSTDIIKAIARLSAFFKHESCGQCTPCREGTGWMWRVMERMVKGNAQKREIDMLFDVTKQIEGHTICALGDAAAWPIQGLIRNFRPEIEKRIDEYTRNAVQSRNIRLEAAE

SEQ ID NO: 39136 - DNA, 1332 bp, Leptospira interrogans serovar Lai str. 56601
  CDS (1)..(1332): transl_table=11
atggcagaaatgaaacttcttacgaaatacatcgacaatcctcagtccaccaaactggagttttacgaatccgtacacggatacgatggaatgaaaaaagcgcttcagatgaaaccagacgacatcatcgcagaagtcaaaaaatccggactgagaggaaggggtggagccggttttccgaccggtcttaaatggtcgtttattcccaaagacattccaaaaccgaaatatatcatttgcaacgcggacgaaggagaaccgggaacattcaaagatcgtaaactgattgagaatcttccacatcagattatagaaggaatgatcataggagcgcgcgcgatcggttccaacaaaggatttttttatattcgaggagaattccaaaaaggcgcaaaagccatgcaggcggcgatcgacgaggcctactccaaaggatatttaggaaagaatattttaggaagcggttttgattttgatctgattctttacgaaggagcgggcgcctatatctgtggagaagaaaccgcgctgatcaattcactcgaaggaagaaggggccatcctagattaaaaccccccttccccgccgtgtcgggactttatcgttctccgaccgtagtcaataacgtagaaactttttcggcgattcctcatattttagataagggagcggattggtattctaaaataggaacggaaaaatctccgggcacgagattattcagcgtatccggtcacgtaaaaaaaccgggcgtttacgaaatcgaattaggaactcctttattagaattagtgaatgatctttgtggtggaatcatagacgataaacctctcaaggcgatcattccgggaggatcctccgttccgattctcaccgcggaagaatgtaaaaccgcaaatatggattttgaatccatggccgctcataaaaccatgctcggctctggagcggtaatcgttcttgcggaaggaactgacattgtagaaaccacgtatcgattcgcccgtttttacgcacacgaatcctgcggtcagtgcactccttgtagagaaggaacacattgggtcagggacattctctataaaattagagaaggagaaggaacaaccgaagacatagatctgattttttctttatccagaaatatggaaggaggaaccacgatctgtccactttcagacgcttgtgtaggagcggtccgaccagcgttacaaaagttccgctccgagtttgacgcaaaattgaaagtaaaaccgatcgtacccgatcatcctcgaagaagaaaagaagataagatcgagtcgactgcaggagaaaagacaagtccatga

SEQ ID NO: 39137 - protein, 443 aa, Leptospira interrogans serovar Lai str. 56601
MAEMKLLTKYIDNPQSTKLEFYESVHGYDGMKKALQMKPDDIIAEVKKSGLRGRGGAGFPTGLKWSFIPKDIPKPKYIICNADEGEPGTFKDRKLIENLPHQIIEGMIIGARAIGSNKGFFYIRGEFQKGAKAMQAAIDEAYSKGYLGKNILGSGFDFDLILYEGAGAYICGEETALINSLEGRRGHPRLKPPFPAVSGLYRSPTVVNNVETFSAIPHILDKGADWYSKIGTEKSPGTRLFSVSGHVKKPGVYEIELGTPLLELVNDLCGGIIDDKPLKAIIPGGSSVPILTAEECKTANMDFESMAAHKTMLGSGAVIVLAEGTDIVETTYRFARFYAHESCGQCTPCREGTHWVRDILYKIREGEGTTEDIDLIFSLSRNMEGGTTICPLSDACVGAVRPALQKFRSEFDAKLKVKPIVPDHPRRRKEDKIESTAGEKTSP

SEQ ID NO: 39138 - DNA, 1386 bp, Shewanella oneidensis MR-1
  CDS (1)..(1386): transl_table=11
atgagcctaccacagagcaaagttctcacctcctttggcaccgccaaccgtacgccacgcgcggccgaaacccatccgctcacttggcggctacgggacgacggccagccagtgtggctagaggaatatcaaaccaagcaaggctatgacgccgtgcgcaaggcgctgggccagatgagtccggacgagattgtcagcacagtcaaagatgccgggcttaagggccgcggcggcgcgggcttccccactggtgttaagtggggactgatgcccaaagatgagagcatgaacatccgttacctgctctgcaacgccgatgagatggagcctaacacctggaaagacaggctactgatggagcagctaccccatctgttgatcgaggggatgatcatctccgccaaggctctcaaggcctatcgcggctacatcttcctgcgtggcgagtacgtggatgccgccatcaacctgcgccgggccgtagaagaggccaaggccgcgggcctgctcggtaagaacattctcggctcgggttttgacttcgagttgttcgtccataccggcgctggccgctacatctgcggagaagagacggcgctgattaactccctagaagggcgccgcgccaacccgcgcgccaagccccccttccccgccgtttccggcgtttggggcaaacccacctgcgttaacaacgtcgagaccctgtgcaacgtacccgccattatcggcaatggtgtggcttggtatcacaccctggcgctaccgggctcagaagatcacggcactaagctgatggggttttccggcaaggtcaacaaccctggcgtgtgggagctgccctttggcatcaccgcccgtgagctatttgaaggctatgccggcggcatgagaagcggttatcgcctgaaagcctggcaaccgggcggcgcaggtaccggctttttgctgcccgagcacctcgatgcccagatgtacacagcaggcataggtaaggtcggcacccgcatgggcacgggccttgcgatggcggtggatgattccatcagcatggtgagtttgctgcgcaatatggaagaattttttgcccgcgaatcctgcggctggtgtacgccttgccgtgacggtctgccttggagcgtcaagctgctgcgatcccttgagcgcggtgaagggcaagagggcgatttagcaacgctcgagcagctttgcaatttcctcggccccggcaagaccttctgcgcccacgccccgggcgccgttgagccgcttgccagcgccattaaatatttccgctccgagtttgaggccgggatcaagggcagcggtgataaccgcaagtccattaaagggatccagcccaatctgctgggcgagcgctggtaa

SEQ ID NO: 39139 - protein, 461 aa, Shewanella oneidensis MR-1
MSLPQSKVLTSFGTANRTPRAAETHPLTWRLRDDGQPVWLEEYQTKQGYDAVRKALGQMSPDEIVSTVKDAGLKGRGGAGFPTGVKWGLMPKDESMNIRYLLCNADEMEPNTWKDRLLMEQLPHLLIEGMIISAKALKAYRGYIFLRGEYVDAAINLRRAVEEAKAAGLLGKNILGSGFDFELFVHTGAGRYICGEETALINSLEGRRANPRAKPPFPAVSGVWGKPTCVNNVETLCNVPAIIGNGVAWYHTLALPGSEDHGTKLMGFSGKVNNPGVWELPFGITARELFEGYAGGMRSGYRLKAWQPGGAGTGFLLPEHLDAQMYTAGIGKVGTRMGTGLAMAVDDSISMVSLLRNMEEFFARESCGWCTPCRDGLPWSVKLLRSLERGEGQEGDLATLEQLCNFLGPGKTFCAHAPGAVEPLASAIKYFRSEFEAGIKGSGDNRKSIKGIQPNLLGERW

SEQ ID NO: 39140 - DNA, 1446 bp, Drosophila melanogaster
  CDS (1)..(1446)
atgttgcggcagaagcttaaaaactatttaccgtctgtttgggaacagcaactgcgtctcgtccaaactgccaagaaagcgggaggtagcaaaaagctgggtcccgataggcctcccattatcgatccgcccaagggatatgagcccaattgcaagaccaaatttggtccgctggacgattgtgatcgtgtgtttcagaatctctatggacgccacgattggcgcttgcatggagcatgccaacgtggggattggcatcgcaccgctgagttgctggagcagggtcccgaatggatcatgaagcaggtaagcaagagtggattgcgcggacggggaggagctggcttctatgccggactgaagtgggaatttctacgccagaccaagtccgagaaggtgcccaaaatggtcatcgtgaactgtgcagagggagagcccggaacctgcaaggaccgtgatatcctgcgacatgaaccccacaaactgatagaaggtatccttctggtaggtgtggccatgggatgcggtagagccattgtgtacattcgaaatcgcttctacaacgaggcctgcaacctgcactttgccttggcggaggcctatcatcatggtttgttgggaaacagtgtctgtggcacgggcatcaaattcgatgtgatggtccagcgtggagatcgttacttatgtggcgaggaaaccgccatgatcaactgtttgatgggtaaactgggaagaccacgacgtcgtccgcccttccttacggaaaagggctacttcgagcatccctgtttggtgatcaatgccgagtcgattgcagtagtgcccacaattctgcgaagaggttcccagtggtgggctggattgggtcgcagttacaacacgggaaccaaactttactgtctcagcggtcaggtgaataatccctgcactgtggaggaagagatgtccatacccctgaaagaccttatagaacgacatgctggtggagtaaaaggtggttgggacaatctcgcagcagtatttccaggtggtttgtccacaccattgttggatccatcaacagccggaaaggttctcatggatttcgatagtttgacggatgcaggcagtggtttcgggtgcggagcggttattgtgatgaccaaggactgtgatcctctggcaataatgttgcgatcaattcagtttttcgagaagcacacttgcaaacagtgctcctattgtcgcgatggtgccatatggctgccggagatattcgcccgctttgttaagggtcagacacatccccacgagatcgattggacgctggtcattgccgataaaatgaggaatagtaagcccatttgcgcactcgcttatagccaagtcagcgtggccgagagtttggttcgaatgtttagccggaagatcgaggaacgccttttaaaatatgccaagggttcttaa

SEQ ID NO: 39141 - protein, 481 aa, Drosophila melanogaster
MLRQKLKNYLPSVWEQQLRLVQTAKKAGGSKKLGPDRPPIIDPPKGYEPNCKTKFGPLDDCDRVFQNLYGRHDWRLHGACQRGDWHRTAELLEQGPEWIMKQVSKSGLRGRGGAGFYAGLKWEFLRQTKSEKVPKMVIVNCAEGEPGTCKDRDILRHEPHKLIEGILLVGVAMGCGRAIVYIRNRFYNEACNLHFALAEAYHHGLLGNSVCGTGIKFDVMVQRGDRYLCGEETAMINCLMGKLGRPRRRPPFLTEKGYFEHPCLVINAESIAVVPTILRRGSQWWAGLGRSYNTGTKLYCLSGQVNNPCTVEEEMSIPLKDLIERHAGGVKGGWDNLAAVFPGGLSTPLLDPSTAGKVLMDFDSLTDAGSGFGCGAVIVMTKDCDPLAIMLRSIQFFEKHTCKQCSYCRDGAIWLPEIFARFVKGQTHPHEIDWTLVIADKMRNSKPICALAYSQVSVAESLVRMFSRKIEERLLKYAKGS

SEQ ID NO: 39142 - DNA, 1578 bp, Pseudomonas putida KT2440
  CDS (1)..(1578): transl_table=11
ttgccgggaggactcagcatgctgaagctgtatattccctgtgattcggtagcccgtgccgtgggtgccgaccaggttgccgaggccctgctgcgcgaggccgagcgccgccagttgccgctggacatccagcgcaccagctcgcgtgggctttactggctggagccgctgatcgagtgcgacagtgcgcaagggcgcctgggtttcggcccgattacgccacacgatgtgccatcactgcttgatgccctggcgggcgaacccggtggccactcgctggcactggggccggtcgaagaaataccctatctcaagacccagcaacgcttgctgttcgctcgcgctggcattacccgcccattgtcgctggacgactatcgcgccaacggcggtttcgcaggcctggaggccgctgtggcgctggacggtgccgaagtggttgccgcagtactcgactccggcctgcgtggccgtggtggtgcggcgttcccggccggcatcaagtggcgtaccgtgcgtgatgctggcgccgggcagaagtacgtggtgtgcaacgccgacgagggtgactcgggcacgttcgctgatcgcatgctgatggaaggcgaccccttcctgctgatcgagggcatgatcattgccggcctcgccgtgggtgccgacaagggctatatctatgtgcgctcggagtatcccgatgccatccgggtactcgaccaggccttcgccatcgcacgtgacgctggctacctgggtgctgacgtagccggcagcggccaggcgttcgacctggaggtgcgggtgggcgccggtgcctatatttgcggcgaagaaaccgcgctgctcgaatccatcgaaggcaagcgtggcatcgtccgcgccaagccaccgctgcctgcgctgcaagggcttttcggcctgccgacgctggtgcacaacgtgcttaccctggcttcggtgcccatcattctggccaagggtgcagcgttctatcgcgatttcgggatgggtcgctcgctgggcaccatgccgttccagctggccggcaacattcgccagggtggccttgtcgagcgcgcgttcggcctgaccctgcgcgagctggtggaaggctatggcggtggtacggccagtggccgcccgctgaaggccgcgcaggtcggtggcccgctcggtgcctgggtacctcccagccatttcgacaccccattggactatgaagcgtttgctgccgtgggcgcgatgctcggccacggcggtgtggtggtggccgacgatacgttgaacatggccagcatggcgcgtttcgccctgcagttctgtgccgaggagtcctgcggcaagtgcaccccgtgccgtatcggttccacccggggcatggaagtggtcgaccggctgatcgccagcagcgacatcaccgagcgccatgaccaggcgctgttgctgcgcgacctgtgcgacaccctgcagtacggttcgctgtgcgccatgggcggtatgactgcctatccggtggccagcgcgctcaagtacttccccgccgatttcgggctgaccaccacggaggccgcacagtga

SEQ ID NO: 39143 - protein, 525 aa, Pseudomonas putida KT2440
MPGGLSMLKLYIPCDSVARAVGADQVAEALLREAERRQLPLDIQRTSSRGLYWLEPLIECDSAQGRLGFGPITPHDVPSLLDALAGEPGGHSLALGPVEEIPYLKTQQRLLFARAGITRPLSLDDYRANGGFAGLEAAVALDGAEVVAAVLDSGLRGRGGAAFPAGIKWRTVRDAGAGQKYVVCNADEGDSGTFADRMLMEGDPFLLIEGMIIAGLAVGADKGYIYVRSEYPDAIRVLDQAFAIARDAGYLGADVAGSGQAFDLEVRVGAGAYICGEETALLESIEGKRGIVRAKPPLPALQGLFGLPTLVHNVLTLASVPIILAKGAAFYRDFGMGRSLGTMPFQLAGNIRQGGLVERAFGLTLRELVEGYGGGTASGRPLKAAQVGGPLGAWVPPSHFDTPLDYEAFAAVGAMLGHGGVVVADDTLNMASMARFALQFCAEESCGKCTPCRIGSTRGMEVVDRLIASSDITERHDQALLLRDLCDTLQYGSLCAMGGMTAYPVASALKYFPADFGLTTTEAAQ

SEQ ID NO: 39144 - DNA, 1362 bp, Pseudomonas putida KT2440
  CDS (1)..(1362): transl_table=11
atgaccattacttccttcggcccggccaaccgcatcgcgcgctcggccgaaacccacccgctgacctggcgcctgcgtgacgacggcgagccggtctggctggccgagtacgaatcgaagaacggctacgccgcagcccgcaaggcgctggcgcaaatgtccgccgacgacatcgtgcagagcgtcaaggactccggcctcaaaggccgtggcggtgcaggtttccccactggcgtgaagtggggcctgatgcccaaagacgaatccatgaacatccgctacctgctgtgcaacgcggacgaaatggagccgaacacctggaaggaccgcatgctgatggagcaacagccccatctgctggtcgagggcatgctgatcagcgcccgcgccctgaaggcctaccgcggctacatcttcctgcgtggcgagtacaccaccgcagcgaaaaacctcaaccgcgccatcgatgaagccaaggccgccggcctgctgggcaagaacatcctgggcagcggtttcgatttcgagctgttcgtgcacaccggtgcaggccgctacatctgcggtgaagaaaccgcgctgatcaactcgctggaaggccgccgcgccaacccgcgctccaagccgcccttccctgccgccgttggcgtgtggggcaagccgacgtgcgtgaacaacgtcgagaccctgtgcaacgtcccggccatcgtcgccaacggcaacgactggtacaagtcgctggcccgcgaaggcagcgaggaccacggcaccaagctgatgggcttctccggcaaggtgaagaacccaggcctgtgggaactgccatttggcgttaccgcccgcgaattgttcgaagactacgccggtggcatgcgcgatggcttcaagctcaagtgctggcagccaggcggcgccggtaccggcttcctgctgcctgagcacctcgatgcgcaaatgtacgccggtggcatcgccaaggtcggcacccgtatgggtactggcctggccatggcggtcgacgacagcatcaacatggtgtcgctgctgcgcaacatggaagagttctttgcccgcgaatcgtgcggctggtgcaccccatgccgtgacggcctgccgtggagcgtgaagatgctgcgcgcgctggaaaacggccaaggccgcgccgaggacatcgagacgctgctggggctggtcaacttcctcggcccgggccgtaccttctgtgctcacgcaccgggtgccgtcgagccgctgggcagtgccatcaaatacttccgctcggagttcgaggccggcgtggcgccagaaagcgctgccaccctgcgccccgacctggcgaagccgatcgtggtcggcgcataa

SEQ ID NO: 39145 - protein, 453 aa, Pseudomonas putida KT2440
MTITSFGPANRIARSAETHPLTWRLRDDGEPVWLAEYESKNGYAAARKALAQMSADDIVQSVKDSGLKGRGGAGFPTGVKWGLMPKDESMNIRYLLCNADEMEPNTWKDRMLMEQQPHLLVEGMLISARALKAYRGYIFLRGEYTTAAKNLNRAIDEAKAAGLLGKNILGSGFDFELFVHTGAGRYICGEETALINSLEGRRANPRSKPPFPAAVGVWGKPTCVNNVETLCNVPAIVANGNDWYKSLAREGSEDHGTKLMGFSGKVKNPGLWELPFGVTARELFEDYAGGMRDGFKLKCWQPGGAGTGFLLPEHLDAQMYAGGIAKVGTRMGTGLAMAVDDSINMVSLLRNMEEFFARESCGWCTPCRDGLPWSVKMLRALENGQGRAEDIETLLGLVNFLGPGRTFCAHAPGAVEPLGSAIKYFRSEFEAGVAPESAATLRPDLAKPIVVGA

SEQ ID NO: 39146 - DNA, 1704 bp, Bradyrhizobium japonicum USDA 110
  CDS (1)..(1704): transl_table=11
atgagccatgacgtgcacgaggtccgctcgttcgaacatccgggcgaggggcggaagcgagccaaggccacgcccaaggggcggcaggtcgatcccaccgccgcacacgagatcgagcagctgctcggcgatcgcccgcggcggcgcgacctcctgatcgaatatctccacctgatccaggacaaatatcaccagatctcggcggcgcatcttgcggccctcgccgacgagatgaagctcgccttcgccgaggtgttcgagaccgcgaccttctacgcgcatttcgacatcgtgaaggaaggtgagcctgatatcgcgccgctgacgatccgcgtctgcgattcgttgacctgtgagatgctcggcggtgggcagctgttgcaggatctccagcgcagcgccggtcccggtattcgcgtcgtacgcgcgccctgtgtcggattgtgcgacgcggccccggtcgcggaagtcggccatcatttcgtgcatcaggctacggccgccgaggtgctggccacggcagcgcgcggcgacgttcacgcgcacattcctgcttatgtcgactacgacgcctatgtgcaggacggcggatacaagctgctggagcggctgcgctccggggcggtcagcaaggacgatatcctcaggcttctcgaggattccagcctgcgtggtctcggcggcgcgggcttcccgacgggacgcaaatggcgcgcggtgcttggcgagcccggcccgcggctgatggcggtcaacggcgacgagggcgagccgggcaccttcaaggaccgcgtctacctcaacaacgacccgcatcgcttcatcgagggcaccctgatcggtgcgcatatcgttgaggcgtccgacgtctacatctacatccgcgacgaatatccggccgcacgcgagatcctggagcgcgagatcgcaaagctgccgccgggcggcccgacgttgcacatgcgccgcggcgccggcgcctacatctgcggcgaggaatcttcgctgctcgagagcatcgagggcaagcgcggcctgccccggcacaagccgccttatccgttccaggtcggcctgttcggactgccgacgctgatcaacaacgtcgagacgctgtggtgggtgcgcgacatcgtcgagaagggcgccgactggtggaagggccacggccgccacgagcgtcatggcctgcgcagcttctcggtctccggccgcgtgaagaatcccggcatgaagctcgcgccgtcaggcatcaccgtgcgcgagttgatcgacgaatattgcggcggcatggccgacggccacaccttctacgcttatcttccgggtggcgcctcgggcggcatcctgccggcgtcgatggacgacatcccgctcgatttcggtacgctggagaaatacggctgcttcatcggctcggccgcgatcgtgatcctgtcgcagaaggacagcgtgcgagcagcggccctgaacctgatgaaattcttcgaggacgagagctgcggccagtgcacgccgtgccgcgttggaacccagaaggcggcgctgctgatgcagaagccagtctggaaccgcgcgttgctggaagaattgagccaggcgatgcgcgatgcctcgatctgcgggctcgggcaggcggcatcgaatccgcttaccaccgtgatcaaatatttccctgacgagttcaaggaagcggccgaatga

SEQ ID NO: 39147 - protein, 567 aa, Bradyrhizobium japonicum USDA 110
MSHDVHEVRSFEHPGEGRKRAKATPKGRQVDPTAAHEIEQLLGDRPRRRDLLIEYLHLIQDKYHQISAAHLAALADEMKLAFAEVFETATFYAHFDIVKEGEPDIAPLTIRVCDSLTCEMLGGGQLLQDLQRSAGPGIRVVRAPCVGLCDAAPVAEVGHHFVHQATAAEVLATAARGDVHAHIPAYVDYDAYVQDGGYKLLERLRSGAVSKDDILRLLEDSSLRGLGGAGFPTGRKWRAVLGEPGPRLMAVNGDEGEPGTFKDRVYLNNDPHRFIEGTLIGAHIVEASDVYIYIRDEYPAAREILEREIAKLPPGGPTLHMRRGAGAYICGEESSLLESIEGKRGLPRHKPPYPFQVGLFGLPTLINNVETLWWVRDIVEKGADWWKGHGRHERHGLRSFSVSGRVKNPGMKLAPSGITVRELIDEYCGGMADGHTFYAYLPGGASGGILPASMDDIPLDFGTLEKYGCFIGSAAIVILSQKDSVRAAALNLMKFFEDESCGQCTPCRVGTQKAALLMQKPVWNRALLEELSQAMRDASICGLGQAASNPLTTVIKYFPDEFKEAAE

SEQ ID NO: 39148 - DNA, 1557 bp, Bradyrhizobium japonicum USDA 110
  CDS (1)..(1557): transl_table=11
atgagcatgcgtctcttcgtctcacgcgacgcgggtgcgttggccgtcggcgccgacgaggttgcgctggcgctggaacaggctgcggccaagcgcggcgtcgccgtcgagatcatcaggaccggctcgcggggcatgtactggctggagccgctggtcgaggtcgcgacgccgcagggccggatcgcgttcggcccggtcaccgagaccgatgtaccctccctgctcgacgccctcgccagcaatacgccgcatctgctgcggttaggggcgaccgacgagattccctggctgaagcgccagacccgcctcaccttcgcccgctgcggcgtgatcgatccgcgctcgctcgaggactaccgcgcccacggtggctacaaagggctggagcgcgcgctgtcgctcggctcggaggccatcctcaccgaggtcaccgcatcgggcctgcgcggccgcggcggcgcgggctttccgaccggcatcaaatggaagacggttgcccaggccaaggccgaccgcaagttcatcgtctgcaacgccgacgaaggcgacagcggtaccttcgccgaccgcatgatcatggaaggcgatcccttcctggtgatcgagggcatgaccaccgccggcatcaccgtcggcgcgaccaagggctacatctacattcgcagcgaatatccgcacgcggtcgaggcgatgaaggccgcgatccaggctgcgaagcgcggcggttatctcggcgacaagatcggcggctcgacctacagcttcgacctcgaagtccgcgtcggcgccggagcctatgtctgcggcgaggaaacgtcgctgctggagagcctcgaaggccgccgcggcatcgtgcgcgccaagccgcccctgccggcccatcacggcctgttcggcaagccgaccgtgatcaacaacgtgctgtcgttcgcggcgatccccttcatcctcgccgaaggcgccaaggcctatgccgatttcggcatgggccgctcgcgcggcacgatgccgatccagctcgccggcaatatccgccatggcggcctgtacgagaccgccttcggcgtgacgctgggcgagcttgtcgacgacatcggcggcggcacgttcacgggccgcccggtccgtgcggtgcaggtcggcgggccccttggcgcttacttcccccgcgcgctgttcgacacgccgttcgactacgaggcctttgctgcgcgtgacgggctgatcggccacggcggcatcgtcgtgttcgacgacagcgtcgacatgcgcaggcaggcgcgcttcgcgatggaattctgcgccgtcgaatcctgcggcaagtgcacgccctgccggatcggctcgacccgcggcgtcgagaccatcgagaagatcatcaacggcgaacgcgtcagcgaaaacctcgcgctcgtcgaagacctctgcaacaccatgaaattcggctcgctctgcgcgctcggcggcttcacgccctatcctgtgctcagcgcattgaagcacttccgggaggacttcgtcccggcgccgaccacgcttcaggccgcggaatag

SEQ ID NO: 39149 - protein, 518 aa, Bradyrhizobium japonicum USDA 110
MSMRLFVSRDAGALAVGADEVALALEQAAAKRGVAVEIIRTGSRGMYWLEPLVEVATPQGRIAFGPVTETDVPSLLDALASNTPHLLRLGATDEIPWLKRQTRLTFARCGVIDPRSLEDYRAHGGYKGLERALSLGSEAILTEVTASGLRGRGGAGFPTGIKWKTVAQAKADRKFIVCNADEGDSGTFADRMIMEGDPFLVIEGMTTAGITVGATKGYIYIRSEYPHAVEAMKAAIQAAKRGGYLGDKIGGSTYSFDLEVRVGAGAYVCGEETSLLESLEGRRGIVRAKPPLPAHHGLFGKPTVINNVLSFAAIPFILAEGAKAYADFGMGRSRGTMPIQLAGNIRHGGLYETAFGVTLGELVDDIGGGTFTGRPVRAVQVGGPLGAYFPRALFDTPFDYEAFAARDGLIGHGGIVVFDDSVDMRRQARFAMEFCAVESCGKCTPCRIGSTRGVETIEKIINGERVSENLALVEDLCNTMKFGSLCALGGFTPYPVLSALKHFREDFVPAPTTLQAAE

SEQ ID NO: 39150 - DNA, 1326 bp, Bradyrhizobium japonicum USDA 110
  CDS (1)..(1326): transl_table=11
atgctcgaggacaaggaccgcatcttcaagaacctctacggcctccatgactgggggctcgagggtgcgcggcgccgcggcgcctgggatggtacgaagaacatcatcgacaagggccgcgactggatcatcaacgagatgaaggcctcgggcctgcgcggccgcggcggcgccggcttcccgaccggcctgaaatggtccttcatgccgaaggaatcgaccgacggccggccgagctatctcgtcgtcaacgccgacgaatccgagcccggcacctgcaaggatcgcgagatcatgcggcacgacccgcatctcctgatcgagggctgcctgatcgccagctgcgcgatgaacgcgcatgcctgctacatctatgtccgcggcgagttcatccgcgagcgcgagcatctccaggccgcgatcgaccaggcctacgaggccaagctggtcggcaaggacaatgtcaacggatggccgttcgacatctacgtcgcgcacggcgccggcgcctatatctgcggtgaggagaccgcgctgctcgaaagcctcgagggcaagaagggccagccgcgcctgaagccgccgttcccggcgaatgtcggcctgttcggctgcccgaccaccgtcaacaacgtcgagtcgatcgcggtggcgccggatatcctgcgccgtggcgcggcgtggttcgccggcatcggccgtccgaacaatgtcggcaccaagctgttctgcatctccggccatgtcgagcggccctgcaacgtcgaagaagccatgggcattccgttccgcgagctgatcgagaagcattgcggcggcatccgcggcggctgggacaacctcaaggccgtgatccccggcggctcgtcggtgcgcatggtgccggccgagcagatcatcgatacgccgatggatttcgacagcctgagcaagctgcgctcgggtctcggcaccgcggccgtgatcgtgatggacaagtccaccgatttgatccgcgccatcgcccgcatctcgtacttctacaagcatgagagctgtggccagtgcacgccgtgccgcgagggcacggggtggatgtggcgcgtcctgacccgcatggccgaaggccgcgcccacaagcgcgagatcgacatgctgctggaggtcaccaagcaggtcgaaggccacaccatctgcgcgctcggcgacgcagccgcctggccgatccagggcctgatcgcgcatttccgtcatgagatcgaagcgcgcatcgaccagtattcgcataagtccgacatcgacgatatcggcgtccgcgatcccgtgaacatggtcgcggcggagtaa

SEQ ID NO: 39151 - protein, 441 aa, Bradyrhizobium japonicum USDA 110
MLEDKDRIFKNLYGLHDWGLEGARRRGAWDGTKNIIDKGRDWIINEMKASGLRGRGGAGFPTGLKWSFMPKESTDGRPSYLVVNADESEPGTCKDREIMRHDPHLLIEGCLIASCAMNAHACYIYVRGEFIREREHLQAAIDQAYEAKLVGKDNVNGWPFDIYVAHGAGAYICGEETALLESLEGKKGQPRLKPPFPANVGLFGCPTTVNNVESIAVAPDILRRGAAWFAGIGRPNNVGTKLFCISGHVERPCNVEEAMGIPFRELIEKHCGGIRGGWDNLKAVIPGGSSVRMVPAEQIIDTPMDFDSLSKLRSGLGTAAVIVMDKSTDLIRAIARISYFYKHESCGQCTPCREGTGWMWRVLTRMAEGRAHKREIDMLLEVTKQVEGHTICALGDAAAWPIQGLIAHFRHEIEARIDQYSHKSDIDDIGVRDPVNMVAAE

SEQ ID NO: 39152 - DNA, 1395 bp, Bos taurus
  CDS (1)..(1395)
atgctggcggcacggcggctgctcggcgggtcgctccccgcgcgggtgtctgtgcgattcagcggcgacacgacagcgcccaagaaaacctcatttggctcgctgaaggacgaagaccggatcttcaccaacctgtatggccgccatgactggaggcttaaaggtgcccagagtcgaggtgactggtacaagacgaaggagattctgctgaaggggcctgactggatcctgggtgaggtcaagacgtcgggcttgcggggccgtggaggtgctggcttccccactggccttaaatggagcttcatgaataagccctcagatggcaggcccaagtatctggtggtgaacgcggatgagggggagccaggcacgtgcaaggaccgagagatcatccgccacgacccccacaagctggtggaaggctgcctagtagggggccgggccatgggcgctcgtgccgcctacatctacatccgcggggagttctacaacgaggcctccaatctgcaggtagccatccgagaggcctacgaggctggtctgattggcaagaatgcctgcggctccggctacgatttcgacgtgtttgtggtgcgtggggccggggcctacatctgcggggaggagacggcgctcatcgagtccatcgagggcaaacagggcaagccccgcctgaagccgcctttccctgcagacgtgggagtgtttggctgccctacaactgtggccaatgtggagactgtggccgtgtcccctaccatctgccgccgtgggggtgcctggtttgccagcttcggccgagagcgcaactcaggcaccaaactgttcaacatctctggccacgtcaacaacccctgcaccgtggaggaggagatgtctgtgccgctgaaggagctgattgaaaagcacgccgggggtgtcacgggtggctgggacaacctccttgctgtgatccctggcggctcgtccaccccgctgatccccaagtccgtgtgtgagacggtgctgatggacttcgacgcgctgatccaggcgcagacggggctgggcacggctgccgtgatcgtcatggaccgctcgacggacattgtgaaagccatcgcccgcctcatcgagttctacaagcatgagagctgtggccagtgtaccccgtgccgcgagggtgtggactggatgaacaaggtgatggcccgctttgtgaggggagatgcccggccggcagagatcgactctctgtgtgagatcagcaagcagatcgagggccacaccatctgcgccctgggcgatggggctgcgtggcccgtgcagggcctgatccgacacttccggccggagctcgaggagcggatgcagcagtttgcccagcagcaccaggccaggcaagcagctttctga

SEQ ID NO: 39153 - protein, 464 aa, Bos taurus
MLAARRLLGGSLPARVSVRFSGDTTAPKKTSFGSLKDEDRIFTNLYGRHDWRLKGAQSRGDWYKTKEILLKGPDWILGEVKTSGLRGRGGAGFPTGLKWSFMNKPSDGRPKYLVVNADEGEPGTCKDREIIRHDPHKLVEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGAWFASFGRERNSGTKLFNISGHVNNPCTVEEEMSVPLKELIEKHAGGVTGGWDNLLAVIPGGSSTPLIPKSVCETVLMDFDALIQAQTGLGTAAVIVMDRSTDIVKAIARLIEFYKHESCGQCTPCREGVDWMNKVMARFVRGDARPAEIDSLCEISKQIEGHTICALGDGAAWPVQGLIRHFRPELEERMQQFAQQHQARQAAF

SEQ ID NO: 39154 - DNA, 1335 bp, Xylella fastidiosa Temecula1
  CDS (1)..(1335): transl_table=11
atgggacatcctcacgtatccaagggaccggttggcccggcacctcagccgcaccaagtgatctataccacgttgcattatgaaattccttggtcgtatgaaagctatttgaagaccggcggctacactgcgttacgcaagatttttgaggaaaagatccctccggagcaggtcatagacatggtcaagcagtcgaatctgcggggtcgtggtggtgcaggttttccgacgggtctcaaatggtccttcatgccgaagggcaccatgcaaaaatatattctgtgtaactcggacgagtccgaaccgggaacctgtaaagatcgtgacatcctgcgctataacccgcattccgtggtggaggggatggcgattgcatgttatgccactggttccactgtggcttacaactatttgcgtggggagttccaccacgagccgttcgaacattttgaacaggcgctggccgatgcttacacacatggttggcttggtaagagcgttttgggaagtggcgtagatatcgatatctatgcggtgcttggtgctggtgcctacatctgtggtgaagagactgcgctcatggagtctctggaaggcaagaaggggcagcctcgctacaagcccccctttcctgccaattttggcttgtacggcaagccatcaacgatcaacaacactgagacgtatgccgcagtgccagccattattcgcaatggtccggagtggtttttgtctctgagcaagactaaaaacggtggctctaagatcttctccgtctcggggtgcgtgcagcaagggggtaacttcgaggtacccttaggcaccacctttgatgaattgctggagatggctggtggcctgcggccaggtcgcgctctgaaagctgcaattccggggggagtatccatgccggtattgaaagccgagcagttgcagggccttcagatggactacgacacactgcgtgtgctgggtagcggtttaggctcgggggggattgttgtgcttgatgacagtgtctgttgtgtccgttttgcctgccgcatctcgcagttttttcataaggaatcgtgtggccagtgtactccgtgccgtgaggggaccggttggatgcaccgcgttttggagcgtatcgttgctggccaggccacgatggaggatctgcaccagcttaaagttgtggcggggcagattgaggggcataccatttgtgcgtttggtgaagctgcagcttggccaatccaagggttcctgcgccaattctgggatgaatttgagtactacattgttcatggtcggtcgattgtggatgacaaggcgagagtggctgcatga

SEQ ID NO: 39155 - protein, 444 aa, Xylella fastidiosa Temecula1
MGHPHVSKGPVGPAPQPHQVIYTTLHYEIPWSYESYLKTGGYTALRKIFEEKIPPEQVIDMVKQSNLRGRGGAGFPTGLKWSFMPKGTMQKYILCNSDESEPGTCKDRDILRYNPHSVVEGMAIACYATGSTVAYNYLRGEFHHEPFEHFEQALADAYTHGWLGKSVLGSGVDIDIYAVLGAGAYICGEETALMESLEGKKGQPRYKPPFPANFGLYGKPSTINNTETYAAVPAIIRNGPEWFLSLSKTKNGGSKIFSVSGCVQQGGNFEVPLGTTFDELLEMAGGLRPGRALKAAIPGGVSMPVLKAEQLQGLQMDYDTLRVLGSGLGSGGIVVLDDSVCCVRFACRISQFFHKESCGQCTPCREGTGWMHRVLERIVAGQATMEDLHQLKVVAGQIEGHTICAFGEAAAWPIQGFLRQFWDEFEYYIVHGRSIVDDKARVAA

SEQ ID NO: 39156 - DNA, 1359 bp, Pseudomonas syringae pv. tomato str. DC3000
  CDS (1)..(1359): transl_table=11
atgaccatcacgtccttcggccctgccaaccgcattgcgcgcacggcagaaacccatccgctgacctggcgtttgcgcgatgacggcgagccggtctggctcgacgagtatcagaccaaagacggctatgcggcggcgcgcaaggcgctgacccagcaggcccctgacgatatcgtccagtcggtcaaggactccggcctcaagggtcgcggcggtgcgggcttccccaccggcgtgaagtggggcctgatgcccaaagacgaatccatgaacatccgctacctgctatgcaacgcggacgagatggagcccaacacctggaaagaccgcatgttgatggagcaactgccccatctgctgattgagggcatgctgatcagtgcccgcgccctgaaagcctatcgcggctatatcttcctgcgtggcgaatacgtgacggcagcgaagcacttgaaccgtgccgtggctgaagccaaggccgccggtttgctgggcaagaacattcttggcaccggcttcgatttcgagctgttcgtgcacaccggcgccggtcgttacatctgcggtgaagaaaccgcactgatcaactcgctggaaggtcgccgcgccaacccccgctccaagccgcccttccctgctgcggtaggcgtgtggggcaagccgacctgtgtcaacaacgtcgaaaccctgtgcaacgtgccggccatcgtcaacaacggcaacgactggtacaagtcgctggctcgcgaaggcagtgaagatcacggcaccaagctgatgggcttctccggcaaggtgaaaaaccctggcctgtgggagctgccgtttggtgttcaggcccgcgaactgttcgaagactacgccggtggcatgcgcgacggcttcacactcaagtgctggcagcccggtggtgcagggactggtttcctgttgccggagcacctggacgcgcagatgtacgcaggcggtatcgccaaggttggcacccggatgggcacaggcctggcaatggccgtcgacgactcggtcaacatggtatcgctgctgcgcaacatggaagagttcttcgctcaggagtcctgtggcttctgcaccccatgtcgcgatggcctgccatggagcgtgaaaatactgcgtgccatcgagaacggtcacggccagccgggtgatatcgaaaccctgctcggcctagtcaacttcctcggccctggcaagacgttctgtgctcatgcaccaggtgccgttgaaccgttgggcagtgcgatcaagtatttccgttcggagttcgaagccggtattgcgcccgccagcgcagccatgcttgttccgggtaaaagtccgaccgtggtcggcgcataa

SEQ ID NO: 39157 - protein, 452 aa, Pseudomonas syringae pv. tomato str. DC3000
MTITSFGPANRIARTAETHPLTWRLRDDGEPVWLDEYQTKDGYAAARKALTQQAPDDIVQSVKDSGLKGRGGAGFPTGVKWGLMPKDESMNIRYLLCNADEMEPNTWKDRMLMEQLPHLLIEGMLISARALKAYRGYIFLRGEYVTAAKHLNRAVAEAKAAGLLGKNILGTGFDFELFVHTGAGRYICGEETALINSLEGRRANPRSKPPFPAAVGVWGKPTCVNNVETLCNVPAIVNNGNDWYKSLAREGSEDHGTKLMGFSGKVKNPGLWELPFGVQARELFEDYAGGMRDGFTLKCWQPGGAGTGFLLPEHLDAQMYAGGIAKVGTRMGTGLAMAVDDSVNMVSLLRNMEEFFAQESCGFCTPCRDGLPWSVKILRAIENGHGQPGDIETLLGLVNFLGPGKTFCAHAPGAVEPLGSAIKYFRSEFEAGIAPASAAMLVPGKSPTVVGA

SEQ ID NO: 39158 - DNA, 1908 bp, Bacteroides thetaiotaomicron VPI-5482
  CDS (1)..(1908): transl_table=11
atgaaaatactatctatccatgatttgcaaataatcaggaagagagcggagcaccatctttcattgcgcgaagaaagtaatgaaaaggtttccgaaaaatgttgcgggctggcgtccggaacaacacacctccagattcttatttgcggaggtaccggttgtaaagcctcttccagtcagggcatcactgaaaatcttcaaaaagccatcgaaagaaacgggattaccgacaaagtagacgtcatcacagtaggctgcttcggcttctgcgaaaagggccccatcgtaaagatcattcctgacaatacgttctatacccaagtcactcccgaagatgcggaggaaatcatcagcgaacacatcatcggaggacgaagaatcgaacggctgctctacatagacccgaagaccgaacaaactgtcagtgactccaaacacatggacttctaccggaaacaactccgcatcgccttgcgcaactgcggattcatcgactccgaaaatatagaagaatacatcgcccgtgaaggatacttcgcactggccgactgccttctcaacaaacagcctgccgacgtcatcgacatcatcaaacgctccggactgcggggacgtggcggtggcggtttccccaccggcttgaaatgggaatttgccagtaagcaggtatcgaacgtaaagtacgttgtctgcaacgccgacgaaggcgaccccggcgccttcatggaccgctccatcatggaaggcgacccgcactctattgtagaagcgatgtgcatctgcggttactccatcggttcctccaaaggactggtctacatccgcgccgaatatccgctggccatcaaccgcctcaaaaaagcgattgagcaagcccgtgaatacggattactgggggaccacatcctggggacagatttcagcttcgacatagagatccgttacggagcaggcgcattcgtctgcggcgaggaaaccgccctcatccactcgatggaaggaaaacggggagagccgaccctgaaacctcctttccccgccgaatccggttatctgggcaaaccgaccaatgtgaacaatgtggaaaccctcgccaatattcccattatcctgaccaaaggcgccgaatggttcgcctccatcggaacagaacgctccaaaggcaccaaagtcttcgctcttgccggaaagatcaacaatgtcggactgatcgaagtaccgatgggaactaccctgcgggaagtaatctacgaaatcggcggaggcatcaagggaggaaagaaattcaaagccgtacagacaggcggtccgtcagggggctgtctgacggagaaacatctggatactcccattgacttcgacaacctgctggcagccggttccatgatgggatcgggaggcatgatcgtgatggacgaagatgactgtatggtatccgtcgcccgtttctatctcgactttaccgtcgaagaatcctgcggtaaatgtaccccatgccgtatcggcaacaaacgcctgctggaactgctgaacaagataacggaaggacggggcacggaaaaagacctggacacgcttgccaccctcggacgggtgataaaagacacggcactctgcggactgggacagacgtccccgaatccggtgttgtctaccctcgacaacttccgtgacgaatatctggaacatgtcagagacaagacctgccgcgccaaacaatgcaagtccctgctgacctataccattaatccggaactttgtatcggttgccacctgtgtgccaagaattgtccggcggatgccatcagcggcttggtacgcaaacctcatgtcatccaccccgagaaatgtatcaagtgcggcatgtgtatggcacgctgtaaattcaaagctattcttgtctgttaa

SEQ ID NO: 39159 - protein, 635 aa, Bacteroides thetaiotaomicron VPI-5482
MKILSIHDLQIIRKRAEHHLSLREESNEKVSEKCCGLASGTTHLQILICGGTGCKASSSQGITENLQKAIERNGITDKVDVITVGCFGFCEKGPIVKIIPDNTFYTQVTPEDAEEIISEHIIGGRRIERLLYIDPKTEQTVSDSKHMDFYRKQLRIALRNCGFIDSENIEEYIAREGYFALADCLLNKQPADVIDIIKRSGLRGRGGGGFPTGLKWEFASKQVSNVKYVVCNADEGDPGAFMDRSIMEGDPHSIVEAMCICGYSIGSSKGLVYIRAEYPLAINRLKKAIEQAREYGLLGDHILGTDFSFDIEIRYGAGAFVCGEETALIHSMEGKRGEPTLKPPFPAESGYLGKPTNVNNVETLANIPIILTKGAEWFASIGTERSKGTKVFALAGKINNVGLIEVPMGTTLREVIYEIGGGIKGGKKFKAVQTGGPSGGCLTEKHLDTPIDFDNLLAAGSMMGSGGMIVMDEDDCMVSVARFYLDFTVEESCGKCTPCRIGNKRLLELLNKITEGRGTEKDLDTLATLGRVIKDTALCGLGQTSPNPVLSTLDNFRDEYLEHVRDKTCRAKQCKSLLTYTINPELCIGCHLCAKNCPADAISGLVRKPHVIHPEKCIKCGMCMARCKFKAILVC

SEQ ID NO: 39160 - DNA, 1254 bp, Enterococcus faecalis V583
  CDS (1)..(1254): transl_table=11
atgcaatctgcgaccgatgttgctgaatattgtaaatacgatggatttgatggtttaaaaagagcaatttcactatcggatgaagaaattttaaacgaactggatattgcgcacttaagaggtcgcggtggagcagcctatcctttaggaaaaaaatggcgccatctttatcatgcaaaaggaaccacaaagtacattgtttgtaatgctgatgaaggcgaaccagggacctttaaggataaagtacttttatctgaagatccattgagtgtgattgaaggaatgattattgctggctatttattttcagcaaaagcaggttatatttatatgcgaggagaatatcgcagaatccaaaaaacatttcaagaagcactcgataatgcacgacaagctggctttttaggggaaaacattttaggaattgaaggattcaattatgatattacgattatttctggtgctggcgcctatatttgtggggaaaattcagcacttttaaattcaattgaaggaaaaacggggcggccgcgtgtcaaaccaccacacttagcagatgttggtttatatttgcaaccaacattagtaaataatgttgaatcatttgcaagtgttcctgtaattttaagagaaggtggacaagcctttttagagatgggtactgccgatggtggcggaacaaagctaatttgtttgtctggacatattaaaaatcggggcttatacgaggtcaaccttggaacaccattagaagaaataatttatggcgagcaatacggcggaggctctgcaactggtcgagcattgaaatttattcacttcggtggacaatccggtccaattggtgctgtcgcaacgttaagggattgtttgtattcctacgaagatttatgggcccatgacttatctgtcggctctggtgcaattgtagtaatggatgattcagttaatgttgtggactatttagtacacgtggcggccttttttgctcatgagtcctgtggtaaatgcaccccttgtcgattgggaacaactaggattttggaattattgagtaaattcaatcggaacgaggcaacagctagtgatttgccgcgattggaaaagatgctcacacatgtcacgcgattatcagcttgtggtttgggccaatccgtcgcaaatccaatgaagagtgcattggctttgtttccagaagaatttgaaacgactgctgaaacagaaatctatgccaccagcaaaggaggttggtaa

SEQ ID NO: 39161 - protein, 417 aa, Enterococcus faecalis V583
MQSATDVAEYCKYDGFDGLKRAISLSDEEILNELDIAHLRGRGGAAYPLGKKWRHLYHAKGTTKYIVCNADEGEPGTFKDKVLLSEDPLSVIEGMIIAGYLFSAKAGYIYMRGEYRRIQKTFQEALDNARQAGFLGENILGIEGFNYDITIISGAGAYICGENSALLNSIEGKTGRPRVKPPHLADVGLYLQPTLVNNVESFASVPVILREGGQAFLEMGTADGGGTKLICLSGHIKNRGLYEVNLGTPLEEIIYGEQYGGGSATGRALKFIHFGGQSGPIGAVATLRDCLYSYEDLWAHDLSVGSGAIVVMDDSVNVVDYLVHVAAFFAHESCGKCTPCRLGTTRILELLSKFNRNEATASDLPRLEKMLTHVTRLSACGLGQSVANPMKSALALFPEEFETTAETEIYATSKGGW

SEQ ID NO: 39162 - DNA, 1269 bp, Coxiella burnetii RSA 493
  CDS (1)..(1269): transl_table=11
atgctgactaatgcggtttgttatcgaacattgcatttagaaaaaccgtggacgctagaatcctacgaaagcgttggtggttatcaagtgttacgaaaaattttaaaagaaaaaacgccgccggaaaatatcattaatgaaattaaagaatcctcattgcgtggtcgcggcggcgctggatttcccaccggtttaaaatggagttttattccgcgcgataaacctggcgaaaaatacgtaatttgtaattccgatgaaagtgagccaggcacttttaaagaccgcgatattttacgatttaacccccaccaagtattagaaggcatcgctattgcctgttacacgcttggcgcgaccgtcggctataattttttgcgcggtgaattttgggagccgtttgatcgttgcgaacaagccttagcacaagcgcgcgaggcggggttgattggaaaaaatgttttaaactccggtgtggatattgaaatatttaatcattttagcgccggtgcctatatttgcggcgaagaaaccgcactcatgaattcattggaaggcaagcgcggctggccacgatttaagccgccttttccggctaattttgggttatatgaacgccccagtaatattaataataccgaaacgtatgcctccgtgccggttattttagaaaaaggtgggaaatggtttgcggatttaggtcctccaaaaaatggcggtacaaaaatattttccgtcagcggtcatgtggcaaaaccgggtaattatgaagttcccttgggaattcctttcgcggatttattagcattggctggcggaatgcgggaggggagcgagttaaaggctgtgattcccggtggaagttcgatgcccgtattgcctgccgaggtaatgatgaaagcgatcatgagctttgacggtttggttgaagcaggttcgatgctaggttctggcggcgtgatggtgatggatcaatcaacgtgcatggtgaaagtccttgagcgcatttcaaaattttatatgcacgaatcgtgcggccaatgcacgccttgccgtgaaggaacaggatggctttatcgattagttcatcgaattgaaaaaggcgaagggacgaaacgcgacatagaacagttaagcagagtcgcaaagggcatcgaaggccgcaccatttgtgcgtttggcgaggcggctgcatggcccgtcagcggaatgttgaaacatttttacgatgaatttgaataccatgtaacgcatgggaaatgtatggtgtaa

SEQ ID NO: 39163 - protein, 422 aa, Coxiella burnetii RSA 493
MLTNAVCYRTLHLEKPWTLESYESVGGYQVLRKILKEKTPPENIINEIKESSLRGRGGAGFPTGLKWSFIPRDKPGEKYVICNSDESEPGTFKDRDILRFNPHQVLEGIAIACYTLGATVGYNFLRGEFWEPFDRCEQALAQAREAGLIGKNVLNSGVDIEIFNHFSAGAYICGEETALMNSLEGKRGWPRFKPPFPANFGLYERPSNINNTETYASVPVILEKGGKWFADLGPPKNGGTKIFSVSGHVAKPGNYEVPLGIPFADLLALAGGMREGSELKAVIPGGSSMPVLPAEVMMKAIMSFDGLVEAGSMLGSGGVMVMDQSTCMVKVLERISKFYMHESCGQCTPCREGTGWLYRLVHRIEKGEGTKRDIEQLSRVAKGIEGRTICAFGEAAAWPVSGMLKHFYDEFEYHVTHGKCMV

SEQ ID NO: 39164 - DNA, 1824 bp, Streptomyces avermitilis MA-4680
  CDS (1)..(1824): transl_table=11
atggatctgcacttcggtgacagcaaaccgtcggacgaggagcgggcggccgtcgacgcgctgctcggtcccccggagtcctcgtgggagggcgccgaccggtccgacgccgacctcaggtgggcccgcggcgggcgcgcggcccgggaccgccgcgacctgctgctgccggggctgcacgcggtcaacgaccggatcggctggatcagcgagggcgccctcgactacctgtgccggcggctgacggtgccgcccgcggaggcgtacggcgtcgccacgttctactcgatgttcgcggtgaaaccgcgccccgcgaccgtcctgcatgtgtgcacggacctcgcgtgcgcgtccgccggggcggctgagctgtgcgccggtgtcgaggcccggctcgggcccggcagcggcgtcggagtggaacgcggcccctgtctgggcctgtgcgagcgggctccggccgcactggcggtcagggccggggatccggtgcgtacggcggtgtcggcgcccgcgaccgtcgaggccgcggtgctggcggcgagcgcgcccgactcggcgcccgaggagccgtccgccgccctcgcggtcccccaggcgggtcaggacgggctggttctcctgcgccgcgtcggcgtggtcgaccccgcgtcgctcgacgactaccgggcgcacggcggttacgcggcgctgcggcgggccttcgagctcgggccggccgaggtcatccgggaggtcaccgacgcgggcctggtcgggcgcggcggcgccgccttccccaccggccgcaaatggcaggcgacggcgtcccggcccgaccgtccgcaccacctcgtctgcaacgccgacgaatccgagcccggcaccttcaaggaccgggtgatcatggagggcgacccgtacgcgctcgtcgagtcgatgacgatcgccgcgtacgccgtcggggcgcaccagggctatctgtatctgcgcggggagtacccgcgcgccctggagcgcatgagccacgccatcgagcaggcacgcgcgcgtgggctgctcggcgacgacgtcctcggtcagggctacgccttcgacatcgagatccggcgcggcgcgggcgcgtacatctgcggtgaggagaccgccctcttcaactcgatcgaggggtaccggggggagccgcggtcgaagccgcccttccccgtggagaagggcttgttcggccggcccactgccgagaacaatgtcgagacgctggtcaacgtgttgcccgtcctcacgatgggggcgcaggcgtacgcggcgatcggcacggcgaagtccaccgggcccaagctcttctgcgtgtcgggcagcgtggaccggcccggcgtctacgagctgccgttcggcgcgacgctgggcgagctgctggagctggccggagtgcgggaacggctgcgcgcggtcctgctcggcggcgcggccggcggcttcgtacggcccgacgaacgggacatcccgctcaccttcgaaggcacccgtcaggcgggcaccacgctcggctcgggagtcgtcatggccttcgacgacaccgtcccgctcccccggctcctcctgaggatcgccgagttcttccgcgacgagtcgtgcggccagtgcgtgccgtgccgggtcgggaccgtgcgccaggaggaggcgctgcaccggatcgtggcgcggacgggggcggcggccgccgacgacatcgccctgctcagagaggtgggccgggcgatgcgggacgcctcgatctgcggtctgggccagagcgcgtggaacgccgtggaatctgccatcgaccgtctgggggcgtacgaatga

SEQ ID NO: 39165 - protein, 607 aa, Streptomyces avermitilis MA-4680
MDLHFGDSKPSDEERAAVDALLGPPESSWEGADRSDADLRWARGGRAARDRRDLLLPGLHAVNDRIGWISEGALDYLCRRLTVPPAEAYGVATFYSMFAVKPRPATVLHVCTDLACASAGAAELCAGVEARLGPGSGVGVERGPCLGLCERAPAALAVRAGDPVRTAVSAPATVEAAVLAASAPDSAPEEPSAALAVPQAGQDGLVLLRRVGVVDPASLDDYRAHGGYAALRRAFELGPAEVIREVTDAGLVGRGGAAFPTGRKWQATASRPDRPHHLVCNADESEPGTFKDRVIMEGDPYALVESMTIAAYAVGAHQGYLYLRGEYPRALERMSHAIEQARARGLLGDDVLGQGYAFDIEIRRGAGAYICGEETALFNSIEGYRGEPRSKPPFPVEKGLFGRPTAENNVETLVNVLPVLTMGAQAYAAIGTAKSTGPKLFCVSGSVDRPGVYELPFGATLGELLELAGVRERLRAVLLGGAAGGFVRPDERDIPLTFEGTRQAGTTLGSGVVMAFDDTVPLPRLLLRIAEFFRDESCGQCVPCRVGTVRQEEALHRIVARTGAAAADDIALLREVGRAMRDASICGLGQSAWNAVESAIDRLGAYE

SEQ ID NO: 39166 - DNA, 1350 bp, Streptomyces avermitilis MA-4680
  CDS (1)..(1350): transl_table=11
gtgatgaccttggcacccgagatcaacgagaccagtcccgagaagctgctcgcacccgtgctgtccgccttctgggacgaggagaagtcctggacgctggacgtctaccgaaggcacgaggggtacgagggcctgcgcaaggcgctcgccatgtcgccggacgacctcatcgcgtacgtcaaggactccggtctgcgcggccgcggcggtgccggattccccacgggaatgaaatggcagttcattcctcagggcgatggaaagccgcactatctagttgtcaacgccgacgaatcggaaccgggaacctgtaaggacatcccgctcctcttcgcgaacccgcatagcctcatcgagggcatggtgatcgcgtgctatgccatccggtcgtcgcatgccttcatctatctgcgcggtgaagtggtccccgtgttgcggcggttgcacgaggccgtacgagaggcctacgcggcgggctacctcggcaagaacatcctgggcagtggcctcgacctcgaaatcaccgtgcacgcgggcgcgggcgcgtacatctgcggtgaggagaccgcactgctcgactcgctcgaaggccgccgtggtcaaccgcggctccgtcccccctttcctgctgtcgcgggcctctatgcgtgcccgactgttgtaaataacgtcgagtcgatcgcgtcagttcccgcaattctgcacaagggcaaggaatggttcaggtcgatgggcagcgagaagtccccgggcttcacgctctactcgctcagcggccacgtcgccagccccggccagtacgaggccccgctcggcatcacactccgccaactcctcgacatgagcggcgggatgcggccgggccaccggctgaagttctggacgccgggcggctcctcgacgccgatgttcaccgacgagcacctcgacgtgccccttgactacgagggcgtgggcgcggccggttccatgctcggcaccaaggcgctccagtgcttcgacgagaccacctgcgtcgtccgggcggtcacccgctggaccgagttctacgcccacgagtcctgcggcaagtgcacgccgtgccgtgaagggacgtactggctcgtgcagttgctgcgcgacatcgaggccggcaagggcgtcatgaccgacctcgacaagctgaacgacatcgccgacaacatcaacggcaagtccttctgcgccctcggcgacggcgccgcctcgccgatcttctcctcgctcaagtacttccgtgaggagtacgagcagcacatcacgggccgcggctgcccctttgacccggccaggtcgacggcctgggccgaccgcacggaggtgaacgcatga

SEQ ID NO: 39167 - protein, 449 aa, Streptomyces avermitilis MA-4680
MMTLAPEINETSPEKLLAPVLSAFWDEEKSWTLDVYRRHEGYEGLRKALAMSPDDLIAYVKDSGLRGRGGAGFPTGMKWQFIPQGDGKPHYLVVNADESEPGTCKDIPLLFANPHSLIEGMVIACYAIRSSHAFIYLRGEVVPVLRRLHEAVREAYAAGYLGKNILGSGLDLEITVHAGAGAYICGEETALLDSLEGRRGQPRLRPPFPAVAGLYACPTVVNNVESIASVPAILHKGKEWFRSMGSEKSPGFTLYSLSGHVASPGQYEAPLGITLRQLLDMSGGMRPGHRLKFWTPGGSSTPMFTDEHLDVPLDYEGVGAAGSMLGTKALQCFDETTCVVRAVTRWTEFYAHESCGKCTPCREGTYWLVQLLRDIEAGKGVMTDLDKLNDIADNINGKSFCALGDGAASPIFSSLKYFREEYEQHITGRGCPFDPARSTAWADRTEVNA

SEQ ID NO: 39168 - DNA, 1278 bp, Nitrosomonas europaea ATCC 19718
  CDS (1)..(1278): transl_table=11
atgacccagcctactcaagtcatcatggcaggtgtggatactgcggattcggataattggcggctaaagaattatcttaagcgtgatggttatgccgcgttgaaaaaaattctttcacagaaaatttctcccgaggcagtaattgatgaagtcaagaaatctgcactgcgcggccgcggtggcgcgggctttccgacgggactgaaatggagtttcatgccgaaacagtatacgggtgagaagtatctcgtctgtaattctgatgagggtgagccgggtacattcaaggaccgtgatatcatgcgttacaatccccatatcctgatcgagggtatgttgattgccgcctatgcgatgggtatccgtaccggctacaactatgtacacggggaaatatgggatgtttacgagcgaatggaggaggccgtcgaggaggcgaatgtcgcaggtttcctgggggataacatcttgggttccggctttagtttccgactttataaccatcatggatacggtgcctatatttgtggagaagagaccgccctcctggaatccatagaaggaaaaaagggtcagccacgctttaagccgccatttcctgccaattttggtttgtacggtaaacctacgacaatcaacaatacagaaacatttgcttctgttccctggatcatccgtaacggaggggagcgttatctgcagctcggtaaaccaaacaacggtggtactaaaatattttcagtttccggacatgtcaataagccgggtaactatgaggtacccatgggaacaccctttgcaaagctgttggaacttgctggcgggatgcgtggtggcagaaagctgaagggatgtattccgggtggatcgtcaatgccggttctgcctggtgacatcatgatggaaactgacatggactatgattcaatagcaaaagcaggctccatgctgggctcgggcgcggtgatcatcatggatgacacgacctgtatggtgcgtgcgctggagcggctttcttatttttactatgaggaatcctgtggccagtgtactccgtgccgggaaggaacaggctggctttaccggatcatcaaccggatcgagcacggaaaggggcgggttgaagatctggatttgcttgataatctagcggataacatccagggtagaacgatctgtgcgctgggtgatgctgccgcaatgccggtaagagcaatgctgcagcatttccgggatgaatttgttttccatatcgaacataaaaagtgcatggtctag

SEQ ID NO: 39169 - protein, 425 aa, Nitrosomonas europaea ATCC 19718
MTQPTQVIMAGVDTADSDNWRLKNYLKRDGYAALKKILSQKISPEAVIDEVKKSALRGRGGAGFPTGLKWSFMPKQYTGEKYLVCNSDEGEPGTFKDRDIMRYNPHILIEGMLIAAYAMGIRTGYNYVHGEIWDVYERMEEAVEEANVAGFLGDNILGSGFSFRLYNHHGYGAYICGEETALLESIEGKKGQPRFKPPFPANFGLYGKPTTINNTETFASVPWIIRNGGERYLQLGKPNNGGTKIFSVSGHVNKPGNYEVPMGTPFAKLLELAGGMRGGRKLKGCIPGGSSMPVLPGDIMMETDMDYDSIAKAGSMLGSGAVIIMDDTTCMVRALERLSYFYYEESCGQCTPCREGTGWLYRIINRIEHGKGRVEDLDLLDNLADNIQGRTICALGDAAAMPVRAMLQHFRDEFVFHIEHKKCMV

SEQ ID NO: 39170 - DNA, 1338 bp, Candidatus Blochmannia floridanus
  CDS (1)..(1338): transl_table=11
atgatattggaaaaatattgttatagcccagaaagacaaccattaacgtggagaattcgtgcagatagaaaaccagtgtggttttctgagtatcaatctaaaaatgggtatatggcttttcgtaaagctattgttaatttatctcaatctaatattattgagttaattaataaatctggattgagaggtcgaggaggaggtggatttttaactggattaaaatggtctatgatgacacaaaataaatcagggttagtacgttatttggtatgtaatgctgatgagatggaaccaggaacatataaggatcgttttttaatggaaagattacctcatttgttgttagagggtatattaattgcgggatatgctttgggcgtatcagttgcttatatttttttgcgttatgagtatatgactgcagcagagtatttaagaattgctattaatgaaattagatcggcaggattattgggaaaaaatattttaaatactgaatttaatttagagttatttatacatacaggagcaggaagatatatttgtggagaagaaacagctttgcttagttctttagaaggtaatcgggccattcctagagctaaacctccttttccagctcagtcaggtttatggggtaaacctacatgtgttaataatgtagaaactttatgtaatattcctggaattatagaacatggagtaagttggtacaaaaatatttccgttaaatatagtaatgattctggtacgaagttaatgggattttctggtaaagtaaaaaatcctggaatttgggaattgccatttggaataactgctagagaaattttagaagattatgcgtatggtatgtgtaatggtttttatttaaaagcgtggcaaccgggtggagctagtacggattttttaattgaaaatcatttagatacacctatggattttgataatattaaatctgttggtagtagatttggaacaggaatagcagtagcagtagataatactgttaatatggttggattagtgcgtaatttagaggagtttttttctcgagaatcttgtggttggtgtacgccatgtcgagatgggttgccatgggtagtaaaattgcttattgcattggaaaaaaatagtggatatcctgaagatttaataatgttagagcatttatgtaatttattgggtccaggcaaaactttttgtgcgcatgctcctggagctatggagcctttaaaaagtgctttaaaatattttcgcgatgaatttgaattgggtgttaatttaaataatttgcatacgcgtgataacaatattaaatgcattcaaattatttaa

SEQ ID NO: 39171 - protein, 445 aa, Candidatus Blochmannia floridanus
MILEKYCYSPERQPLTWRIRADRKPVWFSEYQSKNGYMAFRKAIVNLSQSNIIELINKSGLRGRGGGGFLTGLKWSMMTQNKSGLVRYLVCNADEMEPGTYKDRFLMERLPHLLLEGILIAGYALGVSVAYIFLRYEYMTAAEYLRIAINEIRSAGLLGKNILNTEFNLELFIHTGAGRYICGEETALLSSLEGNRAIPRAKPPFPAQSGLWGKPTCVNNVETLCNIPGIIEHGVSWYKNISVKYSNDSGTKLMGFSGKVKNPGIWELPFGITAREILEDYAYGMCNGFYLKAWQPGGASTDFLIENHLDTPMDFDNIKSVGSRFGTGIAVAVDNTVNMVGLVRNLEEFFSRESCGWCTPCRDGLPWVVKLLIALEKNSGYPEDLIMLEHLCNLLGPGKTFCAHAPGAMEPLKSALKYFRDEFELGVNLNNLHTRDNNIKCIQII

SEQ ID NO: 39172 - DNA, 1368 bp, Bordetella parapertussis 12822
  CDS (1)..(1368): transl_table=11
atgaacgcgcctgacctgtacaagcgcctggcgcaggggctggaccccaatccgctgaacgatctgtcgatttcgatgtgcctgcatggccggcacatcgcgccgcagatcatggccgacgtcgatggcgagaactggcgcctgcaggagtacgtcaagcgcggcggctacgaggcgctgcgcaagatcctcaccaccggcatgacgccggaagacgtgatcgcggaagtcaaggcctcgggcctgcgcggccgcggcggcgcgggctttcccaccgggctgaagtggagcttcatgccgcgcgcgttcccgggtcagaagtacctggtgtgcaactcggacgagggcgagcccggcacgttcaaggatcgcgacatcctgcgcttcaatccccatatcgtgatcgaaggcatggtgatcgccgcctacgcgatggggatcagcgtgggctacaactacatccacggcgaaatcttcgaggtgtacgaacgcttcgaggaagcgctcgaagaggcgcgcgccgcgggctttctgggcgacaagctgctgggctcggatttcagcttccagctgcacgcgttccatggctacggcgcctacatctgcggcgaggaaaccgcgctgctcgaatcgctggaaggcaagaaaggccagccgcgcttcaagccgccgttcccggccagcttcggcctgtacggcaagccgaccacgatcaacaacaccgaaaccttcgcggcggtcccctggatcatccgcaacggcgggcaggcctacctcgaagtgggcaagcccaacaacggcggcaccaagctgttctcgatttccggcgacgtcgagcgtcccggcaactacgagatcccgatgggcacgccgttctcgaagttgctggaactggccggcggcatgcgcggcggccgcaagctgaaggcggtgattcccggcggctcgagcgcgccggtgctgcccgccgacatcatgatggactgcacgatggactatgacgccatcgccaaggccggctcgatgctgggttcgggcgcggtgatcgtcatggacgagacgcgctgcatggtcaagtcgctgctgcggctgtcgtatttctatttcgaggaaagctgcggccagtgcacgccgtgccgcgaaggcaccggctggctctaccgcatggtgcaccgtatcgagaatggccagggccgccccgaggacctggacatgctcgacagcgtggcgggcaacatcatggggcgcaccatctgcgccctgggcgatgccgctgccatgcccgtgcgcagcttcatcaagcattttcgcgacgaattcgcgcaccacatcgagcacaagtcttgtgtggtcccgcaatatctgtag

SEQ ID NO: 39173 - protein, 455 aa, Bordetella parapertussis 12822
MNAPDLYKRLAQGLDPNPLNDLSISMCLHGRHIAPQIMADVDGENWRLQEYVKRGGYEALRKILTTGMTPEDVIAEVKASGLRGRGGAGFPTGLKWSFMPRAFPGQKYLVCNSDEGEPGTFKDRDILRFNPHIVIEGMVIAAYAMGISVGYNYIHGEIFEVYERFEEALEEARAAGFLGDKLLGSDFSFQLHAFHGYGAYICGEETALLESLEGKKGQPRFKPPFPASFGLYGKPTTINNTETFAAVPWIIRNGGQAYLEVGKPNNGGTKLFSISGDVERPGNYEIPMGTPFSKLLELAGGMRGGRKLKAVIPGGSSAPVLPADIMMDCTMDYDAIAKAGSMLGSGAVIVMDETRCMVKSLLRLSYFYFEESCGQCTPCREGTGWLYRMVHRIENGQGRPEDLDMLDSVAGNIMGRTICALGDAAAMPVRSFIKHFRDEFAHHIEHKSCVVPQYL

SEQ ID NO: 39174 - DNA, 1581 bp, Bordetella bronchiseptica RB50
  CDS (1)..(1581): transl_table=11
atgaacgcgccgctgaccacccccatcaccgtctacgtgccgcgcgatgccgcggcgctggccatggacgccgacgccgtggcgcaggccatcgcgcaacaggccgcggccctggacctgccggtgcgcatcgtgcgcaacggctcgcgcggcatgctgtggctggagccgctggtcgaagtggccacgccggccggccgcatcgcctacggcccggtgcagcccgaagacgtggccgcgctgttcgaggccggctggctggacggcggcgcgcatccgctgcggctgggcctgaccgacgagatcccgtacctcaagcaccaggaacgcctgacgttcgcccgcgtcggcgtgatcgacccgctgtcgctgcaggactatgccgcgcacggcggactggccgggctgaaccgggcgctggccatgagcgccgagcagatcgtcgacgaagtcagcgcctcgggcctgcgcgggcgcggcggcgcggcgtttccgaccggcatcaagtggaagaccgtgctgaccacgccggcgccgcgcaagtacatcgtctgcaacgccgacgagggcgactcgggcaccttcgccgaccgcctgctgatggaaggcgatccctactcgctgatcgaaggcatgaccatcgccggcctggcggtgggcgccacgtacggctatatctacgtgcgctcggagtatccgcacgccatcgccacgctgcggcaggccatcgcgcgcgcccgcgaggtcggctggctgggcgacgatatccacggcagcgggcagcgcttcgacctggaagtccgcgagggcgccggcgcctatatctgcggcgaggagacctcgctgctggaaagcctggaaggcaagcgcggcgtggtgcgcgccaagccgccgctgccggccatcgccggcctgttcggcctgcccacggtcatcaacaacgtgatttcgctggccacggtgcccaccatcatggcgcgcggcgcggcccattaccgcgacttcggcgtgggccgctcgcacggcacgctgccgttccagctggccggcaatctcaagcacggcggcctggtcgagaaggccttcggcctgacgctgcgcgacctgctctatggcttcggcggcggcagcgccagcggccggccgctgcgcgcggtgcaggtgggcggcccgctgggcgcctacctgcccgaatcgcaatgggatgtgccgctggactacgaggcctatgtgcagatctcggccatggtcggccatggcggcctggtggccttcgacgacacggtcgacatggcgcgcatggcccgctacgcgatggagttctgcgccatcgaatcgtgcggcaaatgcacgccctgccgcatcggctcgacccgcggcgtggaaaccatcgacaagatcgtcgccggcgggccgcaacgcgaacagcgcgtgcatctgctgcgcgacctgtgcgacaccatgctggccggctcgctgtgcgcgctgggcggcatggccccctatccggtgctgtcggccctgaaccacttccccgaagacttcgggctcgccccgcaacccgccgcgcagccggcctga

SEQ ID NO: 39175 - protein, 526 aa, Bordetella bronchiseptica RB50
MNAPLTTPITVYVPRDAAALAMDADAVAQAIAQQAAALDLPVRIVRNGSRGMLWLEPLVEVATPAGRIAYGPVQPEDVAALFEAGWLDGGAHPLRLGLTDEIPYLKHQERLTFARVGVIDPLSLQDYAAHGGLAGLNRALAMSAEQIVDEVSASGLRGRGGAAFPTGIKWKTVLTTPAPRKYIVCNADEGDSGTFADRLLMEGDPYSLIEGMTIAGLAVGATYGYIYVRSEYPHAIATLRQAIARAREVGWLGDDIHGSGQRFDLEVREGAGAYICGEETSLLESLEGKRGVVRAKPPLPAIAGLFGLPTVINNVISLATVPTIMARGAAHYRDFGVGRSHGTLPFQLAGNLKHGGLVEKAFGLTLRDLLYGFGGGSASGRPLRAVQVGGPLGAYLPESQWDVPLDYEAYVQISAMVGHGGLVAFDDTVDMARMARYAMEFCAIESCGKCTPCRIGSTRGVETIDKIVAGGPQREQRVHLLRDLCDTMLAGSLCALGGMAPYPVLSALNHFPEDFGLAPQPAAQPA

SEQ ID NO: 39176 - DNA, 1368 bp, Bordetella bronchiseptica RB50
  CDS (1)..(1368): transl_table=11
atgaacgcgcccgacctgtacaagcgcctggcgcaggggctggaccccaatccgctgaacgatctgtcgatctcgatgtgcctgcatggccggcacatcgcgccgcagatcatggccgacgtcgatggcgagaactggcgcctgcaggagtacgtcaagcgcggcggctacgaggcgctgcgcaagatcctcaccaccggcatgacgccggaagacgtgatcgcggaagtcaaggcctcgggcctgcgcggccgcggcggcgcaggctttcccaccggcctgaagtggagcttcatgccgcgcgcgttcccgggccagaagtacctggtgtgcaactcggacgagggcgagcccggcacgttcaaggatcgcgacatcctgcgcttcaatccccatatcgtgatcgagggcatggcgatcgccgcctacgcgatggggatcagcgtgggttacaactacatccacggcgaaatcttcgaggtgtatgaacgcttcgaggaagcgctcgaagaggcgcgcgcggcgggctttttgggcgacaagctgctgggctcggatttcagcttccagctgcacgcgttccatggctacggcgcctacatctgcggcgaggaaaccgcgctgctcgaatcgctggaaggcaagaaaggccagccgcgcttcaagccgccgttcccggccagcttcggcctgtacggcaagccgaccacgatcaacaacaccgaaaccttcgcggcggtcccctggatcatccgcaacggcgggcaggcctacctcgaagtgggcaagcccaacaacggcggcaccaagctgttctcgatttccggcgacgtcgagcgtcccggcaactacgagatcccgatgggcacgccgttctcgaagttgctggaactggccggcggcatgcgcggcggccgcaagctgaaggcggtgattcccggcggctcgagcgcgccggtgctgcccgccgacatcatgatggactgcacgatggactatgacgccatcgccaaggccggctcgatgctgggttcgggcgcggtgatcgtcatggacgagacgcgctgcatggtcaagtcgctgctgcggctgtcgtatttctatttcgaggaaagctgcggccagtgcacgccgtgccgcgaaggcaccggctggctctaccgcatggtgcaccgtatcgagaatggccagggccgccccgaggacctggacatgctcgacagcgtggcgggcaacatcatggggcgcaccatctgcgccctgggcgatgccgctgccatgcccgtgcgcagcttcatcaagcattttcgcgacgaattcgcgcaccacatcgagcacaagtcttgtgtggtcccgcaatatctgtag

SEQ ID NO: 39177 - protein, 455 aa, Bordetella bronchiseptica RB50
MNAPDLYKRLAQGLDPNPLNDLSISMCLHGRHIAPQIMADVDGENWRLQEYVKRGGYEALRKILTTGMTPEDVIAEVKASGLRGRGGAGFPTGLKWSFMPRAFPGQKYLVCNSDEGEPGTFKDRDILRFNPHIVIEGMAIAAYAMGISVGYNYIHGEIFEVYERFEEALEEARAAGFLGDKLLGSDFSFQLHAFHGYGAYICGEETALLESLEGKKGQPRFKPPFPASFGLYGKPTTINNTETFAAVPWIIRNGGQAYLEVGKPNNGGTKLFSISGDVERPGNYEIPMGTPFSKLLELAGGMRGGRKLKAVIPGGSSAPVLPADIMMDCTMDYDAIAKAGSMLGSGAVIVMDETRCMVKSLLRLSYFYFEESCGQCTPCREGTGWLYRMVHRIENGQGRPEDLDMLDSVAGNIMGRTICALGDAAAMPVRSFIKHFRDEFAHHIEHKSCVVPQYL

SEQ ID NO: 39178 - DNA, 1296 bp, Chromobacterium violaceum ATCC 12472
  CDS (1)..(1296): transl_table=11
atggctgtcttcgctaatggcgtgattttcgacggcgtcgacaccgcgcagcccgactgctggcgtctggacgcctacgtggcccgcggcggctaccaggcgctgcgccgcatcctcgactccaagatgacgcaagaggacgtgatcgcggaagtgaagaactccggcctgcgcggccgcggcggcgcgggcttcccgaccggcctgaaatggagcttcatgccgcgctcgttcccgggcgacaaatacgtcgtctgcaacaccgacgagggcgagccgggcaccttcaaggaccgcgacatcatccgctacaacccgcactcgctgatcgagggcatgatcatcgccggttacgcgatgggcaccaaggcgggttacaactacatccacggcgaaatcttcgaagactacctgctgttcgaggaagcgctggaagaggcgcgcaaggcgggcttcctgggtcagaacatcctgggctccggcttcaacttcgagctctacgcccatcacggctacggcgcctacatctgcggcgaggaaaccgcgctgctggagtcgctggaaggcaagaagggccagccgcgcttcaagccgccgttcccggccagcttcggcctgtacggcaagccgaccaccatcaacaacaccgaatcgttcgcctcggtgccgttcatcatccgcgacggcgcgcagaccttcctcgagaagggcaagccgaacaacggcggcaccaagctgttctcggtttccggccacgtcaaccgtccgggcaactacgagatcgcgctgggcaccccgttctccgagctgctggaaatggccggcggcatgcgcgacggcaagaagctgaaggcggtgatcccgggcggctcgtccgctccggtgctgccggccgacatcatgatgcagtgcaccatggactacgacagcatcgccaaagccggttcgatgctgggttcgggcgccgtgatcgtgatgaacgaggacgtgtgcatggtcaaggcgctggagcgtctggcctatttctaccacgaagaatcctgcggccagtgcacgccgtgccgcgaaggcaccggctggctgtacaaggtgatccatcgcatcgccagcggccagggccgcaagggcgatctggagctcctggattccgtgggcaacaacatggccggccgcaccatctgcgcgctggccgacgccgcggtgttcccggttcgcagtttcaccaagcatttccgcaacgagttcgagtacgcgatcgaacacggaaagaccttggtggatcacaaatggtgttga

SEQ ID NO: 39179 - protein, 431 aa, Chromobacterium violaceum ATCC 12472
MAVFANGVIFDGVDTAQPDCWRLDAYVARGGYQALRRILDSKMTQEDVIAEVKNSGLRGRGGAGFPTGLKWSFMPRSFPGDKYVVCNTDEGEPGTFKDRDIIRYNPHSLIEGMIIAGYAMGTKAGYNYIHGEIFEDYLLFEEALEEARKAGFLGQNILGSGFNFELYAHHGYGAYICGEETALLESLEGKKGQPRFKPPFPASFGLYGKPTTINNTESFASVPFIIRDGAQTFLEKGKPNNGGTKLFSVSGHVNRPGNYEIALGTPFSELLEMAGGMRDGKKLKAVIPGGSSAPVLPADIMMQCTMDYDSIAKAGSMLGSGAVIVMNEDVCMVKALERLAYFYHEESCGQCTPCREGTGWLYKVIHRIASGQGRKGDLELLDSVGNNMAGRTICALADAAVFPVRSFTKHFRNEFEYAIEHGKTLVDHKWC

SEQ ID NO: 39180 - DNA, 1365 bp, Photorhabdus luminescens subsp. laumondii TTO1
  CDS (1)..(1365): transl_table=11
atgacagcatattcaggaataaaagaaattattcttactgaggaaaaccatcctcttacttggcgattgcgtgatgacaaacaaccggtatggttggatgagtaccgtagcaaaagtggttatcgtggtgctgaaaaagcactgaaaagcatgtccccagatgaagtggtttctctggtaaaagacgccgggctgaaaggccgtggcggtgcaggtttctctactggtctgaagtggagcctgatgccaaaagatgaaagcatgaatatccgttatctgctatgtaacgcagatgaaatggagccgggtacctacaaagatcgcttgctgatggaacaacttcctcatttgctggtggaaggaatgttgatcagtgcatttgccctgaaagcttatcgtggctatatcttcctgcgtggtgaatatgtggaagcggctgtgcatctgcgtaaagccatcgaagaagctaaagcagcgggtttgttgggtaaaaacatcatgggcagcggctttgattttgagttgtttgttcataccggcgcggggcgttatatctgtggtgaagagaccgcactgattaactcactggaaggtcgccgagctaatcctcgttcaaaaccgccatttcctgccacttccggcgcatggggtaaacctacttgtgtcaacaatgttgaaaccttgtgcaacgttccttcaattctcgaatacggcaaagagtggtatatcggcctgagtgcaggcaagagtaaagatgccggcactaaactgatgggtttctctggtcgggtgaaaaatccgggcttgtgggagttgccatttggtacgactgcccgtgaaattcttgaagattatgctggtggtatgcgtgacggcttgaaattcaaagcatggcagcccggtggggcagggactgacttcctgactgctgaacatctggatctgccaatggatttcgaaaatattgctaaagcgggcagccgtttgggcacggccttggcaatggcagttgaccatgaaattaatatggtttcgttgacgcgtaatcttgaagaattctttgcccgtgaatcttgcggttggtgtactccatgtcgtgacgggttgccgtggagcgtaaaaatcctgcgcgcaatagagcgtggggaagggcaacccggggatattgaaacattggaacagctctgtcgtttccttgggccaggcaatacattctgtgctcatgcaccaggggccgtggaaccactacagagtgccatcaaatatttccgtgatgaattcgaagctggaattgtgaccaaagactatgggaacacccatttcattgcgggtatccagtcaaacctgttaaagcagcgttggtaa

SEQ ID NO: 39181 - protein, 454 aa, Photorhabdus luminescens subsp. laumondii TTO1
MTAYSGIKEIILTEENHPLTWRLRDDKQPVWLDEYRSKSGYRGAEKALKSMSPDEVVSLVKDAGLKGRGGAGFSTGLKWSLMPKDESMNIRYLLCNADEMEPGTYKDRLLMEQLPHLLVEGMLISAFALKAYRGYIFLRGEYVEAAVHLRKAIEEAKAAGLLGKNIMGSGFDFELFVHTGAGRYICGEETALINSLEGRRANPRSKPPFPATSGAWGKPTCVNNVETLCNVPSILEYGKEWYIGLSAGKSKDAGTKLMGFSGRVKNPGLWELPFGTTAREILEDYAGGMRDGLKFKAWQPGGAGTDFLTAEHLDLPMDFENIAKAGSRLGTALAMAVDHEINMVSLTRNLEEFFARESCGWCTPCRDGLPWSVKILRAIERGEGQPGDIETLEQLCRFLGPGNTFCAHAPGAVEPLQSAIKYFRDEFEAGIVTKDYGNTHFIAGIQSNLLKQRW

SEQ ID NO: 39182 - DNA, 1557 bp, Rhodopseudomonas palustris CGA009
  CDS (1)..(1557): transl_table=11
atgagtttgcgcatcttcatcccgcgcgattccggcgcgctcgcggtcggcgccgacgaggtcgcggccgcgctggtcgatcaggcgcacgcgcgcgagctgccggtcgatctggtccgccccggctcgcgcgggctgtactggctcgaaccgatgctggaggtcgacacgccagagggccgcgtcgcctatgggccggtgacgccggccgatgtgccgtcactgctcgatgcgatcgtggccggcgggccgcatccgctgcagcaggggctcacagaggagatcccgtggctgaagcggcagactcggttgaccttcgcgcgctgcggcatcgtcgatccgcgctcgatcgatgattatcgcgcccatggcggctatcgcgggctcgaacgcgcgctgaagatgagctctgatgcgatcatcgatgatgtcgtcaaatccggcctgcgtggccgcggcggtgccggtttcccgaccggcaccaaatggcgcaccgtggcccaggccggccgcggccagaaatatatctgctgcaatgccgacgagggcgacagcggcaccttcgccgaccggatgctgatggagggcgatcccttcatgatcatcgagggcatgacgatcgccggcatcgcggtcggcgcgaccaagggctacatctacattcgctcggaatatccgcatgccgtcgaggcgatgaacgccgcgatcgaggcggcgcggcgcaccggctatctcggcgagcacatctgccattcgaccgattcgttcgacatcgaagtccgggtcggtgccggggcctatatctgcggcgaagaaacctcgatgctggagagcctcgaaggcaagcgcggcacggtgcgggccaagccgccgctgccggcccacaagggactgtttggccggccgacggtgatcaacaacgtgctcaccttctcggcggtgccctacatcctcgacggcggcgcgcaggcctatgccgattgcggcatgggcaagtcgcgcggcaccaagccgatccagctcggcggcaacatcaagcacggcgggctattcgaggtggcgttcggcatcaccctcggcgaattggtcgacgagatcggcggcggcacgctgagcggccgcccggtgcgcgccgtccaggtcggcggcccgctcggcgcttacttcccgcgcgcgctgttcgacacgccgttcgattacgaggcgttcgcagcgcgcagcggcatggtcgggcacggcggcgtggtggtgttcgacgacaccgtcgacatggctaagcaggcgcggttcgcgatggagttctgcgcccacgaatcttgcggcaagtgcacgccatgccggatcggttcgacccgtggcgccgagacggtcgacaagatcatcgccggcgaccggcccgcggcgaacatcgccgtgctcgaagacctctgcaacaccatgaagttcggctcgctgtgcgcgctgggcggcctcgcgccgatcccggtgctcagcgcgctgacgcacttcccggaagatttcggcctcgcgccgcgccgcctgcaggccgcggaataa

SEQ ID NO: 39183 - protein, 518 aa, Rhodopseudomonas palustris CGA009
MSLRIFIPRDSGALAVGADEVAAALVDQAHARELPVDLVRPGSRGLYWLEPMLEVDTPEGRVAYGPVTPADVPSLLDAIVAGGPHPLQQGLTEEIPWLKRQTRLTFARCGIVDPRSIDDYRAHGGYRGLERALKMSSDAIIDDVVKSGLRGRGGAGFPTGTKWRTVAQAGRGQKYICCNADEGDSGTFADRMLMEGDPFMIIEGMTIAGIAVGATKGYIYIRSEYPHAVEAMNAAIEAARRTGYLGEHICHSTDSFDIEVRVGAGAYICGEETSMLESLEGKRGTVRAKPPLPAHKGLFGRPTVINNVLTFSAVPYILDGGAQAYADCGMGKSRGTKPIQLGGNIKHGGLFEVAFGITLGELVDEIGGGTLSGRPVRAVQVGGPLGAYFPRALFDTPFDYEAFAARSGMVGHGGVVVFDDTVDMAKQARFAMEFCAHESCGKCTPCRIGSTRGAETVDKIIAGDRPAANIAVLEDLCNTMKFGSLCALGGLAPIPVLSALTHFPEDFGLAPRRLQAAE

SEQ ID NO: 39184 - DNA, 1326 bp, Rhodopseudomonas palustris CGA009
  CDS (1)..(1326): transl_table=11
atgctggacgacaaggaccgcatcttccggaacctgtacggtctcgacgactggacgctgaagggcgcacgccgtcgcggcgggtgggaaggtaccaaggcgatcatcgacaagggccgcgactggatcatcaacgagatgaaggcgtcgggcctgcgcggccgcggcggcgccggcttcccgaccggcctgaagtggtctttcatgccgaaggacaatgccgacggccggccgagctatctcgtcgtcaatgccgacgagtccgagcccggcacctgcaaagaccgcgagatcatgcgccacgacccgcacacgctggtcgaaggctgtctgctcgcgggctgcgcgatgggggcccacaccggctacatctacgtccgcggagagttcatccgcgagcgcgagcggctgcaggcggcgatcgaccaggcctatgaggccaagctgatcggcaaggacaacgttcacggctatccgttcgacctctacgtcgctcacggcgccggcgcctacatctgcggtgaagaaaccgcgctgctcgaaagcctcgagggcaagaagggccagccgcggctgaagccgccgttcccggcgaacgtcggtctgttcggctgcccgaccacagtcaacaacgtcgagtcgatcgcggtcgccccggacatcctgcgccgcggcgcagcgtggttctcctcgatcggccgggccaacaacgttggtaccaagctttacggcatctccggccacgtcaacacgccctgcgtcgtcgaagaggcgatgagcattccgttccgcgagctgatcgagaagcacggcggcggcattcgtggcggctgggacaatctgctggcgatcatacccggcggcgcgtcgtgcccgctgatcccggcggcggattgcgaagagctgatcatggacttcgacggcacccgcgcggtgaagtcgagcttcggcaccgccggcgtgatcgtgatggacaagtcgaccgacgtcgtcgccgcgatcgcgcgcatcagctacttcttcaagcacgaaagctgcggccagtgcacgccgtgccgcgaaggcaccggctggatgtggcgcgtgctcgaccgcatggtcgaaggccgcgcccataagcgcgaaatcgacatgctgctggaagtgaccaagcaggtcgaaggccacaccatctgcgcgctcggcgatgccgcggcctggccgatccagggcctgatccgcgccttccgccccgagatcgagcgccgcatcgacgacttctcgcgcaaggccacgctcgacgatcagggcgtgctcgatccggcgcacatgcaagcggcggagtga

SEQ ID NO: 39185 - protein, 441 aa, Rhodopseudomonas palustris CGA009
MLDDKDRIFRNLYGLDDWTLKGARRRGGWEGTKAIIDKGRDWIINEMKASGLRGRGGAGFPTGLKWSFMPKDNADGRPSYLVVNADESEPGTCKDREIMRHDPHTLVEGCLLAGCAMGAHTGYIYVRGEFIRERERLQAAIDQAYEAKLIGKDNVHGYPFDLYVAHGAGAYICGEETALLESLEGKKGQPRLKPPFPANVGLFGCPTTVNNVESIAVAPDILRRGAAWFSSIGRANNVGTKLYGISGHVNTPCVVEEAMSIPFRELIEKHGGGIRGGWDNLLAIIPGGASCPLIPAADCEELIMDFDGTRAVKSSFGTAGVIVMDKSTDVVAAIARISYFFKHESCGQCTPCREGTGWMWRVLDRMVEGRAHKREIDMLLEVTKQVEGHTICALGDAAAWPIQGLIRAFRPEIERRIDDFSRKATLDDQGVLDPAHMQAAE

SEQ ID NO: 39186 - DNA, 1287 bp, Rhodopseudomonas palustris CGA009
  CDS (1)..(1287): transl_table=11
atgagcgacaagccgctcaccggccgcgcgcgcgccgaccgtcagccgcacagcctcgctgcctggcgcgggctcggcggctatgcggcgctgtcgctcgcgctcaagcggcacagcccggaagcgatcatcgcgatggtcgaggctgctggcctgcgcggccgcggcggcgccggcttcccgaccgccaacaaatggcgcttcatgcgcaccggcagtgagagagccggtccaggcgcgcgctatctctgcgtcaacggcgatgagaccgagcccggctcgttcaaggaccggctgttgatggaggcgttgccacatcaactgatcgagggcgcgaccatcgcggcctatgcgatcggcgccaccgaagtgatcattctggtgcgcgacgaatatcgcgccgccgccgctgcgctgagccgcgcgattgcggaagccgaagccgccgggctgctcggccgcgacattctcggctccggcttcgaccttacgatgcgggtgcatgcctccgccggccgctacattgtcggcgaggagaccgcgctgatcgctgcgatcgagggcgaacgtccggtgccgcggcatcgtccgccttatccggccgtcagcggattgtgggggcgaccgacgaccgtcaacaacgtcgagaccctgtcttcggtgccgtcgatcatcgagaatggcgccgagtggtaccgatcgctgtcattcaccgacgaaggtggcaccaagctgtatggcatttccggctgcgtcgagcgtccgcaactgatcgaagcgccgatgggctcgaccgcgcgtgagctactgcatcgtgccggcggcattcgcaatggtcgcgggctgctggcattccagccaggcggcggcgccaccgcgttcttcgagaaggccgaactcgacgtgccgctcgatttcaccagcaccaagaaggccggcagttcgctcggcaccggcgcgctgattgtgctcgacgatcgcgcctgtccggtggcggcgatcgggcgtcacatgcggttctacgcgcgtgagagctgcgggctgtgcacgccgtgccgcgatggcctgccgtgggtgtcgaagctgctcgatgcgctcgaagccggcaagggcacacaaggcgatatcgaggtgttgcaccagcacgtcgcgctgtccggtccgtctgggcgctcctattgcgacctcaacaccggcgcgctcacgccgctgcgcagcggtctcgagcgcttcggcgacatcttcacggcccacctgcagggcttctgtccggtgggccgcgcatga

SEQ ID NO: 39187 - protein, 428 aa, Rhodopseudomonas palustris CGA009
MSDKPLTGRARADRQPHSLAAWRGLGGYAALSLALKRHSPEAIIAMVEAAGLRGRGGAGFPTANKWRFMRTGSERAGPGARYLCVNGDETEPGSFKDRLLMEALPHQLIEGATIAAYAIGATEVIILVRDEYRAAAAALSRAIAEAEAAGLLGRDILGSGFDLTMRVHASAGRYIVGEETALIAAIEGERPVPRHRPPYPAVSGLWGRPTTVNNVETLSSVPSIIENGAEWYRSLSFTDEGGTKLYGISGCVERPQLIEAPMGSTARELLHRAGGIRNGRGLLAFQPGGGATAFFEKAELDVPLDFTSTKKAGSSLGTGALIVLDDRACPVAAIGRHMRFYARESCGLCTPCRDGLPWVSKLLDALEAGKGTQGDIEVLHQHVALSGPSGRSYCDLNTGALTPLRSGLERFGDIFTAHLQGFCPVGRA

SEQ ID NO: 39188 - DNA, 1776 bp, Geobacter sulfurreducens PCA
  CDS (1)..(1776): transl_table=11
atgggcgaagcgataaagattctgatctgtcaggggaccggtggtgtctcagcgggtgctaaaaaggttgaggcggagttcctccgtgttatcggtgaaaagggcgtcgatgccaccgtcggcaaacgatgtgacgtcatcaagaccggctgtcgcggcctgtgtgcaaacgatgttcttgtggatattgtagatcccgagcttgggcgtgtaacttacgatttcgttctgccagaagaagtcgaaaagattgtggccgagcatatcgtcaaccggaccccccttgagaagcgcaaagcaaaaccgtactacaacacgttcgtagaccagcagatgagggttgttatgaccgggtgcggtcagatcgacccggaaagtctcgatgcgtatctagaagaggacggcttcaaggcaattgaaaaatgcgttaaggaaatgactcccgctgcagttatcgacgaagtcaagaagtctggacttcgaggtagagggggcggtggcttcccgacgggcatgaagtggtctttctgtgctgcgacgcccggcaaactgaagtatgtcatctgcaatgcggacgaaggtgaccccggtgctttcatggaccggtcgattctcgagggtgacccttactgcatcattgaaggaatgatgatagcggcatacgcaatcggctgtactgctggctatgtgtacgtacgggcagagtacccacttgctattgagcgtctgcagaaggctctcgatgtttgctacgaaaagggctacctcggcaagaacgtcatgggctggggattcgacttcgaccttcggatcaagaagggtgcgggggcctttgtgtgcggtgaggaaaccgcgctcatggcttcgatcgaaggcgagcggggaatgcctcgccctcgtccgccgttccccgctgtcaaaggtctgtgggggaagcctaccaacattaacaacgttgagacgttcgccaacgtgcgtcacatcatcctgaagggtgctgactggtacgcatctctcggtactgataccacaaaagggacaaagatcttcgcggtcaccggtaaagtaaagcacacgggacttgtggaagtcccggcgggtatgagcgtgcgcgaagttatctataacgtttgcggcggcatcgccaacaaccggaagttcaaagcagttcaggcaggtggaccatcaggcggatgtattccctcagaagttctcgatacaccggttgattatgactcgcttatcaaggccggtgccatgatgggctccggtggtctcgtcgtcatggacgaaactacctgcatggtcgacgtagcacgcttcttccttaccttcacgcggatggaatcatgcggtaaatgcgttccgtgccgcattggactcaaggcgatgttggacatcctcgaacgcatcaccgaaggaagaggccaagctggtgacattgagacactgcttgagatggggagcaccatcaaaaaggcctcactctgcggtctgggccagacagcacccaacccgatcctctccacgatcaagtatttccgtgaggagtatgaagcgcatatcaatgatcggcgttgcccgtcgaactgctgtaaagagcttctgttgtggcaagtagtcgaggaaaagtgcgttaagtgcggagcctgcttcaaggcatgccctgttgacgcaattatctgggagaaggggcaaattgcaatcctagataaagagaaatgcaccaaatgcaaatcctgctacgacgcctgccggttcatggccatcgagtag

SEQ ID NO: 39189 - protein, 591 aa, Geobacter sulfurreducens PCA
MGEAIKILICQGTGGVSAGAKKVEAEFLRVIGEKGVDATVGKRCDVIKTGCRGLCANDVLVDIVDPELGRVTYDFVLPEEVEKIVAEHIVNRTPLEKRKAKPYYNTFVDQQMRVVMTGCGQIDPESLDAYLEEDGFKAIEKCVKEMTPAAVIDEVKKSGLRGRGGGGFPTGMKWSFCAATPGKLKYVICNADEGDPGAFMDRSILEGDPYCIIEGMMIAAYAIGCTAGYVYVRAEYPLAIERLQKALDVCYEKGYLGKNVMGWGFDFDLRIKKGAGAFVCGEETALMASIEGERGMPRPRPPFPAVKGLWGKPTNINNVETFANVRHIILKGADWYASLGTDTTKGTKIFAVTGKVKHTGLVEVPAGMSVREVIYNVCGGIANNRKFKAVQAGGPSGGCIPSEVLDTPVDYDSLIKAGAMMGSGGLVVMDETTCMVDVARFFLTFTRMESCGKCVPCRIGLKAMLDILERITEGRGQAGDIETLLEMGSTIKKASLCGLGQTAPNPILSTIKYFREEYEAHINDRRCPSNCCKELLLWQVVEEKCVKCGACFKACPVDAIIWEKGQIAILDKEKCTKCKSCYDACRFMAIE

SEQ ID NO: 39190 - DNA, 1713 bp, Geobacter sulfurreducens PCA
  CDS (1)..(1713): transl_table=11
atgaaccccgccgatctccatgccatggcccgggaagaacaggcccgccaggaggcgctgcggtgccgtatcatggtctgtgccggtaccccctgtctttccgccggcgcactggcggtcctggacgcgctgcgccaggcggtggaggagagccggctcgatgcggagatcgaggccgtcagcaccggctgcatggggccgtgcagccgcggtcccctcgtgaaagtggcagttcaggggaaacccgagatcgtctacgagcgcgtcacccccgaactggcccgccagattctctactcggtggtgaaggggcgccggccgccgacggcctcgccgctgccgccggatcacccctatttcacccgccagatgaagatcgtcttggccaactgcggttccatcgaccccgagcggatcgaggagtatgtggccacggggggctacgatgcccttgcccacgccctgcacgagatgacccccgaggatgtctgtcgcgagatctccgcttcgggactgcgggggcgggggggggccggctatccggccggcgtcaagtggaacctggcccgcaaggcgccgggcgagcggaaatacgtggtggccaacggcgacgagggggacccgggcgcctacatggaccgctccgtcatggagtcggacccccaccgcatcctggaaggaatggccattgccggctacgccatcggcgcggatcagggctacatctacgtccggggcgagtactacctggccggaaggcggctcgaggccgccatccgcgacgccgagcgcaaggggctcctgggaagccgggtgctcggcagcaacttcagtttccgcatcgacatccgcaccggcgccggcgcctttgtctgcggcgaggaaacctcgctcatggcttccatcatggggcggcgcggacagccctggcaccggccgccctatccggcccagcgggggctctgggggtgtccgaccctcatcaataacgtggagacccttgccaccgtcccggctatcatcggacgcggggccacctggtacgccggcatcggctcgacccggagcccgggaaccaaggtctatgccctggccggccaggtggagaccgccggcctgatcgaagtccccatgggtaccacgctgcgggaggtggtgttcgacatcggcggcggaatccccggcggcaagcgcttcaaggctgcccagtcgggcggcccttcgggcggctgcattccggccgaacacctggacacccccctcgattacgaaagtatggagcggatcggcaccatcatgggctccggcggacttatcatcatggacgagacgagctgcatgcccgacgtcgcctcgtttttcctcgatttctgccgggacgagagctgcggcaagtgcatcccgtgccgcgtcggcagcatggagatgcaccggctgctgcgccgcataacctccggcaccgcttggccggacgacctgcgccggctggaggagctctgcgatctgatgggcgccacgagcctctgtggtctcggccagaccgcgcccaacccggtggtgagcaccctgcgctacttccggcacgaatacgaggcccacatccgcgagcgccgctgcccggcgggccgctgcaccatggctgccgagcaggagcccggacccggcggcaaggcactcctgcacgccgtcggcgtccctggggaggtaggctga

SEQ ID NO: 39191 - protein, 570 aa, Geobacter sulfurreducens PCA
MNPADLHAMAREEQARQEALRCRIMVCAGTPCLSAGALAVLDALRQAVEESRLDAEIEAVSTGCMGPCSRGPLVKVAVQGKPEIVYERVTPELARQILYSVVKGRRPPTASPLPPDHPYFTRQMKIVLANCGSIDPERIEEYVATGGYDALAHALHEMTPEDVCREISASGLRGRGGAGYPAGVKWNLARKAPGERKYVVANGDEGDPGAYMDRSVMESDPHRILEGMAIAGYAIGADQGYIYVRGEYYLAGRRLEAAIRDAERKGLLGSRVLGSNFSFRIDIRTGAGAFVCGEETSLMASIMGRRGQPWHRPPYPAQRGLWGCPTLINNVETLATVPAIIGRGATWYAGIGSTRSPGTKVYALAGQVETAGLIEVPMGTTLREVVFDIGGGIPGGKRFKAAQSGGPSGGCIPAEHLDTPLDYESMERIGTIMGSGGLIIMDETSCMPDVASFFLDFCRDESCGKCIPCRVGSMEMHRLLRRITSGTAWPDDLRRLEELCDLMGATSLCGLGQTAPNPVVSTLRYFRHEYEAHIRERRCPAGRCTMAAEQEPGPGGKALLHAVGVPGEVG

SEQ ID NO: 39192 - DNA, 1272 bp, Geobacter sulfurreducens PCA
  CDS (1)..(1272): transl_table=11
atggaacaggttctcttccgacataaccgtcccggccggtgcgtaacctttgccgagtaccgggcggagggaggcttcgcggccctggagaaggccctttccggcatgtcgcccaacgatgtccagcaggtggtgatcgacgccaatctgcggggccggggcggggccgggttccccaccgggaagaagtggtccttcgtgccgcgggacatcccaggcccccgttatctcatctgtaactgcgacgagatggagccgggcacctacaaggaccggatactcctggaggcgaacccctattctctggtggaggggatgaccctggccgcttatgccatcggtgtggcccatgccttcatcttcatccgccgcggctacgaagaggcggcggagaattgccggcgcgccattgccgaggcaaaggaagcgggcctgctggggaagaacatcctcggctccggtttctccctggacctggacgtccaccagtccgccgggcgttacatctgtggcgaggaaacagccctcatgaacgcgctggaggggaggcgggccaacccgcggagcaaaccccccttcccggcagtgaaagggctctgggggcgccccacggtggtgaacaacgtggagaccctggccaacatcccggctatcgtggccaacggcgccgcctggttcaaggggctggcgagaatctccgaagcggccggtaccaagctcttctgcgtgagcggacatgtgaacaacgccgcctgcttcgagcttcccctggggatgagcctgggcgagatcatcgacggcccctgcggcggcatgctgccggggcgggagttcaaggcgtgcatacccggcggggcgtccacgccgttctttacccgggagcactggaacgtccccatggacttcgatgccgtggcaagggccggctcccggctcggcaccggcggcatcgtggtcttcgaccggaacacctgcatggtggcggcaaccctgaacctggtgtccttttacgctcgggagtcgtgcggctggtgtaccccctgccgggaagggctcccctttgtgaaggacgtcctggcccggatcgaggcgggcgccgggcgggaggagcacatcgccatcctgcgggagcatgtccagtacctgaactacgccttctgtcccctggcccccggtgccatggggccggtggaggggctcctgcggctcttcgaggacgagatccgggagcacatcgtgatggggcgctgccccctcggaggaaagggatga

SEQ ID NO: 39193 - protein, 423 aa, Geobacter sulfurreducens PCA
MEQVLFRHNRPGRCVTFAEYRAEGGFAALEKALSGMSPNDVQQVVIDANLRGRGGAGFPTGKKWSFVPRDIPGPRYLICNCDEMEPGTYKDRILLEANPYSLVEGMTLAAYAIGVAHAFIFIRRGYEEAAENCRRAIAEAKEAGLLGKNILGSGFSLDLDVHQSAGRYICGEETALMNALEGRRANPRSKPPFPAVKGLWGRPTVVNNVETLANIPAIVANGAAWFKGLARISEAAGTKLFCVSGHVNNAACFELPLGMSLGEIIDGPCGGMLPGREFKACIPGGASTPFFTREHWNVPMDFDAVARAGSRLGTGGIVVFDRNTCMVAATLNLVSFYARESCGWCTPCREGLPFVKDVLARIEAGAGREEHIAILREHVQYLNYAFCPLAPGAMGPVEGLLRLFEDEIREHIVMGRCPLGGKG

SEQ ID NO: 39194 - DNA, 1362 bp, Mycobacterium avium subsp. paratuberculosis K-10
  CDS (1)..(1362): transl_table=11
atgacaacgacttcggagacttcggaggcctccggggccccgcaggcgacgccgctgacgccggtgatcagccgcttctgggacgatcccgagtcgtggacgctgcagacgtaccaccggcacggcggctacacggcgatgaagaaggcgctggcgatggagcccgacgcggtcatcgggatggtcaaggactccgggctgcgcgggcgcggcggcgcgggcttctcgaccggcaccaagtggtcgttcatcccgcagggcgacaccggcgcggccgccaagccgcactacctggtggtcaacgccgacgagtcggaacccggtacgtgcaaagacattccgttgatgctggccaccccgcacgtcctgatcgagggggtgatcatcgcggcgtatgcgatccgggccaaccacgcgttcatctatgtgcgcggcgaggtgctgccggtgctgcgccggctgcagaacgccgtcgccgaggcctacgccgccggctacctgggccgcgacatcgacggctccggcttcgatctggagctggtggtgcacgccggcgccggcgcctacatctgcggcgaggagaccgcgctgctggactcgctggagggccgccgcggccagccccggctgcggccgccgttcccggcggtggccgggctgtacggctgccccacggtgatcaacaacgtcgagaccatcgccagcgtgccgtccatcatcggcaacggcgtggactggttccgctcgatgggcagtgagaaatcgccgggtttcacgctgtattcgctgtccggccacgtcactcggcccggccagtacgaggcgccgctgggaatcacgttgcgcgagttgctcgattacgccggcggggtgcgggccgggcaccggctcaagttctggacccccggcggctcgtcgaccccgctgctgaccgacgaacacctcgacgtgccactggattacgagggcgtgggcggggtcggctcgatgctgggcaccaaggcgctggagatcttcgacgagaccacctgcgtggtgcgtgcggtgcgccgctggacctacttctacaagcacgagtcgtgcggcaagtgcacgccgtgccgcgagggcacgttctggctcgaccagatctacgaacggctggagaccggtaagggcacggccgaggacatcgacaagctgctggacatctccgacaccatcctgggaaagtcgttctgcgcgttgggcgatggcgccgccagcccggtgatgtcgtcgatcaagtacttccgcgacgagtacgtcgcccacgtcgagaacggcagatgcccgttcgacccgcgagactccatgctgacaccgaacgggagcgactcgtga

SEQ ID NO: 39195 - protein, 453 aa, Mycobacterium avium subsp. paratuberculosis K-10
MTTTSETSEASGAPQATPLTPVISRFWDDPESWTLQTYHRHGGYTAMKKALAMEPDAVIGMVKDSGLRGRGGAGFSTGTKWSFIPQGDTGAAAKPHYLVVNADESEPGTCKDIPLMLATPHVLIEGVIIAAYAIRANHAFIYVRGEVLPVLRRLQNAVAEAYAAGYLGRDIDGSGFDLELVVHAGAGAYICGEETALLDSLEGRRGQPRLRPPFPAVAGLYGCPTVINNVETIASVPSIIGNGVDWFRSMGSEKSPGFTLYSLSGHVTRPGQYEAPLGITLRELLDYAGGVRAGHRLKFWTPGGSSTPLLTDEHLDVPLDYEGVGGVGSMLGTKALEIFDETTCVVRAVRRWTYFYKHESCGKCTPCREGTFWLDQIYERLETGKGTAEDIDKLLDISDTILGKSFCALGDGAASPVMSSIKYFRDEYVAHVENGRCPFDPRDSMLTPNGSDS

SEQ ID NO: 39196 - DNA, 1254 bp, Wolbachia endosymbiont of Drosophila melanogaster
  CDS (1)..(1254): transl_table=11
atgctaaaagaacaagacaaaatattcaccaacctaaatggtaaaggaactccactacttgagggtgcaaaaaaacgtggtagctggcaaaaaacaaaggaattactggatttaggatcagaaaagatcattgatgaagtaaagaaatctggtttgagaggtcgagggggtgcaggattttccaccggccttaagtggagctttatgcccaaaaatctcccaaaagcatatttagtagtcaatgcagatgagtcagaacctggtacatgtaaagatagagatatattgcgatatgagccacataagttacttgagggaattctcctggccggcaaagcgatcagcgcatcagttgcatatatttatatcaggggtgaattttataatgaatatttagttctaaaaaaagcacttgaggaagcctataaagaaggtttaattggaaaaaatgcctgcaaatcaggttatgatcttgatgtgtttatccataggggcgcaggagcttacatatgtggggaagaaacagctcaactcgaatcaattgaaggaaaaaagggctttcctcgcatgaagcctccatttcccgcaggtgttggactttttggctgcccaaccacaataaacaacgttgaaactatagccatggttccagatattctgaatcgcggaggagaatggtttgcatctcttggtaaaccaaataatactggtaccaaggtcttttgtatttcagggcacgtaaacaacccgtgtaatgttgaagaagagctcggaattccattacgtgaattaattgaaaaatacgcaggtggagtgcgaggaggttgggataatttacttgctgtaatacctggtgggtcttcagtgccattaattccaaaatctatatgtgatactattgaaatggattttgattcattaagaactgcacaatcagggcttggtactgctgctgtaatagtgatgaataaatcaactgatataatagctgcaatagagaggttatcacacttttatatgcatgagtcctgtggacaatgcacaccatgccgtgaaggtactggatggatgtggaggattatgaagaggatggtggcaggagatattaagcctgatgaaatagataagctgcttgaccttacaactcaaatagaaggacatacaatttgcgcacttggcgatgctgcagcttggccgattcaaggattaataagacattttcgccatgttatcaaagagagagcgataatttaa

SEQ ID NO: 39197 - protein, 417 aa, Wolbachia endosymbiont of Drosophila melanogaster
MLKEQDKIFTNLNGKGTPLLEGAKKRGSWQKTKELLDLGSEKIIDEVKKSGLRGRGGAGFSTGLKWSFMPKNLPKAYLVVNADESEPGTCKDRDILRYEPHKLLEGILLAGKAISASVAYIYIRGEFYNEYLVLKKALEEAYKEGLIGKNACKSGYDLDVFIHRGAGAYICGEETAQLESIEGKKGFPRMKPPFPAGVGLFGCPTTINNVETIAMVPDILNRGGEWFASLGKPNNTGTKVFCISGHVNNPCNVEEELGIPLRELIEKYAGGVRGGWDNLLAVIPGGSSVPLIPKSICDTIEMDFDSLRTAQSGLGTAAVIVMNKSTDIIAAIERLSHFYMHESCGQCTPCREGTGWMWRIMKRMVAGDIKPDEIDKLLDLTTQIEGHTICALGDAAAWPIQGLIRHFRHVIKERAII

SEQ ID NO: 39198 - DNA, 1293 bp, Bdellovibrio bacteriovorus HD100
  CDS (1)..(1293): transl_table=11
atgtctgaagtaaaaatgcttacagaattctaccacctgcctgaatatcaaactctggcgggctacaaagccaagggtggttacgaaactcttcataaagcttttaaaatgcaacctcaggccatcatcgatgaagtgaaagcttcgggtttgcgtggtcgtggtggtgcgggtttcccgaccggtatgaagtggggctttttgccgaaaaatggcgagccacgctatcttctttgcaacgccgatgaaggtgaaccggggactttcaaggatcgtatgatgatggagcgtgctccacatcagttgatcgagggcatgatcatttctgctttcgcgatcggttcccacaaaggttacatctatgttcgtggtgaatacgtattcccgatcgaatgcctgaacaaggcaatcaaagaggcttacgctgccggcctgctgggtaaaaacatcctgggttctggttttgacttcgatctggatgtttaccgtggcgcaggcgcttacatctgcggtgaggaaacaggcatgatttcttctttggaaggtctgaaaggccagccaaaactgaaaccgccattcccggcagttcagggttacctgagaaagccgaccatcgtgaacaacgtggagactctggctgcagtaacatacatcattaaagacggcgctcaggcctaccgcaaacacggtactgagaaatccgctggtactaaattgttctctttgtccggtaacgtgatgactccaggcaacttcgaagttccactgggttacccgttgatggacctgatcatgaaagagggcggcggtatgaagccgggccgcaaactgaaagcggttattccgggtggttcttccgctccggttctgacagctgaagaagtggcgaaagcaaacttggattacgaatccctggcgggtctgggcacaatgcttggttccggcgcggtgatcgtgatcgacgattcccagtgcatggttgatatgctgggtgttttgactcacttctatgctcacgaatcttgtggtcagtgcacgccttgccgtgagggtacaggctggctgaataaagttcttcattcgattctggaaggccgcggccgtttgcaggacatcgatttgttgatcaaagtggctgacaacatgaaaggtaaaaccatctgcgcgctttccgatgcagcggctttgccggttctcagctttgtaactaaattccgtgatgagtttgaattctacgttcgcgaaggacgctctaaggtaaaaggaacgacatatgccgaaatgcaccattaa

SEQ ID NO: 39199 - protein, 430 aa, Bdellovibrio bacteriovorus HD100
MSEVKMLTEFYHLPEYQTLAGYKAKGGYETLHKAFKMQPQAIIDEVKASGLRGRGGAGFPTGMKWGFLPKNGEPRYLLCNADEGEPGTFKDRMMMERAPHQLIEGMIISAFAIGSHKGYIYVRGEYVFPIECLNKAIKEAYAAGLLGKNILGSGFDFDLDVYRGAGAYICGEETGMISSLEGLKGQPKLKPPFPAVQGYLRKPTIVNNVETLAAVTYIIKDGAQAYRKHGTEKSAGTKLFSLSGNVMTPGNFEVPLGYPLMDLIMKEGGGMKPGRKLKAVIPGGSSAPVLTAEEVAKANLDYESLAGLGTMLGSGAVIVIDDSQCMVDMLGVLTHFYAHESCGQCTPCREGTGWLNKVLHSILEGRGRLQDIDLLIKVADNMKGKTICALSDAAALPVLSFVTKFRDEFEFYVREGRSKVKGTTYAEMHH

SEQ ID NO: 39200 - DNA, 1473 bp, Candida albicans SC5314
  CDS (1)..(1473): transl_table=12
atgcttagcaattttaaaataaaaccacgcacattactacgtggattagccactgctgctgctgacccagctgccaatcctaatagagtacatggtggattaaaagatcaagatcgtatatttcaaaatgtttatggaacttatggtcatgatttgaaatctgctcaaaaaatgggtgattggtataaaactaaagaaattatattaaaaggagataaatggattattgatgagatgaaaaaatccggattaagaggtcgtggaggtgctggtttcccctcaggtttaaaatggtcatttatgaatccgccaggttgggaaaaaaatgttggaccaagatatttggtggttaatgctgatgaaggggaaccaggtacttgtaaagatagagaaatcattagaaaagatcctcataaattagttgaaggttgtttattagctggtagagctatgaatgccactgctgcttatatttatattagaggtgaattttataatgaaacagttgttttacaaaatgccattaatgaagcttataaagcaggattgataggtaaaaatgcatgtggatcaggttatgattttgatatttatattcatcgtggtatgggtgcctatatttgtggtgaagaaaccgctttgattgaatccatcgaaggtaaagctggtaaaccaagattgaagccacctttcccagctggtgttggtttatttggtagaccaactactgttgccaatgttgaaagtgtatcagttgctcctactattttaagaagaggtggtgattggtttgcttcatttggtcgtgaaagaaatgccggtaccaaattgttttgtatttctggacatgttaatgaaccatgtactgttgaagaagaaatgtcgatcccattgaaagaattgttagaaaaacattgtggtggtattgttggtggttgggataatttattaggagttattcctggtggatcctcagtgcctattatgcctaaagaaacatgtgacaatgttttaatggattatgatgccttgagagatgttggctccgggttaggtactgctgctgttattgtcatgaataaacaaacagatattataagggcaattcaaagattttctcatttctataaacatgaatcttgtggtcaatgtactccatgtcgtgaaggtaccacttggttacaaagaatgatggatagattttacactggtcaagccactgaaaaggaaattgatcaaatttttgaattgactaaagaaattgaaggtcacactatttgcgccttgggtgatgctgctgcttggccagttcaaggtttaatcaaatcatttagaccagttatggtagatagaattaaagaattccaacaaaaacacgctggtgaacaccttgaatatggtggatgggttgatggtggtaaagtaaagaatggtgttgttattgacaatccattaccatctggccatcattag

SEQ ID NO: 39201 - protein, 490 aa, Candida albicans SC5314
MLSNFKIKPRTLLRGLATAAADPAANPNRVHGGLKDQDRIFQNVYGTYGHDLKSAQKMGDWYKTKEIILKGDKWIIDEMKKSGLRGRGGAGFPSGLKWSFMNPPGWEKNVGPRYLVVNADEGEPGTCKDREIIRKDPHKLVEGCLLAGRAMNATAAYIYIRGEFYNETVVLQNAINEAYKAGLIGKNACGSGYDFDIYIHRGMGAYICGEETALIESIEGKAGKPRLKPPFPAGVGLFGRPTTVANVESVSVAPTILRRGGDWFASFGRERNAGTKLFCISGHVNEPCTVEEEMSIPLKELLEKHCGGIVGGWDNLLGVIPGGSSVPIMPKETCDNVLMDYDALRDVGSGLGTAAVIVMNKQTDIIRAIQRFSHFYKHESCGQCTPCREGTTWLQRMMDRFYTGQATEKEIDQIFELTKEIEGHTICALGDAAAWPVQGLIKSFRPVMVDRIKEFQQKHAGEHLEYGGWVDGGKVKNGVVIDNPLPSGHH

SEQ ID NO: 39202 - DNA, 1332 bp, Leptospira interrogans serovar Copenhageni str. Fiocruz L1-130
  CDS (1)..(1332): transl_table=11
atggcagaaatgaaacttcttacgaaatacatcgacaatcctcagtccaccaaactggagttttacgaatccgtacacggatacgatggaatgaaaaaagcgcttcagatgaaaccagacgacatcatcgcagaagtcaaaaaatccggactgagaggaaggggtggagccggttttccgaccggtcttaaatggtcgtttattcccaaagacattccaaaaccgaaatatatcatttgtaacgcggacgaaggagaaccgggaacattcaaagatcgtaaactgattgagaatcttccacatcagattatagaagggatgatcataggagcgcgcgcgatcggttccaacaaaggatttttttatattcgaggagaattccaaaaaggcgcaaaagccatacaggcggcgatcgacgaagcctactccaaaggatatttaggaaagaatattttaggaagcggttttgattttgatctgattctttacgaaggagcgggcgcttatatctgtggagaagaaaccgcgctgatcaattcactcgaaggaagaaggggccatcctagattaaaaccccccttccccgccgtgtcgggactttatcgttctccgaccgtagtcaataacgtagaaactttttcggcgattcctcatattttagataagggagcggattggtattctaaaataggaacggaaaaatctccgggcacgagattattcagcgtatccggtcacgtaaaaaaaccgggcgtttacgaaatcgaattaggaactcctttattagaattagtgaatgatctttgtggtggaatcatagacgataaacctctcaaggcgatcattccgggaggatcctccgttccgattctcaccgcggaagaatgtaaaaccgcaaatatggattttgaatccatggccgctcataaaaccatgctcggctctggagcggtaatcgttcttgcggaaggaactgacattgtagaaaccacgtatcgattcgcccgtttttacgcacacgaatcctgcggtcagtgcactccttgtagagaaggaacacattgggtcagggacattctctataaaattagagaaggagaaggaacaaccgaagacatagatctgattttttctttatccagaaatatggaaggaggaaccacgatctgtccactttcagacgcttgtgtaggagcggtccgaccagcgttacaaaagttccgctccgagtttgacgcaaaattgaaagtaaaaccgatcgtacccgatcatcctcgaagaagaaaagaagataagatcgagtcgactgcaggagaaaagacaagtccatga

SEQ ID NO: 39203 - protein, 443 aa, Leptospira interrogans serovar Copenhageni str. Fiocruz L1-130
MAEMKLLTKYIDNPQSTKLEFYESVHGYDGMKKALQMKPDDIIAEVKKSGLRGRGGAGFPTGLKWSFIPKDIPKPKYIICNADEGEPGTFKDRKLIENLPHQIIEGMIIGARAIGSNKGFFYIRGEFQKGAKAIQAAIDEAYSKGYLGKNILGSGFDFDLILYEGAGAYICGEETALINSLEGRRGHPRLKPPFPAVSGLYRSPTVVNNVETFSAIPHILDKGADWYSKIGTEKSPGTRLFSVSGHVKKPGVYEIELGTPLLELVNDLCGGIIDDKPLKAIIPGGSSVPILTAEECKTANMDFESMAAHKTMLGSGAVIVLAEGTDIVETTYRFARFYAHESCGQCTPCREGTHWVRDILYKIREGEGTTEDIDLIFSLSRNMEGGTTICPLSDACVGAVRPALQKFRSEFDAKLKVKPIVPDHPRRRKEDKIESTAGEKTSP

SEQ ID NO: 39204 - DNA, 1317 bp, Thermus thermophilus HB27
  CDS (1)..(1317): transl_table=11
atgacgggccccatcgtttccggactagaccctaggtttgaacggaccctctacgcccacgtggggaaggaggggtcctggaccctggactactacctccggcacggggggtacgagacggcgaagcgggtgctcaaggagaagaccccggacgaggtcatagaggaggtgaagcgctccgggcttaggggccggggcggggcgggcttccccacggggcttaagtggagcttcatgcccaaggacgacgggaagcagcactacctcatctgcaacgccgacgagtccgagcccgggagcttcaaggaccgctacatcctggaggacgtcccccacctcctcattgaggggatgatcctcgccgggtacgccatccgggccacggtgggctacatctacgtccgcggggagtaccgcagggcggcggaccggctagaacaagccatcaaggaggcccgggcccggggctacctggggaagaacctcttcggcacggacttctcctttgacctccacgtccaccggggggccggggcctacatctgcggcgaggagacggccctcatgaactccctggagggcctaagggcgaacccccgcttgaagccccccttccccgcccagtcgggcctttggggcaagcccaccaccatcaacaacgtggagaccttggcctccgtggtgcccatcatggaacggggcgccgactggttcgcccagatgggcacggagcagtccaaggggatgaagctctaccagatctccgggcccgtgaagcgccccggggtgtacgagctccccatgggcaccacgttccgcgagctcatctacgagtgggcgggcgggcccctggagcccatccaggccatcatccccggggggtcctccaccccgcctctgcccttcaccgaggaggtcctggacacccccatgagctacgagcacctccaggccaagggctccatgctgggaacggggggcgtgatcctcatccccgagcgggtgagcatggtggacgccatgtggaacctcacccgcttctacgcccacgagtcctgcggcaagtgcaccccctgccgcgagggcgtggcggggttcatggtgaacctcttcgccaagatcggcaccggccagggggaggagaaggacgtggagaacctggaagccctcctccccctcattgaggggcggagcttctgccccttggcggacgcggcggtgtggccggtgaagggctcgctaaggcacttcaaggaccagtacctggccctggcgcgggagaagcgccccgtgcccaggccttccctctggaggtga

SEQ ID NO: 39205 - protein, 438 aa, Thermus thermophilus HB27
MTGPIVSGLDPRFERTLYAHVGKEGSWTLDYYLRHGGYETAKRVLKEKTPDEVIEEVKRSGLRGRGGAGFPTGLKWSFMPKDDGKQHYLICNADESEPGSFKDRYILEDVPHLLIEGMILAGYAIRATVGYIYVRGEYRRAADRLEQAIKEARARGYLGKNLFGTDFSFDLHVHRGAGAYICGEETALMNSLEGLRANPRLKPPFPAQSGLWGKPTTINNVETLASVVPIMERGADWFAQMGTEQSKGMKLYQISGPVKRPGVYELPMGTTFRELIYEWAGGPLEPIQAIIPGGSSTPPLPFTEEVLDTPMSYEHLQAKGSMLGTGGVILIPERVSMVDAMWNLTRFYAHESCGKCTPCREGVAGFMVNLFAKIGTGQGEEKDVENLEALLPLIEGRSFCPLADAAVWPVKGSLRHFKDQYLALAREKRPVPRPSLWR

SEQ ID NO: 39206 - DNA, 1299 bp, Parachlamydia sp. UWE25
  CDS (1)..(1299): transl_table=11
atgtctgaaatgcgtattttaacagcttacatggatgatccacatcaatgtaagatcgaaacttatgagcgtaatggcggttatcaagcactcaaaaaagcaatttcttctatttcctcggatcagctaattgaaatggtaaaacaatcttggttgagaggtagaggtggaggtggttttcaaacaggcttgaaatggagttttgtccccaaagattgtcaaatttctaaatatctcgtttgcaattgtgatgaaagtgaacctggtacatttaaagatcgatatatcattgaaaatgatcctcatcaattaattgaaggaataattttagcttgttacgcaataggggcaaagcaggcttttatttattgcagaggagaattttttgaaggaaataaaaagttgcgattagctattcaagaagctaaaaaaagaggttatttagaagctccattaggagaagcaaatttttctgttagtattattgttcatccaggcgcaggagcctatattgcaggcgaagaaactgctcaattgaattcacttgaaggctatcgtgcaactcctcgtttaaaacccccttttccagcagtttctggcttatatgaaaaaccgactgtcgttaataatgttgaaacattatgtaacgttgttcacattgtgaatcgtggagttgaatggtatcaaagtattggtaaaccaaaaaatacaggaacaaaaatcttccaagttagcggtcatgttcaaaatccaggatgttttgaatttcctttgggaattcctttaaaagaagttttagaaagagctggttggatgctaccaggccatcaatttaaagcttgttatccggggggatcatcttgttcattattgactgaacgggatttagatactcctatggattttgatagtgttgcagcaaaaaaatccatgttgggaacggcatcaattattgttatggatgattcgacggatatggtgaaagttgccaatcgtttgatggaattctatcaaaatgagtcttgtggaaaatgtactccttgtcgcgaagggacgcgttggacaaaacaaatccttactcgtatcttagcgggtaggggaacagttggggatttaaaaacgatagagcgaatttgtcaacaaatggaaatggattcgttttgcccgttggctccaggagctgctcttccaattgtcagtgcgattagagaattcagaggcgaatttgaatcttatattatgcgtaacattcatgctgataaacctcctgaaatgaaaattacttatccttatttgtag

SEQ ID NO: 39207 - protein, 432 aa, Parachlamydia sp. UWE25
MSEMRILTAYMDDPHQCKIETYERNGGYQALKKAISSISSDQLIEMVKQSWLRGRGGGGFQTGLKWSFVPKDCQISKYLVCNCDESEPGTFKDRYIIENDPHQLIEGIILACYAIGAKQAFIYCRGEFFEGNKKLRLAIQEAKKRGYLEAPLGEANFSVSIIVHPGAGAYIAGEETAQLNSLEGYRATPRLKPPFPAVSGLYEKPTVVNNVETLCNVVHIVNRGVEWYQSIGKPKNTGTKIFQVSGHVQNPGCFEFPLGIPLKEVLERAGWMLPGHQFKACYPGGSSCSLLTERDLDTPMDFDSVAAKKSMLGTASIIVMDDSTDMVKVANRLMEFYQNESCGKCTPCREGTRWTKQILTRILAGRGTVGDLKTIERICQQMEMDSFCPLAPGAALPIVSAIREFRGEFESYIMRNIHADKPPEMKITYPYL

SEQ ID NO: 39208 - DNA, 1308 bp, Bartonella quintana str. Toulouse
  CDS (1)..(1308): transl_table=11
atgctggctgataaagatcgcattttcaccaatatttatggtttgaaagacaaatcattaaaggctgcgatgtcgcgtgggcattgggatggtataaaggcgattattgataaaggtcgtgattggatcattgatgaggtgaaagcatcggggttacgtggccgtggtggagctggttttcctactggaatgaagtggtcttttatgccaaaacaaaatgatggccgtcctcattatttggttgtaaatgcagatgaatcagagccgggaacttgtaaagaccgcgatattttgcggcatgatccccatactttgattgaagggtgtgcacttgctacttttgcaatgggagccaatgtcgcttttatttatgttcgtggtgaatatattcgtgagcgtgaagcgcttcaagctgccgttgatgaatgttatgatgcaggtttacttggcaaaaaaacgaaatatgggcatgtttgcgatattattattcatcatggtgctggtgcttatatttgtggcgaagaaacagctcttctcgaaagtcttgaggggaaaaaaggacaacctcgacttaaaccaccattccctgcgaatgtggggatttatggctgtccaacaacagttaataatgtagagtccattgccgttattccaacgattttgcgtcgtggtgcttcgtggttttcatcaatcggacgtgcaaataataccggaacaaaattatttatggtttctgggcatgttaatgcaccttgtacatttgaagaagctctaggtgtttcttttcgcgaattaattgaaaagcataccggtggtattcgtggtggatggagtaatcttttagcagttattccaggtggagcttcttgtccggttgttcgtggtgaggatatggttgatgcgatcatggattttgatgggatgcgcgatgttggatcttcttttggcacaggtggtgtgattgttatggataaatcaaccgatattatcaaggcaatttggcgtataacagcttttttcaagcatgagagttgtggtcaatgtacaccgtgtcgtgaaggcacaggttggatgatgcgtcttttagggcgtatggttgagggaagagcgcaaaaacgtgaaattgatcttttgtttgaagtttctgaacaagttgaaggacacactatatgtgcactgggtgatgctgccgcatggcctatacaggggttgatacgtaattttcgtccagaaattgagcgtagaattgatgattatacgcgaagtgtcatccaaagcaaaaatattgctttgggagcagtaggatag

SEQ ID NO: 39209 - protein, 435 aa, Bartonella quintana str. Toulouse
MLADKDRIFTNIYGLKDKSLKAAMSRGHWDGIKAIIDKGRDWIIDEVKASGLRGRGGAGFPTGMKWSFMPKQNDGRPHYLVVNADESEPGTCKDRDILRHDPHTLIEGCALATFAMGANVAFIYVRGEYIREREALQAAVDECYDAGLLGKKTKYGHVCDIIIHHGAGAYICGEETALLESLEGKKGQPRLKPPFPANVGIYGCPTTVNNVESIAVIPTILRRGASWFSSIGRANNTGTKLFMVSGHVNAPCTFEEALGVSFRELIEKHTGGIRGGWSNLLAVIPGGASCPVVRGEDMVDAIMDFDGMRDVGSSFGTGGVIVMDKSTDIIKAIWRITAFFKHESCGQCTPCREGTGWMMRLLGRMVEGRAQKREIDLLFEVSEQVEGHTICALGDAAAWPIQGLIRNFRPEIERRIDDYTRSVIQSKNIALGAVG

SEQ ID NO: 39210 - DNA, 1308 bp, Bartonella henselae str. Houston-1
  CDS (1)..(1308): transl_table=11
atgctggctgataaggatcgcattttcaccaatctttatggtttaaaagacaaatcattaaaggctgcgatatcacgtggacattgggatggtaccagggcaattatcgataaaggtcgtgattggattattgatgagatgaaggcatcgggtttgcgtggccgtggtggtgcgggttttcctactggaatgaagtggtcttttatgccaaaacagagcgatggtcggcctcattatttggttgtaaatgcagatgaatcagagcctggtacatgtaaagatcgcgatattttgcgacatgatccccatactttaattgaaggatgtgtacttgctacttttgcgatgggagcaaatgtcgcttttatttatattcgtggtgaatatattcgtgaacgtgaagcgcttcaagctgccgttgatgaatgttatgatgctggtttgcttggcaaaaaaacgaaatatgggcatgcttgtgatattattattcatcatggtgctggtgcttatatctgtggggaagaaaccgctcttcttgaaagtcttgaaggaaaaaaaggacaacctcggcttaaaccgccatttcctgcaaatatgggaatttatggctgtccaaccacagtcaataatgtagagtccattgctgttgtgccaacaattttgcgtcgcggtgcttcatggttttcatcaattgggcgtgcaaataatgttggaacgaaattgtttatggtttctgggcatgtgaatgcaccttgtacatttgaagaagctcttggagtttcttttcgtgaattaattgaaaaacataccggcggtattcgtggtgggtggaataatcttttagcagttattccaggaggggcttcttgcccggtcgttcgtggtgaggatatggtggatgcgattatggattttgatggaatgcgcgatgtcggatcttcttttggtacaggaggtatgattgttatggataaatcgaccgatattatcaaggcaatttggcgtatagcagctttttttaagcatgaaagttgtggtcagtgcacaccatgtcgtgaaggaacgggttggatgatgcgtcttttaggacgtatggttgagggaaaggcgcaaaaacgcgagattgatcttttatttgaggtttctaaacaagttgaagggcacactatttgtgcacttggtgatgctgccgcgtggcctatacaggggttaatacgtaattttcgtccagaaattgagcgtagaattgatgattatacgcgtaatgtagtccaaagaaaaaatattgctttagaagcagtagaatag

SEQ ID NO: 39211 - protein, 435 aa, Bartonella henselae str. Houston-1
MLADKDRIFTNLYGLKDKSLKAAISRGHWDGTRAIIDKGRDWIIDEMKASGLRGRGGAGFPTGMKWSFMPKQSDGRPHYLVVNADESEPGTCKDRDILRHDPHTLIEGCVLATFAMGANVAFIYIRGEYIREREALQAAVDECYDAGLLGKKTKYGHACDIIIHHGAGAYICGEETALLESLEGKKGQPRLKPPFPANMGIYGCPTTVNNVESIAVVPTILRRGASWFSSIGRANNVGTKLFMVSGHVNAPCTFEEALGVSFRELIEKHTGGIRGGWNNLLAVIPGGASCPVVRGEDMVDAIMDFDGMRDVGSSFGTGGMIVMDKSTDIIKAIWRIAAFFKHESCGQCTPCREGTGWMMRLLGRMVEGKAQKREIDLLFEVSKQVEGHTICALGDAAAWPIQGLIRNFRPEIERRIDDYTRNVVQRKNIALEAVE

SEQ ID NO: 39212 - DNA, 1332 bp, Acinetobacter sp. ADP1
  CDS (1)..(1332): transl_table=11
atgaatactgaaccaaaaccgatttatggcgacggaaaccctgaaactcatccgctgacttggcgtttgagtaagcaggagcatgtacgtagtgctgatgattacgaagcactagacggttatgcaggttttaaaaaagccattggcatgacacctgctgaagtccttgatgtcgtaaaagccgcaacagtcaaaggccgtggtggtgctggtttccctgccgggatcaaatggtcattgatggcgccaaatgatggtggtcctcgctacctgatttgtaatgccgatgaaatggaaccagggacttttaaagaccgtctattgatggaaaagttacctcaccagctgattgaaggtatgttgattgcagcatatacacttgaagcgactcagggttacatctttatccgtggtgaatatattgaagctgcccagtacttaaatgaagcactggaacaggctcgtgccaaaggttatcttggcgataatattcttggaacaggctggaatttcgagctttacgtccatacgggtgcggggcgttatatttgtggtgaagaaactgcattgattaactcactggaaggccgtcgtgccaacccacgtaccaaaccaccatttccacaggttgcaggtgcttggggtcgtccaaccatcgtcaataacgtagaaacctataataacttaccagcgatcatgttacgtggtcctgagtggtatatcggattgtctgctggcaagtcaaaagacccaggtaccaagatttatggtgcatcgggtaaagttaaattcccaggtttatgggagcttccatttggtacaactgcgcgcgaagtgattgaagagcatgcaggtggtatgcgtgatggattaaagctgaaagcatggttaccaggtggtgcatcaacagactttttggctgctgagcacattgatctgcctatggattcagaaagcattatgaaggcgggttctcgtttgggaacatgcttgctgatggtggtggatgaaacccaatgtatggtttcagcaacacgtaatctggaagaattctttgcacgtgaatcatgtggttggtgtacaccctgtcgtgatggtttgccttgggctgtgaaagcattaaaagcgctcgagaatggtgaagggaagatggaagatattcagcatcttcaggaactgactcgaaagttatggattggtaagactttctgtgctcacgcaccaggtgcgatggagccactgatgggcgcactcaaatatttccgtagcgagtttgaagcgaaagtggcaaaaagcccagtcgttcaaactagccacgtagcacaagcttaa

SEQ ID NO: 39213 - protein, 443 aa, Acinetobacter sp. ADP1
MNTEPKPIYGDGNPETHPLTWRLSKQEHVRSADDYEALDGYAGFKKAIGMTPAEVLDVVKAATVKGRGGAGFPAGIKWSLMAPNDGGPRYLICNADEMEPGTFKDRLLMEKLPHQLIEGMLIAAYTLEATQGYIFIRGEYIEAAQYLNEALEQARAKGYLGDNILGTGWNFELYVHTGAGRYICGEETALINSLEGRRANPRTKPPFPQVAGAWGRPTIVNNVETYNNLPAIMLRGPEWYIGLSAGKSKDPGTKIYGASGKVKFPGLWELPFGTTAREVIEEHAGGMRDGLKLKAWLPGGASTDFLAAEHIDLPMDSESIMKAGSRLGTCLLMVVDETQCMVSATRNLEEFFARESCGWCTPCRDGLPWAVKALKALENGEGKMEDIQHLQELTRKLWIGKTFCAHAPGAMEPLMGALKYFRSEFEAKVAKSPVVQTSHVAQA

SEQ ID NO: 39214 - DNA, 1350 bp, Erwinia carotovora subsp. atroseptica SCRI1043
  CDS (1)..(1350): transl_table=11
atgagtaaagacattgttctgactgctgagcagcaccctctgacctggcgtttacgcgcagacaaacagccggtgtggctggatgaatatcgcagtaaaaatggttatgtcgccgcgcaaaaagcgttaacgggtatggcgcaggatgaagtggtctcgctggttaaagacgccggcctgaaagggcgtggcggtgcgggcttttcaacaggcttgaagtggagcctgatgccgaaagacgaaagcatgaacatccgctatctgctatgtaacgcagatgagatggagccaggtacttataaagaccgcctgttgatggagcaagagcctcatctgctggttgaaggcatgctaatcagcgcctttgcgctgaaagcctaccgcggttacatcttcctgcgtggagaatacatcgaagctgctgttcacttgcgtcgtgcaattgaagaagcaaaagccgctggcttgctaggcaagaatatcctgggcagcggattcgatttcgagctgttcgtgcatacgggcgcagggcgttacatctgcggcgaagaaactgcactgattaactcgctggaaggccgtcgtgctaaccctcgctccaagccgccgttccctgcgtctgcgggtgcttggggcaaaccgacttgcgtcaataacgtcgaaacgctgtgtaacgtgcccgcgattatcgagcacggtgcggcgtggtatcagggattgtctgcgggtaaaagtaaagatgccggcacgaaactgatgggcttttctggccgcgtcaagaatccgggcctgtgggaactgccttttggcaccacggcgcgtgagattttggaagattacgcgggcggcatgcgcgatggtctgaaactgaaagcttggcagccgggcggtgcaggtacagatttcctaacggaaagccatctcgatctgccgatggactttgagcacattgcaaaagcaggtagccgtatgggtaccgcgctggcgatggctgtcgatcacgaaatcaatatggtctcgttgacgcgcaatttggaagagttcttctcccgtgaatcctgtggctggtgtacaccgtgccgtgatggtctgccgtggagtgtgaagattctgcgtgcgctggaaaatggtgaaggtcagcctggcgatatcgaaacgctggagcagctttgccgtttcctcggaccgggtaacaccttctgtgcgcatgcgccgggtgcggtcgagccgctgcaaagtgccatcaagtatttccgggaagaattcgaagcgggtatctctaaacagtatttaggcaacctcaaagcgattggcggtattcagcctaacctgttgaaagagcgctggtaa

SEQ ID NO: 39215 - protein, 449 aa, Erwinia carotovora subsp. atroseptica SCRI1043
MSKDIVLTAEQHPLTWRLRADKQPVWLDEYRSKNGYVAAQKALTGMAQDEVVSLVKDAGLKGRGGAGFSTGLKWSLMPKDESMNIRYLLCNADEMEPGTYKDRLLMEQEPHLLVEGMLISAFALKAYRGYIFLRGEYIEAAVHLRRAIEEAKAAGLLGKNILGSGFDFELFVHTGAGRYICGEETALINSLEGRRANPRSKPPFPASAGAWGKPTCVNNVETLCNVPAIIEHGAAWYQGLSAGKSKDAGTKLMGFSGRVKNPGLWELPFGTTAREILEDYAGGMRDGLKLKAWQPGGAGTDFLTESHLDLPMDFEHIAKAGSRMGTALAMAVDHEINMVSLTRNLEEFFSRESCGWCTPCRDGLPWSVKILRALENGEGQPGDIETLEQLCRFLGPGNTFCAHAPGAVEPLQSAIKYFREEFEAGISKQYLGNLKAIGGIQPNLLKERW

SEQ ID NO: 39216 - DNA, 1335 bp, Propionibacterium acnes KPA171202
  CDS (1)..(1335): transl_table=11
gtgaccgatccactgaccccggttctgtcggccaattgggatgaagagcgcagttggaagctgcttaactacgagcgacagggcggatacaccggccttcgtaaggctttgacgatgccgcctgacgacgttgtctcgctggttaaggacgctaacctgcgtggccgtggtggcgccgggttccccaccggcatgaagtggtccttcgtgcctaaggacaatcccaacccgacctacctcgttgtcaacggcgacgagtctgagccgggcacgtgcaaggacatgccgctcatgatggcctccccgcacaccctcgtcgagggcgtcatcattgcctcctacgccatcaaggccaagatggccttcatctacatccgcggtgaggtgctgcacgtcgtccgacgcgtgcagcaggccgtgcgggaggcctactcggctggttacattggcaaaaacatcctcggttccgggtacgaccttgacgttgtcgtccatgccggcgcaggcgcctacatctgtggcgaggagacggctctgctggattccttggaggggcgtcgtggtcagcctcgtctgcgcccgcctttcccggccgttgccggcctgtacgccagtccgacggtcattaacaacgtcgagtccatctcgacggtgccgtcgatcctgcgcaacggcaaggaatggttcaagtccatgggcaccgagaagtccgatggtttcaccatctactctttgtctgggcacttggctcaccctgggcagtatgaggccccgatgggcactacgctgcgtcagctcctcgacatctccggtggcatgcgacagggacatgaactgaagttcttcacccccggtggttcctcgaccccgatcctgaccaaggacgacatcgacctcccgctcgactacgaggggatggctggggccaagacgatgctcggcacgaaagctctgcagtgcttcgacgagacgacctcggtggttcgcgtcacgttgcggtggttggagttttacaagcacgaatcctgcggtaaatgcaccccgtgccgtgagggcacctggtgggttgtccagatgttgcgtcgcatcgaggctggtgagggccaagagggtgacgtcgacaagttgatggacattgccgacaatatcggtggccgttctttctgcgctttggccgacggtgccgtgggctgtttgcgcggggctattggccacttccgtgacgagttcgaagctggatgtcgggggattcccgcttggcagtatctgccctatgagcgcagctcgatcttcaacgacgccgatcgccgagtcctggagggggccggagcatga

SEQ ID NO: 39217 - protein, 444 aa, Propionibacterium acnes KPA171202
MTDPLTPVLSANWDEERSWKLLNYERQGGYTGLRKALTMPPDDVVSLVKDANLRGRGGAGFPTGMKWSFVPKDNPNPTYLVVNGDESEPGTCKDMPLMMASPHTLVEGVIIASYAIKAKMAFIYIRGEVLHVVRRVQQAVREAYSAGYIGKNILGSGYDLDVVVHAGAGAYICGEETALLDSLEGRRGQPRLRPPFPAVAGLYASPTVINNVESISTVPSILRNGKEWFKSMGTEKSDGFTIYSLSGHLAHPGQYEAPMGTTLRQLLDISGGMRQGHELKFFTPGGSSTPILTKDDIDLPLDYEGMAGAKTMLGTKALQCFDETTSVVRVTLRWLEFYKHESCGKCTPCREGTWWVVQMLRRIEAGEGQEGDVDKLMDIADNIGGRSFCALADGAVGCLRGAIGHFRDEFEAGCRGIPAWQYLPYERSSIFNDADRRVLEGAGA

SEQ ID NO: 39218 - DNA, 1905 bp, Desulfotalea psychrophila LSv54
  CDS (1)..(1905): transl_table=11
ttgaccagaaggaagaggccaatgacgattaaagagatacgacagcaggcagaggcgaactggcagtcacttataaagggcaccgttatctatattggagctgcaacctgtggacgttccgccggcgccctaaaaaccaaaaaagcctttgagacagagctggcaaaacaaaatgttaaggctgaaattgtcgaggtgggttgctttggcccctgttacacagagcccctgatctgtattgccagacccggcaagaccaagctcttctttcaaaatgtcgacggagagagggcggaagaactggtgactggctacctgcaaacaggagagattccccgtgactatctctttgctgccgtcccagaagatggcattgaacgggaaaaggaattgccataccttgatgaaaagccagaatttgcccggcaaaaaagaattctctttgccagcttcggctttaccgaccccaccaatatagagcactacctcgtccatgatggctacctggccctggaaaagtccctgcaagagggccctgacatggtacttaccgagataaaaaaatctgccctacgcggtcgcggcggtggcggcttccctgctgcccgcaagtgggaggcgggcaggaaagctacaggtcaccctaaatatgtggtctgtaacgcagatgaaggtgaccccggagccttcatggatcgatccgtgctcgagggtgatccccatgcagttcttgagggcatggccattgccggcctcaccattggttctgaaaaaggctatatctatgtccgggcagaatacccccttgccattgcccgattgcaaaatgccatcgatcaggccaaggagaaaaacctcctcggagccaacatcctcggcacagacttctcctttgacatcgaactattccagggagcaggggcctttgtctgcggggaatcgacggcactcacccaatccatccagggctaccgcggcatgcccaaggcctctccccgcccccgtaccaccgacgagggtctctttgacaagccaaccctgctcaataacgtaaagacctttgcctatgtccccaagattatcaacagcggcggtgaaagctttgccgccatcggtaccgagaagagcaagggtaccgctgtctttgccctgaccggaatggtcaagcactgcggactcatcgaagtccccatgggcaccaccctgcgtgaaatcgtctttgagctgggtggtgggatggtcggtgaaagtcccttcaaggccattcaatccggtggcccctccggtggctgccttcccgcccacacccttgatacccctgtggattatgactctctggtttctgccggggccatgatgggctccggtggactggtggtcatggatgagtcaacctgtatggtggacattgcccgatattttctcgatttcacccaaaaagagtcctgcggccagtgcaccctctgcaagcttggcaccaaacagatgctcaacatccttgaagatattgtcgccggtcgcggcaaagagggagacatagagctacttcttgaggtgggcgaggcagttaacgctggttctctctgcggactgggcaagagtgcagcaaaccccgttctcaccaccattaaatattttagagacgagtacgaggctcatatccgcgacaaggcctgtcccgcatgtgcatgcaaagaccttatctcttttcacatcgaccctgaaaaatgcacaggctgtactgcctgcgccagggcctgccctgtctcggccatcagtggcgaaaagagacaggtacatcaaatcgaccaagcactctgtatccgttgcggagtttgtctggaaaaatgtccgaaaaaatgggccgcagttagctgcatccccggtaatgggttgggagaataa

SEQ ID NO: 39219 - protein, 634 aa, Desulfotalea psychrophila LSv54
MTRRKRPMTIKEIRQQAEANWQSLIKGTVIYIGAATCGRSAGALKTKKAFETELAKQNVKAEIVEVGCFGPCYTEPLICIARPGKTKLFFQNVDGERAEELVTGYLQTGEIPRDYLFAAVPEDGIEREKELPYLDEKPEFARQKRILFASFGFTDPTNIEHYLVHDGYLALEKSLQEGPDMVLTEIKKSALRGRGGGGFPAARKWEAGRKATGHPKYVVCNADEGDPGAFMDRSVLEGDPHAVLEGMAIAGLTIGSEKGYIYVRAEYPLAIARLQNAIDQAKEKNLLGANILGTDFSFDIELFQGAGAFVCGESTALTQSIQGYRGMPKASPRPRTTDEGLFDKPTLLNNVKTFAYVPKIINSGGESFAAIGTEKSKGTAVFALTGMVKHCGLIEVPMGTTLREIVFELGGGMVGESPFKAIQSGGPSGGCLPAHTLDTPVDYDSLVSAGAMMGSGGLVVMDESTCMVDIARYFLDFTQKESCGQCTLCKLGTKQMLNILEDIVAGRGKEGDIELLLEVGEAVNAGSLCGLGKSAANPVLTTIKYFRDEYEAHIRDKACPACACKDLISFHIDPEKCTGCTACARACPVSAISGEKRQVHQIDQALCIRCGVCLEKCPKKWAAVSCIPGNGLGE

SEQ ID NO: 39220 - DNA, 1653 bp, Desulfotalea psychrophila LSv54
  CDS (1)..(1653): transl_table=11
atgaccctgacgcttgaagatcttaaccatatcgcggccatagaaaaagaacaccagcacagttttcaacatcagctgaatatttgtgttgctgcaggttgtctctcctgcggaagcggggagcttaaaacagcactgcaagaagaggtggctcgacgcgggctggataaacaggtctgcgtcaaaggggttggatgccttggactgtgttcagctggaccgcttgttgcccttgcctcgaagaatgtactttatcagggatgcggccctgctgatgtggagacaatcctcgatgctttggggggggcacctgcgaagcatttactctgttccagtgatattccctttttcaacaagcagcgcaaggttgtacttgagtactgtggtaaaatagaccctgaacgtattgaggaatatatcgcggtaggggggtaccagtccctatatactgcgttgcgtcaaatgacgcccaaggaagttatcgatgaggtcaccgcatctggcttacgtggtcgcggtggcgctggatatcccacaggcctcaaatggtctacggtgtccaaagcaatcaatgccgtgaagtatgttgtttgtaacgcagatgaaggcgaccctggtgcattcatggatcgaagtgtcttggaaagtgacccccaccgagtgatcgagggcatggctattggtgcttacgctgttggtgccaggcagggaattatttatgttcgagccgagtatccgctggcggtaaaacggctacaaaaggccattacccaggctaagcgcataggcattttggggaatggtatttttaacagcgactttcaatttgatattcaaatcaggttgggggcaggcgcttttgtctgcggagaagaaacagcgctgattgcctctattgaaggccgagtaggaaaaccgtgtccgcgccctccttatcctgccgaatcagggttaaaacaatgtcccaccttaatcaataatgtggaaacctttgccaatattgcacctattatccgcaatggcggtcagtggctggccagtatcggcaccagcaagagcaaaggaaccaaggtttttgctcttgccggtaaggtgcaacagaagggattgattgaagtggccatgggcacaaccctgggggagattgtttttgatatcggcggtggtatcgctgatggcggtacattcaaagccgtacagacaggcggcccctcgggtggttgtattccaaagcagtttcttgatatgggggtggattatgagtctcttgccaaggttggctcgattatggggtcaggaggcatgattgttatggatcaaggctcatgtatggtggatgttgccaggttttttgttgaattttgtatgagtgaatcgtgtgggaagtgtgtcccctgtcgggtggggaccaggcagatgcatgatgtgctgggcaagatcgcaagcggccggggggaggcgtctgatctcaccttgcttgaagagttgtgtgatttggtgaaaaataccgctctgtgcggtcttggccaggcatcggttaacccgatattgagcaccctatgctactttaaagatgagtacctggctcatattgaggagaagcggtgtattgctcattcctgcacactaccagtaaacaaggagggcaaatga

SEQ ID NO: 39221 - protein, 550 aa, Desulfotalea psychrophila LSv54
MTLTLEDLNHIAAIEKEHQHSFQHQLNICVAAGCLSCGSGELKTALQEEVARRGLDKQVCVKGVGCLGLCSAGPLVALASKNVLYQGCGPADVETILDALGGAPAKHLLCSSDIPFFNKQRKVVLEYCGKIDPERIEEYIAVGGYQSLYTALRQMTPKEVIDEVTASGLRGRGGAGYPTGLKWSTVSKAINAVKYVVCNADEGDPGAFMDRSVLESDPHRVIEGMAIGAYAVGARQGIIYVRAEYPLAVKRLQKAITQAKRIGILGNGIFNSDFQFDIQIRLGAGAFVCGEETALIASIEGRVGKPCPRPPYPAESGLKQCPTLINNVETFANIAPIIRNGGQWLASIGTSKSKGTKVFALAGKVQQKGLIEVAMGTTLGEIVFDIGGGIADGGTFKAVQTGGPSGGCIPKQFLDMGVDYESLAKVGSIMGSGGMIVMDQGSCMVDVARFFVEFCMSESCGKCVPCRVGTRQMHDVLGKIASGRGEASDLTLLEELCDLVKNTALCGLGQASVNPILSTLCYFKDEYLAHIEEKRCIAHSCTLPVNKEGK

SEQ ID NO: 39222 - DNA, 1266 bp, Rickettsia typhi str. Wilmington
  CDS (1)..(1266): transl_table=11
atgctaaaagaagaagataaaatttttattaatttgtatggacagcaaagctatgatttaaaatctagcaaaaagcgaggagattggtataatactaaggcattgcttgataaaggtagagacttcattattgacgaggttaagaaatcagggcttagaggacgcggtggtgctggattttctactggtatgaaatggtcatttatgcctaaaaattcagagaagccttgttatttagtagtaaatgcagacgaatctgagcctggtacttgtaaagatcgtgatatattaagatttgaaccgcacaaattaatagaaggttgtttgattgcaagctttgctataggagcgaataattgttatatctatattagaggtgaattttataatgaagcttctaatatgcagcgtgccttagatgaagcttatacagaagggttaataggcaaaaatgcttgtggttcaggttttgattgtaatatttatttacatcgtggtgcaggtgcttatatttgcggggaagaaactgcgttacttgagagcttagaaggtaaaaaaggtatgccacgacttaagccaccttttcctgctgggtttggtttatatggttgtccaactactataaataatgttgaatctattgcagtagtgccgacaattttaagacgaggggcaagttggtttgctgcaatcggtaagcctaacaatactggtactaagattttttgcatatctggtcatgttaataagccttgcaatattgaagaagcaatggggattccattaaaagaattgattgagaaatatgctggcggtgtgcgtggtggatgggataatcttaaagcaataatcccaggtggtgcttctgtgcctttgctacctaaatcattatgtgaagtagagatggattttgatagtttaagaacagtaggttctggacttggtacaggtggtattattgttatggatagatctactgacattatttatgcaatagcacgcctgagtaaattttatatgcatgaatcatgtgggcaatgtaccccttgccgagagggtactggttggatgtggcgagttatgatgcgcttagttaatggtaatgcaaaaaaaaccgaaatagaaactttgttgaatgttacaaaagaaatagaggggcatactatttgtgccttgggtgatgctgcagcttggccaatccaagggttgatacgacattttagagatgaaattgaggagaggatcaagaattttggcatagcttaa

SEQ ID NO: 39223 - protein, 421 aa, Rickettsia typhi str. Wilmington
MLKEEDKIFINLYGQQSYDLKSSKKRGDWYNTKALLDKGRDFIIDEVKKSGLRGRGGAGFSTGMKWSFMPKNSEKPCYLVVNADESEPGTCKDRDILRFEPHKLIEGCLIASFAIGANNCYIYIRGEFYNEASNMQRALDEAYTEGLIGKNACGSGFDCNIYLHRGAGAYICGEETALLESLEGKKGMPRLKPPFPAGFGLYGCPTTINNVESIAVVPTILRRGASWFAAIGKPNNTGTKIFCISGHVNKPCNIEEAMGIPLKELIEKYAGGVRGGWDNLKAIIPGGASVPLLPKSLCEVEMDFDSLRTVGSGLGTGGIIVMDRSTDIIYAIARLSKFYMHESCGQCTPCREGTGWMWRVMMRLVNGNAKKTEIETLLNVTKEIEGHTICALGDAAAWPIQGLIRHFRDEIEERIKNFGIA

SEQ ID NO: 39224 - DNA, 1278 bp, Symbiobacterium thermophilum IAM 14863
  CDS (1)..(1278): transl_table=11
atgatccagtttgaacctgtgctgacgaaaggcatcgggaaggtcgacctgaccaacatcgatgtgtacgaagcgcagggcgggtatcaggctctccgcaaggccctcgccatggagccccaggcgatcgtggaggaggtcaagaaggcgaacctccgcggccgcggcggcgccggcttcccggccggggtcaagtggagcttcctgcccaacgacggccggccccgctacctcacggtgaacgcggacgagtccgagcccggcacctgcaataaccgcaccctgatctacgccaatccccaccagctcatcgaggggatcctcatcaccgcgtatgccaaccggatcacgcagtcgttcatctacatccgcggcgagttcaagcggggcgccgagatcctgatgaaggccatcgaggacgcccggcggaagggctatgtcggccagaacatcctgggtaccggcttcagccaggagatcaccgtgcaccggggcgccagcgcctacatctgcggcgaggagtccgcgctgctcaactcgctggagggccggcgcggcgagccgcgggtgaagccgccgttcccggcggtggtgggcctgtacggctgcccgaccatcatcaacaacgtggagaccatctccaacgtgccgcacatcatcaagaacggctgggagtggtacacgaagatcaccgccaatcccgacaaccccaagtcctgcggcccgaagatcttcacggtgtcgggctgcgtgcagcgccccggcaactacgagttgccgatgggcgtgaagctgcgggacgtgatcgagatcgccggcggcctccggcccggtcgcaagctgaaggcggtgcagcccggcggctcgtcgaccccgatgctcacgcctgaccacctggacgtgcccatggactttgagtcggtggcggcggcgggctcgctgctgggcaccgcggcggtgatcgtctacgacgacaccgtcgacctggtggacgtggcgctgtactgggcccggttctactcccacgagtcctgcggccagtgcacgccttgccgagagggcacccactggctggagcgggtcttcacccggatcaaggaaggcggcggcacggagggcgacctgaagatgatcgccgacatgcagacccagatggcggggaccaccatctgcgtcctgtccgacgccgcggtcgccttcccggcctcgctgctgaagctgttccccgaggagctcgaccgctacatcaaccgcgtgaaggaggtgcggccggcgtga

SEQ ID NO: 39225 - protein, 425 aa, Symbiobacterium thermophilum IAM 14863
MIQFEPVLTKGIGKVDLTNIDVYEAQGGYQALRKALAMEPQAIVEEVKKANLRGRGGAGFPAGVKWSFLPNDGRPRYLTVNADESEPGTCNNRTLIYANPHQLIEGILITAYANRITQSFIYIRGEFKRGAEILMKAIEDARRKGYVGQNILGTGFSQEITVHRGASAYICGEESALLNSLEGRRGEPRVKPPFPAVVGLYGCPTIINNVETISNVPHIIKNGWEWYTKITANPDNPKSCGPKIFTVSGCVQRPGNYELPMGVKLRDVIEIAGGLRPGRKLKAVQPGGSSTPMLTPDHLDVPMDFESVAAAGSLLGTAAVIVYDDTVDLVDVALYWARFYSHESCGQCTPCREGTHWLERVFTRIKEGGGTEGDLKMIADMQTQMAGTTICVLSDAAVAFPASLLKLFPEELDRYINRVKEVRPA

SEQ ID NO: 39226 - DNA, 1857 bp, Symbiobacterium thermophilum IAM 14863
  CDS (1)..(1857): transl_table=11
gtgcgggcccggcgtgcgggcgccatcgccctgcgccaggccgaggccgtgaacctggcggaagcgcccgaggtgcacatcctcgtctgtgcgggcacgggctgccaatccaacaagtccctgaacaccgtcgcggccctccagcaggcggtggaggaccacggcgtggctgaccgggtgaaggtcgtgcccgtcgggtgtttcggcttctgccggatggggccggtggtggtggtgtatcccggccagaccttctactgcgaggtgcagccgcagcacgcaccggtcatcatccagcagcacgtgctgggcggccagcccgtcgaggcgctgctgtacgcgcccaatccgcgggagaagcaccgcatcgccaagatgatggaccagcccttctacaaggggcagcaccgcacggccctcagccactgcggcctcatcaaccccgagtgcatcgaggaggccatcgctgcggaccgctacttcgccctggccaaggccctgctggagatgaccccggcccaggtgatcgaagaggtgaagcgctcgggcctgcggggccggggcggcggcggcttccccacgggccgcaagtgggaactggcggccgcggtggagggcgacgtgaagtacgtcctctgcaacgccgacgagggggatcccggcgcgttcatggaccgctccatcatcgagggcgacccgcacgccatcctggaagccatggccatcgccgggtacgccatcggggcacagcacggctacatctacgtgcgcgccgagtacccggtcgcggtgcaccggctggagatcgccatccggcaggcccgcgagctcggcctcctgggcgagaacattctcggcacgggcttcagcttcgacatcgacatccgtctcggcgccggcgccttcgtctgcggcgaggagacggctctgatcgcctcgattgaaggccagcgcggcctgccccggccccggcctcccttcccggcgcagaaggggctgtggggcaagccgacgctgaacaacaacgtcgaaacctacgccaacgtgccgtacatcatcctccacggcgctgaggccttccgtagcgtgggcacggagaagtcgccgggcaccaaggtgtttgccgtggccggcaacgtgatgaacaccggcctggttgaggtgcccatcggcaccaccctccgggagatcgtctacggcatggccggcggcatcccgaaggggcggccgttcaaggcggcccagaccggcggcccctccggcgggtgcattcccgcccacctgctggatatccccatggattacgagccgctcaacgaggtcggctccatgatggggtccggcgggctcatcgtgatggacgaccagtcctgcatggtcgacgtggcacgcttctacctgcagttcacccaggacgagtcctgcgggaagtgcccgccctgccgcatcggcaccaagcggatgctggagatcctggaccgcatcgtcgagggcgagggcacgatggaggacctggacgagctggagcggctggccaacgggatcaaggccacggcgctgtgcggcctcggccagaccgcgccgaacccggtcctgtccaccctgcgctacttccgtgaggagtacgaggcgcacgtgcgggacaagcactgcccggcggggcgctgcaaggccctgacggacttccggatcgaccaggagcggtgcaaggcgtgcaacgtctgcgcccggaactgcccggtggacgccgtccacggcgaggtgcgcaagccggagacgttctacatcgacgccgaggcgtgcatcaagtgcgggacgtgcgccaccgtctgcaagttcaacgccgttgtatggtaa

SEQ ID NO: 39227 - protein, 618 aa, Symbiobacterium thermophilum IAM 14863
MRARRAGAIALRQAEAVNLAEAPEVHILVCAGTGCQSNKSLNTVAALQQAVEDHGVADRVKVVPVGCFGFCRMGPVVVVYPGQTFYCEVQPQHAPVIIQQHVLGGQPVEALLYAPNPREKHRIAKMMDQPFYKGQHRTALSHCGLINPECIEEAIAADRYFALAKALLEMTPAQVIEEVKRSGLRGRGGGGFPTGRKWELAAAVEGDVKYVLCNADEGDPGAFMDRSIIEGDPHAILEAMAIAGYAIGAQHGYIYVRAEYPVAVHRLEIAIRQARELGLLGENILGTGFSFDIDIRLGAGAFVCGEETALIASIEGQRGLPRPRPPFPAQKGLWGKPTLNNNVETYANVPYIILHGAEAFRSVGTEKSPGTKVFAVAGNVMNTGLVEVPIGTTLREIVYGMAGGIPKGRPFKAAQTGGPSGGCIPAHLLDIPMDYEPLNEVGSMMGSGGLIVMDDQSCMVDVARFYLQFTQDESCGKCPPCRIGTKRMLEILDRIVEGEGTMEDLDELERLANGIKATALCGLGQTAPNPVLSTLRYFREEYEAHVRDKHCPAGRCKALTDFRIDQERCKACNVCARNCPVDAVHGEVRKPETFYIDAEACIKCGTCATVCKFNAVVW

SEQ ID NO: 39228 - DNA, 1287 bp, Legionella pneumophila subsp. pneumophila str. Philadelphia 1
  CDS (1)..(1287): transl_table=11
gtgtttgccatggttgaactaaatcaagtttgttaccgaacatttcatttaccagagtcctggtcgctatcaacttatgaaagtattggtggctatagcgcatggcgaaaaattttaaaagagcaaacatcacctcaattaataattgaagagttgaaaacttctgccttgcgcggacgaggaggggctggattcccaaccggtttaaaatggagttttatgaatagaaactcccctgttcaaaaatacgtagtatgtaattctgatgaaggtgaaccgggtacttgtaaggacagagagattcttactttaaatcctcaccaattaatcgaaggaatggccatagctgggtatgttatgggcgccacggttggttacaactacataagaggagaattctggctaccttttgagcgtactgaggctgcaataaaagaagcatacgatgctggcttgctaggtaaaaatatattaggctccggctttgattttgatttatataatcatttaggcgctggtgcttacatttgcggtgaagaaactgcattgcttaactcaattgaaggaaaaaagggaatgcctcgttttaaaccaccattcccggcaaattatggcttgtatggtaaaccgacaaccataaataacacggaaacatttgcgtctgttccggttattatggaaaaaggtggagaatggtttttaaaattaggtaaaccgaacaatggcggtgccaaatgctttagtgttagcggccatgttaacaaacctggtaactatgaaattcccttgggcacgccattcaaaacgctacttgatctggctggcggcgtgattaaaggccgaaaaatcaaagccgtgattcctggtggttcctctatgccagtgctcccaggcgacgtcatgctggggctggatatggattatgacagtatacagaaagccggctcaggcttgggttcaggcgcagtcattatcatggatgaaaccacctgcatggtggatgctttgtatcgtatttctgagttctacatggatgaatcctgtggacaatgcacaccttgtcgggaaggcacaggttggttagtcaggttattacacagaattataaacggtcatggcgagccgggagacgtggagaaattagtgaatgtggcgaataacatagagggaagaaccatttgtgcattaggcgaggcagcagcttggccagtacagagttttgttaaacatttctatgatgaatttgaatatttcataaagcataaacgctcgatcgtcgcagcataa

SEQ ID NO: 39229 - protein, 428 aa, Legionella pneumophila subsp. pneumophila str. Philadelphia 1
MFAMVELNQVCYRTFHLPESWSLSTYESIGGYSAWRKILKEQTSPQLIIEELKTSALRGRGGAGFPTGLKWSFMNRNSPVQKYVVCNSDEGEPGTCKDREILTLNPHQLIEGMAIAGYVMGATVGYNYIRGEFWLPFERTEAAIKEAYDAGLLGKNILGSGFDFDLYNHLGAGAYICGEETALLNSIEGKKGMPRFKPPFPANYGLYGKPTTINNTETFASVPVIMEKGGEWFLKLGKPNNGGAKCFSVSGHVNKPGNYEIPLGTPFKTLLDLAGGVIKGRKIKAVIPGGSSMPVLPGDVMLGLDMDYDSIQKAGSGLGSGAVIIMDETTCMVDALYRISEFYMDESCGQCTPCREGTGWLVRLLHRIINGHGEPGDVEKLVNVANNIEGRTICALGEAAAWPVQSFVKHFYDEFEYFIKHKRSIVAA

SEQ ID NO: 39230 - DNA, 1566 bp, Burkholderia mallei ATCC 23344
  CDS (1)..(1566): transl_table=11
atgagcacgcgcattcatgtgccgcgcgattcggccgcgctcgcggtcggcgccgacgcgctcgcgcgcgcgatcgaggcgcaggcggccgcgcgcggcatcgcgatcgagctcgtgcgcaacggctcgcgcgggctgctgtggctcgagccgctcgtcgaagtgagcaccccggcgggccgcatcggctatgcgaacctcacggcagccgacgtccccgcgctcttcgacgcgggctggctcgacggcgccgcgcatccggcgtgcgtcggcatcgtcgacgagattccctatctgaagcgccagcagcggctcacgttcgcgcgcatcggcatcaccgatccgctgtcgatcgacgattacgtcgcgcacggcggcctcgaaggcctgaggaacgcgctcgcactcgacggcgccgccgcatgcgagacgctcgtcgaatcgggcctgcgcgggcgcggcggcgccgcattcccggcgggcgtcaaatggcggaccgtgcgcgaggccgcggccgcgcagaaatacgtcgtctgcaatgcggacgaaggcgactccggcaccttctccgatcgcctcgtgatggaaagcgatccgtactgcctgatcgaaggaatgatcatcgcgggcatcgcgacgggcgcgaccgtcggccatatctacgtgcgcagcgaatatccgcacgcgatcgcggcgctcggcgaggcgatcgcccgcgcgcgcgcggccggctggctcggcgcgagcgtgctcggcaccgcgcatgcgttcgagctgcacgtcgcgaaaggcgcgggcgcctacgtctgcggcgaagagaccgcgctcctcgaatcgctcgaaggcaagcgcggcgtcgtgcgcgcgaagccgccgctgcccgcgctatcgggactcttcgcaaaaccgaccgtcatcaacaacgtgatcacgctcgcgaccgtaccgatcatcttcgcgcgcggcgcggcgttctatcgcgattacggcatgggccgctcgcgcggcacgctgccgttccagctcgcaggcaacgtgaagcgcggcgggctcgtcgagctcgcgttcggcgtcacgctgcgcgagctgctgttcgatttcggcggcggcaccgcgagcgggcgccccgcgcgcgccgcgcaggtcggcggcccgctcggcacctacctgcccgagggccagtgggacatcccgctcgattacgaggcgtacgcggctgtcggcgccgtcgtcgggcacggcggcatcgtgctgcacgacgacacgtcgaacctggccgagctcgccgaatacgcgatgcacttctgcgcgctcgaatcgtgcggcaagtgcacgccgtgccggatcggctcgacgcgcggcgtcgagacgatcgcgaggatccgcgcgggcgacacgtcggagcgacaggtgcgcctgctgcgcgacctgtgcgacacgatgaccgcgggctcgctctgcgcgatgggcggcatgacgccgtacccggtgctgtccgcgctcgaccatttccccgaagatttcggcctcgccgcgcacgcgagccacgcggcacccgccgcctga

SEQ ID NO: 39231 - protein, 521 aa, Burkholderia mallei ATCC 23344
MSTRIHVPRDSAALAVGADALARAIEAQAAARGIAIELVRNGSRGLLWLEPLVEVSTPAGRIGYANLTAADVPALFDAGWLDGAAHPACVGIVDEIPYLKRQQRLTFARIGITDPLSIDDYVAHGGLEGLRNALALDGAAACETLVESGLRGRGGAAFPAGVKWRTVREAAAAQKYVVCNADEGDSGTFSDRLVMESDPYCLIEGMIIAGIATGATVGHIYVRSEYPHAIAALGEAIARARAAGWLGASVLGTAHAFELHVAKGAGAYVCGEETALLESLEGKRGVVRAKPPLPALSGLFAKPTVINNVITLATVPIIFARGAAFYRDYGMGRSRGTLPFQLAGNVKRGGLVELAFGVTLRELLFDFGGGTASGRPARAAQVGGPLGTYLPEGQWDIPLDYEAYAAVGAVVGHGGIVLHDDTSNLAELAEYAMHFCALESCGKCTPCRIGSTRGVETIARIRAGDTSERQVRLLRDLCDTMTAGSLCAMGGMTPYPVLSALDHFPEDFGLAAHASHAAPAA

SEQ ID NO: 39232 - DNA, 1311 bp, Burkholderia mallei ATCC 23344
  CDS (1)..(1311): transl_table=11
atgacgtcccttcacgatcgtcacatcaaaccgctgatcctcgccggcctgaccggcgagaactggcatctcgaagactacgtcgcgcgcggcggctacaagcagttgcgccgcatcctcgaagaaaagattccgcccgagcaggtgatcgccgacgtgaaggcgtcggggctgcgcggccgcggcggcgcgggcttcccgaccggcctgaagtggagcttcatgccgcgccagttcccgggccagaagtatctcgtctgcaactcggacgagggcgagccgggcacgttcaaggatcgcgacatcctgcgctggaacccgcatgcgctgatcgaaggcatggcgatcggcgcgtacgcgatgggcatcaccgtcggctacaactacatccacggcgagatcttcgaagtgtatcggcgcttcgaggcggcgctcgacgaagcgcgccgcgcgggcttcctcggcgagaagatcatgggctcggatttctcgttccagttgcatgcgcaccacggctacggcgcgtacatctgcggcgaggaaaccgcgctgctcgagtcgctcgaaggcaagaagggccagccgcgcttcaagccgccgttcccggcgagcttcggcgtatacggcaagccgacgacgatcaacaacaccgagacgttcgcggcggtgccgttcctgctggcggtcggcccgcagaactacctcgagatgggcaagccgaacaacggcggcacgaagatcttctcggtgtcgggcgacgtcgagcgtccgggcaactacgagattccgctcggcacgccgtttgcgacgctgatggagctcgcgggcgggatgcgcggcggcaagaagatcaaggcggtgatcccgggcggttcgtccgcgccggtgatcccgggcgacatcatgatgcagaccgatatggactacgactcgatcgcgaaggcgggctcgatgctcggctccggcgcggtgatcgtgatggacgagacgcgctgcatggtgcgctcgctgctgcgcctgtcgtacttctattacgaagagtcgtgcggccagtgcacgccgtgccgcgaaggcacgggctggctgtatcgcgtcgtgaaccgcatcgagcacggcgaggggcgccaggaagacctggacctgctgaactcggtcgcggagaacatcatgggccgcacgatctgcgcgctcggcgacgcggcggtgatgccggtgcgcgggatgctcaagcactactgggacgaattcgcgtaccacgtcgagcacaagcactgcatggtcggcggccacgcgcatgcggccgtcgcctga

SEQ ID NO: 39233 - protein, 436 aa, Burkholderia mallei ATCC 23344
MTSLHDRHIKPLILAGLTGENWHLEDYVARGGYKQLRRILEEKIPPEQVIADVKASGLRGRGGAGFPTGLKWSFMPRQFPGQKYLVCNSDEGEPGTFKDRDILRWNPHALIEGMAIGAYAMGITVGYNYIHGEIFEVYRRFEAALDEARRAGFLGEKIMGSDFSFQLHAHHGYGAYICGEETALLESLEGKKGQPRFKPPFPASFGVYGKPTTINNTETFAAVPFLLAVGPQNYLEMGKPNNGGTKIFSVSGDVERPGNYEIPLGTPFATLMELAGGMRGGKKIKAVIPGGSSAPVIPGDIMMQTDMDYDSIAKAGSMLGSGAVIVMDETRCMVRSLLRLSYFYYEESCGQCTPCREGTGWLYRVVNRIEHGEGRQEDLDLLNSVAENIMGRTICALGDAAVMPVRGMLKHYWDEFAYHVEHKHCMVGGHAHAAVA

SEQ ID NO: 39234 - DNA, 1311 bp, Burkholderia pseudomallei K96243
  CDS (1)..(1311): transl_table=11
atgacgtcccttcacgatcgtcacatcaaaccgctgatcctcgccggcctgaccggcgagaactggcatctcgaagactacgtcgcgcgcggcggctacaagcagttgcgccgcatcctcgaagaaaagattccgcccgagcaggtgatcgccgacgtgaaggcgtcggggctgcgcggccgcggcggcgcgggcttcccgaccggcctgaagtggagcttcatgccgcgccagttcccgggccagaagtatctcgtctgcaactcggacgagggcgagccgggcacgttcaaggatcgcgacatcctgcgctggaacccgcatgcgctgatcgaaggcatggcgatcggcgcgtacgcgatgggcatcaccgtcggctacaactacatccacggcgagatcttcgaagtgtatcggcgcttcgaggcggcgctcgacgaagcgcgccgcgcgggcttcctcggcgagaagatcatgggctcggatttctcgttccagttgcatgcgcaccacggctacggcgcgtacatctgcggcgaggaaaccgcgctgctcgagtcgctcgaaggcaagaagggccagccgcgcttcaagccgccgttcccggcgagcttcggcgtatacggcaagccgacgacgatcaacaacaccgagacgttcgcggcggtgccgttcctgctggcggtcggcccgcagaactacctcgagatgggcaagccgaacaacggcggcacgaagatcttctcggtgtcgggcgacgtcgagcgtccgggcaactacgagattccgctcggcacgccgtttgcgacgctgatggagctcgcgggcgggatgcgcggcggcaagaagatcaaggcggtgatcccgggcggttcgtccgcgccggtgatcccgggcgacattatgatgcagaccgatatggactacgactcgatcgcgaaggcgggctcgatgctcggctccggcgcggtgatcgtgatggacgagacgcgctgcatggtgcgctcgctgctgcgcctgtcgtacttctattacgaagagtcgtgcggccagtgcacgccgtgccgcgaaggcacgggctggctgtatcgcgtcgtgaaccgcatcgagcacggcgaggggcgccaggaagacctggacctgctgaactcggtcgcggagaacatcatgggccgcacgatctgcgcgctcggcgacgcggcggcgatgccggtgcgcgggatgctcaagcactactgggacgaattcgcgtaccacgtcgagcacaagcactgcatggtcggcggccacgcgcatgcggccgccgcctga

SEQ ID NO: 39235 - protein, 436 aa, Burkholderia pseudomallei K96243
MTSLHDRHIKPLILAGLTGENWHLEDYVARGGYKQLRRILEEKIPPEQVIADVKASGLRGRGGAGFPTGLKWSFMPRQFPGQKYLVCNSDEGEPGTFKDRDILRWNPHALIEGMAIGAYAMGITVGYNYIHGEIFEVYRRFEAALDEARRAGFLGEKIMGSDFSFQLHAHHGYGAYICGEETALLESLEGKKGQPRFKPPFPASFGVYGKPTTINNTETFAAVPFLLAVGPQNYLEMGKPNNGGTKIFSVSGDVERPGNYEIPLGTPFATLMELAGGMRGGKKIKAVIPGGSSAPVIPGDIMMQTDMDYDSIAKAGSMLGSGAVIVMDETRCMVRSLLRLSYFYYEESCGQCTPCREGTGWLYRVVNRIEHGEGRQEDLDLLNSVAENIMGRTICALGDAAAMPVRGMLKHYWDEFAYHVEHKHCMVGGHAHAAAA

SEQ ID NO: 39236 - DNA, 1284 bp, Methylococcus capsulatus str. Bath
  CDS (1)..(1284): transl_table=11
atggacaagccgctcacccgcaacatcaaatccgacggctcgaccgtgactctggccgagtatctcgccagcggcggctacgaaggattgaaaaaaaccctcgccgaattcgcccctctcgacgtacaacaacgggtcaaagactccggactgcgcggccgcggcggcgccggcttcccgaccggcctgaaatggagcttcgtgccgatgggcgagggcgcaccccggaccaaatacctggtggtcaacggcgacgagatggaacccggtgcgttcaaggaccggctgttactggagggcgatccgcaccagctgatcgaaggcgtggtcatcgcagcttacgccatccaggccaatatcgcctacgtcttcctccgcggcgaataccggctggcggcggcgcggctgcggcaggcgatcgccgaagccgaagcccaggggctgctcggcgaagacatcctcggctcgggattcagcctggacctgcgcctgcacaccagcgccgggcgctacatctgcggcgaggaaaccgccctgctcaactcgctggaaggcaagcgcgccaacccccgcgccaagccgccgtttccgcaagtctccggcctgttcggcaagcccaccatcgtcaacaacgtcgagaccctctgcaacctgccgcacatcctccgcaacggggtggagtggtacaaaggactcagccggaccggcgaaccgggcaccaagatctacggcgtcagcggccgggtcaggtcccccggcgcctgggagctgcccatgggcacgacggcgcgcgagatcatcgaggagcacgccggcggcatgcgcgacggctaccgtttgaagggctacctgccgggaggggcctctaccgacttcctgctgcccgaacacctggacattcccatggactacggctccatcggcaaggccggcagccggctcggtaccggcacgatgatcttgctggatgataagacctgcccggtgcagatggtgctcaacctcgaacggttcttcgctcaggaatcctgcggctggtgcaccccttgccgggatggcctgccctggaccgtcagcctgctcgaagggctgatcgaagggcgcggccggccggaggacctcgagactctggagcgcttgtgcggcctgctcggcccgggcaacaccttctgcgccctcgcgcccggtgcaatggaaccgctgcagagcgccctcaagcacttccgcgccgatttcgagcgctatctccagccgcaaaccacccgcggaggcatgtatgcctga

SEQ ID NO: 39237 - protein, 427 aa, Methylococcus capsulatus str. Bath
MDKPLTRNIKSDGSTVTLAEYLASGGYEGLKKTLAEFAPLDVQQRVKDSGLRGRGGAGFPTGLKWSFVPMGEGAPRTKYLVVNGDEMEPGAFKDRLLLEGDPHQLIEGVVIAAYAIQANIAYVFLRGEYRLAAARLRQAIAEAEAQGLLGEDILGSGFSLDLRLHTSAGRYICGEETALLNSLEGKRANPRAKPPFPQVSGLFGKPTIVNNVETLCNLPHILRNGVEWYKGLSRTGEPGTKIYGVSGRVRSPGAWELPMGTTAREIIEEHAGGMRDGYRLKGYLPGGASTDFLLPEHLDIPMDYGSIGKAGSRLGTGTMILLDDKTCPVQMVLNLERFFAQESCGWCTPCRDGLPWTVSLLEGLIEGRGRPEDLETLERLCGLLGPGNTFCALAPGAMEPLQSALKHFRADFERYLQPQTTRGGMYA

SEQ ID NO: 39238 - DNA, 1551 bp, Methylococcus capsulatus str. Bath
  CDS (1)..(1551): transl_table=11
atgattacggtctacgtcccccgtgattccagcgccctcggtctcggtgccgagcgggtggccaatgccatccagctcgaggccgccaggcgcggcacggcgatcaagctggtccgcaacggttcacgcggcctgtactggctcgaacccctggtagaggtcgtcacccccggcgggcgtgtcgcctatggtccggtgcggccgggcgacgtcgccggcctgttcgaagccggcttcttggaaggcaaggcacatcccttgtatcaaggattgacggaggaaataccttacctcaagaatcaggaacgcctgacgttcgcccgcgtcggcatcaccgatccggtctgcctggaagattatctggctcacggaggctaccgcggactgcgtaacgccttggcgatggagcccgccgcgatcgtcgaggaagtcaccgcttccggcctgcggggtcgcggcggtgcggccttccccaccggtatcaaatggaagacggtgctcaatgcccccgccggccagaagtacgtcgtctgtaacgccgatgagggtgattccggtaccttctccgaccgcatgatcatggaaggtgaccccttcgtgctgatcgagggcatgaccatcgccggtctcgcagtgggggcaacccagggctacatctatctccgcatcgaatatccccatgccggggtggccttgaatcaggccatcgaggccgctatccaggccggctacctgggcgatgacatcctcggcagcggcaagcgcttccagctcgaagtccgtctgggcgccggcgcctatgtctgcggcgaggaaaccgccctgctggaaagcctcgaaggcaagcgcggcatggtgcgcttcaagccgccgctgcccgccatcgagggcctattcggccagcccacggtcatcaacaacgtgatctcgctggcctcggtgccgatcatcctggacaagggcggcaaatactacgccgactatggcatgggccgctcacgtggtaccctgccgctgcagcttgccggcaacgtcaagcggccaggcctgatcgagaaggccttcggcatgaccctgcgcgagctgctgtacgactatggcggcggttccgccagcgggcgcccgatccgggctgtgcaggtcggcggcccgctgggttcctacatgccggaatcgcagttcgacacaccgctggactatgagtcgttcagcgccatctgggccgtgctcggccatggcggtgtcgtggtattcgacgacacggtcgacatggcgaagatggcgcgctacgccatggaattctgcgcgctcgagtcctgcggcaaatgcacaccctgccggatcggttcgacccgaggcgtggaagtcatcgaccgcatcatcgacgaccgggaccgggcgaagaatctggcgctgctgcgggatttgggcgacaccatgctggccggttcgctctgcgcactgggaggcatgacgccctaccccgtcctcagcgccctcaatcatttcccggaagatttcggcgagaagagtgtggcgcaggttgcctga

SEQ ID NO: 39239 - protein, 516 aa, Methylococcus capsulatus str. Bath
MITVYVPRDSSALGLGAERVANAIQLEAARRGTAIKLVRNGSRGLYWLEPLVEVVTPGGRVAYGPVRPGDVAGLFEAGFLEGKAHPLYQGLTEEIPYLKNQERLTFARVGITDPVCLEDYLAHGGYRGLRNALAMEPAAIVEEVTASGLRGRGGAAFPTGIKWKTVLNAPAGQKYVVCNADEGDSGTFSDRMIMEGDPFVLIEGMTIAGLAVGATQGYIYLRIEYPHAGVALNQAIEAAIQAGYLGDDILGSGKRFQLEVRLGAGAYVCGEETALLESLEGKRGMVRFKPPLPAIEGLFGQPTVINNVISLASVPIILDKGGKYYADYGMGRSRGTLPLQLAGNVKRPGLIEKAFGMTLRELLYDYGGGSASGRPIRAVQVGGPLGSYMPESQFDTPLDYESFSAIWAVLGHGGVVVFDDTVDMAKMARYAMEFCALESCGKCTPCRIGSTRGVEVIDRIIDDRDRAKNLALLRDLGDTMLAGSLCALGGMTPYPVLSALNHFPEDFGEKSVAQVA

SEQ ID NO: 39240 - DNA, 1686 bp, Methylococcus capsulatus str. Bath
  CDS (1)..(1686): transl_table=11
atgcccgaataccaggccgtttcctcggatgagcagaggcgcaggctgggaaagccgaaggggcgtcccgtcgacgcccatgtgcttgaggagatacaacgattgctgggggcggaaccgcgccgcgccgacctgctgatcgaacacctgcacaagatccaggaccactacggccatgtgtccgcccgccacatcgccgccttggccttcgagatgaagctctcccaggcggaggtctacgaggtcgccaccttctaccatcacttcgatgtggtcgcggaaggcgaatcgccgcccccgccgctcaccgtccgggtgtgcgagtccctgagttgcgccatggccggcgcccacgccctgatgccggcgctgaaagacgccctgggggagggcgtgcggatacagccggtgccctgcgtcgggcgctgccagcacgcgccggtggcggtggtgggccagaaccccgtggaccgggccacgcctgcggcggtgagcgccgcggtggagcaggggcagaccctgcccgcgcccgccgcctaccgcagctatgccgcctatcaggccgatggcggttaccagctatatcaggactgccgttccggtcaccgcagtcccgaggaggtcatcgccctgctggaaagctccggcctgcgcggtctgggcggggccggtttcccggtgggacgcaagtggcgcatcgtcagagcccagcccgcaccgcgcctcatggcggtcaatatcgacgagggcgagcccggcaccttcaaggatcgccactatctggaacgcgatccccaccgcttcctggaaggcatgctgatcgccgcctgggcggtgggcatcgaatccatctacatctatctgcgggacgaatacgccggctgccggcagatattgctgcgggaattgcagcaactgcgggaggccgtgcccggaccgctgccggaaatccagctgcgccggggcgccggggcctatatctgcggcgaggagtcggccatgatcgagtccatcgaaggcaagcgcggcatgccccggctgcgtccccctttcgtggcgcaggtcggcctgttcggccggccgaccctggaacacaacatggagtcgctgtactgggtgcgggacatcgtcgaacgcgggccggactggttcaccggccatgggcggcgcgatcgcaagggcttgcgctcgttctcggtgagcggccgggtgcggaaacccggcgtacacctggccccggccggcatcagcgtgcgcgaactgatcgccgagtattgcggcggcatggcggaggggcatgaattctacggctactttccgggcggggcttccgggggcatcctgcccgccagcctgggcgatctgcccctcgacttcgataccctcaccccctacggctgtttcataggatccgccgccgtcgtggtgttctccacgcaggacaaggcccgcgacctggcgctcaatgccatgcgctttttcgccgaggaatcctgcggccagtgcaccccttgccgggtcggcaccgccaaggccgccgcgctcatggcccagccccagtgggatcggccattgctggaggagctggccggcgccatgagcgatgcgtccatctgtggactgggccaggccgcggccaatccgctgcgctgcgccatgaagtattttccggaggaatttcgatga

SEQ ID NO: 39241 - protein, 561 aa, Methylococcus capsulatus str. Bath
MPEYQAVSSDEQRRRLGKPKGRPVDAHVLEEIQRLLGAEPRRADLLIEHLHKIQDHYGHVSARHIAALAFEMKLSQAEVYEVATFYHHFDVVAEGESPPPPLTVRVCESLSCAMAGAHALMPALKDALGEGVRIQPVPCVGRCQHAPVAVVGQNPVDRATPAAVSAAVEQGQTLPAPAAYRSYAAYQADGGYQLYQDCRSGHRSPEEVIALLESSGLRGLGGAGFPVGRKWRIVRAQPAPRLMAVNIDEGEPGTFKDRHYLERDPHRFLEGMLIAAWAVGIESIYIYLRDEYAGCRQILLRELQQLREAVPGPLPEIQLRRGAGAYICGEESAMIESIEGKRGMPRLRPPFVAQVGLFGRPTLEHNMESLYWVRDIVERGPDWFTGHGRRDRKGLRSFSVSGRVRKPGVHLAPAGISVRELIAEYCGGMAEGHEFYGYFPGGASGGILPASLGDLPLDFDTLTPYGCFIGSAAVVVFSTQDKARDLALNAMRFFAEESCGQCTPCRVGTAKAAALMAQPQWDRPLLEELAGAMSDASICGLGQAAANPLRCAMKYFPEEFR

SEQ ID NO: 39242 - DNA, 1833 bp, Methylococcus capsulatus str. Bath
  CDS (1)..(1833): transl_table=11
atggatcgacacgagtacgaacaccggatcataaaccgcatcgtcgaaaaccacggccgcgacacccgccagctcttgtccatcttgcgggaggtccagcacgaattccggcaggtatcacccgaagctcaacagaaggtcgccgagtctctcggcgtttgcatcacgcaggtgagggcggtggtggatttctacagtttcctgtcgaccgtcccattggggaaattcgacatccggatcagcgactccatcaccgatcacatgctcggcagccgggaggtcgccgcgggtctgtgccgcaagctcggcatccagccgggcgagccccgccaggatgggcgagtcggcctttcctttacgtcctgtaccggcctgtgcgaccaggggccggccggactgatcaacggttatgccatcccacgactcacggaagaccgtaccgaccagattgccaggttgatcaatgatgacatcccgctaggcgagtggcccgaggaattcttcgccatcaaggaaaacatccggctggcggaccggctgctcggcaatcctgtccggcccggagaggcactggaacgcactcttgcgctggacagggagacgatgttcggggaaatcgaaacttcccagcttcgcggcaggggaggcgcgggcttcaacaccgcatggaaatggcgtttctgctacgaagggccggaaacggcggcggtttgcccgcctggccagccggccgccggaatcgagcgttacgtcgtctgcaacgcggacgaaggggaacccggcacattcaaggaccgtgtcctgctgcaaagctgcgccgaccaggttttcgaaggcatgacggtctgcgcatacttggtgggggcgaagcaaggattcctctatttgagaggcgaatacctctacttgcatgatcagctcgaagccgtgctggcggcacggcggcggcacggcttgctcgggaaatccattttgggaagagagggcttcgatttcgacatcgaaatccggctgggcgccggcgcctatatctgcggcgaggagtccgccttgatcgagtcgctggaaggcaatcggggcgtgccacgcaaccgcccgccgtaccccgtcacccacggctatctcggcaagcccaccgtcgtgaacaacgtggagaccttctttgcggccgcggccatcgccgtccacggcggagaatggtttgccgaggtcggcaccgaaaaatccaagggcacgaaactgctgagcatctgcggcgactgcgcccggccgggcatctacgaataccccttcggcgtcacgatcaggcaggtcctcgaagactgcggcgcggcggacgtcctgggcgtacagataggaggcccctccggaacctttctgtccgacaaggaatgcgaccgcaagctggcttacgaggatctcgccaccggcggctcattcatcgtgttcgaccggacccgcgatgtgatcgggatcgcccgcaacttcacccatttctttgcccacgagagctgtgggttctgcacgccctgccgggtcggcaccgccttgctcaagaatctgctggacaagatcgccgaaggacacggcgcgacgggcgatcttgccgagctgtcccggctggggcggttcgtgcgcagcgccagccattgcggactcggccagacggccgccaatccgatcctgagcactctggaacgttatcccgaaatctatcaggcgcgactcaagacgatcgacttcgaacccggcttcgatctggatggcgcactcgccaccgcccggcgcctgagcggccgggacgatgccaatgcccatctgtcacagtcgtaa

SEQ ID NO: 39243 - protein, 610 aa, Methylococcus capsulatus str. Bath
MDRHEYEHRIINRIVENHGRDTRQLLSILREVQHEFRQVSPEAQQKVAESLGVCITQVRAVVDFYSFLSTVPLGKFDIRISDSITDHMLGSREVAAGLCRKLGIQPGEPRQDGRVGLSFTSCTGLCDQGPAGLINGYAIPRLTEDRTDQIARLINDDIPLGEWPEEFFAIKENIRLADRLLGNPVRPGEALERTLALDRETMFGEIETSQLRGRGGAGFNTAWKWRFCYEGPETAAVCPPGQPAAGIERYVVCNADEGEPGTFKDRVLLQSCADQVFEGMTVCAYLVGAKQGFLYLRGEYLYLHDQLEAVLAARRRHGLLGKSILGREGFDFDIEIRLGAGAYICGEESALIESLEGNRGVPRNRPPYPVTHGYLGKPTVVNNVETFFAAAAIAVHGGEWFAEVGTEKSKGTKLLSICGDCARPGIYEYPFGVTIRQVLEDCGAADVLGVQIGGPSGTFLSDKECDRKLAYEDLATGGSFIVFDRTRDVIGIARNFTHFFAHESCGFCTPCRVGTALLKNLLDKIAEGHGATGDLAELSRLGRFVRSASHCGLGQTAANPILSTLERYPEIYQARLKTIDFEPGFDLDGALATARRLSGRDDANAHLSQS

SEQ ID NO: 39244 - DNA, 1326 bp, Nocardia farcinica IFM 10152
  CDS (1)..(1326): transl_table=11
atgaccgccctcgcgcccgtcctcacccgctactgggacgacccgcagtcgtggaccctcgacacctaccgccgccacgacgggtacgagggcctgcggatcgcgctgggcatggagccggaccaggtgatccagacggtcaaggacgcgggcctgcgcggccgcggcggcgccggcttccccaccggcatgaagtgggggttcatcccgcagggccccggaccggacggcaccgtgaaaccgcactacctggtggtcaacgccgacgagtccgaacccggcacgtgcaaggacatcccgctgctgatggccaccccgcacgcgctggtggagggcgcgatcatcgcctcctacgccatccgcgccaacaccgccttcatctacctgcgcggcgaggtggtgccggtgctgcggcggctgcgcgccgcggtcgaccaggcctatgcggcgggtctgctcggccgcgacatcctcggctccggcttcgatctggagctgatcgtgcacgcgggcgcgggcgcctacatctgcggcgaggagaccgcgctgctggattcgctggagggtcgccgcggccagccccggctgcgcccgccgttccccgccgtcgccggtctgtacgcctgcccgaccgtggtcaacaacgtggagtccatcgccagcgtgcccccgatcctgcggtacggcaccgactggttccggtcgatgggcagcgagaagtcgcccgggttcacgatctactcgctgtccggtcacgtcacccggcccggccagtacgaggcgccgctcggcatcaccctgcgcgagctgctcgactacgccgacggcgtgcgcgccggacaccggctgaagttctggacacccggcggctcgtccacgccgctgttcaccgacgagcacctggacgtgccgctggactacgagggcgtcgccgcggcgggctcgatgctgggcaccaaggcgctgcagatcttcgacgagaccacctgcgtggtgcgggcggtgctgcgctggacggagttctacgcccacgagtcgtgcggtaagtgcacaccgtgccgcgaaggcacctactggctggtgcagttgctgcggcggatcgagaccggcgggggcaccgaggccgatctggacaccctgctcgacatcaccgacagcatcaacggcaaatcgttctgcgcgctcggcgacggcgcggcgagcccgatcgtgtcctcggtgaagtacttccgcgacgagtacctcgcgcacatgcgcggcgacggctgtccgttcgacccggcgcggtcgacggcgtgggccgaggcaggagaaggggttcgatga

SEQ ID NO: 39245 - protein, 441 aa, Nocardia farcinica IFM 10152
MTALAPVLTRYWDDPQSWTLDTYRRHDGYEGLRIALGMEPDQVIQTVKDAGLRGRGGAGFPTGMKWGFIPQGPGPDGTVKPHYLVVNADESEPGTCKDIPLLMATPHALVEGAIIASYAIRANTAFIYLRGEVVPVLRRLRAAVDQAYAAGLLGRDILGSGFDLELIVHAGAGAYICGEETALLDSLEGRRGQPRLRPPFPAVAGLYACPTVVNNVESIASVPPILRYGTDWFRSMGSEKSPGFTIYSLSGHVTRPGQYEAPLGITLRELLDYADGVRAGHRLKFWTPGGSSTPLFTDEHLDVPLDYEGVAAAGSMLGTKALQIFDETTCVVRAVLRWTEFYAHESCGKCTPCREGTYWLVQLLRRIETGGGTEADLDTLLDITDSINGKSFCALGDGAASPIVSSVKYFRDEYLAHMRGDGCPFDPARSTAWAEAGEGVR

SEQ ID NO: 39246 - DNA, 1278 bp, Legionella pneumophila str. Lens
  CDS (1)..(1278): transl_table=11
atggttgaactaaatcaagtttgttaccgaacatttcatttaccagagccctggtcgctatcaacttatgaaagtattggtggctatagcgcatggcgaaaaattttaaaagagcaaacatcacctcaattaataattgaagagttgaaaacttctgccttacgcggacgaggaggggctggattcccaaccggtttaaaatggagttttatgaatagaaactcccctgttcaaaaatacgtagtatgtaattctgatgaaggtgaaccgggtacttgtaaggacagagagattcttactttaaatcctcaccaattaatcgaaggaatggccatagctgggtatgttatgggcgctacggttggttacaactacataagaggagaattctggctgccttttgagcgtactgaggctgcaataaaagaagcatacgatgctggcttgctaggtaaaaatatattaggctccggcgttgattttgatttatataatcatttaggagcgggagcttacatttgcggtgaagaaactgcattgcttaactcgattgaaggaaaaaagggaatgcctcgttttaaaccaccattcccggcaaattatggcttgtatggaaaaccgacaaccataaataatacggaaacatttgcgtctgttccggttattatggaaaaaggtggagaatggtttttaaaattaggcaaaccgaacaatggcggtgccaaatgctttagtgttagcggccatgttaacaaacctggtaactatgaaatccccttgggcactccattcaaaacgctgcttgatctggctggcggcgtcattaaaggccgaaaaatcaaagcagtgattcctggtggttcctctatgccagtgctcccgggtgacgtcatgctggggctggatatggattatgacagtatacagaaagccggctcaggcttgggttcaggcgcagttattatcatggatgaaaccacctgcatggtggatgctttgtatcgtatttctgagttctacatggatgaatcctgtggacaatgcacgccttgtcgagaaggcacaggctggttagtcaggttattacacagaattataaacggtcatggcgagccgggagacgtggagaagttagtgaatgtggcgaataacatagagggaagaaccatttgtgcattaggcgaggcagcagcttggccagtacagagttttgttaaacatttctatgatgaatttgaatatttcataaagcataaacgctcgatcgtcgcagcataa

SEQ ID NO: 39247 - protein, 425 aa, Legionella pneumophila str. Lens
MVELNQVCYRTFHLPEPWSLSTYESIGGYSAWRKILKEQTSPQLIIEELKTSALRGRGGAGFPTGLKWSFMNRNSPVQKYVVCNSDEGEPGTCKDREILTLNPHQLIEGMAIAGYVMGATVGYNYIRGEFWLPFERTEAAIKEAYDAGLLGKNILGSGVDFDLYNHLGAGAYICGEETALLNSIEGKKGMPRFKPPFPANYGLYGKPTTINNTETFASVPVIMEKGGEWFLKLGKPNNGGAKCFSVSGHVNKPGNYEIPLGTPFKTLLDLAGGVIKGRKIKAVIPGGSSMPVLPGDVMLGLDMDYDSIQKAGSGLGSGAVIIMDETTCMVDALYRISEFYMDESCGQCTPCREGTGWLVRLLHRIINGHGEPGDVEKLVNVANNIEGRTICALGEAAAWPVQSFVKHFYDEFEYFIKHKRSIVAA

SEQ ID NO: 39248 - DNA, 1293 bp, Anaplasma marginale str. St. Maries
  CDS (1)..(1293): transl_table=11
gtgaaaagcgaggatgcggcgtttaccaaccttgccggccgagagtctccgtatcttggggcggctaagaagcgtggcgcatgggatggtacaaaacggatactggagctgggccccgacaaaataatccaggaggttaaggattctgggttgagagggaggggcggtgctgggtttcccacgggaactaaatggagctttatgcccaaaacacgtcctgaaggccgtccagcgtacttggtaattaatgctgatgagtcagagccagggacctgtaaggatagagacataatcagatatgagccgcataagatcatagagggaattctaatagccggcttcgccatgggcgtcaccgctgcgtacatttacataaggggtgagttctataatgagtacctagtgctgtcccaagctttggatgaggcgtacaaacacggattggttggaaagaatgcgtgctcgtctggctacgatttggatattttcatccacagaggcgccggtgcgtacatctgtggggaggaaagcgcgcagctagaatccctggaagggagaaagggcatgcccaggttaaagcccccgttccccgcggctgtgggtctatacggctgtcctacaaccataaacaatgttgagaccgtcgctgtggttgcggacatcatgcgcagggggtccaaatggttttcctctttaggtaggccaaacaacactgggacaaaggttttttgtatttcggggcacgtgaacaagccgtgtaacgtggaagaagagcttgggatcccgatgcgagaattaatagaaaaatacgccggtggcgttattggtggttgggataacctcttggctgtcatacccggtggttcgtctgttcccatgttgcccaaatctgtttgtgacgatgtgctgatggattttgactccctcaaggccgtacaatctggcctcggtacagccgggctgatagtgatggataagtctacagacttggtggaggcaattgagcgaatttcgcgcttctatatgcatgagtcatgtggtcaatgtactccatgccgggagggcaccggatggatgtggagaatgatgaaaaaaatggtcgatggaacggcaaaagatggtgaaatagacaaactgcttgacgttgcatcccagattgaaggccatacaatctgcgcgcttgcggacgctgcggtgtggcctatacaaggcctgtttcgccacttcaggcacgtggttgaagatcggattggtaacaagggaaagaaaaagcgccgggtcgcggcttcatga

SEQ ID NO: 39249 - protein, 430 aa, Anaplasma marginale str. St. Maries
MKSEDAAFTNLAGRESPYLGAAKKRGAWDGTKRILELGPDKIIQEVKDSGLRGRGGAGFPTGTKWSFMPKTRPEGRPAYLVINADESEPGTCKDRDIIRYEPHKIIEGILIAGFAMGVTAAYIYIRGEFYNEYLVLSQALDEAYKHGLVGKNACSSGYDLDIFIHRGAGAYICGEESAQLESLEGRKGMPRLKPPFPAAVGLYGCPTTINNVETVAVVADIMRRGSKWFSSLGRPNNTGTKVFCISGHVNKPCNVEEELGIPMRELIEKYAGGVIGGWDNLLAVIPGGSSVPMLPKSVCDDVLMDFDSLKAVQSGLGTAGLIVMDKSTDLVEAIERISRFYMHESCGQCTPCREGTGWMWRMMKKMVDGTAKDGEIDKLLDVASQIEGHTICALADAAVWPIQGLFRHFRHVVEDRIGNKGKKKRRVAAS

SEQ ID NO: 39250 - DNA, 1758 bp, Azoarcus sp. EbN1
  CDS (1)..(1758): transl_table=11
gtgagcacgagcatgatcggtgagaaagagcgcagcgcgggcgcacgcccgggcaaaggatcccgcgaacgatcggcggaccggccgcgagggcgcgagccgctgccggcgtcggcacggctcgccgcatcggctgcgctcgccggcgagacgccgcgcgccgaccgcctgatcgaatacctgcaccgcctgcaggacgagcacggcgcgctccacgccgaccaccttgccgcgctcgccgaggcgatgaagctcgcgcgcgccgaggtgttcgaggttgcgaccttctatcaccatttcgacttcgtccccgccggcgggaaagcgccgccggcgctgaccgtgcgcgtgtgcgaatcgctcggctgcgcgatggccggtggcgccgaactcgccgcgtcgctcgcgagccagctcggggcggaggtgcgcgtgcagcgcgtgccgtgtgtcgggcgttgcgacagtgccccggtcgcagtcgtcgggcagcgcccggtgctgcacgccgatgccgatcgcgtcgccgcagtagtcgcgggcggcgagcgcgacgagccgctgcctgaggcgatccgtttcgacgcgtaccgcgcggccgccggctaccggctgtgggatgcggtgcgcagcggtgaaatcgcaggtgatgcggtcgtcgccgcgctcgacgccgccggcctgcgcggcctcggcggcgcaggcttcccggctgcgcgcaagtggcgcacggtggccgcacagcccgcaccgcggttcatggcagtcaatatcgacgaaggcgagccgggcacgttcaaggaccgccattacctcgagaccgatccgcaccgcttcattgaaggcatgctgatcgctgcgcacgtcgtcggcatcgacggcatctggatctacatccgcgacgaatacccggcgctgcgccggctgctcgcggaggaactcgaccgcgtgcgcgccgcgtggccggatgtgccgtcgatcgagatccgccgcggcgccggcgcgtatgtctgcggcgaagagtcggcgatgatcgagtcgatcgaaggcaagcgcggcatgccgcggctgcgcccgccgtacgtcgccgaagtgggcctcttcggccgcccgacgctcgaacacaacctcgagacgctgtggtgggtgcgcgacatcgtcgcccccgcgctcgcgggcgagcccggcccgttcgcgagccgcggccgcaacggtcgcaaggggctgcgcagcttctccgtcagcggccgcgtcgcgaagcccggcgtcgtcgtcaccgacgccggcatcacgctgcgcgaactcgtcgaggagcactgcggcggcatgctgccaggccacgagctgtacggctatttccccggcggcgcgtccggcggcatgctgccggcgcgcctcgccgatatgccgctcgacttcgacacccttggcgaatacggctgcttcatcggctcggcggcgatcgtcgtgttctcgcagcacgaccgcgcgcgcgtgctcgccgaaaacgcgatggaattcttcgcccacgaatcctgcggccaatgcacgccgtgccgtgtcggcactgcgaaagcggccgaactgatgaaacagccggcgtgggacgctgcgctgctgaccgaactcggaacagtgatgatggacgcttcgatctgcggcctcggccaagccgcgccgaacccgatgcaatcggtgctgcgcttcttcccgcacgaagtgggtgtggccggcaagaacgaggagggcgcggcatga

SEQ ID NO: 39251 - protein, 585 aa, Azoarcus sp. EbN1
MSTSMIGEKERSAGARPGKGSRERSADRPRGREPLPASARLAASAALAGETPRADRLIEYLHRLQDEHGALHADHLAALAEAMKLARAEVFEVATFYHHFDFVPAGGKAPPALTVRVCESLGCAMAGGAELAASLASQLGAEVRVQRVPCVGRCDSAPVAVVGQRPVLHADADRVAAVVAGGERDEPLPEAIRFDAYRAAAGYRLWDAVRSGEIAGDAVVAALDAAGLRGLGGAGFPAARKWRTVAAQPAPRFMAVNIDEGEPGTFKDRHYLETDPHRFIEGMLIAAHVVGIDGIWIYIRDEYPALRRLLAEELDRVRAAWPDVPSIEIRRGAGAYVCGEESAMIESIEGKRGMPRLRPPYVAEVGLFGRPTLEHNLETLWWVRDIVAPALAGEPGPFASRGRNGRKGLRSFSVSGRVAKPGVVVTDAGITLRELVEEHCGGMLPGHELYGYFPGGASGGMLPARLADMPLDFDTLGEYGCFIGSAAIVVFSQHDRARVLAENAMEFFAHESCGQCTPCRVGTAKAAELMKQPAWDAALLTELGTVMMDASICGLGQAAPNPMQSVLRFFPHEVGVAGKNEEGAA

SEQ ID NO: 39252 - DNA, 1314 bp, Azoarcus sp. EbN1
  CDS (1)..(1314): transl_table=11
atgagcgcacgcggacttattctcgccggcgtcgacggcgaccgcacctggcggttacaggactatatcgggcgcggcggttattccgctctgaaaaaaatcattgcggaaaagattccggccgaaacggttatcgccgaattgaaggcttcttcgctgcgcggacgcggcggtgcgggtttccccaccgggctcaaatggagcttcatgccgcgttcattcccgggagcgaaatatctcgcctgcaattccgacgagggcgagccgggtactttcaaggaccgcgacattctccgctacaacccgcacagcgtcatcgagggcatgacgatcgcggcgtatgcgatgggatgcgagcggggctacaactacatccacggcgagattttcgagatctacgagcgcttcgaggaggcgctggccgaagcgcgtgaagcgggcctgctcgggcagaaaatcctgggttcggatttttcgttcgagttgttcgcacaccacggctacggtgcctacatctgtggtgaagagaccgcgttgctcgagtcgatcgaaggcaagaaagggcagccgcgcttcaagccgccgtttccggcaagctatggcctttacggcaagcccacgacgatcaacaacactgaaactttcgcctcggtgccgttcatcatcaatatgggcggcgagagttttctcaacctcgggaagccgaacaacggcggcacgaagttgttctcgatttcgggacacgtcaatcgtccggggaattacgagatcggaatgggcactcccttcgcggagttgctcgaaatggctggcggaatgcgcggcgggggcaagctcaaagccgtcattcccggcggctcgtcatcgcccgtgttgccggcagccgtgatgatggactgcacgatggactacgactccatcgccaaggcagggtcgatgctcggttcaggcgcggtgatcgtcatggatgagaccacgtgcatggtgaaggcgctcgaacgcctgtcgtatttctacttcgaggagtcctgcgggcagtgcacgccgtgccgtgagggaaccggttggctttatcgggtggttcatcggatcgagaacgggttgggacgtcgcgacgatctcgatctgctcaactcggtgaccggcaatatcatgggacgcaccatttgcgccctcggtgatgccgcgtcgatgccggtgcagagtttcatcaagcacttcggctcggagttcgagtaccacatcgaaaacaagaaatgtctagtgccgcccgaggttcagtaccagggcagccaaatctacgtgagtccgtga

SEQ ID NO: 39253 - protein, 437 aa, Azoarcus sp. EbN1
MSARGLILAGVDGDRTWRLQDYIGRGGYSALKKIIAEKIPAETVIAELKASSLRGRGGAGFPTGLKWSFMPRSFPGAKYLACNSDEGEPGTFKDRDILRYNPHSVIEGMTIAAYAMGCERGYNYIHGEIFEIYERFEEALAEAREAGLLGQKILGSDFSFELFAHHGYGAYICGEETALLESIEGKKGQPRFKPPFPASYGLYGKPTTINNTETFASVPFIINMGGESFLNLGKPNNGGTKLFSISGHVNRPGNYEIGMGTPFAELLEMAGGMRGGGKLKAVIPGGSSSPVLPAAVMMDCTMDYDSIAKAGSMLGSGAVIVMDETTCMVKALERLSYFYFEESCGQCTPCREGTGWLYRVVHRIENGLGRRDDLDLLNSVTGNIMGRTICALGDAASMPVQSFIKHFGSEFEYHIENKKCLVPPEVQYQGSQIYVSP

SEQ ID NO: 39254 - DNA, 1704 bp, Silicibacter pomeroyi DSS-3
  CDS (1)..(1704): transl_table=11
atggcaccattggacagcaaatctgcgggcggcgaaccgggcgtatggaagagtggacgtggtcgtgggcgtcgattgccgaagggtcgtgtttacagcgatgaggcgttggcggctgttcggggtgtgttgggggatcgtcctcggcggcgggatttgctgatcgagttcctgcatctgatccaggacgtttacgggcatctttcggcggatcatcttgcggccttggcgttcgagatgaagctggggcaggcggaggtttacgagaccgcaaccttttacgcgcattttgacgtggtgaaggagggcgagacaccgccgccggcgctgacgatccgggtctgcgattcgctgagctgcgcgctggccggggccgagcagctgcgcgcggcgctggaagaggggctcgatccgggccaggtgcgggtgttgcgggcgccctgcatggggcgctgcgacacggcgccggtgctggagctgggccataaccatatcgatcacgccacgccggaaaaggtgcgggcggcgattgcggcgggcgacacccatgcgcatctgcccgattacgaggggttcgatgcctatgcggcggcgggcggttacgcggtgctcaaggggctgcgcgcgggcggcgactgggaagcggtgcaggacagcgtgctggcggcgggcctgcgcggcctgggcggcgcgggtttcccctcggggcgcaaatggggctttgtgcgggccaatccgggtccgcgttacctggcggtgaatggcgacgagggcgagccgggcaccttcaaggaccgctattacctggagcgggtgccgcatctgttcctcgagggcatgctgatcgcggcctgggcggtcgaggccgagacctgctatatctacatgcgcgacgaataccccgccgtgctggagatcctgcggcgcgagatcgcggcgctggaggcggccgggatcgtggccaaaggctatatcgacctgcgccggggcgcgggcgcctatatctgcggcgaagaaagcgcgatgatcgagagcatcgagggcaagcgtggcctgccccggcaccggccgccctttgtggcgcaggtggggctgttcggccgtccgacgctggtccataatatcgagacattgcattgggttgcgcgggtctgccgcgaggggccggaggttctgaattcgatcgagaagaacggccgcaagggcctgcgcagctattcggtctcgggccgggtggccaggccgggggtgcatctgctgccggcgggctcgaccatccgcgacgtgatcgcggcggcgggcggcatggcggcgggccatgtgttcaaggcctatcagccgggcggcccgtcctcgggcctgctgccggcgagcatggacgacattccgctcgacttcgacacattgcaaccccatggcagcttcatcggctcggcggcggtggtggtgctgagccagcaggacagcgcgcgcgacgcggcgctgaacatgctgcgcttcttcgaggacgagagctgtggccagtgcaccccctgccgggcgggctgcgaaaaggcggtcaagctgatgcaggccgaacactgggaccagccgctgctggaagagctgtgccaggtgatggcggatgcctcgatctgcggtctgggccaggcggcgccgaacccgatccggctgaccatgaaacacttcgcggaggagatctga

SEQ ID NO: 39255 - protein, 567 aa, Silicibacter pomeroyi DSS-3
MAPLDSKSAGGEPGVWKSGRGRGRRLPKGRVYSDEALAAVRGVLGDRPRRRDLLIEFLHLIQDVYGHLSADHLAALAFEMKLGQAEVYETATFYAHFDVVKEGETPPPALTIRVCDSLSCALAGAEQLRAALEEGLDPGQVRVLRAPCMGRCDTAPVLELGHNHIDHATPEKVRAAIAAGDTHAHLPDYEGFDAYAAAGGYAVLKGLRAGGDWEAVQDSVLAAGLRGLGGAGFPSGRKWGFVRANPGPRYLAVNGDEGEPGTFKDRYYLERVPHLFLEGMLIAAWAVEAETCYIYMRDEYPAVLEILRREIAALEAAGIVAKGYIDLRRGAGAYICGEESAMIESIEGKRGLPRHRPPFVAQVGLFGRPTLVHNIETLHWVARVCREGPEVLNSIEKNGRKGLRSYSVSGRVARPGVHLLPAGSTIRDVIAAAGGMAAGHVFKAYQPGGPSSGLLPASMDDIPLDFDTLQPHGSFIGSAAVVVLSQQDSARDAALNMLRFFEDESCGQCTPCRAGCEKAVKLMQAEHWDQPLLEELCQVMADASICGLGQAAPNPIRLTMKHFAEEI

SEQ ID NO: 39256 - DNA, 1683 bp, Silicibacter pomeroyi DSS-3
  CDS (1)..(1683): transl_table=11
atgtcactggatgacgcgggcgtatggaagagtggacgtggtcgtggacgtcgattgccgaagggtcgtgtttacagcgatgaggcgttggcggctgttcggggtgtgttgggggatcgtcctcgtcggcgggatttgctgatcgagttcctgcatctgatccaggacgcttgcgggcatctttcggcggatcatcttgcggctctggcgttcgagatgaagctggggcaggcggaggtttacgagaccgcaaccttttacgcgcattttgacgtggtgaaggagggcgagacaccgccgccggcgctgacgatccgggtttgcgattcgctgagctgcgagctggccggggccgagcagctgcgcgcggcgctggaagaggggctcgatccgggccaggtgcgggtgttgcgggcgccctgcatggggcgctgcgacaccgcgccggtgctggagctgggccataaccatatcgatcacgccacgccggaaaaggtgcgggcggcgatcgcggcgggcgatacccatgcgcatctgcccgcatacgagacgttcgatgcctatgcggcggcgggcggttacgcggtgctcaaggggctgcgcgcgggcggcgactgggaagcggtgcaggacagcgtgctggcggcgggcctgcgcggcctgggcggcgcgggtttcccctcggggcgcaaatggggctttgtgcgggccaatccgggtccgcgctacctggcggtgaatggtgacgagggcgagccgggcaccttcaaggaccgctattacctggagcgggtgccgcatctgttcctcgagggcatgctgatcgcggcctgggcggttgaggccgagacctgctatatctacatgcgcgacgaataccccgccgtgctggagatcctgcggcgcgagatcgcggcgctggaggcggccgggatcgtggccaaaggctatatcgacctgcgccggggcgcgggcgcctatatctgcggcgaagaaagcgcgatgatcgagagcatcgagggcaagcgtggcctgccccggcaccggccgcccttcgtggcgcaggtggggctgttcggccgtccgacgctggtccataatatcgagacattgcattgggttgcgcgggtctgccgcgaggggccggaggttctgaattcggtcgagaagaacggccgcaagggcctgcgcagctattcggtctcgggccgggtggccaggccgggggtgcatctgctgccggcgggctcgaccatccgcgacgtgatcgcggcggcgggcggcatggcggcgggccatgtgttcaaggcctatcagccgggcggcccgtcctcgggcctgctgccggcgagcatggatgacattccgctcgacttcgacacattgcagccccatggcagcttcatcggctcggcggcggtggtggtgctgagccagcaggacagcgcgcgcgacgcggcgctgaacatgctgcgcttcttcgaggacgagagctgtggtcagtgcaccccctgccgggcgggctgcgaaaaggcggtcaagctgatgcaggccgaacattgggaccagccgctgctggaagagctgtgccaggtgatggcggatgcctcgatctgcggtctgggccaggcggcgccgaacccgatccggctgaccatgaaacacttcgcggaggagatctga

SEQ ID NO: 39257 - protein, 560 aa, Silicibacter pomeroyi DSS-3
MSLDDAGVWKSGRGRGRRLPKGRVYSDEALAAVRGVLGDRPRRRDLLIEFLHLIQDACGHLSADHLAALAFEMKLGQAEVYETATFYAHFDVVKEGETPPPALTIRVCDSLSCELAGAEQLRAALEEGLDPGQVRVLRAPCMGRCDTAPVLELGHNHIDHATPEKVRAAIAAGDTHAHLPAYETFDAYAAAGGYAVLKGLRAGGDWEAVQDSVLAAGLRGLGGAGFPSGRKWGFVRANPGPRYLAVNGDEGEPGTFKDRYYLERVPHLFLEGMLIAAWAVEAETCYIYMRDEYPAVLEILRREIAALEAAGIVAKGYIDLRRGAGAYICGEESAMIESIEGKRGLPRHRPPFVAQVGLFGRPTLVHNIETLHWVARVCREGPEVLNSVEKNGRKGLRSYSVSGRVARPGVHLLPAGSTIRDVIAAAGGMAAGHVFKAYQPGGPSSGLLPASMDDIPLDFDTLQPHGSFIGSAAVVVLSQQDSARDAALNMLRFFEDESCGQCTPCRAGCEKAVKLMQAEHWDQPLLEELCQVMADASICGLGQAAPNPIRLTMKHFAEEI

SEQ ID NO: 39258 - DNA, 1299 bp, Silicibacter pomeroyi DSS-3
  CDS (1)..(1299): transl_table=11
atgctgaaggatcaggaccggatctttaccaatctctacgggatgcacgaccgcacgctgaaaggcgcaatggcacgcggccattgggacggaaccgccggcatcatcggcaaggggcgggactggatcatccagcagatgaaggacagcgggctgcgcgggcgcggcggcgcgggctttccgaccggtctgaaatggtccttcatgcccaaggaaagcgatggccgcccgtcctatctggtggtcaatgccgacgaatccgagccgggcacctgcaaggaccgcgagatcatgcgccacgatccgcatacgctgatcgaaggctgcctgatcgccagtttcgcgatgaacgcaaacgcctgctatatctacattcgcggcgaatacatccgcgagcgcgaggcgctgcaggccgcgattgacgaggcctatgacgcgggtctcttgggcaagaatgccgccaaatccggctgggatttcgacctctacctgcatcacggtgcgggcgcctatatctgcggcgaggaaaccgcgctgatcgaaagcctcgagggcaagaagggcatgccccggatgaaaccgccctttccggcgggtgcggggctttatggctgcccgaccacggtcaacaacgtcgaatccatcgccgtcgtgcccaccatcctgcggcgcggaccggaatggttcgcgggctttggccgccagaacaacgccggcaccaagctgtttgccatctcgggccatgtgaacaacccctgcgtggtcgaagaggcgatgtcgatctcgttcgaggaactgatcgagacccattgcggcggcattcgcggcggctgggacaacttgctggccgtgatcccgggcggctcctcggttccctgcgtgcgcggggaaaagatgaaggacgcgatcatggatttcgattacctgcgcggcgaactgggctcgggcctgggcacggcggcggtgatcgtgatggacaaatccaccgatatcgtgaaggcgatctggcgcctcagcaaattctacaagcatgaaagctgcggccagtgtaccccctgccgcgagggcaccggctggatgatgcgggtgatggaccgtctggtgcgcggcgaggccgagccggaagagatcgacatgctctgggacgtgaccaagcaggtcgagggccacaccatctgcgccctgggcgatgcggcggcctggccgatccagggcctgatccgcaacttccgcgacgagatcgaggatcgcatcaaggcacagaaatcgggccgcatgggcgcgatggcggcggagtga

SEQ ID NO: 39259 - protein, 432 aa, Silicibacter pomeroyi DSS-3
MLKDQDRIFTNLYGMHDRTLKGAMARGHWDGTAGIIGKGRDWIIQQMKDSGLRGRGGAGFPTGLKWSFMPKESDGRPSYLVVNADESEPGTCKDREIMRHDPHTLIEGCLIASFAMNANACYIYIRGEYIREREALQAAIDEAYDAGLLGKNAAKSGWDFDLYLHHGAGAYICGEETALIESLEGKKGMPRMKPPFPAGAGLYGCPTTVNNVESIAVVPTILRRGPEWFAGFGRQNNAGTKLFAISGHVNNPCVVEEAMSISFEELIETHCGGIRGGWDNLLAVIPGGSSVPCVRGEKMKDAIMDFDYLRGELGSGLGTAAVIVMDKSTDIVKAIWRLSKFYKHESCGQCTPCREGTGWMMRVMDRLVRGEAEPEEIDMLWDVTKQVEGHTICALGDAAAWPIQGLIRNFRDEIEDRIKAQKSGRMGAMAAE

SEQ ID NO: 39260 - DNA, 1275 bp, Francisella tularensis subsp. tularensis SCHU S4
  CDS (1)..(1275): transl_table=11
atggcaaatgaagtttgttttcgtactctacatttagataagccatacagtttggagtcttatttatctgtgggagggtattcctactggaataaaatattgacagaaaaaattccacctgagcaaattattgaagagctcaaaatatctgggcttaggggtcgtggtggtgctggtttccctacgggattgaaatggagttttatgccacgtaatgctccggggcagaaatacgttgtatgcaactctgatgagggtgagcctggtacatgtaaggatagagaaattcttaggaataatcctcatcaattgattgaaggtatagctattgctggatatgttgttggggctactgcaggctataactatactagaggcgagttctatgagccaatagctaggtttgaagacgcgcttattgaggcatatcaagcaggtttattgggtacaaatatcaaatcatcaggaatctcttttgatttatactcagctattggtgctggtgcttatatctgtggtgaagaaacagcattgcttaactcacttgagggtaaaaaaggtcgcccaagatttaagccaccatttcctgcatttaaaggtctttatgacaagccaacaaatataaataatacagaaacatatgcttcagtgccggcaatattacaatatggcggtgagtggtttaagaaattgggtactgagaaaagtggcggtactaagttattctgtgtctctggacatgtacagcagcaaagagttgttgaaataggtttaggtatgccgtttaaagagcttttagacatgtgcggaggcgttcgcaatggtaataagcttaaggcagtaatccctggtggcagctcatctaagatcttgacagctgatgagatgatggctgttactatggattatgagtcaatagcagcggcaggttcaatgcttggttcaggagcagttgtagtgttggatgagactacatgtattgttagaactctagcaaggcttgctgatttctattatgaagagtcttgtggtcaatgtacgccttgtagagagggtactgggtggttagcacgaactttacatagaattgttgctggtgaaggaagaccggaggatattgatactttagttagagtagcaacaaatatagagggtaatactatttgtggtttgggtgatgcagctgcatggccagtccagagttatatagataaatttaggcatgagtttgtttatatgatcgagaataatggtagaagtatagtggatcaatag

SEQ ID NO: 39261 - protein, 424 aa, Francisella tularensis subsp. tularensis SCHU S4
MANEVCFRTLHLDKPYSLESYLSVGGYSYWNKILTEKIPPEQIIEELKISGLRGRGGAGFPTGLKWSFMPRNAPGQKYVVCNSDEGEPGTCKDREILRNNPHQLIEGIAIAGYVVGATAGYNYTRGEFYEPIARFEDALIEAYQAGLLGTNIKSSGISFDLYSAIGAGAYICGEETALLNSLEGKKGRPRFKPPFPAFKGLYDKPTNINNTETYASVPAILQYGGEWFKKLGTEKSGGTKLFCVSGHVQQQRVVEIGLGMPFKELLDMCGGVRNGNKLKAVIPGGSSSKILTADEMMAVTMDYESIAAAGSMLGSGAVVVLDETTCIVRTLARLADFYYEESCGQCTPCREGTGWLARTLHRIVAGEGRPEDIDTLVRVATNIEGNTICGLGDAAAWPVQSYIDKFRHEFVYMIENNGRSIVDQ

SEQ ID NO: 39262 - DNA, 1605 bp, Synechococcus elongatus PCC 6301
  CDS (1)..(1605): transl_table=11
atggattgggaagatttggggcgtttggctaacgaggaactgacttgccagaagccgattcgtctgcgctgttgtacagccacgggttgtcgtgccaacggtgctgaggccgtttttaaagcagtacagcagacgatcgccgatcaaaatttgggcgatcgctgcgaggctgtcagcgtcggttgcttgggactctgtggtgcggggccactggtgcagtgtgatcccagcgatcgcctctacagtgacatccgtcctgatcaggcagcggatctcgttgcggcggctcaaggtgcagcgatggatctacccgaagttgatcaggctcagcccttctttagccaacaactgaaaatcgtcaatcgccacagcggcttgatcaatcccgatcgcctcgaaagctatctggcagcgggcggctatcgggctttgatgcacaccatctttgacttaacaccaacagaagtcgccgagattattcgccttagtgggctgcgcgggcgcggcggtggcggctatcccaccggcttgaaatgggcgaccgtcgccaaaatgcccagcgatcgcaagtttgtggtttgcaacggcgatgagggcgaccccggcgcttttatggatcgcagcgtcctagagagcgacccccatcaagtcatcgagggcatggcgatcgcggcctatgcggtgggtgcgaactttggctacctttacgtgcgggcggaatatccactagcgatcgcacgactcaatcaagccattcgccaagcccgccgccgtgggctgctgggcaacagtgtcttggatagccgcttcagctttgatctcgaggtgcggatcggtgcgggtgcctttgtctgcggcgaagaaacggcgctgattcactcaattcaaggggagcgcggtgtgcctcgggtgcgtccgccttatccggcagagtcgggcctctggggtcatccaacgctgatcaataacgtcgaaacctttgccaatattgccccgattgtggagcaaagcgctgactggtttgcggcgatcggcacgccgaccagcaaggggacgaaagtttttgcattgactggtaagctgcgcaacaacggcctgattgaagtgccgatgggcattccgctgcgatcgatcgtcgatggcatgggtattcccgaaagccctgtgaaagcggtgcaaaccggcgggccttccggcggctgcattcctttagcgcaattggatacaccggtcgactacgactcactcatacaactgggatcaatgatgggttccggcggcatggtagtcatggacgagaacaccgatatggtggcgatcgcccgcttctacatggaattttgccgctccgaaagctgtggcaaatgcattccctgtcgggcaggcacagtgcaactgcatgagctcctcgggaagttatctagcggtcaaggcaccgcgatcgatctccaacagctcgaagacctttgctatttggtcaaagacaccagtctctgtggcttgggaatgtctgctcccaacccaattcttagtacgctgcgctggttccgtcaggagtacgagtcacgcctgattccagaacgggcgatcgcactgactcattag

SEQ ID NO: 39263 - protein, 534 aa, Synechococcus elongatus PCC 6301
MDWEDLGRLANEELTCQKPIRLRCCTATGCRANGAEAVFKAVQQTIADQNLGDRCEAVSVGCLGLCGAGPLVQCDPSDRLYSDIRPDQAADLVAAAQGAAMDLPEVDQAQPFFSQQLKIVNRHSGLINPDRLESYLAAGGYRALMHTIFDLTPTEVAEIIRLSGLRGRGGGGYPTGLKWATVAKMPSDRKFVVCNGDEGDPGAFMDRSVLESDPHQVIEGMAIAAYAVGANFGYLYVRAEYPLAIARLNQAIRQARRRGLLGNSVLDSRFSFDLEVRIGAGAFVCGEETALIHSIQGERGVPRVRPPYPAESGLWGHPTLINNVETFANIAPIVEQSADWFAAIGTPTSKGTKVFALTGKLRNNGLIEVPMGIPLRSIVDGMGIPESPVKAVQTGGPSGGCIPLAQLDTPVDYDSLIQLGSMMGSGGMVVMDENTDMVAIARFYMEFCRSESCGKCIPCRAGTVQLHELLGKLSSGQGTAIDLQQLEDLCYLVKDTSLCGLGMSAPNPILSTLRWFRQEYESRLIPERAIALTH

SEQ ID NO: 39264 - DNA, 1278 bp, Ehrlichia ruminantium str. Welgevonden
  CDS (1)..(1278): transl_table=11
atgttagaagataaagacaaagtttttactaatcttagtggtcaaggttctccatttttaaaatctgcaaaaagtagaggtatttggagtaatatcttagatatattaaatttaggctcagaacacattattcaagaagtaaaaaaatctggattacgtggtaggggtggtgcaggtttttctacaggacttaagtggagttttatgccaaaaaccagaaaagaaggacagccagcgtatttagttgttaatgctgatgagtcggaacctggtacatgtaaagatcgtgatatattaaggtatgaaccacataggcttattgaaggaatattaatagctgggtttgctatgagagtgactacagcttatatttatattcgtggtgaattttataatgaatatttaatattatctgaggcacttaaggaggcatataaagcaaaattaattggtaaaaatgcatgtaagtctggttatgacatagatatatttattcatagaggtgctggtgcatatatttgtggggaggaaactgctcagcttgaatctttggaaggtagaaaggggatgccaaggttaaaaccaccatttcctgctgcaataggattatatggatgtcctactacgattaataatgttgaaactattgcaacaattggtgaaattttaagaagaggtagtaattggtttgcatctcttggaaaggagaataatactggtactaaaatcttctgcatatcaggacatgttaataatccgtgtaatgtagaagaggaattaggtattcctatgagagagttaatagagaaatatgcaggaggtgttcgtggtggatgggataatttattagcagtaataccaggtggttcttcagttcctgtgcttccaaaatctatttgtgatactattactatggattttgattctttaagggctgtgcaatctggtttgggtactgcaggtttgatagtgatggataaatcaacagatataattgcagctatagaaaggttatcacatttttacatgcatgaatcttgtgggcagtgtacaccatgccgtgagggtactggttggatgtggaaaatcatgaggaagctagtaaaaggaactgctacatatgatgatattgatttattattaagtattagttatcagatagaaggacatacaatttgtgctcttggtgatgctgcagcttggccagtacaaggtttaattagacattttagaggtgttattgaagagagaatagataattgtattagaaaatcatag

SEQ ID NO: 39265 - protein, 425 aa, Ehrlichia ruminantium str. Welgevonden
MLEDKDKVFTNLSGQGSPFLKSAKSRGIWSNILDILNLGSEHIIQEVKKSGLRGRGGAGFSTGLKWSFMPKTRKEGQPAYLVVNADESEPGTCKDRDILRYEPHRLIEGILIAGFAMRVTTAYIYIRGEFYNEYLILSEALKEAYKAKLIGKNACKSGYDIDIFIHRGAGAYICGEETAQLESLEGRKGMPRLKPPFPAAIGLYGCPTTINNVETIATIGEILRRGSNWFASLGKENNTGTKIFCISGHVNNPCNVEEELGIPMRELIEKYAGGVRGGWDNLLAVIPGGSSVPVLPKSICDTITMDFDSLRAVQSGLGTAGLIVMDKSTDIIAAIERLSHFYMHESCGQCTPCREGTGWMWKIMRKLVKGTATYDDIDLLLSISYQIEGHTICALGDAAAWPVQGLIRHFRGVIEERIDNCIRKS

SEQ ID NO: 39266 - DNA, 1254 bp, Dehalococcoides ethenogenes 195
  CDS (1)..(1254): transl_table=11
atgcaagacattaagattattacccgtcatctgaataccgccagctcagctgatattgatgtatatatggctgacggcggctaccaggcccttaaaaaagccctgtccatgactccggacgaagtaattgccgaagtcaaacgctcaaagctggtgggtcggggtggagcggcctttcctaccgggctcaagtgggagcttacccgcaaggaaaaggctaatccgaaatatatcgtctgtaatgccagcgagggtgaaccgggcacttttaaagaccggctgatacttaaaaacgacccccacatggtgctggaaggttttattattgccgcttatgcggtgggtacttcccagggctttatccatgcccgtgaggtttataccgaagaaatagagctgttccagaaagccatagaccaggcaaccgaacgcggttttctggggcagaatatcatggggagcaatttctcgctggatatccagttttacaagagcgccggtgcttatatctgcggtgaggaaaccgccctttttgaatcccttgaagggcacagaggtattcccgccgcccgcccgccgtatccggtgcaggtggggcttatggataaacccaccactgttaataacgtagaaactctctgcaatgtgcctgccattataaataacggggcagactggtttgctgcaatcggccatccggactatcccggcaccaagctcttctgcctttcgggtaacgtgaaagagccgggtgtttttgaaatgccgctgggaaccaaccttaaggacttgcttgaggccgggggaggcgtagacggcaagttcaaggcggttttgccggggggcatatcttccagcctgcttaccgaaatggacgtcaatctggactttaagacgctggccaaggctggtactatgctggggtcaggtgcagttattgtgataaactccgataccagcatggtaaatgtagcttccaacgtagcccacttctttgacgaagagggttgcggcaagtgctctatctgccgtgaaggcacccgccgggcggctgaaatccttagccgcttttcccgcgggcagggcaaccgcaacgaactggagtggctgctggaactgcacgaagtaatgaaagataccgcttcctgcggtctgggacaggtagccttaaatgtggctgccagtgccattcgcaacttcaagggtgaattcttggcgcaggtgcgtaaggaggaaggcgtatggttacgctaa

SEQ ID NO: 39267 - protein, 417 aa, Dehalococcoides ethenogenes 195
MQDIKIITRHLNTASSADIDVYMADGGYQALKKALSMTPDEVIAEVKRSKLVGRGGAAFPTGLKWELTRKEKANPKYIVCNASEGEPGTFKDRLILKNDPHMVLEGFIIAAYAVGTSQGFIHAREVYTEEIELFQKAIDQATERGFLGQNIMGSNFSLDIQFYKSAGAYICGEETALFESLEGHRGIPAARPPYPVQVGLMDKPTTVNNVETLCNVPAIINNGADWFAAIGHPDYPGTKLFCLSGNVKEPGVFEMPLGTNLKDLLEAGGGVDGKFKAVLPGGISSSLLTEMDVNLDFKTLAKAGTMLGSGAVIVINSDTSMVNVASNVAHFFDEEGCGKCSICREGTRRAAEILSRFSRGQGNRNELEWLLELHEVMKDTASCGLGQVALNVAASAIRNFKGEFLAQVRKEEGVWLR

SEQ ID NO: 39268 - DNA, 1872 bp, Dehalococcoides ethenogenes 195
  CDS (1)..(1872): transl_table=11
atgattaatacagcaattaaaaagtttaacagtgtagccgaacttgaggccaaacggcaggaaatccttaaagacaggaattcccaaaagacggttattgctatttgctgcggtaccggctgccaggcttacggggctaaaaaagttgccgatgcctttgaggaagagctttccaaagccggtttgggagataaggttgaggtcagaactactggctgtcacggcttttgcgaacgcggcccgctggtagttatccgcccccagaatattttttatcagcgcctgaagatttcagatataccagaaatcattgaaaaaaccataaaaaacaatgaagttattgaacgcctgctgtatgttgaccccatgaccaaagacaaaaaggtgcatgaacatgatgtgcctttctataaaaaacagatgcgtctggttttcggcaacaacggcaatatagaccctacctctatagatgactatctggcggtgggcggctataaatccttggccaaggctatatctggcctgaagccggaagaaattgtggaagaggttatcaaatccggactgcgcggacggggcggcggcggtttccccaccggctggaaatggaagtcctgccgggacgcccatgacccggtaaaatatgtaatctgcaactgtgacgagggtgacccgggtgcgtttatggaccgctcacttatggagggcaatccccatagcgttatagaaggcatgattatcggtgcttatgctattggctctcatgaagcttatatttatatccgtgatgaatatcctatggctgtaaagcacgcccttttggctataaaacaggccgaagactatggtctgctgggtgaaaacatactgggcagcggctttgacctgaaaatccatatcaaccggggtggcggtgcctttgtctgcggtgagtccacggcccttatggcctctctggagggcaaggtcggcgaaccccgtgccaagtatgttcatacctctgaaaagggtctgcatgacaagcctaccaccctgaataatgtggaaacctgggctaatatacccctgattatagaaaaaggagcagactggtttaacaaaataggtacagagggcagcaagggaaccaagatattctcactggtgggtaaggtaaacaataccggcctgattgaggttcccatgggtattacccttcgggaaattgtatatgatataggcggcggcattcccaaaggcaaaaaattcaaggctattcagaccggcggcccttcaggcggctgtctgcccgaaagtatgctggatttgccggtagactttgatgaacttaccaaggccggttctatgatgggttcgggtgccatgattgttatggacgaagataactgcatggtggagattgcccgttacttcctgagcttccttgaaggagaatcctgcggcaaatgtgtaccctgccgtgagggtgtcaagcgtatgcgccagattctggaaagaataaccaagggcgaaggcgaagagggagatatagagcttctggagcagctttcacaagcgatacaggacgcttctttatgtgctttgggcggcagtgctcctaatccggttttatctaccattaaatacttccgtgatgagtacgaagcccatatccgccagaagacctgtccggctaaggaatgtaaagcccttataacttataacatcattgatgccaattgccccggctgcggtttatgttacaaagcctgtccgacaggggctattatttcacagggtaaaaagatgccggtcatacttgaccagagcaaatgtactaaatgcggtgcgtgttttgatgcttgtaagctccacgccgtagaaatcagataa

SEQ ID NO: 39269 - protein, 623 aa, Dehalococcoides ethenogenes 195
MINTAIKKFNSVAELEAKRQEILKDRNSQKTVIAICCGTGCQAYGAKKVADAFEEELSKAGLGDKVEVRTTGCHGFCERGPLVVIRPQNIFYQRLKISDIPEIIEKTIKNNEVIERLLYVDPMTKDKKVHEHDVPFYKKQMRLVFGNNGNIDPTSIDDYLAVGGYKSLAKAISGLKPEEIVEEVIKSGLRGRGGGGFPTGWKWKSCRDAHDPVKYVICNCDEGDPGAFMDRSLMEGNPHSVIEGMIIGAYAIGSHEAYIYIRDEYPMAVKHALLAIKQAEDYGLLGENILGSGFDLKIHINRGGGAFVCGESTALMASLEGKVGEPRAKYVHTSEKGLHDKPTTLNNVETWANIPLIIEKGADWFNKIGTEGSKGTKIFSLVGKVNNTGLIEVPMGITLREIVYDIGGGIPKGKKFKAIQTGGPSGGCLPESMLDLPVDFDELTKAGSMMGSGAMIVMDEDNCMVEIARYFLSFLEGESCGKCVPCREGVKRMRQILERITKGEGEEGDIELLEQLSQAIQDASLCALGGSAPNPVLSTIKYFRDEYEAHIRQKTCPAKECKALITYNIIDANCPGCGLCYKACPTGAIISQGKKMPVILDQSKCTKCGACFDACKLHAVEIR

SEQ ID NO: 39270 - DNA, 1923 bp, Dehalococcoides ethenogenes 195
  CDS (1)..(1923): transl_table=11
atgccaaggctgaatactccggctgagctggaaaccctgcggaaaaaactggtcaaaaaccagtctgcctcccgcccctgcataacggtatgctgcggtacaggatgccgggcattgggttcggttaaactggtagatgctttccgggccgagcttgccaagcagggcctggaaagttcagttgatattaaagaaaccggctgccatggtttttgtgaaaaaggttcggtggttgttatctatccccaaaatatctgctatttccatgtaaaacctgaagacgccgcagacgttgtcgctaaaacaataaaaaccggcgaactggtagaccatttgctttacaaagaccctgccagcggcgaaaagctggtttatcatcaggatattcccttttacaagtaccaggaacggactgtactgggcgataacgagcatataaatccccagaatatagaggattatattcagcggggcggttattccgccctggttaaagcccttttccagatgaccccggaatctgtactggaagaagtagatacagccaatctgcgcggacgcggcggcgacggtttccctgccggtaaaaagtggcgcaccacccgtgatgctcctgacccggtcaaatacgtgctggttaactgtgacgagggtgacccaggggcatttatggaccgctccatcatggagggtaacccccactgcgtgctggaaggtctggctataggggcttttgcagtcggcgccaaagagggttatatatatgtacgtgccgaatacccattggcggtggaaaacctgtacgctgccataaggcaggcagaggagtatggtctgctgggcaaaaatatacttggctccggatttgattttattgtcaaagtccacgaaggagccggggcttttgtatccggcgaatcgtccgcactgatgactgctattgaagggcgggttggtgaaccccgccccaaatatatccgcactgcgatcaaggggctctgggataaaccctcaaatctaaataacgtggagacctgggctaacgtaccccatattataaacaaaggggcggagtggttcaggtctatcggtaccgaaggcagcaaaggcaccaaaatatttgctttggttggcaaggttaacaataccggactggtagaagtacctatgggtactaccctccgggatattatatttaaaataggcggcggcctgcgtgacggcaaaaaaataaaagctgtccagacaggcggcccctcaggcggctgcatacccgaaaacctgctggattcgcctgttgattatgatgtgctgagtaaactgggttctatggtaggttcaggcgggcttatcataatggacgaagaaacctgcatggtagatattgcccgctattttataaactttttgtcagatgaatcctgcggcaaatgcctgccctgccgcgagggactccgccagctggtagaaatacttacccgtattaccgaaggcaaaggcactatggcagatatggacactctggaagacctgagcggggtaatgagtgaagcctgcctgtgcgctttgggacagcaagccccaaatcccctgctgaccacccttaaatatttccgtcacgaatacattgaccatattaaaaacaaacactgtgaagccggcgtctgcaaagccttgcttactttctatattgaccctgacaaatgcaaagcctgcatgatttgcgcccgaaactgccctactgatgccataaagggcggcaaagggcttattcatactatagaacaggataaatgcatcaagtgcggagcctgtctggatacctgcccggccaaattttatgcggtcaggaaaatatccggcatacctataccggacaacgtaccgtctgaacctattcctttaaaccggaaggcagaataa

SEQ ID NO: 39271 - protein, 640 aa, Dehalococcoides ethenogenes 195
MPRLNTPAELETLRKKLVKNQSASRPCITVCCGTGCRALGSVKLVDAFRAELAKQGLESSVDIKETGCHGFCEKGSVVVIYPQNICYFHVKPEDAADVVAKTIKTGELVDHLLYKDPASGEKLVYHQDIPFYKYQERTVLGDNEHINPQNIEDYIQRGGYSALVKALFQMTPESVLEEVDTANLRGRGGDGFPAGKKWRTTRDAPDPVKYVLVNCDEGDPGAFMDRSIMEGNPHCVLEGLAIGAFAVGAKEGYIYVRAEYPLAVENLYAAIRQAEEYGLLGKNILGSGFDFIVKVHEGAGAFVSGESSALMTAIEGRVGEPRPKYIRTAIKGLWDKPSNLNNVETWANVPHIINKGAEWFRSIGTEGSKGTKIFALVGKVNNTGLVEVPMGTTLRDIIFKIGGGLRDGKKIKAVQTGGPSGGCIPENLLDSPVDYDVLSKLGSMVGSGGLIIMDEETCMVDIARYFINFLSDESCGKCLPCREGLRQLVEILTRITEGKGTMADMDTLEDLSGVMSEACLCALGQQAPNPLLTTLKYFRHEYIDHIKNKHCEAGVCKALLTFYIDPDKCKACMICARNCPTDAIKGGKGLIHTIEQDKCIKCGACLDTCPAKFYAVRKISGIPIPDNVPSEPIPLNRKAE

SEQ ID NO: 39272 - DNA, 1803 bp, Thermococcus kodakarensis KOD1
  CDS (1)..(1803): transl_table=11
atgtctgagatcaaggccatagcggtcggcatgaactcctgtggtatagcggccggtgccagggagacctacgaggcaattaaggcggagctggagaagaggaacctcaacatcaagctcaagatagtcggctgcgtcggtatgtgctaccgcgagcccctcgtggacataatcactgaggacgaaatcataacctacggccacgttgacccaaagaaggttccgaggatcatagaggagcacgtcatcaacgggaggcccataaaggagtggatagtcaagcgcgactggtgggagaacggcgagaggaagacgtgggacgtggatggttacttcgccaagcagaagaagatagtcctcgagaactctggctacatcgaccccgagaacatagacgagtacatccaggcaggcggctacgaggcgcttaaaaaggcccttaagatggatccggaggagataattgaaataatcaccaagtctggcctgaggggtaggggaggcgcgggcttccccaccggcctgaagtggaagttcactcgccaagccccgggagacgagaagtacgttatctgcaacgccgacgaaggcgatcctggggcatttatggacaggaacgtccttgaaggggatccacaccgcgtgatcgagggaatgataatcggcgcctacgcgatcggggcaacgaagggcttcatatacgtccgtgccgagtacccgctggcgataagaaggctaaagatagccctgaaacaggctagggagaggggcttcctcggcgagaacatcctcgggagcggtttctccttcgacatcgtcatcaaagagggcgccggtgccttcgtttgcggtgaggagactgccctgattgcctccatagagggcaagcgcggaatgccgaggccgaggccgccttatcctgcccagaagggcctgtggggcaaaccaaccaacataaacaacgtggagacttgggcgaacgtgccctggataataaggcatggctgggaggcctacgcctcacttgggacggagaagagcaagggcaccaaggtcttcgcgctgtcgggcaagataaagcacggcggcaacgttgaggttccgatgggaatcacgcttagggagatactctacgagataggcggcgggacgaagacgggtaagaggattaaagctgttcagctcggcgggccttccggcggctgcataccagaggagctcttcgacactcccgttgactacgagagcgtgaatgcaacgggagcgataatgggaagcggcggaatggtggttatggacgaggacacctgtatggttgacgtcgccaagttcttcctcgacttcacggtcaaggagtcctgcggtaagtgcaccttctgccgcataggcaccaagaggatgtgggaaatccttgacaggttcactaggggagaggcgaccgaggaggaccttgaaaagcttgagcggctcgcctatcaggttaaggccggctcgctctgcggtctcgggcagaccgccccgaacccggttctaacgacgctccgctacttcagggaagaatacatagagcacataaacggccgctgtccggcgaaggtctgcaagccgctcataaggtacgtcataataacggataagtgtacgggctgcaccgcctgcgccatcttctgcccggccaatgccatcagcggcgagaggctcaagccccacttcattgaccaagaggcgtgcatcaagtgcggtacctgctacgaagtgtgccgcttcaacgccattgaaatcctcaccgggagggaggagtga

SEQ ID NO: 39273 - protein, 600 aa, Thermococcus kodakarensis KOD1
MSEIKAIAVGMNSCGIAAGARETYEAIKAELEKRNLNIKLKIVGCVGMCYREPLVDIITEDEIITYGHVDPKKVPRIIEEHVINGRPIKEWIVKRDWWENGERKTWDVDGYFAKQKKIVLENSGYIDPENIDEYIQAGGYEALKKALKMDPEEIIEIITKSGLRGRGGAGFPTGLKWKFTRQAPGDEKYVICNADEGDPGAFMDRNVLEGDPHRVIEGMIIGAYAIGATKGFIYVRAEYPLAIRRLKIALKQARERGFLGENILGSGFSFDIVIKEGAGAFVCGEETALIASIEGKRGMPRPRPPYPAQKGLWGKPTNINNVETWANVPWIIRHGWEAYASLGTEKSKGTKVFALSGKIKHGGNVEVPMGITLREILYEIGGGTKTGKRIKAVQLGGPSGGCIPEELFDTPVDYESVNATGAIMGSGGMVVMDEDTCMVDVAKFFLDFTVKESCGKCTFCRIGTKRMWEILDRFTRGEATEEDLEKLERLAYQVKAGSLCGLGQTAPNPVLTTLRYFREEYIEHINGRCPAKVCKPLIRYVIITDKCTGCTACAIFCPANAISGERLKPHFIDQEACIKCGTCYEVCRFNAIEILTGREE

SEQ ID NO: 39274 - DNA, 1278 bp, Ehrlichia ruminantium str. Gardel
  CDS (1)..(1278): transl_table=11
atgttagaagataaagacaaagtttttactaaccttagtggccaaggttctccatttttaaaagctgcaaaaagtagaggtatctggagtaatatcttagatatattaaatttaggctcagaacacattattcaagaagtaaaaaaatctggattacgtggtaggggtggtgcaggtttttctacaggacttaagtggagttttatgccaaaaaccagaaaggaaggacagccagcgtatttggttgttaatgcggatgagtcggaacctggtacatgtaaagatcgtgatatattaaggtatgaaccacataggcttattgaaggaatattaatagctgggtttgctatgagggtgactacagcttatatttatattcgtggtgaattttataatgagtatttaatattatctgaggcacttaaagaggcatataaagcaaaattaattggtaaaaatgcatgtaagtctggttatgacatagatatatttattcatagaggtgctggtgcatatatttgtggggaggaaactgctcagcttgaatctttggaaggtagaaaagggatgccaaggttaaaaccaccatttcctgctgcaataggattatatggatgtcctactacgattaataatgttgaaactattgcaaccattggtgaaattttaagaagaggtagtaattggtttgcatctcttggaaaggagaataatactggtactaaaatcttctgcatatcaggacatgttaataatccgtgtaatgtagaagaggaattaggtattcctatgagagagttaatagagaaatatgcaggaggtgttcgtggtggatgggataatttattagcagtaataccagggggttcttcagttcctgtgcttccaaaatctatttgtgatactattactatggatttcgattctttaagggctgtacaatctggtttgggtactgcaggtttgatagtgatggataaatcaacagatataattgcagctatagaaaggttatcacatttttacatgcatgaatcttgtgggcagtgtacaccatgccgtgagggtactggttggatgtggaaaatcatgaggaagctagtaaaaggaactgctacatatgatgatattgatttattattaagtattagttatcagatagaaggacatacaatttgtgctcttggtgatgctgcagcttggccagtacaaggtttaattagacattttagaggtgttattgaagagagaatagataattgtattagaaaatcatag

SEQ ID NO: 39275 - protein, 425 aa, Ehrlichia ruminantium str. Gardel
MLEDKDKVFTNLSGQGSPFLKAAKSRGIWSNILDILNLGSEHIIQEVKKSGLRGRGGAGFSTGLKWSFMPKTRKEGQPAYLVVNADESEPGTCKDRDILRYEPHRLIEGILIAGFAMRVTTAYIYIRGEFYNEYLILSEALKEAYKAKLIGKNACKSGYDIDIFIHRGAGAYICGEETAQLESLEGRKGMPRLKPPFPAAIGLYGCPTTINNVETIATIGEILRRGSNWFASLGKENNTGTKIFCISGHVNNPCNVEEELGIPMRELIEKYAGGVRGGWDNLLAVIPGGSSVPVLPKSICDTITMDFDSLRAVQSGLGTAGLIVMDKSTDIIAAIERLSHFYMHESCGQCTPCREGTGWMWKIMRKLVKGTATYDDIDLLLSISYQIEGHTICALGDAAAWPVQGLIRHFRGVIEERIDNCIRKS

SEQ ID NO: 39276 - DNA, 1278 bp, Ehrlichia ruminantium str. Welgevonden
  CDS (1)..(1278): transl_table=11
atgttagaagataaagacaaagtttttactaatcttagtggtcaaggttctccatttttaaaatctgcaaaaagtagaggtatttggagtaatatcttagatatattaaatttaggctcagaacacattattcaagaagtaaaaaaatctggattacgtggtaggggtggtgcaggtttttctacaggacttaagtggagttttatgccaaaaaccagaaaagaaggacagccagcgtatttagttgttaatgctgatgagtcggaacctggtacatgtaaagatcgtgatatattaaggtatgaaccacataggcttattgaaggaatattaatagctgggtttgctatgagagtgactacagcttatatttatattcgtggtgaattttataatgaatatttaatattatctgaggcacttaaggaggcatataaagcaaaattaattggtaaaaatgcatgtaagtctggttatgacatagatatatttattcatagaggtgctggtgcatatatttgtggggaggaaactgctcagcttgaatctttggaaggtagaaaggggaatccaaggttaaaaccaccatttcctgctgcaataggattatatggatgtcctactacgattaataatgttgaaactattgcaacaattggtgaaattttaagaagaggtagtaattggtttgcatctcttggaaaggagaataatactggtactaaaatcttctgcatatcaggacatgttaataatccgtgtaatgtagaagaggaattaggtattcctatgagagagttaatagagaaatatgcaggaggtgttcgtggtggatgggataatttattagcagtaataccaggtggttcttcagttcctgtgcttccaaaatctatttgtgatactattactatggattttgattctttaagggctgtgcaatctggtttgggtactgcaggtttgatagtgatggataaatcaacagatataattgcagctatagaaaggttatcacatttttacatgcatgaatcttgtgggcagtgtacaccatgccgtgagggtactggttggatgtggaaaatcatgaggaagctagtaaaaggaactgctacatatgatgatattgatttattattaagtattagttatcagatagaaggacatacaatttgtgctcttggtgatgctgcagcttggccagtacaaggtttaattagacattttagaggtgttattgaagagagaatagataattgtattagaaaatcatag

SEQ ID NO: 39277 - protein, 425 aa, Ehrlichia ruminantium str. Welgevonden
MLEDKDKVFTNLSGQGSPFLKSAKSRGIWSNILDILNLGSEHIIQEVKKSGLRGRGGAGFSTGLKWSFMPKTRKEGQPAYLVVNADESEPGTCKDRDILRYEPHRLIEGILIAGFAMRVTTAYIYIRGEFYNEYLILSEALKEAYKAKLIGKNACKSGYDIDIFIHRGAGAYICGEETAQLESLEGRKGNPRLKPPFPAAIGLYGCPTTINNVETIATIGEILRRGSNWFASLGKENNTGTKIFCISGHVNNPCNVEEELGIPMRELIEKYAGGVRGGWDNLLAVIPGGSSVPVLPKSICDTITMDFDSLRAVQSGLGTAGLIVMDKSTDIIAAIERLSHFYMHESCGQCTPCREGTGWMWKIMRKLVKGTATYDDIDLLLSISYQIEGHTICALGDAAAWPVQGLIRHFRGVIEERIDNCIRKS

SEQ ID NO: 39278 - DNA, 1275 bp, Wolbachia endosymbiont strain TRS of Brugia malayi
  CDS (1)..(1275): transl_table=11
gtgaaagaacaggacaaaatattcactaatttgagtggtaaagaaactccactactcaagggtgcaaaaaaacgtggtagttggcaaaaaacaaaagaattattggatttagggtcagaaaaaattattgatgaagtaagaaaatctggcttaagaggtcgagggggtgcaggattttctactggtcttaaatggagctttatgcccaagaatccttcaaaagagcagccaacatacttagtagtcaatgcggatgaatcagaacctggtacatgtaaagatagagatatattgcggtatgagccacacaagttacttgagggagttctcttggctagcagagcaattagtgcatctgttgcatatatttacattaggggtgaattttataatgaatatttagttttaaaacaagcacttgaagaagcgtataaagaaggcctaataggaaaaaatgcatgcaaatcaagttatgatcttaacgtgtttatccatagaggtgcaggggcttacatatgtggagaagaaacagctcagcttgaatcgatcgaaggaaaaaagggctttccccgtatgaagcctccatttcctgctggtgttggactttttggctgcccaaccacgataaacaacgttgagactatagctatggttccagacattctgtatcgtggaggggagtggtttgcatctcttggcaaaccaaataatactggtactaagatcttttgtgtttcagggcatgtaaataacccgtgtaatgttgaagaggaacttggaattccgctacgtgagttgattgaagaatatgcgggtggagtacgaggaggttgggataacttacttgctgtaatacctggtgggtcttcagtatcattaattccaaagtctatatgtgatattattaaaatggattttgattcattaagagcagcacagtcagggcttggtactgctgctgtaatagtgatggataaatcgactgatataatagctgcaatagagaggttatcgcacttctatatgcatgaatcatgtggacagtgcacaccatgtcgcgagggtactggatggatgtggagaattatgaaaagaatggtaacaggaaatattaagcatggtgaaatagataaattacttgaccttacaactcaaatagaaggcaatacaatttgcgcacttggtgatgctgcagcttggccaattcaaggattaatcagacattttcgccacgttatcgaagagagagcaattactaaactctctgtttattaa

SEQ ID NO: 39279 - protein, 424 aa, Wolbachia endosymbiont strain TRS of Brugia malayi
MKEQDKIFTNLSGKETPLLKGAKKRGSWQKTKELLDLGSEKIIDEVRKSGLRGRGGAGFSTGLKWSFMPKNPSKEQPTYLVVNADESEPGTCKDRDILRYEPHKLLEGVLLASRAISASVAYIYIRGEFYNEYLVLKQALEEAYKEGLIGKNACKSSYDLNVFIHRGAGAYICGEETAQLESIEGKKGFPRMKPPFPAGVGLFGCPTTINNVETIAMVPDILYRGGEWFASLGKPNNTGTKIFCVSGHVNNPCNVEEELGIPLRELIEEYAGGVRGGWDNLLAVIPGGSSVSLIPKSICDIIKMDFDSLRAAQSGLGTAAVIVMDKSTDIIAAIERLSHFYMHESCGQCTPCREGTGWMWRIMKRMVTGNIKHGEIDKLLDLTTQIEGNTICALGDAAAWPIQGLIRHFRHVIEERAITKLSVY

SEQ ID NO: 39280 - DNA, 1335 bp, Xanthomonas oryzae pv. oryzae KACC10331
  CDS (1)..(1335): transl_table=11
atggcacatcatcacgcaccctcaggcccggtcggtccggcgccgctgccgcatcaggtggtgtatacgacgctgcattacgacaccccgtggtcgtacgagagctatctgaaaacaggtggctacgccgcgctgcgcaagatcctcgaagagaagatcgcgccggccgatgtcatcgaaatggtcaaggcgtcgaatctgcgcggccgtggcggcgcgggcttcccgaccggtttgaagtggtcgttcatgcccaagggcacgatgcagaagtacatcctgtgcaactctgacgaatccgagccgggtacctgcaaggaccgcgacatcctgcgttacaacccgcattcggtggtggagggcatggcgatcgcctgctacgccaccggctcgacggtggggtacaactatctgcgtggcgagttccaccacgagccgttcgaaaatttcgagctggcgctggccgacgcgtacgccaacggttggttgggcaagaacatcctcggcagcggcgtggatatcgatatctacggcgcgctgggtgccggtgcctacatctgcggcgaagaaaccgcattgatggaatctctggaaggcaagaaaggccagccgcgctacaagccgccgttcccggccaacttcggcctgtacggcaagccgaccaccatcaacaacaccgagacctatgcgtcggtgccggcgatcattcgcaacggcccggagtggttccttgggttgagcaagaccaaaaacggcggcccgaagattttctcggtgtccggttgcgtgcagaagggcggcaatttcgaagtgccgctcggcaccaccttcgacgaattgctggaaatggccggcggtctgcgcccgggtcgcaagctcaagggcgtggtgcccggtggcgtgtcgatgccggtgctgaaagccgaccaggtcgctggcctgcagatggattacgacaccttgcgcgcactgggcaccggcttgggttcgggcgccatcgtggtgctggacgacagcgtctgctgcgtgcgtttcgcttgccgcatctcgcagttcttccacaaggaatcctgcggccagtgcaccccgtgccgcgagggcaccggctggatgcaccgcgtgctggagcgcattgtcgccggcaaggccacgatggaagacctgcatcagctgcgtaccgtggccggccagatcgaaggccacaccatctgcgcgttcggtgaagcggcggcatggccgattcagggcttcctgcgtcagttctgggacgagttcgagtactacatcgtcaacggtcgttcgatcgtcgatacgcaagtcggagtggctgcatga

SEQ ID NO: 39281 - protein, 444 aa, Xanthomonas oryzae pv. oryzae KACC10331
MAHHHAPSGPVGPAPLPHQVVYTTLHYDTPWSYESYLKTGGYAALRKILEEKIAPADVIEMVKASNLRGRGGAGFPTGLKWSFMPKGTMQKYILCNSDESEPGTCKDRDILRYNPHSVVEGMAIACYATGSTVGYNYLRGEFHHEPFENFELALADAYANGWLGKNILGSGVDIDIYGALGAGAYICGEETALMESLEGKKGQPRYKPPFPANFGLYGKPTTINNTETYASVPAIIRNGPEWFLGLSKTKNGGPKIFSVSGCVQKGGNFEVPLGTTFDELLEMAGGLRPGRKLKGVVPGGVSMPVLKADQVAGLQMDYDTLRALGTGLGSGAIVVLDDSVCCVRFACRISQFFHKESCGQCTPCREGTGWMHRVLERIVAGKATMEDLHQLRTVAGQIEGHTICAFGEAAAWPIQGFLRQFWDEFEYYIVNGRSIVDTQVGVAA

SEQ ID NO: 39282 - DNA, 1302 bp, Neisseria gonorrhoeae FA 1090
  CDS (1)..(1302): transl_table=11
atggctatttaccaatcaggcgtgatttttgaccaagtggataccgccaatcccgattgctggacattggacgaatacgtcaaacgcggcggctataccgccctgcgtaaaatcctgtccgaaaacatctcgcaaaccgatgtgattgacgaagtcaaaacctccggcttgcgcgggcgcggcggtgcgggcttcccgaccggtttgaaatggagctttatgccccgttctttcccgggcgaaaaatatgtggtttgcaacaccgacgaaggcgagccgggtacatttaaagaccgcgacatcatcatgttcaatcctcatgccctgattgaaggcatgatcattgccggttacgcgatgggcgcgaaagccggctacaactatatccacggcgaaattttcgaaggttatcaacgctttgaagccgctttggagcaggcgcgtgccgcaggctttttgggtaaaaatattttgggttcggattttgaattcgaactcttcgcccaccacggctacggcgcatatatttgcggcgaagaaaccgcattgcttgaatcgttggaaggcaaaaaaggccagccgcgcttcaaaccgccgttccccgcctcgttcggcctgtacggcaaaccgaccaccatcaacaataccgaaacgttctcctccgtcccgtttattatccgtgacggcggacaggcgtttgccgataaaggtattccgaatgcaggcggtaccaaattattttgtatttccggccatgtcgagcgtccgggcaactatgaagtgccgttgggcacgccgtttgccgaagtcttgaaaatggcgggcggtatgcgcggcggtaaaaaactcaaagccgttattcccggcggttcgtccgcccccgtattgcctgccgacattatgatgcagaccaatatggactatgactcgatttccaaagccggctcgatgctcggttccggcgcgattatcgtgatggacgaagacgtgtgcatggtcaaagccctcgaacgcttaagctatttctactacgacgaatcctgcggccaatgcaccccctgccgcgaaggtaccggctggctttaccgcatcgtccgccgcatcgtagaaggcaaaggccgcatggaagacttggatttgctggattctgtcggcaaccaaatggcaggccgcaccatctgcgcccttgccgatgccgccgtcttccctgtccgcagctttaccaagcatttccgtgatgagtttgcgcattacatcgaacacggcgggccgatgaaagagcataagtggggagggtggtaa

SEQ ID NO: 39283 - protein, 433 aa, Neisseria gonorrhoeae FA 1090
MAIYQSGVIFDQVDTANPDCWTLDEYVKRGGYTALRKILSENISQTDVIDEVKTSGLRGRGGAGFPTGLKWSFMPRSFPGEKYVVCNTDEGEPGTFKDRDIIMFNPHALIEGMIIAGYAMGAKAGYNYIHGEIFEGYQRFEAALEQARAAGFLGKNILGSDFEFELFAHHGYGAYICGEETALLESLEGKKGQPRFKPPFPASFGLYGKPTTINNTETFSSVPFIIRDGGQAFADKGIPNAGGTKLFCISGHVERPGNYEVPLGTPFAEVLKMAGGMRGGKKLKAVIPGGSSAPVLPADIMMQTNMDYDSISKAGSMLGSGAIIVMDEDVCMVKALERLSYFYYDESCGQCTPCREGTGWLYRIVRRIVEGKGRMEDLDLLDSVGNQMAGRTICALADAAVFPVRSFTKHFRDEFAHYIEHGGPMKEHKWGGW

SEQ ID NO: 39284 - DNA, 1308 bp, Brucella abortus biovar 1 str. 9-941
  CDS (1)..(1308): transl_table=11
atgctggctgacaaagatcgcatcttcaccaatatttacggcttcaaggatcagtccctgaagggtgccatggctcgtggccattgggacaataccaagggcctgatcgagaagggccgcgactggatcatcgaggagatgaaggcgtcgggcctgcgtggccgtggcggcgctggcttcccgacgggtctcaaatggtcgttcatgcccaagcagagcgatggtcgcccgcattacctcgtcgtcaatgccgacgaatcggagccgggcacctgcaaggaccgcgaaatcctgcgccacgatccgcatacgctgatcgaaggctgcgtgattgccggttgcgcgatgggcgtacacaccgcttatatttatattcgcggcgagttcatgcgtgagcgtgaggcgcttcaggctgcaatcgacgagtgctacgaagccggccttctcggcaagaacaacaagtgcggctgggatatggacatttatgtcacccacggcgctggcgcttatatctgcggtgaagaaacggctctgctcgaaagcctcgaaggcaagaagggtcagccgcgcctcaagcctccattcccggccaatatgggcctctacggttgcccgacgacggtcaacaacgtggaatcgattgccgttgcgccgacgatcctgcgtcgtggcgcggcatggttctcgtccatcggacgtccgaacaatgtcggcaccaagctgttccagatgtccggccatgtgaacacgccgtgcgtcgtggaagaggggctcggcattccgttccgcgagctgatcgaaaagcatggcggcggtatccgtggcggctgggacaatctgctggcggtcattcccggcggcgcgtcgtgcccggtcatcaaggccgaggacatgatggacgccgtcatggattttgatggcatgcgtgagaagaagtcgtccttcggcaccggcggcttgatcgtcatggacaagtccaccgacatcatcaaggcgattgcgcgcctgtctgccttcttcaagcatgagagctgcggccagtgcacgccgtgccgcgaaggcactggctggatgtggcgcgtgatggagcgcatggtcaagggtaacgcgcagaagcgtgaaatcgacatgctgttcgacgtcaccaagcagatcgaaggtcacacgatctgcgcgctcggtgatgcggccgcatggccgatccaggggctgattcgcaatttccgtccggaaattgaaaagcgcattgatgaatatactcgcaacgccgttcagagccgtaatatccgtctggaagcggctgaataa

SEQ ID NO: 39285 - protein, 435 aa, Brucella abortus biovar 1 str. 9-941
MLADKDRIFTNIYGFKDQSLKGAMARGHWDNTKGLIEKGRDWIIEEMKASGLRGRGGAGFPTGLKWSFMPKQSDGRPHYLVVNADESEPGTCKDREILRHDPHTLIEGCVIAGCAMGVHTAYIYIRGEFMREREALQAAIDECYEAGLLGKNNKCGWDMDIYVTHGAGAYICGEETALLESLEGKKGQPRLKPPFPANMGLYGCPTTVNNVESIAVAPTILRRGAAWFSSIGRPNNVGTKLFQMSGHVNTPCVVEEGLGIPFRELIEKHGGGIRGGWDNLLAVIPGGASCPVIKAEDMMDAVMDFDGMREKKSSFGTGGLIVMDKSTDIIKAIARLSAFFKHESCGQCTPCREGTGWMWRVMERMVKGNAQKREIDMLFDVTKQIEGHTICALGDAAAWPIQGLIRNFRPEIEKRIDEYTRNAVQSRNIRLEAAE

SEQ ID NO: 39286 - DNA, 1359 bp, Pseudomonas syringae pv. syringae B728a
  CDS (1)..(1359): transl_table=11
atgaccatcacttccttcggccctgccaaccgcattgcgcgcacggcagaaacccatccgctgacctggcgtctgcgcgacgacggcgaaccggtctggctcgacgagtaccagaccaaggacggctacgctgcagcgcgcaaggcgctgacgcagcaggcgcctgacgatatcgtccagtcggtcaaggattccggcctcaagggccgcggtggcgcaggcttccccacgggggtgaagtggggcctgatgcccaaagacgagtccatgaacatccgctacctgctgtgcaacgcggacgagatggaacccaacacgtggaaagaccgcatgctgatggagcaactgccccatctgctggtcgagggcatgctgatcagtgcccgcgcgctgaaagcctatcgcggctatatcttcctgcgcggcgaatacgtcaccgcagccaagcacctcaatcgcgcagtggctgaagccaaggccgcgggtttgctgggcaagaacattctcggcaccggtttcgacttcgaactgttcgtgcacacgggtgccggtcgctacatctgcggtgaagaaaccgcactgatcaactcgctggaaggccgccgcgccaacccgcgctccaagccgcccttccctgctgcggtgggcgtgtggggcaagccgacttgtgtgaacaacgtcgagactttgtgcaacgtgcctgccatcgtcaacaacggcaacgactggtacaagtcgctggctcgcgaaggcagtgaagaccacggcaccaagctgatgggtttctccggcaaggtcaaaaaccccggtttgtgggaactgcccttcggcgtacaggctcgcgaactgttcgaggactacgccggcggcatgcgcgatggtttcaagctcaagtgctggcaacccggaggcgccggtacgggtttcctgctgccggagcatctggacgcgcagatgtacgcaggcggtatcgccaaggtcggcacccggatgggtacggggctggcgatggcggtcgacgattcggtcaacatggtctcgctgctgcgcaacatggaagagtttttcgctcaggagtcctgtggcttctgcacgccatgccgcgacggcttgccatggagcgtgaagatgcttcgcgccatcgagaacggtcagggtcagccgggggatatcgaaaccctgctgggtctggtcaatttcctcggccctggcaaaaccttctgtgcccatgcaccgggcgccgttgaacccttgggcagtgcgatcaagtatttccgttccgagttcgaagccggtatcgcgccagccagcgcagccacgctcgttccgggcaaaagtccgacagtggtcggcgcataa

SEQ ID NO: 39287 - protein, 452 aa, Pseudomonas syringae pv. syringae B728a
MTITSFGPANRIARTAETHPLTWRLRDDGEPVWLDEYQTKDGYAAARKALTQQAPDDIVQSVKDSGLKGRGGAGFPTGVKWGLMPKDESMNIRYLLCNADEMEPNTWKDRMLMEQLPHLLVEGMLISARALKAYRGYIFLRGEYVTAAKHLNRAVAEAKAAGLLGKNILGTGFDFELFVHTGAGRYICGEETALINSLEGRRANPRSKPPFPAAVGVWGKPTCVNNVETLCNVPAIVNNGNDWYKSLAREGSEDHGTKLMGFSGKVKNPGLWELPFGVQARELFEDYAGGMRDGFKLKCWQPGGAGTGFLLPEHLDAQMYAGGIAKVGTRMGTGLAMAVDDSVNMVSLLRNMEEFFAQESCGFCTPCRDGLPWSVKMLRAIENGQGQPGDIETLLGLVNFLGPGKTFCAHAPGAVEPLGSAIKYFRSEFEAGIAPASAATLVPGKSPTVVGA

SEQ ID NO: 39288 - DNA, 1335 bp, Xanthomonas campestris pv. campestris str. 8004
  CDS (1)..(1335): transl_table=11
atggcacatcatcacgcaccctcaggcccggtcggtccggcgccgctgccgcatcaggtcgtctacacgaccctgcactacgacaccccgtggtcgtacgaaagctatctgaagaccggtggctacgccgcgctgcgcaagatcctcgaagagaagatcccgccgggcgacgtcatcgaaatggtgaaggcttccaacctgcgcggccgcggtggcgcgggcttcccgactggtctgaagtggtccttcatgcccaagggcaccatgcagaagtacatcctgtgcaattcggacgaatccgagccggggacctgcaaggaccgcgacatcctgcgttacaacccgcactcggtggtggagggcatggcaatcgcctgctacgccactggctcgaccgtgggctacaactatctgcgtggtgagttccatcacgagccgttcgaaaatttcgagctggcactggccgatgcctatgccaacggctggctgggcaagaacattctcggcagcggcgtggatatcgatatctatggtgcgctgggcgctggcgcttacatctgcggcgaagaaaccgcgctgatggaatcgctggaaggcaagaagggccagccgcgctacaagccgccgttcccggcgaacttcggcctgtacggcaagcccaccaccatcaacaacaccgagacctacgcgtcggtgccagcgatcattcgcaatggcccggagtggttcctggggttgagcaagaccaagaacggcggcccgaagatcttctcggtgtccggctgcgtgcagaagggcggcaatttcgaagtgccgctcggcaccaccttcgacgaactgctggaaatggccggtggcctgcgtccgggccgcaagctcaagggcgtggtgcccggcggcgtgtcgatgccggtgctgaaggccgaccaggtcgctggcctgcagatggattacgacaccctgcgcgcgcttggcaccggtctgggttccggcgccatcgtggtgctggatgacagcgtgtgctgcgtgcggtttgcctgccgcatctcgcagttcttccacaaggaatcctgcggccagtgcaccccgtgccgcgaaggcaccggctggatgcatcgcgtgctggagcgcatcgtcgccggcaaggccacgatggaagacctccaccagctgcgcaccgtggccggccagatcgaaggtcacaccatctgcgcgttcggcgaagcggcggcatggccgatccagggcttcctgcgccagttctgggacgaattcgagtactacatcgtcaacggtcgttcgatcgtcgacacgcatgtcggagtggccgcatga

SEQ ID NO: 39289 - protein, 444 aa, Xanthomonas campestris pv. campestris str. 8004
MAHHHAPSGPVGPAPLPHQVVYTTLHYDTPWSYESYLKTGGYAALRKILEEKIPPGDVIEMVKASNLRGRGGAGFPTGLKWSFMPKGTMQKYILCNSDESEPGTCKDRDILRYNPHSVVEGMAIACYATGSTVGYNYLRGEFHHEPFENFELALADAYANGWLGKNILGSGVDIDIYGALGAGAYICGEETALMESLEGKKGQPRYKPPFPANFGLYGKPTTINNTETYASVPAIIRNGPEWFLGLSKTKNGGPKIFSVSGCVQKGGNFEVPLGTTFDELLEMAGGLRPGRKLKGVVPGGVSMPVLKADQVAGLQMDYDTLRALGTGLGSGAIVVLDDSVCCVRFACRISQFFHKESCGQCTPCREGTGWMHRVLERIVAGKATMEDLHQLRTVAGQIEGHTICAFGEAAAWPIQGFLRQFWDEFEYYIVNGRSIVDTHVGVAA

SEQ ID NO: 39290 - DNA, 1269 bp, Rickettsia felis URRWXCal2
  CDS (1)..(1269): transl_table=11
atgctaaaagaagaagacaaaatttttactaacctacatggtcagcaaagccatgatttgaaatcaagcaagaagcgaggcgattgggataatactaaagctttgcttgataaaggtagagagtttattattgaagaggtcaagaaatcagggcttagagggcgaggcggtgccgggttttctacaggcatgaaatggtcgtttatgcccaaaaattcagcgaagccttgctatttagtagtaaatgccgacgagtctgagcctggtacttgtaaggatcgtgatatattaaggtttgagccgcacaaattaatagaaggttgcttgcttgcaagctttgcgataggagcaaatgattgctacatctatattagaggtgagttttataatgaagcttctaatattcagcgtgcattagacgaagcttataaagacgggttaataggaaagaatgcttgtggctcaggtttcgattgtaatatttatttacatcgtggggcgggggcttatatttgcggtgaggaaactgcattacttgaaagtttagagggtaaaaaaggcatgcctcgtttaaagccgccttttcctgccggatttgggctatatggctgcccgactactataaataatgttgagtctattgcagtagtgccgaccattttaagacgaggagctagttggtttgcttctatcggtaagcctaacaataccggtactaagattttctgcatatcggggcatgttaataagccttgcaatgttgaagaggcaatgggaatttcgttaaaagaattgattgagaaatatgccggcggtgttcgaggtggttgggataatcttaaagccataattccgggcggttcttccgtgcctttacttcctaagtcattatgtgaagtggatatggattttgatagtttaagaaccgcaggttccggacttggtacaggtggtattatagttatggataaatctaccgatattatttatgcaatagcacgcttaagtaaattttatatgcatgaatcatgcgggcaatgtactccctgccgtgaaggtacgggctggatgtggcgagttatgatgcggctagttaaaggtaatgcccaaaaatccgagatagacgaactccttaacgttacaaaagaaatagaggggcatactatttgtgccttaggtgatgcggcagcttggccaatccaagggctgatacgccattttagaagcgagattgaggagaggataaaggggtggtccagtgctatatga

SEQ ID NO: 39291 - protein, 422 aa, Rickettsia felis URRWXCal2
MLKEEDKIFTNLHGQQSHDLKSSKKRGDWDNTKALLDKGREFIIEEVKKSGLRGRGGAGFSTGMKWSFMPKNSAKPCYLVVNADESEPGTCKDRDILRFEPHKLIEGCLLASFAIGANDCYIYIRGEFYNEASNIQRALDEAYKDGLIGKNACGSGFDCNIYLHRGAGAYICGEETALLESLEGKKGMPRLKPPFPAGFGLYGCPTTINNVESIAVVPTILRRGASWFASIGKPNNTGTKIFCISGHVNKPCNVEEAMGISLKELIEKYAGGVRGGWDNLKAIIPGGSSVPLLPKSLCEVDMDFDSLRTAGSGLGTGGIIVMDKSTDIIYAIARLSKFYMHESCGQCTPCREGTGWMWRVMMRLVKGNAQKSEIDELLNVTKEIEGHTICALGDAAAWPIQGLIRHFRSEIEERIKGWSSAI

SEQ ID NO: 39292 - DNA, 1560 bp, Pseudomonas fluorescens Pf-5
  CDS (1)..(1560): transl_table=11
atgcccagcctctacctgccctgtgattccctggcccgcgccgtgggcgccgatgaagtggccaaggccatcgccacccaggccgaacagcgccagctgccgctgcaactgcaacgcaccagctcccgtggcctgtactggctggagccgctgctggaagtcgacaccccggacgggcgcctgggcttcggcccggtgggcgccgccgacgtaccggcgctgctggacgccctgcaaggcgatgccgccagccatcccctggccctgggccgggtcgaagacctgccctacctgaagaaccagcaacgcctgctgttcgcccgcgccggcattacccggccgctgtccctggccgattaccgggcccacggcggcttcgagggcctgacccgctccatcgccctgggcggcgagcagaccgtggccgcggtgctcgactccggcctgcgtggccgcggcggcgcggccttccccgccgggatcaaatggcgcaccgtgcgcgacacgccgccgcagcagaagtacgtggtgtgcaacgccgacgaaggcgactccggcaccttcgccgaccgcatgctgatggagggcgacccgttcctgctgatcgaaggcatggccattgccggcctcgcggtcggcgccagctacggctacatctacgtacgctcggaatacccccaggccgtggcgaccctgcgcgaggccctggacatcgcccgggatgccggttacctcggggccaacgccggcggtagcggccaggccttcgacatggaagtacgggtcggtgccggggcctatatctgcggcgaggaaaccgccctgctggactccctggaaggcaagcgcggcatcgttcgcgccaagccgccgatcccggcgctgcaaggcctgttcggccagccgaccctggtgcacaacgtgctgaccctggcctcggtaccgctgatcctggccaagggcgcgccgttctatcgcgactacggcatgggccggtccctgggcaccatgcccttccaactggcgggcaacgtgcgccatggcggcctggtggagcgggccttcggcctgaccctgcgcgagctggtggaaggctatggcggcggcaccgccagcggccggccactgaaggcggcgcaagtcggtggccccctgggcgcctgggtaccgccttcgcagttcgatacgccgctggattacgaagccttcgccgccatgggcgcgatgctcggccacgggggcgtagtggtggccgacgacagcctggacctggcccgcatggcgcgcttcgccctgcagttctgcgccgaggaatcctgcggcaaatgcaccccgtgccgcatcggctcgacccgcggcgtggaggtcatcgaccgcctgctggccgctcccgatcaaggccgccgcgatgagcaggcgctgatcctcaaggacctgtgcgacaccctgcaatacggctcgctgtgcgccctgggcgggatgacctcctacccggtggccagcgccctgaagcacttccccgccgacttcggtctggcgccctcggaggccgagcaatga

SEQ ID NO: 39293 - protein, 519 aa, Pseudomonas fluorescens Pf-5
MPSLYLPCDSLARAVGADEVAKAIATQAEQRQLPLQLQRTSSRGLYWLEPLLEVDTPDGRLGFGPVGAADVPALLDALQGDAASHPLALGRVEDLPYLKNQQRLLFARAGITRPLSLADYRAHGGFEGLTRSIALGGEQTVAAVLDSGLRGRGGAAFPAGIKWRTVRDTPPQQKYVVCNADEGDSGTFADRMLMEGDPFLLIEGMAIAGLAVGASYGYIYVRSEYPQAVATLREALDIARDAGYLGANAGGSGQAFDMEVRVGAGAYICGEETALLDSLEGKRGIVRAKPPIPALQGLFGQPTLVHNVLTLASVPLILAKGAPFYRDYGMGRSLGTMPFQLAGNVRHGGLVERAFGLTLRELVEGYGGGTASGRPLKAAQVGGPLGAWVPPSQFDTPLDYEAFAAMGAMLGHGGVVVADDSLDLARMARFALQFCAEESCGKCTPCRIGSTRGVEVIDRLLAAPDQGRRDEQALILKDLCDTLQYGSLCALGGMTSYPVASALKHFPADFGLAPSEAEQ

SEQ ID NO: 39294 - DNA, 1356 bp, Pseudomonas fluorescens Pf-5
  CDS (1)..(1356): transl_table=11
atgaccctgacctctttcggtcctgcgaaccgcattgcgcgcaccgcagaaacccatcccctgacctggcgcctgcgcgacgacggcgagccggtctggttcgacgagtaccaggccaagaacggttacgcggcggctcgcaaggccttcgccgacctgtcccaggacgacatcgtgcagaccgtcaaggatgccggcctcaagggtcgcggcggtgcgggcttccccaccggtgtgaagtggggcctgatgcccaaagacgaatccatgaacatccgctacctgctgtgcaacgcggacgaaatggagcccaacacctggaaagaccgcatgctgatggagcaactgccccatctgctgatcgaaggcatgctgatcagtgcccgcgcactgaaaacctaccgcggctacatcttcctgcgcggcgagtacaccaccgccgccaagcacctgcgacgtgccgtggaagaagccaaggccgcaggccttctgggcaagaacatcctgggcagcggcttcgatttcgagctgttcgtccacaccggcgccgggcgttacatctgcggtgaagaaaccgcactgatcaactccctggaaggccgtcgcgccaacccgcgctccaagccgcccttccctgccgccgtgggcgtgtggggcaagccgacctgcgtgaacaacgtcgagaccctgtgcaacgtgccggcgatcatcggcgacggcgtggaatggtacaaatccctggcccgcgaaggcagcgaagaccacggcaccaagctgatgggcttctccggcaaagtgaagaaccccggcctgtgggagctgcccttcggcgtgaccgcccgcgagctgttcgaagactacgccggcggcatgcgcgacggcttcaagctcaaatgctggcagccaggcggcgccggtaccggcttcctgttgcccgagcacctggacgcccagatgtatgccggcggcatcgccaaagtgggcacccgtatgggtaccggcctggccatggcggtggacgacagcatcaacatggtgtccctgctgcgcaacatggagcagttcttcgcccgcgagtcctgcggcttctgcacaccgtgccgcgacggcctgccctggagcgtcaagctgctgatggccctggaaaaaggccagggccagcaaggggacatcgagaccctgctgggcctggtgggtttcctcggcccaggcaagaccttctgtgctcacgcaccgggtgccgtggagcctttgggcagcgccatcaagtatttccgtccagagttcgaagccggcatcgcgcccaccagcgccgccgtcccgcctctggcccgaccgatcgtagtcggcgcgtaa

SEQ ID NO: 39295 - protein, 451 aa, Pseudomonas fluorescens Pf-5
MTLTSFGPANRIARTAETHPLTWRLRDDGEPVWFDEYQAKNGYAAARKAFADLSQDDIVQTVKDAGLKGRGGAGFPTGVKWGLMPKDESMNIRYLLCNADEMEPNTWKDRMLMEQLPHLLIEGMLISARALKTYRGYIFLRGEYTTAAKHLRRAVEEAKAAGLLGKNILGSGFDFELFVHTGAGRYICGEETALINSLEGRRANPRSKPPFPAAVGVWGKPTCVNNVETLCNVPAIIGDGVEWYKSLAREGSEDHGTKLMGFSGKVKNPGLWELPFGVTARELFEDYAGGMRDGFKLKCWQPGGAGTGFLLPEHLDAQMYAGGIAKVGTRMGTGLAMAVDDSINMVSLLRNMEQFFARESCGFCTPCRDGLPWSVKLLMALEKGQGQQGDIETLLGLVGFLGPGKTFCAHAPGAVEPLGSAIKYFRPEFEAGIAPTSAAVPPLARPIVVGA

SEQ ID NO: 39296 - DNA, 1425 bp, Psychrobacter arcticum 273-4
  CDS (1)..(1425): transl_table=11
atgagattaacggtttcagagcagattgcccttcgcaaccaaggcaaagcaccaagccaacttaatgagcagtgcattcctatctatggtgacagagcgaccgctaccagtgaaactaaaccactgacatggcgtctagcacatcacgatgcggtattagatttggcaacttatgaatcgctacgtggttttgaagcactaaaaatagcgttaaaccaatcaccagatgatacgttaaaaactatcaaagaagcggtagttaaaggacgtggcggtgcaggtttcccagcgggtattaagtggtcgctgatggcaccaccagatggtggtccacgctacctagtttgtaatgctgatgagatggagccgggtacgtttaaagaccgtttgctgatggagcgtctgccactacagcttatagaaggtatgctgatttctgcctacgcgattggtgcaactgctggttatatctttattcgcggtgaatatatcttagcagcggagcgcttaaccgcagcaattgaagagttacgtgccaataacttgattggcgataatattttaggctcagattttagttttgatttacatgtgcatacgggtgctggtcgttatatttgtggtgaagaaacggcattgattaacagcttagaaggtcgtcgtgccaatccgcgtaccaaaccgccatttccacaagtggcaggtgcatggggacgtccaaccgtcgttaataacgttgaaactttgcataacgtctcagcaattatcctgcatggtagcaagtggtatcaagacttgccaaaagccaaaggtgtggtcgaaacacctggtactaaactgtttggttgctcaggcttggttaacgatcccggtctttgggaattaccttttggttatacggcacgtgagatcattgaagattttgcgggtggtatgcaggaaggtcgcacgcttaaggcttggttaccgggcggcgcatcaacggattttttaaccgctgaacatttagatactgttgttgattttgataccattcaaaaagccggtagtcgtatgggtacaggcctgctgatggtcgtcgacgaagagcaagatatggtgccattggtacgtaaccttgagattttctttcagcgtgaatcgtgtggttggtgtacgccatgccgtgatggtctaccgtggggcgttaaaatcctcaccgctatcaatgatggcgaagggcagatgggcgatgttgaaaagttagaagggttaacccgtgacttatggatcggtaaaaccttctgtgcccatgcgccgggtgcgatggaaccactcatgagtgcaattaaatatttccgtcctgagtttgatcaaaaaattacgcaggcggttggtgaagatgtcattgaggctgcagccagtcaacagctagatgtgaaataa

SEQ ID NO: 39297 - protein, 474 aa, Psychrobacter arcticum 273-4
MRLTVSEQIALRNQGKAPSQLNEQCIPIYGDRATATSETKPLTWRLAHHDAVLDLATYESLRGFEALKIALNQSPDDTLKTIKEAVVKGRGGAGFPAGIKWSLMAPPDGGPRYLVCNADEMEPGTFKDRLLMERLPLQLIEGMLISAYAIGATAGYIFIRGEYILAAERLTAAIEELRANNLIGDNILGSDFSFDLHVHTGAGRYICGEETALINSLEGRRANPRTKPPFPQVAGAWGRPTVVNNVETLHNVSAIILHGSKWYQDLPKAKGVVETPGTKLFGCSGLVNDPGLWELPFGYTAREIIEDFAGGMQEGRTLKAWLPGGASTDFLTAEHLDTVVDFDTIQKAGSRMGTGLLMVVDEEQDMVPLVRNLEIFFQRESCGWCTPCRDGLPWGVKILTAINDGEGQMGDVEKLEGLTRDLWIGKTFCAHAPGAMEPLMSAIKYFRPEFDQKITQAVGEDVIEAAASQQLDVK

SEQ ID NO: 39298 - DNA, 1530 bp, Candidatus Pelagibacter ubique HTCC1062
  CDS (1)..(1530): transl_table=11
atgggtgtctcaactattcatggtgcagaaagtttttatgaatttttaagaccctctcatagagaaaaaaaagcttttgtttgcaatggaagtgcttgcatgtgtgctggtactcaagagccgcttaaaaaaaaattacaagaaaaattaggtgacgataaagttggtgaaatgttttgccttggtcactgctatgaaaataatgcttttcattatgatggtgagaattatgccggaaacgatattaataagattgatcaaataattaaaggtgaagacatagttcaagaaaaattcttttctaaaagttatgcctcaactagttttttaatggatgacaaactttctaatttagatcaatttaatgaacaattaaaaaaatttattgctactgacaaacaagaaataactaaatcccttctagactctaatttaactggcagaggtggtgctggttttcctactggtatgaaatgggatttttgtagaaaagctccttctgaaaaaaaatatgttatatgtaatgccgatgaaggtgactcaggtgctttctctgatagatatttattagaagatcaaccattaaaagttttatttggaatggttatttgtggttatgttattggtagtgatgaaggtgttttatatataagaggagagtacccaaaatctatagaagcaataaatggagcaattaattctttaaaaaaagcaggcttgcttggagaaaatattttaggaactaaattttcttttgatttaaatatttgtattggtcaaggtgcttatatttgtggagaagaaacagcattgattgcatcaattgaaggaagaagagctgaagtagatgtaagacctcccttccctgtcactgaaggtctttacaagaaaccaacagttgtaaataatgttgaaacattagctgcagctacgggtatacttattaatggagctgataagttttctgcaattggaaataaaaaatctgctggaaccaaattagtttgctttgatagttttttcaataatccaggtgtttatgaagttgaaatgggaacaccaatgaaaaaagttttaaatgatattggtggtggttttaaagaacccattaaagcattacaaattggaggtccattaggaggtgtaattcctattaccgagattgaaaaattaaatttagattttcaagaatttactgctgcaggttttatgttaggacacgcgagcatagtaagtattccaaaagactttcctatggttgaatatattcatcatttatttgagttttctgccgaagagtcatgtggaaaatgctttcctggtagacttggttcttacaggggtaaagaaatgtttgatcaagcaaagaataaaactgctaaaattccattaaaattactaaatgagctgcttgtaactatgcaaaaaggctgtttatgcgctttgtgtggagcaattcctactcccatcatgaatatattaaaatattttggtgatgaaatgaaggatgatatggtgaaagataattaa

SEQ ID NO: 39299 - protein, 509 aa, Candidatus Pelagibacter ubique HTCC1062
MGVSTIHGAESFYEFLRPSHREKKAFVCNGSACMCAGTQEPLKKKLQEKLGDDKVGEMFCLGHCYENNAFHYDGENYAGNDINKIDQIIKGEDIVQEKFFSKSYASTSFLMDDKLSNLDQFNEQLKKFIATDKQEITKSLLDSNLTGRGGAGFPTGMKWDFCRKAPSEKKYVICNADEGDSGAFSDRYLLEDQPLKVLFGMVICGYVIGSDEGVLYIRGEYPKSIEAINGAINSLKKAGLLGENILGTKFSFDLNICIGQGAYICGEETALIASIEGRRAEVDVRPPFPVTEGLYKKPTVVNNVETLAAATGILINGADKFSAIGNKKSAGTKLVCFDSFFNNPGVYEVEMGTPMKKVLNDIGGGFKEPIKALQIGGPLGGVIPITEIEKLNLDFQEFTAAGFMLGHASIVSIPKDFPMVEYIHHLFEFSAEESCGKCFPGRLGSYRGKEMFDQAKNKTAKIPLKLLNELLVTMQKGCLCALCGAIPTPIMNILKYFGDEMKDDMVKDN

SEQ ID NO: 39300 - DNA, 1332 bp, Candidatus Pelagibacter ubique HTCC1062
  CDS (1)..(1332): transl_table=11
atgcttaacgataaagatagaatatttcaaaacctatataatgataaaggttcagatgttgagtcttcaaaaaatagaggtgactgggtagatactgctgaaataataaaaaaaggtagagaatggattatagaagaagttaaatcatcggaattaagaggaagaggtggtgctggatttcctacgggtcttaaatggtcttttgccccaaaagaacttggttctagacctcactatctagttataaatggtgatgaatctgaacctggcacatgtaaggatcgtgatattttaaggtttgaacctcacaaattaatagaaggatgtttgattgcttcttacgcagttcaggcccatgtttgctatatttatatacgcggcgaatattttattgatggacaaaaacttcaaaaagcaatcgatgaagcttatgaaaaaaaacttataggaaaaaatgcctctggtactggctgggacttagatatttatattcattatggagcaggcgcttatatatgtggtgaagaaacagcacttctagaaagcatcgaaggtaaaaaaggtcagccaagattaaaacctccttttccagctttaataggattatacggatgtccaacaataattaataacgtggaaactatagctgttgttccgacgattttgagaaaaggtggtaaatggtttgcgtcattaggaaaagcgaaaaatacaggaactaaaatattttgtatatctggaaatgttaataaaccatgtaacgttgaagaggaaatgagtatatctcttaaagagttaatagaagtacatgctggcggagtaattggtggatgggataatctacaagcagtaataccaggtggatcttctatgcctattataccaaaaaaaacatgtgaaactttaacaatggattttgattcacttgttgctgagaaaagtggtttaggaaccgcaggtattgtcgttataaataatgatcaggatattattaaatgtatggcaagaattgctagattttataaacatgaaagttgtggacagtgcacaccatgtagagaaggttctggatggatgtggagaatgttagaaagaatggctaagggagaagcgtcaaaagatgaagtagaaatgcttggtgatgttacaaatcaaattgctggtcatactatttgtgcttttggtgaaggatcttcatggcctgtccagggtttgttaagacattttagaaaagaaattgaggaacgaaacaattttgaaccaacaataaaaaaaaataatgaagttccttatttagtcgatcaacatttattggataaaaaaaatgcctaa

SEQ ID NO: 39301 - protein, 443 aa, Candidatus Pelagibacter ubique HTCC1062
MLNDKDRIFQNLYNDKGSDVESSKNRGDWVDTAEIIKKGREWIIEEVKSSELRGRGGAGFPTGLKWSFAPKELGSRPHYLVINGDESEPGTCKDRDILRFEPHKLIEGCLIASYAVQAHVCYIYIRGEYFIDGQKLQKAIDEAYEKKLIGKNASGTGWDLDIYIHYGAGAYICGEETALLESIEGKKGQPRLKPPFPALIGLYGCPTIINNVETIAVVPTILRKGGKWFASLGKAKNTGTKIFCISGNVNKPCNVEEEMSISLKELIEVHAGGVIGGWDNLQAVIPGGSSMPIIPKKTCETLTMDFDSLVAEKSGLGTAGIVVINNDQDIIKCMARIARFYKHESCGQCTPCREGSGWMWRMLERMAKGEASKDEVEMLGDVTNQIAGHTICAFGEGSSWPVQGLLRHFRKEIEERNNFEPTIKKNNEVPYLVDQHLLDKKNA

SEQ ID NO: 39302 - DNA, 1605 bp, Colwellia psychrerythraea 34H
  CDS (1)..(1605): transl_table=11
atgaccactaccctatatttacctatggatacgaccgcactatctatgggagccgacgatgtagccaaggcgcttgaatttcaaacttcagtaaatgagcaaactataaaccttattcgtaatggctctcgtggcatgttttatttggaacccttgctagaagtagaaacagagcaagggcgtgttgcttatggacccgtatcaatagacgatattgaatcattacttgctcaaggtatgctaaatggtgagtcaacacatccactttatttaggcttcacagagaatattccctatttagctaaacaacaacggttaacctttcaacgtgcgggtattattgacccgcttagcatagaagattatatcaaacatcaaggatttattggcttatctaacgctcttaaacttagtgctcagggtattgtcgatgaaatgaagatatctggattacgtggtcgaggcggagccgcatttccaacaggcataaaatggcaaacagtacttgatgctaaagtaacttcttcagaccaaaaaaagtacatcgtttgtaatgccgatgaaggtgattcaggaacttattctgaccgcctaataatggaagccgatccttttagtttaatcgaaggcatgatcattgccggaatagcagtaggtgcaacgcaaggatatatatatcttcgttcagaatacccgcaagcacagaaaatacttgaacaagccatcgctaatgcttatcaagataattacttaggtgacgctattcaaggtactcaacatcaatttgacttagaagttagaataggagcaggtgcttatatttgtggtgaagaaacctctttactggaaagccttgaaggaaaacgtggtttagtaagagcaaaacctcctttgcctgctattacaggtttatttggtcaaccaactactgtgaataatgttatcagtttagctacagtaccaacgattctagccaaaggagcgcaatactatcaggattatggtgttggcagatcgcgcggaaccctaccttttcagttagcgggtaatatcaaacaaggcggcttagtcgaacttgcctttggtaccaccttggccgatcttgttaatgattttggtgctggaacctatactggtgaaacaatgaaagccattcaagttggtggtcccttaggtgcttacttgcccaaatatcaatggcagactcctctcgattatgaagccttttcatcaattggtgctgtattaggccatggcggtatcgttgtctttgatgacagtgtcagtatgactgaacaagcacgttttgctatggaattttgtggtgtggaatcttgcggaaagtgtactccgtgccgtatagggtcaacaagaggcgttgaagttattgataaaatgataacagctcatgaacacgatgaaccaatcgaagcactcaacgaattattagtagatttatgcgataccatggttgatggctccctatgtgctatgggaggcatgacacccattcctgttcgtagcgttatgcagcattttagcgatgacttcatcactgacgctacagttgcggaagttaacaaaacgatgggtaaggagcaataa

SEQ ID NO: 39303 - protein, 534 aa, Colwellia psychrerythraea 34H
MTTTLYLPMDTTALSMGADDVAKALEFQTSVNEQTINLIRNGSRGMFYLEPLLEVETEQGRVAYGPVSIDDIESLLAQGMLNGESTHPLYLGFTENIPYLAKQQRLTFQRAGIIDPLSIEDYIKHQGFIGLSNALKLSAQGIVDEMKISGLRGRGGAAFPTGIKWQTVLDAKVTSSDQKKYIVCNADEGDSGTYSDRLIMEADPFSLIEGMIIAGIAVGATQGYIYLRSEYPQAQKILEQAIANAYQDNYLGDAIQGTQHQFDLEVRIGAGAYICGEETSLLESLEGKRGLVRAKPPLPAITGLFGQPTTVNNVISLATVPTILAKGAQYYQDYGVGRSRGTLPFQLAGNIKQGGLVELAFGTTLADLVNDFGAGTYTGETMKAIQVGGPLGAYLPKYQWQTPLDYEAFSSIGAVLGHGGIVVFDDSVSMTEQARFAMEFCGVESCGKCTPCRIGSTRGVEVIDKMITAHEHDEPIEALNELLVDLCDTMVDGSLCAMGGMTPIPVRSVMQHFSDDFITDATVAEVNKTMGKEQ

SEQ ID NO: 39304 - DNA, 1614 bp, Colwellia psychrerythraea 34H
  CDS (1)..(1614): transl_table=11
atgaatcactcaccttccgatgacagctcaatgccagtagcgtcacgaaaaattttcgtttctttagatactactgcccgctcccgcggtagtgataaggtagcaacgcaggttgaaagtgtacttaacgcacaaccagaactagcagcaacattagtaagaaatggctctcgcggcatgttttggttagagcctttattagaaattaatacccccaaaggtcgagtcgcttatggtccggtaaaagcggaagatgtaaacgacatcattaacctgcaatgttttgatgatgctactgaacacccattatgccttggtttaaccgaagaattaccctggtttaaatctcaacaacggttaacgtttgcccgagtgggcattatcgatcctatcgatgttgatgattacattagccatggtggatttgtcggtttaactaatgctttcgcaaaaactgcacaacagttagtcgatgaagtaaaagagtctggtctcagaggtcgtggcggtgctgcatttcctacaggtataaagtggcaaaccgttttgaatgaaccagagcagcagaaatatattgtctgtaacgccgatgaaggtgattcaggtacttttgccgatcgtatgttaatggaaggcgatccgttagtactagttgaaggcatgatcatcgcaggccttagcgtaggagctgaccaaggttatatctatttacgcagtgagtatcctcaggcccatgacctattaaataaagccattagcaatgcaaaagcagctggttatctaggtgataatatttgtggcactgagcacaactttcatttagaagtgcgtttaggcgctggtgcttatatttgtggcgaggaaacatccttattagaaagccttgaaggcaaacgtggcttagttcgcgctaaaccaccactacccgctattgaaggtttatttggtcaaccaaccgtggtaaataacgtcatatcactcgcttctgtaccttatattttaagccatggcggtgatagttatcgtgatttcggcatgggccgatctcgtggcaccttacccattcaattagcgggtaacattgctcaaggggggttagttgaattagctttcggtatatcccttaatgaattactacagcaatatggcaatggctgtaaaagcaaacgtgctatgcgcagtgtacaagtaggcggaccgttaggtgcttatttgcccgcagagcaatgggataccgcccttgattatgaagagtttgccagtattggtgccgtattaggccacggtggaattgttgtttttgacgacactgtcgatatggctgcacaggctcgttttgccatggaattttgtgaagtagaatcttgtggtaaatgtaccccatgtcgaattggcgccgtacgtggcgttgaagtcattgataaaattatcgatggcaacaatgacgaacaacaacgacaagacagcgtagacttattacatgacctatgtgacaccatggaattcggttctttatgtgctatgggtggcatgaccccattcccggtgcgcagcgcactaaaatatttccctgatgattttttgccacaaccgtcaacacaaaaggctcaataa

SEQ ID NO: 39305 - protein, 537 aa, Colwellia psychrerythraea 34H
MNHSPSDDSSMPVASRKIFVSLDTTARSRGSDKVATQVESVLNAQPELAATLVRNGSRGMFWLEPLLEINTPKGRVAYGPVKAEDVNDIINLQCFDDATEHPLCLGLTEELPWFKSQQRLTFARVGIIDPIDVDDYISHGGFVGLTNAFAKTAQQLVDEVKESGLRGRGGAAFPTGIKWQTVLNEPEQQKYIVCNADEGDSGTFADRMLMEGDPLVLVEGMIIAGLSVGADQGYIYLRSEYPQAHDLLNKAISNAKAAGYLGDNICGTEHNFHLEVRLGAGAYICGEETSLLESLEGKRGLVRAKPPLPAIEGLFGQPTVVNNVISLASVPYILSHGGDSYRDFGMGRSRGTLPIQLAGNIAQGGLVELAFGISLNELLQQYGNGCKSKRAMRSVQVGGPLGAYLPAEQWDTALDYEEFASIGAVLGHGGIVVFDDTVDMAAQARFAMEFCEVESCGKCTPCRIGAVRGVEVIDKIIDGNNDEQQRQDSVDLLHDLCDTMEFGSLCAMGGMTPFPVRSALKYFPDDFLPQPSTQKAQ

SEQ ID NO: 39306 - DNA, 1359 bp, Pseudomonas syringae pv. phaseolicola 1448A
  CDS (1)..(1359): transl_table=11
atgaccatcacttccttcggccctgccaaccgcattgcgcgcacggcagaaacccacccgctgacctggcgtctgcgtgacgacggcgagccggtctggctcgacgagtatcaggccaaagacggttatgcagcagcgcgcaaggcgctgacgcaacagtcgcctgacgatatcgtccagtcggtcaaggactcgggcctcaagggccgcggcggtgcgggcttccctaccggcgttaaatggggcctgatgcccaaagacgaatccatgaacatccgctatttgctgtgcaatgcggatgagatggaacccaatacctggaaagaccgcatgctgatggagcaactgccccatctgctggtcgagggcatgctgatcagtgcgcgtgcgctgaaagcctatcgtggctatatcttcctgcgtggcgaatacgtaacggccgccaagcacttgaaccgcgccgtggccgaagcgaaggctgccggcctgctgggcaagaacatcctcggcaccggcttcgactttgaactgttcgtacacaccggagccggccgttacatctgcggtgaagaaaccgcgctgatcaactcgctggaaggccgccgcgccaacccgcgctccaagccgcccttccctgctgccgtaggcgtctggggcaagccgacctgtgtaaacaacgtcgaaaccctgtgcaacgtgcccgccatcgtcaacaacggcaacgactggtacaagtcgctggcccgcgaaggcagtgaagaccacggcaccaagctgatgggcttctccggcaaggttaaaaacccgggtttgtgggagctgccatttggcgtacaggctcgcgaactgttcgaagactacgccggtggcatgcgcgatggcttcaagctcaaatgctggcaacccggcggcgccggtacgggtttcctgctgccagagcatctggacgcccagatgtacgcaggcggtattgccaaggtcggtacccggatgggcaccggtctggcgatggccgtcgacgattcggtcaacatggtttcactgctgcgcaacatggaagagttcttcgctcaggagtcctgcggcttctgcaccccatgccgcgacggtttgccatggagcgtaaaaatgcttcgcgccatcgagaagggtcaggggcagccgggggatatcgaaaccctgctgggtctggtcaatttcctcggcccaggcaagaccttctgcgcccatgcaccgggcgctgtggaaccgctgggcagtgcgatcaagtatttccgttcggagttcgaagccggtattgcgccagccagcgcaaccacgctcgttccgggcaacagtccgaccgtggtcggcgcataa

SEQ ID NO: 39307 - protein, 452 aa, Pseudomonas syringae pv. phaseolicola 1448A
MTITSFGPANRIARTAETHPLTWRLRDDGEPVWLDEYQAKDGYAAARKALTQQSPDDIVQSVKDSGLKGRGGAGFPTGVKWGLMPKDESMNIRYLLCNADEMEPNTWKDRMLMEQLPHLLVEGMLISARALKAYRGYIFLRGEYVTAAKHLNRAVAEAKAAGLLGKNILGTGFDFELFVHTGAGRYICGEETALINSLEGRRANPRSKPPFPAAVGVWGKPTCVNNVETLCNVPAIVNNGNDWYKSLAREGSEDHGTKLMGFSGKVKNPGLWELPFGVQARELFEDYAGGMRDGFKLKCWQPGGAGTGFLLPEHLDAQMYAGGIAKVGTRMGTGLAMAVDDSVNMVSLLRNMEEFFAQESCGFCTPCRDGLPWSVKMLRAIEKGQGQPGDIETLLGLVNFLGPGKTFCAHAPGAVEPLGSAIKYFRSEFEAGIAPASATTLVPGNSPTVVGA

SEQ ID NO: 39308 - DNA, 1332 bp, Candidatus Blochmannia pennsylvanicus str. BPEN
  CDS (1)..(1332): transl_table=11
atgagcaatacttatgatgttagtgcagaaaataatccacttacatggagaatgcgtgacgataaacaaccagtatggttgcatgaatataaatctaaaaatgggtatcgagctgcgtataaagcaattactcaaatgtctccagaagagattattgaattagttagaaattcaggtttaagaggtcgtggaggtgggggtttttttactggaataaaatggtctatgatgtctcaaagtaagtcagtctgctctcgttatttagtgtgtaatgcagacgaaatggagccaggaacttataaagatcgatttttaatggaacgattgcctcatttattattagaaggtatattaatttcaagttatgctttaggagcgtcacgagcgtatatttttttgagatatgaatacataatcgttgcgaaatatttaactcgtgctatagccgagattaaatcaattggattgattggtaaaaacatattgaatagtgagtttaattttgagttattcttgcatacaggagctggaagatatatttgtggagaagaaacagcgttgattaacgctttagaagggcgtcgagcagtgccgcgtgctaaaccaccttttccaagtcatgtaggattgtggggaaaacctacatgtgtcaataatgttgagacgttatgcaatattccaggaattattgagcatgggaccacttggtatcggaatatttcttctaaaaaaagtaatgattcaggtacaaaattaatgggattttctggtcgagttaaaaacccaggggtttgggagctaccttttggtacgactgctagagaaattttagaagattattctcgaggcatgtgtcctggttttagtttaaaagcatggcaacctgggggtgtaagtacagattttttaactacagatcatttagatacacctatggattttgataaaattgctatttctggtagtagatttggaactggtatggcaatagcgatagataatactgtaaatatggtgtctttagtgcgtaatttagaagagtttttttcaagagaatcttgtggttggtgtactccttgtagagatgggttaccgtggatagtaaaattgttgatttctttggaaaataaagacggcagacctggagacatagaattattagagaaattgtgttgtgtactcggacctggaaggactttttgcgctcacgccccaggagctatagaacctttgaaaagtgctttaaaatattttaaaaatgaatttgaattgggtattcatgaattttataaacaggaaccgaatcgtattatttgtgtgcaaattaattaa

SEQ ID NO: 39309 - protein, 443 aa, Candidatus Blochmannia pennsylvanicus str. BPEN
MSNTYDVSAENNPLTWRMRDDKQPVWLHEYKSKNGYRAAYKAITQMSPEEIIELVRNSGLRGRGGGGFFTGIKWSMMSQSKSVCSRYLVCNADEMEPGTYKDRFLMERLPHLLLEGILISSYALGASRAYIFLRYEYIIVAKYLTRAIAEIKSIGLIGKNILNSEFNFELFLHTGAGRYICGEETALINALEGRRAVPRAKPPFPSHVGLWGKPTCVNNVETLCNIPGIIEHGTTWYRNISSKKSNDSGTKLMGFSGRVKNPGVWELPFGTTAREILEDYSRGMCPGFSLKAWQPGGVSTDFLTTDHLDTPMDFDKIAISGSRFGTGMAIAIDNTVNMVSLVRNLEEFFSRESCGWCTPCRDGLPWIVKLLISLENKDGRPGDIELLEKLCCVLGPGRTFCAHAPGAIEPLKSALKYFKNEFELGIHEFYKQEPNRIICVQIN

SEQ ID NO: 39310 - DNA, 1329 bp, Dechloromonas aromatica RCB
  CDS (1)..(1329): transl_table=11
atggcgatgcttggttcgatcaacggcgttctgatggaaggtcttgacggcgacaacagttggagcctgaaggattacgtggcccgcggcggttatgcgcagctgaagcgaattctggacagcaagatgacccaggaagatgtcatcagcgaagtcaagaagtcggtgctgcgggggcgtggtggtgcaggttttccgacaggcctgaagtggtctttcatgccgcgctccttcccgggtgacaagtatgtcgtctgtaacaccgacgaaggtgagccgggtaccttcaaggaccgcgatatcatgcgttacaacccgcatgccgtcatcgaaggcatggccatcgccgcctacgcgatgggggccaatcgcggttacaactacgtgcacggagaagtctggctggaatacaagcgtttcgaagaagcgctagatcaggctcgtgctgccggttttatcggtcaaaatattcttggctcgggcttcaatttcgaattgttcgcccaccacggttacggtgcctacatctgtggcgaagaaactgcgctgctcgagtcgatcgaaggcaagaaggggcaaccgcgcttcaagccaccattcccggcctctttcggcctctacggcaagccgacgacaatcaacaataccgaaaccttcgcttccatccccttcattctgaagatgggcggcgaggagtttctcaatctgggcaagccgaacaacggaggcaccaagctgttctcggtatccggccacgtcaatcgcccgggcaactacgaaattccgctcggcacgccgtttgccacattgcttgaaatgtgtggtggtatgcgcggaggccgcaagctgaaggcggtaattcccggagggtcttcggcgccggtgatgcctgccgatgtgatcatggattgcaccatggactacgactcgatcagcaagggcggatcgatgcttggttccggtgcggttatcgtcatggacgagacagtctgcatggtcaaggcattggatcgtctgtccttcttctatcacgaagagtcctgcggccagtgcaccccctgtcgtgaaggtacggcctggatgtacaaggttgtacatcgcatcgaaaatggcctcggcaagcccgaggatctggacctgctgaacagcgtgctcggcaacattgcgggtcgcacgatttgcgccctcggcgatgctgcggcttttccggtacagagttttatcaagcacttcggcaaagaattcgagtatcacattgaacacaagacctgtctggtacccaaggatgtgcaatgggccggcagtggcttccacaagattccggcctga

SEQ ID NO: 39311 - protein, 442 aa, Dechloromonas aromatica RCB
MAMLGSINGVLMEGLDGDNSWSLKDYVARGGYAQLKRILDSKMTQEDVISEVKKSVLRGRGGAGFPTGLKWSFMPRSFPGDKYVVCNTDEGEPGTFKDRDIMRYNPHAVIEGMAIAAYAMGANRGYNYVHGEVWLEYKRFEEALDQARAAGFIGQNILGSGFNFELFAHHGYGAYICGEETALLESIEGKKGQPRFKPPFPASFGLYGKPTTINNTETFASIPFILKMGGEEFLNLGKPNNGGTKLFSVSGHVNRPGNYEIPLGTPFATLLEMCGGMRGGRKLKAVIPGGSSAPVMPADVIMDCTMDYDSISKGGSMLGSGAVIVMDETVCMVKALDRLSFFYHEESCGQCTPCREGTAWMYKVVHRIENGLGKPEDLDLLNSVLGNIAGRTICALGDAAAFPVQSFIKHFGKEFEYHIEHKTCLVPKDVQWAGSGFHKIPA

SEQ ID NO: 39312 - DNA, 1899 bp, Dechloromonas aromatica RCB
  CDS (1)..(1899): transl_table=11
gtggctctgaacgatatgcatgccgaggcggtggctggtgttgtcgaccgcgttgtcgcccgttatcaccgggatcccacttgcatggtgcagatactgcgcgaggttcaggaggtttgtgactggatttcgcccgaagccatcgaccgcatgcaggtcacgctcggcgttccacggaccaagatcgagggcgtcgccggcttttacgcctttttctataccgagccacgcggcaaataccgggtgctgttttcggacaacatcactgaccgcatgctgggcagcaaggcgatgatggatcgcctgtgcaacagcctgtgggtcgagcgtggcaaggtttctgaggatggtctggtcagcgtggcgcagacggcctgtaccggtatgtgcgatcaggggccggcgctgctgatcaataactacgccattgccggattgactgcagagcgtattgacgagattgccgagctgattcgcggcaaggtgccgctggccgagtggccgccggcctatttcaagaccgaagacaatatccgccgggccgatatcctgctcaatgccgatttcaaacccggtgaggcactgctggcagcccgagcgcgggcaccgagcgatggtctcaattcatcgaacatgcgttcctggcgcgaaggcttgcccagcgggattggcgggccgggcgccacgctggacgaaatcaagcgcgccaatctgcgggggcgtggcggtgccggtttcaccaccggcctcaaatgggaggcctgccgcaatgccccgctcaaggctggcgcccagcgcatcgtggtctgcaacgccgatgaaggcgaaccgggtactttcaaggatcgcgttttactgtccaggaacccggacctggttttcgagggcatgacggtggcggcttatgcggtcggcgcgacccgcggttttgtctatctgcgcggcgaataccgttacatgctcgaccacctgaatgccgtgctggcccatcgccggcgcgaaaagctgttgggcaaggacattctcggcctgccgggggcggatttcgatatcgagattcatgtcggggccggcgcctatgtctgcggcgaagagtcggcgctgatcgagtcgctcgaaggcaagcgcggcaccccgcgcaaccggccgcctttcccggtcaccaacggctatctggaccagccgaccatcgtcaataacgttgaaacctttgccgcggcagcgctgatcgcgttgaatggcggtgactggtatgccgccatcggcaccaagcattcggccggcaccaagctgctttcggtctccggcgattgcgagcggccgggcatttacgaatacccgttcggcgtcagtgtccgacaggtgctggaagactgcggcgccagggatacgcaggccgtgcaggtcagcgggccatccggcatctgtattgcagagcaggaattcgaccgtgtcatcggttttgaggatatccccacggccggcgctttcaccgtattcaacaacactcgcgacatgttcgaggtggcgcgcaactacgtgcatttcttccagcacgaaagctgcggtttctgcacgccgtgccgggttggcacgtccctgctcaagaacctgatggacaaactgcacaatggcgtcggttcgccctacgactttgccgaaatcgagaagctcaaccagttgctgcaatcgatgagccattgcggactgggccatacggcctgcaacccggtgctcgacacgatcgaacgcttccgtccggcctacgagcgacgcatggcgcaaaaggatttcacaccggctttcgatctcgaccgcgcgctgtcatcggcccgacagatgaccgggcgcgatgatgccggcgcccatctggcgacagaacatggaggtcaatcatga

SEQ ID NO: 39313 - protein, 632 aa, Dechloromonas aromatica RCB
MALNDMHAEAVAGVVDRVVARYHRDPTCMVQILREVQEVCDWISPEAIDRMQVTLGVPRTKIEGVAGFYAFFYTEPRGKYRVLFSDNITDRMLGSKAMMDRLCNSLWVERGKVSEDGLVSVAQTACTGMCDQGPALLINNYAIAGLTAERIDEIAELIRGKVPLAEWPPAYFKTEDNIRRADILLNADFKPGEALLAARARAPSDGLNSSNMRSWREGLPSGIGGPGATLDEIKRANLRGRGGAGFTTGLKWEACRNAPLKAGAQRIVVCNADEGEPGTFKDRVLLSRNPDLVFEGMTVAAYAVGATRGFVYLRGEYRYMLDHLNAVLAHRRREKLLGKDILGLPGADFDIEIHVGAGAYVCGEESALIESLEGKRGTPRNRPPFPVTNGYLDQPTIVNNVETFAAAALIALNGGDWYAAIGTKHSAGTKLLSVSGDCERPGIYEYPFGVSVRQVLEDCGARDTQAVQVSGPSGICIAEQEFDRVIGFEDIPTAGAFTVFNNTRDMFEVARNYVHFFQHESCGFCTPCRVGTSLLKNLMDKLHNGVGSPYDFAEIEKLNQLLQSMSHCGLGHTACNPVLDTIERFRPAYERRMAQKDFTPAFDLDRALSSARQMTGRDDAGAHLATEHGGQS

SEQ ID NO: 39314 - DNA, 1317 bp, Thermobifida fusca YX
  CDS (1)..(1317): transl_table=11
gtgacgacgctgacccccgtgctgtcccgcaactgggaccgcccggactcctacaccctcgacgcctaccgggagaacggtggctacgaggcgctgcgcaaggccctgaccatggagcccgacgccatcgtcgagatggtcaaggcctccggcctgcgcggccgcggcggtgccggcttccccaccgggatgaagtggggtttcctccccaaggacaaccccaagccgcgctacctcgtcgtcaacgccgacgagtctgagcccggcacctgcaaagacatcccgctgatgatggccaacccgcacgcgctcatcgaaggcgtcatcatctccgcctacgcgatcaacagccaccaggccttcatctacgtccgcggggaggtcctgcacgtcatccggcggctgcggcacgccgtcgccgaagcctacgaggccgggctgctcggtaaggacatcctcggcagcggcttcgacctcgacgtcgtcgtccacgccggggcgggcgcctacatctgcggtgaggagaccgccctgctggactcgctcgagggctaccgcggccagcctcgcctcaagccgccgttccccgccgtcgcaggtctgtacgcctcacccaccgtggtgaacaacgtcgaatccatcgccaccgtgccgagcatcgtcgccaacggcgccgagtggttcaagtccatgggcacggagaagtccgccggcttcggcttcttctccctgtccggccacgtcaagcggcccggccagtacgaggccccgctcggcgtgaccttgcgcgaactgctcgagatggccggcggtatccgcgacgggcaccggctcaagttctggacccccggtggctcctccaccccgatcttcaccgaggagcacatcgacatccccctggacttcgagtcggtcggcggagcgggctccatgctcggcacccgcgcgctgcagatcttcgacgaaaccacctcggtcgtccgggtcgtgcgcggctggatcgagttctacgcgcacgagtcctgcggcaagtgcactccgtgccgcgaaggcaactactggatggtccaagtcctgcgccgtatcgaagcaggcaaggggacccaagaggacatcgacacgctgctcgacatctgcgacaacctgctcgggcgctccttctgcgcgctcggggacggtgcgaccagctcggtgacctcggcgatcaagtacttccgggaggagttcatcgcgggaacccacactcccgcgtgggagctgttcccgtaccagcgcaccactcgctgggcgaatgagtccgtggaagaggacgcctga

SEQ ID NO: 39315 - protein, 438 aa, Thermobifida fusca YX
MTTLTPVLSRNWDRPDSYTLDAYRENGGYEALRKALTMEPDAIVEMVKASGLRGRGGAGFPTGMKWGFLPKDNPKPRYLVVNADESEPGTCKDIPLMMANPHALIEGVIISAYAINSHQAFIYVRGEVLHVIRRLRHAVAEAYEAGLLGKDILGSGFDLDVVVHAGAGAYICGEETALLDSLEGYRGQPRLKPPFPAVAGLYASPTVVNNVESIATVPSIVANGAEWFKSMGTEKSAGFGFFSLSGHVKRPGQYEAPLGVTLRELLEMAGGIRDGHRLKFWTPGGSSTPIFTEEHIDIPLDFESVGGAGSMLGTRALQIFDETTSVVRVVRGWIEFYAHESCGKCTPCREGNYWMVQVLRRIEAGKGTQEDIDTLLDICDNLLGRSFCALGDGATSSVTSAIKYFREEFIAGTHTPAWELFPYQRTTRWANESVEEDA

SEQ ID NO: 39316 - DNA, 1566 bp, Ralstonia eutropha JMP134
  CDS (1)..(1566): transl_table=11
atgagcgccgccgtcaccaccatctttgtcccgcgcgattccaccgcgctggcccttggcgccgacgacgtggcgcgcgcgattgctcgtgaagcggctgcgcgcggcgagtcggtgcacatcgtgcgcaacggctcgcgcggcatgttctggctcgagccgttggttgaagtgcaaaccgaagcgggccgcgcggcctacggtccagtcagcgtggacgatgtgccgggactgctagatgcgggcctgctgcaaggcggcgaacacgtactggctcatggcctcaccgacgagattcctttcctcaagcgccaggaacgcctgacgttcgcgcgtgtcggcatcaccgatccgctgtcgctcgacgactaccgcgcgcatgaaggctatgccggcctcgaacgcgcgctggcgatggagcctgccgcgatcgtgcaggaagtgaccgactccggcctgcgtggccgtggcggcgcggcgtttcccaccggcattaagtggaagaccgtgctcggcgcgaagtccgcggtcaagtacatcgtctgcaatgccgacgaaggcgattcgggcacgttctccgaccgcatggtgatggaagacgacccgttcgtgctgatcgagggcatgaccatcgccggtctcgcggtcggtgcggagtacggctatatctactgccgttccgaatacccgcatgcgattgccgtgctgaatgcagccattgctacggctacggccgccggctggctcggcgacgacatccgcggcagcggcaagcgcttccacctggaagtgcgcaagggcgccggcgcctatgtgtgcggcgaggaaaccgcgctgctcgaaagcctggaaggtaaacgtggcgtggtgcgcgccaagccgccgctcccggcgctggagggcctgtttggcaagcccaccgtcatcaacaacgtgatttcgctcgcgacggtgcccgtcatcctcgcgcgcggcgcgcagcactaccgcgacttcggcatgggtcgttcacgcggcacgctgccgttccagctcgccggcaatatcaagcaaggtggtctggtcgaaaaggcattcggcgtgacgctgcgtgaactgctctacgactacggcggtggcacgcgcagcggccgcgccgtacgcgcggtgcaggtgggcggcccgctcggcgcctatctgcccgaagcgcgcttcgatgtgccgatggactacgaagcctatgcggcattcggtggtgtagtcggccacggcggcattgtggtgttcgacgagaccgtcgacatggccaggcaggcgcgctacgcgatggagttctgcgcgatcgaatcatgtggcaagtgcacgccgtgccggatcggctccacgcgcggcgtggaggtcatggaccggatcatcgccggcaacgagcccgtcaagcatgtgaagctggtgcgcgacctgtgcgacaccatgctcaacggctcgctctgcgccatgggcggtatgacgccgtacccggtgctgtccgcactcaacgaattccccgaggacttcggcctcgcctccaacccagccaaggcggcctga

SEQ ID NO: 39317 - protein, 521 aa, Ralstonia eutropha JMP134
MSAAVTTIFVPRDSTALALGADDVARAIAREAAARGESVHIVRNGSRGMFWLEPLVEVQTEAGRAAYGPVSVDDVPGLLDAGLLQGGEHVLAHGLTDEIPFLKRQERLTFARVGITDPLSLDDYRAHEGYAGLERALAMEPAAIVQEVTDSGLRGRGGAAFPTGIKWKTVLGAKSAVKYIVCNADEGDSGTFSDRMVMEDDPFVLIEGMTIAGLAVGAEYGYIYCRSEYPHAIAVLNAAIATATAAGWLGDDIRGSGKRFHLEVRKGAGAYVCGEETALLESLEGKRGVVRAKPPLPALEGLFGKPTVINNVISLATVPVILARGAQHYRDFGMGRSRGTLPFQLAGNIKQGGLVEKAFGVTLRELLYDYGGGTRSGRAVRAVQVGGPLGAYLPEARFDVPMDYEAYAAFGGVVGHGGIVVFDETVDMARQARYAMEFCAIESCGKCTPCRIGSTRGVEVMDRIIAGNEPVKHVKLVRDLCDTMLNGSLCAMGGMTPYPVLSALNEFPEDFGLASNPAKAA

SEQ ID NO: 39318 - DNA, 1296 bp, Ralstonia eutropha JMP134
  CDS (1)..(1296): transl_table=11
atgacctctctgcacgaccgccacatccagccgctgatcctggccggcctggacggcaagaactggcacctggaagactacgtcaagcgcggcggctaccagcagctcaagcgcatcctgaccgaaaagatcccgcccgagcaggtgatcgcggacgtcaaggcctcgggcctgcgtggccgtgggggcgcgggcttcccgaccggcctgaagtggagcttcatgccgcgtacgtttccgggccagaagtacctcgtctgcaataccgatgagggcgagcccggtacgttcaaggaccgcgacatcatccggttcaatccgcactcgctgatcgagggcatggccatcggcgcttacgcgatgggcatcaccgtgggctacaactatatccacggcgagatctggaacgaatacaagatcttcgaggaagccctcgaagaggcgcgcgccgcgggtttcctcggcgacaacatcctgggctcgggcttcagcttccagctgcacgcccaccatggctatggcgcgtacatctgcggcgaagaaaccgcgctgctcgaatcgctggaaggcaagaagggccagccgcgtttcaagccgcccttcccggcgagcttcggcctgtacggcaagccgaccaccatcaataacaccgagacgtttgccgcggtgccgttcctgctggccatcggcccggagaactacctgaagatgggcaagccgaacaacggcggaaccaagatcttctcgatctccggtgacgtcgagcgtccgggcaactacgagatcccgctgggcacgccgttcgccaagctgctggagctggctggtggcatgcgcggtggcaagcgcatcaaggccgtgattcccggtggttcgtccgcgccggtcgtaccgggcgagatgatgatggcgtccgacatggactacgactcgatcgccaaggccggctcgatgctgggctcgggcgccgtgatcgtgatggacgagacgcgctgcatggtgcgctcgttgctgcgcctgtcgtatttctattttgaagaatcgtgtggccagtgcacgccgtgccgtgaaggcaccggttggctgtaccgcatggtcaatcgcattgaacacggagaggggcgccaggaagacctggacctgctcaacaacgtcgcggaaaacatcatgggccgcaccatctgcgcgctcggcgatgccgcggcgatgccggtccgcggcatgctcaagcactactggaaagagttcgaatatcacgtcgaacacaagcagtgcatggttccggcctacatctaa

SEQ ID NO: 39319 - protein, 431 aa, Ralstonia eutropha JMP134
MTSLHDRHIQPLILAGLDGKNWHLEDYVKRGGYQQLKRILTEKIPPEQVIADVKASGLRGRGGAGFPTGLKWSFMPRTFPGQKYLVCNTDEGEPGTFKDRDIIRFNPHSLIEGMAIGAYAMGITVGYNYIHGEIWNEYKIFEEALEEARAAGFLGDNILGSGFSFQLHAHHGYGAYICGEETALLESLEGKKGQPRFKPPFPASFGLYGKPTTINNTETFAAVPFLLAIGPENYLKMGKPNNGGTKIFSISGDVERPGNYEIPLGTPFAKLLELAGGMRGGKRIKAVIPGGSSAPVVPGEMMMASDMDYDSIAKAGSMLGSGAVIVMDETRCMVRSLLRLSYFYFEESCGQCTPCREGTGWLYRMVNRIEHGEGRQEDLDLLNNVAENIMGRTICALGDAAAMPVRGMLKHYWKEFEYHVEHKQCMVPAYI

SEQ ID NO: 39320 - DNA, 1245 bp, Ralstonia eutropha JMP134
  CDS (1)..(1245): transl_table=11
atggaaaagctgaatcaggtcttgcttaaggaggacatccgggtcggcgcagacctgcaggcctggcttgcgcgtggtggcggagaagggctggccaaggctttgtccaatccggatgcgatccttgcggagatcgaacaggccgatctgcgcggcatgggcggcgcggggttcccgacgcaccgcaagtggaggccagttgctgctgcagccgcggtcgacaagtacatcatctgcaatggcaacgaagacgaacccggcacgttcaaggaccgcttccttctggagcacacgccgcaccaggtcatcgagggcgcgctgatcgcggcggcagccacgcgggccaatcatgtcgtgctctacgtcaatccgcatcagccactgtcgctcgaaatgacgcggcaggcggtgcagcagtggcaaacacatgcgcaactcgccgaactcgagcggctgctcggcgggccgctgacgctgcgggtcgtgccgagttccggcctgtacatcggtggcgaggaaacggccgtgatagccagcgtcgagggtacgttcccatttccgcgacgcaagccgccttatcccgccgacagcggcgtgcacggcgcgccgaccatcgtcaacaacaccgagacgctcgcccacgtgccggggatacttcgccacggcgcgcagtggtatcgcgcgctcggcgtcgctcaggcggcagggaccaagctctattcgctgtcgggcgacgtcctgcgcccggggctgtacgagctgccgatgggcaccagcctggagacactgatcttcgagtttggcggcggcatgctgcagggcaaggaattcaaggctgtcttcacgggcgggccgtccaacacgctgctgaccaagcgcgatctcgacgtagcgctggatttcgactcggtgcgcaagcggcgctcgcgcctggggaccggcgcgatgatcgtcgtatcggagggctccagcatcgtccgcaaggtggccgagtatgtgagcttctttgcgcaaggttcctgcggccagtgcccgccgtgcaaggggggcacattccagctgatgcgattgctcaaccggatcgacacgggccgcggcgtgcgcgccgacctggaggcgctggagaacctgtgccgcatccttcccggcagcggtcgctgcgggctgatcgacggcgctgtcacggtggtagacagttcgcttcaccagttccgcgatgaatatgagtcgcagctgatggcatag

SEQ ID NO: 39321 - protein, 414 aa, Ralstonia eutropha JMP134
MEKLNQVLLKEDIRVGADLQAWLARGGGEGLAKALSNPDAILAEIEQADLRGMGGAGFPTHRKWRPVAAAAAVDKYIICNGNEDEPGTFKDRFLLEHTPHQVIEGALIAAAATRANHVVLYVNPHQPLSLEMTRQAVQQWQTHAQLAELERLLGGPLTLRVVPSSGLYIGGEETAVIASVEGTFPFPRRKPPYPADSGVHGAPTIVNNTETLAHVPGILRHGAQWYRALGVAQAAGTKLYSLSGDVLRPGLYELPMGTSLETLIFEFGGGMLQGKEFKAVFTGGPSNTLLTKRDLDVALDFDSVRKRRSRLGTGAMIVVSEGSSIVRKVAEYVSFFAQGSCGQCPPCKGGTFQLMRLLNRIDTGRGVRADLEALENLCRILPGSGRCGLIDGAVTVVDSSLHQFRDEYESQLMA

SEQ ID NO: 39322 - DNA, 1743 bp, Ralstonia eutropha JMP134
  CDS (1)..(1743): transl_table=11
atgaatcaggttgtcatcccgatcgaggccaccggccttggaaggctgcgcaagcgccgccagcccaaaggcaggcaggtggacgctgccgcgctggcggaagtccgcgcggcgcttggcgacatgccgcgccgccgagacctgttgatcgaacatctccactgcatccaggaccgttacggtcagctggccatgccgcatcttgtcgcgctggcgcaggaacttggtctggcgatgaccgaggtctacgaggttgcgacgttctaccaccacttcgacgtggtgcgcgaagatgcggacggccacatcgcgccgccgccggcactgacggtgcgcgtatgcgagggcattgcctgcgagatggccggggcgcaggtgctgatcgacaagctgcccgccgtgcttggcacggacgtacgtgtggtggccgcgccgtgcatcggccggtgcgagaaagcgccggccgtgctggccggacagaagccggtcgatggcgcgacggtggaggccgtcgcgagttgcgtggcggcgggcaccgttcgcgatgccatcgccgcgcagaacagctatggcgcgtacaaggcaaacggcggctatggcctgctcaaagcgcttgtgcaggaaggctcgctcgatccggcagccgtgatttgcacgatggaagactccggcctgcgcggcctgggcggcgccggtttcccgaccggccgcaaatggcgcatcgtgtccggggagccggcaccacggctcatggccgtgaacatcgacgaaggcgagcccggcaccttcaaggaccgcgtctacctggagcgcgatccgcaccgttttctggagggcatgctgatcgctgccgctgtgacgcaggttgctgcgatctatatctacctgcgcgacgaatacgcgggctgccgcgccatcctgacgcaagcgctgcaggaactgcacgacgacccgccggtaccggacctgccgcgcatagaactgcgccgcggcgcgggcgcctatatttgcggcgaagagtccgccatgatcgaatcgatcgaaggcaagcgcggcatgccgcgcctgcggccgccctatgtggcgcaggtcgggctgttcggcaggccgacgctcgagcacaacttcgaaacgctctactgggtgcgcgacatcctggagaagggggccgagtggtttgcgtcgcagggccggcatggccgcaaggggctgcgctcgttctcggtgtcggggcgcgtgcgccagcccggcgtgcacctggcgccggccggtatcaccgtgcgcgagctgatcgatgaatactgcggcggcatgatcgacggacacacgttctacgcgtacctgcccggcggtgcgtcgggcggcatcctgcctgcgtcgatgggcaatataccgctcgacttcgacacgttgcagccgcacggctgctttatcggctcggcggccatcatcgtgctgtccgaccacgacagcgcggtggccgcggcgcgcaacctgatgcactttttcaaacacgagtcgtgcgggcaatgcacgccatgccgcgtcggcaccgccaaggcgcttgatctgatccgccagccgcaatgggacttgcccgcgctggaagacctgtccgccgtgatgcgcgacgcctcgatctgcgggctcggacaggctgcgccaaatcccgtcgattgtgtgatccgttactttccccatgaactgcaggcggcgccagaccgcccggaggcacaggcatga

SEQ ID NO: 39323 - protein, 580 aa, Ralstonia eutropha JMP134
MNQVVIPIEATGLGRLRKRRQPKGRQVDAAALAEVRAALGDMPRRRDLLIEHLHCIQDRYGQLAMPHLVALAQELGLAMTEVYEVATFYHHFDVVREDADGHIAPPPALTVRVCEGIACEMAGAQVLIDKLPAVLGTDVRVVAAPCIGRCEKAPAVLAGQKPVDGATVEAVASCVAAGTVRDAIAAQNSYGAYKANGGYGLLKALVQEGSLDPAAVICTMEDSGLRGLGGAGFPTGRKWRIVSGEPAPRLMAVNIDEGEPGTFKDRVYLERDPHRFLEGMLIAAAVTQVAAIYIYLRDEYAGCRAILTQALQELHDDPPVPDLPRIELRRGAGAYICGEESAMIESIEGKRGMPRLRPPYVAQVGLFGRPTLEHNFETLYWVRDILEKGAEWFASQGRHGRKGLRSFSVSGRVRQPGVHLAPAGITVRELIDEYCGGMIDGHTFYAYLPGGASGGILPASMGNIPLDFDTLQPHGCFIGSAAIIVLSDHDSAVAAARNLMHFFKHESCGQCTPCRVGTAKALDLIRQPQWDLPALEDLSAVMRDASICGLGQAAPNPVDCVIRYFPHELQAAPDRPEAQA

SEQ ID NO: 39324 - DNA, 1284 bp, Ehrlichia canis str. Jake
  CDS (1)..(1284): transl_table=11
atgttaaaagatagtgatagggtatttactaatctttatggtcaacagtctccgtttttaaaatctgcaaagagtaggggtgtgtggagtaatattttagaaatattaaacttaggtcctgatcatattattcaagaggtaaagaaatctggattgcgtggtagaggtggtgcaggattttctacaggattaaagtggagctttatgccaaagactagaaaggatggacaaccagcgtatttagtagttaatgcagatgaatctgaacctggtacatgtaaagatcgtgatatattaagatatgatcctcataggcttattgaagggatattaatagctggttttgcaatgaatgtaactacagcttatgtttatattcgtggtgaattttataatgaatatttagtattatctaaggctttagacgaagcatataaagctaagttgataggaaaaaatgcttgtggttctgggtatgatttggatatttttattcatagaggtgcgggagcttatatttgtggtgaagagactgctcagcttgaatcattagaaggtagaaaggggatgccaaggttaaaacctccttttccagcagcaataggattgtatggttgccctactactattaataatgttgaaactattgctactgttagtgaaattatgagaagaggcagtgattggtttgcatctcttggaaaggaaaataatactggaactaagattttttgtatatcaggacatgtgaataatccgtgtaacgtggaagaagaattgggcattccaatgaaggaacttatagaaaaatatgctggtggtgttcgtggaggatgggataacttattagcagtgatacctggtggttcatcagtaccaatgcttccaaaatctatttgtgatactgtaactatggattttgactctttaagagctgtacagtcaggattaggtacagctgggttaatagttatggataaatctacagatttgatagcagctatagagaggttatcgcatttttatatgcatgaatcttgtggacagtgtacaccttgtagagaaggtactggttggatgtggagaattatgcaaaagatggtgaagggtgacgctacatctgaaagcattgatttattattgaatattactcatcaagtagaaggacatactatatgtgctcttggtgatgctgcagcatggcctatacaaggcttaattagacattttagagatgtgattgaagatagaataaaaaattataatagtagtagattaacttga

SEQ ID NO: 39325 - protein, 427 aa, Ehrlichia canis str. Jake
MLKDSDRVFTNLYGQQSPFLKSAKSRGVWSNILEILNLGPDHIIQEVKKSGLRGRGGAGFSTGLKWSFMPKTRKDGQPAYLVVNADESEPGTCKDRDILRYDPHRLIEGILIAGFAMNVTTAYVYIRGEFYNEYLVLSKALDEAYKAKLIGKNACGSGYDLDIFIHRGAGAYICGEETAQLESLEGRKGMPRLKPPFPAAIGLYGCPTTINNVETIATVSEIMRRGSDWFASLGKENNTGTKIFCISGHVNNPCNVEEELGIPMKELIEKYAGGVRGGWDNLLAVIPGGSSVPMLPKSICDTVTMDFDSLRAVQSGLGTAGLIVMDKSTDLIAAIERLSHFYMHESCGQCTPCREGTGWMWRIMQKMVKGDATSESIDLLLNITHQVEGHTICALGDAAAWPIQGLIRHFRDVIEDRIKNYNSSRLT

SEQ ID NO: 39326 - DNA, 1254 bp, Dehalococcoides sp. CBDB1
  CDS (1)..(1254): transl_table=11
atgaaagacttgaagattattacccgccatctgaacactgccaattcagcggatattgatgtctatctggctgacggcggctaccaggccctcaagaaagctttgtctatgaccccggaggaagtgattgccgaggtcaaacgctcaaagctggtgggtcggggaggggcggcttttcccaccgggctcaagtgggagcttacccgcaaggaaaaggccaacccgaaatatattgtctgcaatgccagcgagggcgaaccgggcacttttaaagaccggttaatactcaaaaatgacccccatatggtgctggaaggttttattattgccgcttatgcggtaggtacatctcagggctttattcacgcccgcgaggtttatacccaagaaatagagcttttccaaaaggccatagaccaggcaaccgaacgcggttttctgggtcagaatatcatggggagcaatttctcgctggatatccagttttacaaaagcgccggtgcgtacatctgcggtgaggaaaccgccctgtttgagtcccttgaagggcacaggggcattcccgccactcgtccgccttacccggtgcaggtggggcttatggataaacccaccaccgtcaacaatgttgaaacattgtgcaatattcctgccattataaataacggggcagactggtttgcttcaatcggccatccggactatcccggtaccaagctcttctgcctttccggcaacgtgaaaaagccgggtgtttttgaattgccactggggactaaccttaaggacttgcttgaggccggggggggcgtagacggtaagttcaaagcggttttaccgggtggcatatcttccagtctgcttaccgaaacggatatcagtctggatttcaagactctggccaaggccggtactatgctgggttcaggtgcggttattgtgataaactctgataccagcatggtaaatgtagcgtccaatgtcgcccacttctttgatgaagagggttgcggcaagtgttctatttgccgcgaaggtacccgccgggcggctgaaatcctgagccgtttttcccgcgggcagggtaaccgcaacgaactggagtggttactggaactgcatgaggtaatgaaagacaccgcttcctgcggtttgggacaggtagccttgaatgtggctgccagtgccatacgtaacttcaagggtgaattcttggcgcaggtgcgtaaggaggaaggcgtatggttacgctaa

SEQ ID NO: 39327 - protein, 417 aa, Dehalococcoides sp. CBDB1
MKDLKIITRHLNTANSADIDVYLADGGYQALKKALSMTPEEVIAEVKRSKLVGRGGAAFPTGLKWELTRKEKANPKYIVCNASEGEPGTFKDRLILKNDPHMVLEGFIIAAYAVGTSQGFIHAREVYTQEIELFQKAIDQATERGFLGQNIMGSNFSLDIQFYKSAGAYICGEETALFESLEGHRGIPATRPPYPVQVGLMDKPTTVNNVETLCNIPAIINNGADWFASIGHPDYPGTKLFCLSGNVKKPGVFELPLGTNLKDLLEAGGGVDGKFKAVLPGGISSSLLTETDISLDFKTLAKAGTMLGSGAVIVINSDTSMVNVASNVAHFFDEEGCGKCSICREGTRRAAEILSRFSRGQGNRNELEWLLELHEVMKDTASCGLGQVALNVAASAIRNFKGEFLAQVRKEEGVWLR

SEQ ID NO: 39328 - DNA, 1872 bp, Dehalococcoides sp. CBDB1
  CDS (1)..(1872): transl_table=11
atgagtaatatagcgattaaaaagtttagcagtgcaaccgaacttgaagccaaaaggcaggaaattcttaaaagcaggaattcggggcaggcggttattgctatttgttgcggtaccggttgtcaggcttacggggctaaaaaagttgcagatgcctttgaagaagaactggctaaagccggtttgggagataaggttgaggtaaggactcccggttgtcatggtttttgtgaacgcggtccactggtagttatccgcccccagaatattttctaccaacgtctaaaaatttcagatatacctgaaatcattgaaaaaaccataaagaataacgaagtaatagaacgattgttgtatgttgatcccatgaccaaagagaaaaaggtgcatgaacatgatgtgcctttttacaaaaaacagatgcgtctggtttttggcaacaacggcaatatagaccctacctctatagaggactatctagcggtaggcggctataaatctctggccaaggctatatccagcctgaagcctgatgaaattgtggaagaaattattaaatccggtctgcgcggtcggggtggcggcggttttcccaccggctggaaatggaagtcctgcagggaagcccatgacccggtaaagtatgtaatctgtaactgtgacgaaggtgatcccggtgcatttatggatcgttcccttatggagggcaatccccatagtgttatagaaggcatgattatcggtgcttatgctattggctcgcacgaggcgtatatttacattcgtgatgaatatcctatggcggttaagcacgcccttctggccataaaacaggccgaagattatggtttgctgggtgaaaatatactgggcagcgggtttagcctgaaaatccatataaacagaggcggcggagcttttgtttgcggtgaatctaccgcccttatggcctcccttgagggtaaggttggcgaaccccgtgccaagtatgttcatacctctgaaaagggtctatacgacaagcctaccactcttaataacgtagagacttgggcgaatatacccctgattatagaaaaaggggcagactggtttaacaaaataggcactgctggcagtaagggtaccaagatattctcactggtaggcaaggtcaacaacactgggcttattgaagttcccatggggattacccttagggaaattgtgtatgatattggcggtggtatccccaaaggcaagaaattcaaagctattcagactggcggcccttccggcggctgtttgcccgaaagtatgctggatctgccggtggactttgatgagcttaccaaggccggctctatgatgggttcaggtgccatgattgttatggatgaagataactgcatggtggagattgcccgttacttcctgagcttccttgagggtgaatcctgcggcaaatgtgtaccttgccgtgagggtgtcaaacgtatgcgccagattctagaaaagataactaaaggtgagggcgaagagggagacatagagcatctggaacagctttcacaggctatacaagacgcttctttgtgcgctctgggcggcagtgctcccaatccggttatgtccaccataaaatacttccgtgaggagtatgaagcccatatccggcaaaagacctgccccgccaaggaatgcaaggctcttattacctataacattattgatgccaactgtcccggctgcggtttgtgctataaagcctgtgcaacaggggctatcatttcgcagggcaaaaagatgccggtcatacttgaccaaagcaaatgtactaaatgcggtgcgtgttttgacgcttgtaagctacacgccgtagaaatcagataa

SEQ ID NO: 39329 - protein, 623 aa, Dehalococcoides sp. CBDB1
MSNIAIKKFSSATELEAKRQEILKSRNSGQAVIAICCGTGCQAYGAKKVADAFEEELAKAGLGDKVEVRTPGCHGFCERGPLVVIRPQNIFYQRLKISDIPEIIEKTIKNNEVIERLLYVDPMTKEKKVHEHDVPFYKKQMRLVFGNNGNIDPTSIEDYLAVGGYKSLAKAISSLKPDEIVEEIIKSGLRGRGGGGFPTGWKWKSCREAHDPVKYVICNCDEGDPGAFMDRSLMEGNPHSVIEGMIIGAYAIGSHEAYIYIRDEYPMAVKHALLAIKQAEDYGLLGENILGSGFSLKIHINRGGGAFVCGESTALMASLEGKVGEPRAKYVHTSEKGLYDKPTTLNNVETWANIPLIIEKGADWFNKIGTAGSKGTKIFSLVGKVNNTGLIEVPMGITLREIVYDIGGGIPKGKKFKAIQTGGPSGGCLPESMLDLPVDFDELTKAGSMMGSGAMIVMDEDNCMVEIARYFLSFLEGESCGKCVPCREGVKRMRQILEKITKGEGEEGDIEHLEQLSQAIQDASLCALGGSAPNPVMSTIKYFREEYEAHIRQKTCPAKECKALITYNIIDANCPGCGLCYKACATGAIISQGKKMPVILDQSKCTKCGACFDACKLHAVEIR

SEQ ID NO: 39330 - DNA, 1923 bp, Dehalococcoides sp. CBDB1
  CDS (1)..(1923): transl_table=11
atgccaaggctaaatactccggctgagctggaaatactgcgtgaaaaactggcaaagaaacagtctgccagccgtccctgcataacggtatgttgcggtacgggttgccgggctttgggttcagttaaactggtagatgccttccgaagtgaacttgccaaacaagggctggagaatcaggttgatatcaaagaaaccggctgtcacggcttttgcgaaaaaggttcggtagtcgttatatatccccaaaatatctgctatttccatgtcaaatctgaagatgcagctgacgttatcgaaaaaactattaaaaccggtgaattagtggaacgcttactgtatgcagatcctgccaccggagagaaactggtctaccaccatgacatccccttttataaatatcagaagcgtattgtactgggtgataacgaacatataaacccccaaaatatagaggattatatccagcgtggtggttattccgctctggttaaaacccttttccatatgactcctgaatctgtgctggaagaggtagacaaagccaatttgcggggacgcggcggcggaggtttcccggccggtaaaaaatggcgcactacccatgatgccgcagacccggtcaagtatgtactggttaactgtgacgaaggtgatccgggtgctttcatggaccgttccataatggagggcaatcctcattgtgtactggaaggtctggctatcggggcttttgccattggtgctaaagaaggttatatatatgttagggctgaataccctttggcggtagaaaatctgtatgctgctttaaggcaggctgaagaatatggcttgctgggcaaaaatatactcggctcaggttttgattttgtagtcaaagtccatgagggcgccggtgcttttgtatccggtgaatcatccgctttaatgactgctatcgaaggccgggttggtgaacctcgccccaaatatatccgcaccgctatcaaaggcctctgggataaaccttcaaacctgaataacgtggaaacttgggctaacgtaccccacataataaataaaggggcagactggttcaggtctatcggcacagagggcagcaaaggcaccaagatattcgcactggttggcaaggtcaataataccggactggtggaagtgcctatgggcactactcttcgggacattatatttaaaataggcggcggtttgcgtgacggcaaaaaaataaaagctgtccagacaggcgggccttcaggcggatgtataccggaaaatctgctggattcgcctgttgattatgatgcactaagcaagctgggttctatggtaggctcaggcgggctgataataatggacgaagaaacctgcatggtagacatcgcccgttattttataaactttttatcagacgaatcttgcggcaagtgcttaccctgccgtgagggtctgcgccagctggtagatatacttacccgtattaccgaaggcaaaggcactatggttgacatggatacactggaagacctgagcggcgtaatgagtgaagcctgtttgtgtgccctgggacaacaagcccccaaccccttgctcactactcttaaatatttccgccacgaatatattgaccatattaaaaataagcattgcgaagccggtgtttgtaaagccttgcttactttttatattgaccctgacaaatgcaaagcctgtatgatttgtgccagaaactgccccactgacgccatcaagggcggcaaggggcttattcatacgattgagcagggaaaatgcatcaaatgcggtgcttgtgtagatacctgccctgccaaatttgatgccgttattaaaatatccggcaaacctattccaaaaaatgtaccggctgaacctattcctttaaaccggaaggcagaataa

SEQ ID NO: 39331 - protein, 640 aa, Dehalococcoides sp. CBDB1
MPRLNTPAELEILREKLAKKQSASRPCITVCCGTGCRALGSVKLVDAFRSELAKQGLENQVDIKETGCHGFCEKGSVVVIYPQNICYFHVKSEDAADVIEKTIKTGELVERLLYADPATGEKLVYHHDIPFYKYQKRIVLGDNEHINPQNIEDYIQRGGYSALVKTLFHMTPESVLEEVDKANLRGRGGGGFPAGKKWRTTHDAADPVKYVLVNCDEGDPGAFMDRSIMEGNPHCVLEGLAIGAFAIGAKEGYIYVRAEYPLAVENLYAALRQAEEYGLLGKNILGSGFDFVVKVHEGAGAFVSGESSALMTAIEGRVGEPRPKYIRTAIKGLWDKPSNLNNVETWANVPHIINKGADWFRSIGTEGSKGTKIFALVGKVNNTGLVEVPMGTTLRDIIFKIGGGLRDGKKIKAVQTGGPSGGCIPENLLDSPVDYDALSKLGSMVGSGGLIIMDEETCMVDIARYFINFLSDESCGKCLPCREGLRQLVDILTRITEGKGTMVDMDTLEDLSGVMSEACLCALGQQAPNPLLTTLKYFRHEYIDHIKNKHCEAGVCKALLTFYIDPDKCKACMICARNCPTDAIKGGKGLIHTIEQGKCIKCGACVDTCPAKFDAVIKISGKPIPKNVPAEPIPLNRKAE

SEQ ID NO: 39332 - DNA, 1281 bp, Thiobacillus denitrificans ATCC 25259
  CDS (1)..(1281): transl_table=11
atgagtctgctcacgcccacgccgcaggtctgcagctggacgcagacgctcgacgatccggcatcgctcgccacctacgtcgccaacggcgggtaccaggctctgcgccgcgtcgtcaccgaagcggtcccgggtgacgacatcatcgccgagatcaagaccagcgcgttgcgcgggcggggcggggcggggtttccgaccggcctcaagtggagcttcatgccgcgtgcgtttccgggcgacaagtacatcgtctgcaatagcgacgaaggcgagccgggcaccttcaaggaccgcgatatcctgcgctacaacccgcaccagctgatcgaaggcatggcgatcgccgggtacgtgctcggcgcgcgcgtgggttacaactatatccacggagagattttcgaggtctaccagatcttcgaacgcgcgctcgaggaagcacggcaagcgggctacctcggcgccaacctgttcggaaccgatttctgcttcgacctgcacgcccaccacggctacggtgcgtacatctgcggcgaagaaacggccctgctcgagtcgatcgaaggcaagaaggggcagccgcgcttcaagccgccgtttcccgcaagcttcggtctctacggcaagccgaccacgatcaacaataccgaaacgctggcgagcgtcccctggatcgtgcagcacggcggccaggccttcctcgagctcggcaagccgaacaacggcggcgccaagctgttttcggtatccggccatgtcaaccggccgggcaattacgaggtgccgctcggcacgccgttcaccgaattgctggaaatggccggcggcgtgcgcgacggccgcagcctgaaggccgtcatccccggcggatcttcggcgccggtgttgccggggcacatcatgatggagacgacgatggatttcgattccatcgccaaggccggctcgatgctcggctccggggccgtcatcgtgatggacgaaaccgtatgcatggtgcgcgcgctcgagcggctctcgtacttctattacgaggagtcgtgcggccagtgcacgccctgccgcgaggggaccggatggatgtatcgcgtgatccatcgcatcgagaacgggcagggacgccccgaagacatggatctcctcaacagtgtcgcaggccagatcggcggacacacgatctgcgccctcggtgacgcggcggccatgccggtgcaaagcttcctcaaacatttcggccacgagttcgagcatcacatcgaacacaagcgctgcatggtctga

SEQ ID NO: 39333 - protein, 426 aa, Thiobacillus denitrificans ATCC 25259
MSLLTPTPQVCSWTQTLDDPASLATYVANGGYQALRRVVTEAVPGDDIIAEIKTSALRGRGGAGFPTGLKWSFMPRAFPGDKYIVCNSDEGEPGTFKDRDILRYNPHQLIEGMAIAGYVLGARVGYNYIHGEIFEVYQIFERALEEARQAGYLGANLFGTDFCFDLHAHHGYGAYICGEETALLESIEGKKGQPRFKPPFPASFGLYGKPTTINNTETLASVPWIVQHGGQAFLELGKPNNGGAKLFSVSGHVNRPGNYEVPLGTPFTELLEMAGGVRDGRSLKAVIPGGSSAPVLPGHIMMETTMDFDSIAKAGSMLGSGAVIVMDETVCMVRALERLSYFYYEESCGQCTPCREGTGWMYRVIHRIENGQGRPEDMDLLNSVAGQIGGHTICALGDAAAMPVQSFLKHFGHEFEHHIEHKRCMV

SEQ ID NO: 39334 - DNA, 1326 bp, Anaeromyxobacter dehalogenans 2CP-C
  CDS (1)..(1326): transl_table=11
gtgagcgagacgctcatcctctcgaagcgctggggcaagccggactccgcctcgctcgcctcgtaccgggccgacggcggctacggcgcgctcgacaaggccatgggcgccgacccggccgccatcgtggacgaggtgaagaagtcgaacctgcgcggccgcggcggcgcgggcttcgcgaccggcctcaagtggacgttcctgccgaaggacgtccgcccgcgttacctgacggtgaacgcggacgagtccgagccgggcacgttcaaggaccgctacatcatcgagcacgatccgcacatgctgatcgaggggatcgcgctcacctgctacgcgctcgacatccacctcgcctacgtctacatccgcggcgagttcgcgaagcaggcgcgcatcctcgagcaggccatccaggaggcgcgcgacgccggcatcctcggcccgcgcctgctcggcaagaaggacttcccgctcgacatccacgtgcaccgcggcgccggcgcgtacatctgcggcgaggagtccgcgctgctcgagtcgctcgagggcaagaagggctacccgcgcctgaagccgccgttcccggcggtggtgggcctgtggggcaagccgaccatcatcaacaacgtcgagaccatcgcgaacgtcccctggatcgtcgcgaacggcggggcggcgttcgccgcgctcggcgtgggcaagtcgggcggcacgcgcctgttcggcgtctcgggccacgtgaaccggccgggcgtctacgagaagccggtccactacaacctgaagaagctgatcatggaggacgcgggcgggatcgtcggcggccgcaagctgaaggcggtcatccccggcggctcctccgcgccggtgctcgccgcgcacgagatcgacatctcgctcgagttcgacgcggtgaaggcggccgggtcgatgtccggctccggcggcgtgatcgtgttcgacgagtcggtgtgcctggtccgggcgctggcccgcatcgcgaagttctacgccgaggagagctgcggccagtgcaccccctgccgcgagggcacctcgtggatggagggcatcctcgagaagatcgagcacgggcacgcgaccgccgccgacgtggagaagctcgagcaggtggccggcaacatcgccgggaacaccatctgcgcgctgggcgacgcggcggccatgccggtgcagtcgttcctgaagaagttcaagccggagttcctgcggcacgtcgaggcgcaccgctgccccatgggcgagagcggctggggcctcgaccagtcctcgcgtgatgccctcgtcggggcggtgaggtactag

SEQ ID NO: 39335 - protein, 441 aa, Anaeromyxobacter dehalogenans 2CP-C
MSETLILSKRWGKPDSASLASYRADGGYGALDKAMGADPAAIVDEVKKSNLRGRGGAGFATGLKWTFLPKDVRPRYLTVNADESEPGTFKDRYIIEHDPHMLIEGIALTCYALDIHLAYVYIRGEFAKQARILEQAIQEARDAGILGPRLLGKKDFPLDIHVHRGAGAYICGEESALLESLEGKKGYPRLKPPFPAVVGLWGKPTIINNVETIANVPWIVANGGAAFAALGVGKSGGTRLFGVSGHVNRPGVYEKPVHYNLKKLIMEDAGGIVGGRKLKAVIPGGSSAPVLAAHEIDISLEFDAVKAAGSMSGSGGVIVFDESVCLVRALARIAKFYAEESCGQCTPCREGTSWMEGILEKIEHGHATAADVEKLEQVAGNIAGNTICALGDAAAMPVQSFLKKFKPEFLRHVEAHRCPMGESGWGLDQSSRDALVGAVRY

SEQ ID NO: 39336 - DNA, 1719 bp, Syntrophobacter fumaroxidans MPOB
  CDS (1)..(1719): transl_table=11
atgaaatcactggacgaactggcaatcatcaaggaaagcgctcaagaaaccctgcagattcggtacggcaagccgggtgtcctccacaaagcgcatatcatggtgtgtggcggccagggttgcatatcttcaaaatgcgcagaggtggtggacgccatccgggaggcgctcaagaagcacaacttttcggaccatgtgaaagtcgttttgacgggctgcatgggcccctgcgacatgggaccggtggccgtcgtctttccggacgccgtgttctatcgaaggttgaaacccaaggacgccgaggcgatcgtcctcgaacacatcatcggcgggcaaccggtgaccaggctgctttacagggttccgggcgaaaaggacccggttccctcgatgtatgacatcgagctgttcaagaaacaggaaaggattgttcttcggaacacactctacatcgatcccctttccatcgaggaatacatcggacgggacggctacgcggcgctggcgaaagcgctcacccgaatgaggccgggggaggtcgttgaagaaatcaagagatcaggacttcgcgggcgtggaggagccgggttttcgacgggcatgaagtggtctttctcggccgctgccgcggggactcccaagtatgtggtgtgcaacggcgacgagggggacccgggtgcgttcatggacaggtccgtgcttgagggcgatccgcacagcgttatcgaaggcatggccatctgcgggcgcgccatcggcgcggagcaaggctacgtgtatgtgcgcgcggagtaccctcttgcgattgaaaggcttgagcacgccatcaggaaagcccgtgaattcgggctgctggggaaagacatattcgggacgggtttcaatttcgatatcgagatccggatcggtgccggggctttcgtctgtggcgaggaaaccgcccttttggcttccgtcgaaggacgcagaggcgagccgcggccgcggccgccgttcccggcgatcgagggagtgttcggcaaaccgacggtcataaacaatgtcgaaacctgggccaacatccccgcgatcattttcaagggggcggactggttcgcctcaatcggaaccccgaagagcaaggggaccaaggtttttgccctggccggcaaaatcaccaacaccggcatagtggaggtgccgatgggcaccacgctccgggaaatggtcttcgacatcggagggggaataccgaagaagaaggaattcaaagcggttcagacaggggggccttccggcggctgcattcccgcccggcacttggatacccccatcgactacgattcactcggggcgcttggcgccatcatgggctccggcggcatgatcgtcatggaccaggacacctgcatggtggacattgcaaaattcttcctggaattctgcgtggatgagtcctgcgggaagtgttcgccgtgcagaatcgggaccaagaggatgcatgagatcctggagcgcatcagcaccgggcacggcagggagggtgacattgagctgctggtggaactggccaccacgatcaagacgactgccttgtgtggtctcggccagacggcccccaaccctgtgctcagcacgatccgatacttccgggatgagtacgagcaacacatcagggatcacgtatgtgtggccaaggtttgtgacttcgccaacggggatccggacgcttcagaatga

SEQ ID NO: 39337 - protein, 572 aa, Syntrophobacter fumaroxidans MPOB
MKSLDELAIIKESAQETLQIRYGKPGVLHKAHIMVCGGQGCISSKCAEVVDAIREALKKHNFSDHVKVVLTGCMGPCDMGPVAVVFPDAVFYRRLKPKDAEAIVLEHIIGGQPVTRLLYRVPGEKDPVPSMYDIELFKKQERIVLRNTLYIDPLSIEEYIGRDGYAALAKALTRMRPGEVVEEIKRSGLRGRGGAGFSTGMKWSFSAAAAGTPKYVVCNGDEGDPGAFMDRSVLEGDPHSVIEGMAICGRAIGAEQGYVYVRAEYPLAIERLEHAIRKAREFGLLGKDIFGTGFNFDIEIRIGAGAFVCGEETALLASVEGRRGEPRPRPPFPAIEGVFGKPTVINNVETWANIPAIIFKGADWFASIGTPKSKGTKVFALAGKITNTGIVEVPMGTTLREMVFDIGGGIPKKKEFKAVQTGGPSGGCIPARHLDTPIDYDSLGALGAIMGSGGMIVMDQDTCMVDIAKFFLEFCVDESCGKCSPCRIGTKRMHEILERISTGHGREGDIELLVELATTIKTTALCGLGQTAPNPVLSTIRYFRDEYEQHIRDHVCVAKVCDFANGDPDASE

SEQ ID NO: 39338 - DNA, 1563 bp, Alcaligenes eutrophus
  CDS (1)..(1563): transl_table=11
atgatcacgatcaccaccatcttcgtgccgcgcgattccaccgcgctggcactgggcgccgacgacgtcgcccgcgccatcgcgcgtgaagccgcggcgcgcaacgagcacgtgcgcattgtgcgcaatggctcgcgcggcatgttctggctggagccgctggtcgaggtgcagaccggagccggccgcgtggcctatggcccggtcagcgccgcagacgtgccggggctgttcgacgccggcttgctgcaaggcggcgagcacgcgctgtcgcagggcgtcaccgaagagatccccttcctgaagcagcaggagcgcctgaccttcgcccgcgtcggcatcaccgatccgctgtcgctggacgactaccgcgcgcatgagggctttgccggcctggagcgcgcgctggcgatgcagcccgccgagatcgtgcaggaggtcaccgactccggcctgcgcggccgcggcggcgcggcgttcccgaccggcatcaagtggaagaccgtgctgggcgcgcagtccgcggtcaagtacatcgtctgcaatgccgacgagggcgactcgggcacgttctccgatcgcatggtgatggaagacgacccgttcatgctgatcgaaggcatgaccattgccgcgcttgcggtgggtgcggagcagggctacatctactgccgttccgaatacccgcacgcgattgccgtgctggaaagcgcgattggtatcgccaacgccgccggctggctcggcgacgacatccgcggcagcggcaagcgcttccacctcgaagtgcgcaagggcgccggcgcctatgtctgcggcgaggaaaccgcgctgctggaaagcctggaaggacggcgcggcgtggtgcgcgccaagccgccgctgccggcgctgcaggggctgttcggcaagcccacggtgatcaacaacgtgatctcgctggccaccgtggccggtgaatcctggcgcgcggcggagtactaccgcgactacggcatgggccgttcgcgcggcacgttgccgtttcagcttgccggcaacatcaagcagggcggactggtggaaaaggcgttcggcgtgacgctgcgcgagctgctggtcgactacggcggcggcacgcgcagcggccgcgccatccgcgcggtgcaggtgggcgggccgctgggcgcctacctgcccgagtcgcgcttcgacgtgccgctggactatgaagcctatgccgcgttcggcggcgtggtcggccacggcggcatcgtggtgttcgatgaaaccgtcgacatggcaaaagcaggcccctacgcgatggagttctgcgcgatcgaatcgtgcggcaagtgcaccccgtgccggatcggctcgacccgcggcgtcgaagtgatggaccgcatcatcgccggcgagcagccggtcaagcacgtcgccctggtgcgcgacctgtgcgacaccatgctcaacggctcgctgtgcgcgatgggcggcatgaccccgtacccggtgctgtccgcgctgaatgaattccccgaggacttcggcctcgcctccaacccagccaaggccgcctga

SEQ ID NO: 39339 - protein, 520 aa, Alcaligenes eutrophus
MITITTIFVPRDSTALALGADDVARAIAREAAARNEHVRIVRNGSRGMFWLEPLVEVQTGAGRVAYGPVSAADVPGLFDAGLLQGGEHALSQGVTEEIPFLKQQERLTFARVGITDPLSLDDYRAHEGFAGLERALAMQPAEIVQEVTDSGLRGRGGAAFPTGIKWKTVLGAQSAVKYIVCNADEGDSGTFSDRMVMEDDPFMLIEGMTIAALAVGAEQGYIYCRSEYPHAIAVLESAIGIANAAGWLGDDIRGSGKRFHLEVRKGAGAYVCGEETALLESLEGRRGVVRAKPPLPALQGLFGKPTVINNVISLATVAGESWRAAEYYRDYGMGRSRGTLPFQLAGNIKQGGLVEKAFGVTLRELLVDYGGGTRSGRAIRAVQVGGPLGAYLPESRFDVPLDYEAYAAFGGVVGHGGIVVFDETVDMAKAGPYAMEFCAIESCGKCTPCRIGSTRGVEVMDRIIAGEQPVKHVALVRDLCDTMLNGSLCAMGGMTPYPVLSALNEFPEDFGLASNPAKAA

SEQ ID NO: 39340 - DNA, 1815 bp, Rhodococcus opacus
  CDS (1)..(1815): transl_table=11
atgagcggagacatcaaggcaatactcgagcggaacggttctgagagaacgcgcctgatcgacatactttgggatgttcagcatctgtacggtcatattccggacgaagtactgccacaactggcggacgagctgaatctctccccacttgatattttggaaactgcctccttctaccatttctttcatcgcaagccgtcgggaaagtatcggatctacctgagcgatacggtgattgccaagatgaacggctatcaagccgtgcacgattctctcgagcgggagactggggcccgtttcggtggaaccgataagacggggatgtttggcctgttcgaaacgccatgtatcggtctcagtgatcaggaaccggcgatgttgatcgacaacgtggtgttcacccgtctaaggcctggaacgatcgtcgacatcatcacacaattgcggcaggggcgatccccggaagatattgcgaacccggctggactaccaagtgatgatgtcgcctatgtcgatggtgtagtggaatccaatgttcggacgaagggcccggtctttttccgaggtctcacggactacgggcggttgctcgaactctgcctcgcactcagacctgaacagatcatcgatagaatcatcgaatccaagctccgcgggcgcggcggcgccggcttttcaaccggattgaagtggcagctttgccggaccgccgtgagcgacgacaagtatatcatctgtaatgccgatgaaggcgaacccggcaccttcaaggaccgcgtgctgctgacccgctctcccaagaaggtattcatggggatgattattgccgcccgtgccatcggcagcagaaacggaatactttatctgcgttgggaatacatttacctgaaggattatctggaaagacagcttcaggaactcagggatgaagggctgctcggtgcccgtattggtggccagtcgggatttgattttgatatccgtatccagatgggggccggcgcctatatatgcggtgacgaatcggcactcatcgaatcatgcgagggcaaacgaggcacgccgcgtgtgaaaccccccttccctgtgcaagagggatacctgggcaaacccacatgcgtcaacaacgtcgagacctttgccgccgcggcccgcatcatggaggaagggccaaactggttcagggcgctgggaaccccggaatccaccggcactcggctgttgagcgttgctggcgactgtagtaggccgggaatctacgaggtcgaatggggcgtcacactcaacgaggtactgacgacggtcggtgctcgggatgcccgggcggtccagatcagcggcccctcgggtcaatgcgtgtcggtggcggaggacggtgaacgcaggatggcgtacgaagatatttcctgcaatggcgcgttcaccatcttcaacacagaacgcgacctgttggaaatcgtcaaggacttcatgcagttcttcgtggatgagtcgtgcggaatttgcgtgccatgtcgagtgggcaatatcgacctgcacaagaaagtggaactggtgatcgccggtaaagcgtgccagaaggacctcgacgatgttgtcagctggggagcgctggtgaaaaagaccagtcgttgcggtcttggcgccacttcacccaatcccatcctgacgaccctggataagttccccgagatctatacgaaaaggctgcgcaaacagaagaaggaggccttgctgctgtcgttcgatctcgatgctgccttgggcgggtacgagaaggcgctcgagggtctggcgaaggaggagatcaaatga

SEQ ID NO: 39341 - protein, 604 aa, Rhodococcus opacus
MSGDIKAILERNGSERTRLIDILWDVQHLYGHIPDEVLPQLADELNLSPLDILETASFYHFFHRKPSGKYRIYLSDTVIAKMNGYQAVHDSLERETGARFGGTDKTGMFGLFETPCIGLSDQEPAMLIDNVVFTRLRPGTIVDIITQLRQGRSPEDIANPAGLPSDDVAYVDGVVESNVRTKGPVFFRGLTDYGRLLELCLALRPEQIIDRIIESKLRGRGGAGFSTGLKWQLCRTAVSDDKYIICNADEGEPGTFKDRVLLTRSPKKVFMGMIIAARAIGSRNGILYLRWEYIYLKDYLERQLQELRDEGLLGARIGGQSGFDFDIRIQMGAGAYICGDESALIESCEGKRGTPRVKPPFPVQEGYLGKPTCVNNVETFAAAARIMEEGPNWFRALGTPESTGTRLLSVAGDCSRPGIYEVEWGVTLNEVLTTVGARDARAVQISGPSGQCVSVAEDGERRMAYEDISCNGAFTIFNTERDLLEIVKDFMQFFVDESCGICVPCRVGNIDLHKKVELVIAGKACQKDLDDVVSWGALVKKTSRCGLGATSPNPILTTLDKFPEIYTKRLRKQKKEALLLSFDLDAALGGYEKALEGLAKEEIK

SEQ ID NO: 39342 - DNA, 1440 bp, Dictyostelium discoideum
  CDS (1)..(1440)
atgatgaatttaggtaatcgtgttaaatcggttattaaattaacttcaacaacaggtttaacaggcaaaaattttcaagcaaccaaagttgcaacattttcaacagcacaagttcaacaagcacaagaaaatgttagatcatatggtggtttgaaggataaagatcgtattttcacaaatttatatggtgaacatgacgtttatttaaagggtgctattgcacgtggagattggtataaaactaaaaatattattgataaaggtaaagattggatattaaaagaaatgatggcctctggtttaagaggtagaggtggtgctggtttcccatcaggtttgaaatggagtttcatgccagaaacaacttcaaaagatagaccacaataccttgtcatcaatgctgatgagggtgaacctggaacatgcaaagatagagaaattatgagacacgatcctcataaattaattgaaggttgtttacttgctggttttgcaatgagagcatgtgcagcatacatttatattcgtggtgaatttcattatgaagcaaaagtattagaacaagcaatcgatgaagcatataaagcaggtttaattggtgaaaatgcatgcggtacaggctataaatttgatgtatatgttcacagaggtgctggtgcatacatttgtggtgaagagacagctctcattggaagtattgaaggtaaacaaggtaaaccacgtttaaagccacctttcccagctatggctggtctttatggttgtccaacaactgtaacaaatgttgaaacagtagctgttgctccaactattttaagacgtggcggtgcttggtttgcaagttttggtagaccaaagaatgcaggtactaaattattttgtatttccggtcatgtcaataatccatgtactgttgaagaagagatgagtattccattaagagaattaattgataaacattgtggtggtgtcattggaggttgggataacttaaaaggtgttattccaggtggttcatcagtaccagtccttccaaaaaatatttgtgataatgttttaatggatttcgatgatcttagacaacacagatctggtttaggtacagctgcagttatagttatgaacaaagaaactgatatgattgcagcaattgcaagattatctaaattctataaacacgaatcatgtggtcaatgtaccccatgtcgtgaaggtgttggatggctctatgatatcaccgatcgtttagtcactggtaatgccaaacccgatgaaattgattcacttgaagaaattagtagacaaattgaaggtcacaccatttgtgctttaggtgatgctgctgcttggccagtacaaggtttaattagacattttagaccagaaattgaagatagaattaaacaattccaactcaataagaaacaatcaccattttaa

SEQ ID NO: 39343 - protein, 479 aa, Dictyostelium discoideum
MMNLGNRVKSVIKLTSTTGLTGKNFQATKVATFSTAQVQQAQENVRSYGGLKDKDRIFTNLYGEHDVYLKGAIARGDWYKTKNIIDKGKDWILKEMMASGLRGRGGAGFPSGLKWSFMPETTSKDRPQYLVINADEGEPGTCKDREIMRHDPHKLIEGCLLAGFAMRACAAYIYIRGEFHYEAKVLEQAIDEAYKAGLIGENACGTGYKFDVYVHRGAGAYICGEETALIGSIEGKQGKPRLKPPFPAMAGLYGCPTTVTNVETVAVAPTILRRGGAWFASFGRPKNAGTKLFCISGHVNNPCTVEEEMSIPLRELIDKHCGGVIGGWDNLKGVIPGGSSVPVLPKNICDNVLMDFDDLRQHRSGLGTAAVIVMNKETDMIAAIARLSKFYKHESCGQCTPCREGVGWLYDITDRLVTGNAKPDEIDSLEEISRQIEGHTICALGDAAAWPVQGLIRHFRPEIEDRIKQFQLNKKQSPF

SEQ ID NO: 39344 - DNA, 1464 bp, Solanum tuberosum
  CDS (1)..(1464)
atggcacctataaagggccttctttctctgcaacggactgcattagctcaacgttctagtgaaagatggggcctatatggtaggttatttagcactcaggctgcatcaactgctagcactccccaacctacacccccacccccacctcccgagaggactcactttggtggccttaaagatgaggatcgtattttcacaaatctctacggattgcatgacccttacctcaaaggtgccatgaagcgaggagattggtacagaacaaaagatcttgtcatcaagggttctgactggatcgtgaatgaaatgaagaaatctggtcttcgaggacgtggtggtgctggttttccatctggtctcaaatggtccttcatgccaaagacaacagatggccgtccttcatatcttgtcgtcaatgctgatgaaagtgaacctggaacctgtaaagacagggaaatcatgcggcatgacccacacaagttgttggaaggctgtctgattgcaggagtggggatgagggctaaagctgcttatatttatatcaggggagagtatgtgaatgaaaggaagagccttcagaaggctagacaagaagcctatgaagctggattgttggggaaaaatgcttgtggatctggttatgattttgacgtatatattcattttggtgctggtgcctatatttgtggtgaagagacagctcttctggagagccttgagggcaaacaaggcaaaccaagattgaagcctccatttccagctaatgcaggactatatggatgtccaacaactgtcacaaatgttgaaacagtagctgtttcaccaaccatcttaaggcgtgggccggagtggtttgctagttttggccggaagaataatgccgggacaaagctgttttgcatctcaggccatgttaacaagccctgcacagttgaagaggaaatgagtatttcattgaaggagctgatagagaggcactgtggtggtgttcgtggaggatgggacaatttgcttgctgttataccaggaggttcatctgttccattgcttcccaagaacatatgtgaggatgtacttatggattttgatgcactcaaagctgtgcagtcagggttggggactgctgctgtaattgtcatggacaagtcaactgatgttgtagatgcaattgcaaggctctcgtacttctataagcacgagagctgtggtcaatgtacaccatgtagggaaggcacagggtggctttggatgatcatggaaagaatgaaggttggcaatgcaaagttggaagagattgacatgctccaagaggtgacaaaacagattgaagggcataccatttgtgccttgggtgacgctgctgcttggccagtgcagggtcttattaggcactttagaccagagctagaaaggaggatcagggagcacgcagagagagagctacaacaggcggctgctgcttga

SEQ ID NO: 39345 - protein, 487 aa, Solanum tuberosum
MAPIKGLLSLQRTALAQRSSERWGLYGRLFSTQAASTASTPQPTPPPPPPERTHFGGLKDEDRIFTNLYGLHDPYLKGAMKRGDWYRTKDLVIKGSDWIVNEMKKSGLRGRGGAGFPSGLKWSFMPKTTDGRPSYLVVNADESEPGTCKDREIMRHDPHKLLEGCLIAGVGMRAKAAYIYIRGEYVNERKSLQKARQEAYEAGLLGKNACGSGYDFDVYIHFGAGAYICGEETALLESLEGKQGKPRLKPPFPANAGLYGCPTTVTNVETVAVSPTILRRGPEWFASFGRKNNAGTKLFCISGHVNKPCTVEEEMSISLKELIERHCGGVRGGWDNLLAVIPGGSSVPLLPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIREHAERELQQAAAA

SEQ ID NO: 39346 - DNA, 1473 bp, Desulfovibrio fructosovorans
  CDS (1)..(1473): transl_table=11
atggcagcgacgaccacggaaaaaaagcagcttcggatcgccacccgcaattgcggcttcatcgatccggaaagtatcgacgattacatcgccctgcggggctatgagggcctggccaaggtcctgaccatgaccccggccgaggtggtggacctggtcaagcgctcgggcctgcgcggccgcggcggcgcgggcttccccaccggcatcaagtggggcatcgcgctcggcaacaaggccgaccagaagtacatggtgtgcaacgccgacgaaggcgacccggagttcatggaccgcgccgtgctcgagggcgacccccactcggtggtggaggccatggccatcggcggctacgccatcggggccacccggggcacggtctacatccgggccgagtatcccctggccatcaagcgcctcaaaaaggccatcgacgacgcccgcgagtacggcctgctcggcgaaaacatcttcggctcgggcttcgatttcgacatcgaactcaagtacggcgccggcgcgttcgtctgcggcgaggaaacggccctgatccgctccatggaaggcaagcgcggcgagcccgtgaccaagccgccgttcccggcccagtccggctattgggaaaagcccaccatcgtcaacaacgtggagaccttcgccaatatccccgccatcatcatcaacggcgcggattggttctccggcatcggcaccgccacctccaagggcaccaaggtgttcgccctggccggcaagatccagaacgtgggcctgatcgaagtccccatgggcatcagcctgcgcgaggtcatcttcgacatcggcggcggctgccccgacggcaaggccttcaaggccgtccagaccggcggcccctccggcggcgcgctggccaacaaggacctcgatgtggccatcgactacgagtccctggccgcctgcaagtccatcatgggttccggcggcatggtcgtcatggacgaggacgactgcatggtctccgtggccaagttcttcctggacttcaccatggacgagacctgcggcaagtgcaccccctgccgcatcggctccaagcgcctctacgagatcctggaccggatcaccaagggcaagggcacccgggccgacctcgatcggctcaagtccctgtccgagatcatcaaggacacggcgctgtgcggcctcgggcagaccatgcccaaccccatcctgtccaccatggataccttcgccaatgaatacgaggcccatgtcgacgacaagaagtgtccggcccacgtctgcacggccctgctgacctacaccatcgatcccgccaagtgcacgggctgcggcctgtgcaccagggtctgcccggtggagtgcatttccggcacgaagaagcagccccacaccatcgataccacacggtgcatcaagtgcggcgcctgctacgacaagtgcaagttcgactccatcatcaagcaataa

SEQ ID NO: 39347 - protein, 490 aa, Desulfovibrio fructosovorans
MAATTTEKKQLRIATRNCGFIDPESIDDYIALRGYEGLAKVLTMTPAEVVDLVKRSGLRGRGGAGFPTGIKWGIALGNKADQKYMVCNADEGDPEFMDRAVLEGDPHSVVEAMAIGGYAIGATRGTVYIRAEYPLAIKRLKKAIDDAREYGLLGENIFGSGFDFDIELKYGAGAFVCGEETALIRSMEGKRGEPVTKPPFPAQSGYWEKPTIVNNVETFANIPAIIINGADWFSGIGTATSKGTKVFALAGKIQNVGLIEVPMGISLREVIFDIGGGCPDGKAFKAVQTGGPSGGALANKDLDVAIDYESLAACKSIMGSGGMVVMDEDDCMVSVAKFFLDFTMDETCGKCTPCRIGSKRLYEILDRITKGKGTRADLDRLKSLSEIIKDTALCGLGQTMPNPILSTMDTFANEYEAHVDDKKCPAHVCTALLTYTIDPAKCTGCGLCTRVCPVECISGTKKQPHTIDTTRCIKCGACYDKCKFDSIIKQ

SEQ ID NO: 39348 - DNA, 1332 bp, Rhodothermus marinus
  CDS (1)..(1332): transl_table=11
atggcgacgaacggagcccagagtaaagccggagactggcggaattacaagcgggtgctgctcccgcccattcgggatctgcaccggctggaagtctacgaagcgcacgggggctaccagaccctgcgcgaagtgctgacctccgaccggtgggatcccaagtcggtcatcgaagaggtcaaaaagagcaagctacgcggacggggcggcgccggctttcctacggggctgaagtggagcttcatgccgccggtggacgatcggccccgcttcctgtgctgcaacggcgacgaaagcgagccgggcacgttcaaggaccgccagctcatggagttcaatccccaccagattttcgaggggattctgatcgcctgctacgccatgtcggtgcgcacgtgctacctgtacgtgcgcggcgaatttgcccggtggatcgagcacatggagcgggagctggaaaagctctacgccaaaggttacgtggggaagaacattatgggcacggacttctcggccgacatcgtgatccacaagggagccggggcctacatctgcggcgaggagtccagcctgatggagtcggtcgagggcaagcgggcctacccgcgcatcaagccgccgtttccggcccagcggggcctctggggctaccccaccacgatcaacaacgtggagacgctggcgaacgtcccgctcattctgcgcaacggcggcgagtggtttgcgtccatcggcgcgcccaaccatcccggtccggtgctctacggtatttcgggccacgtcaaccgccccggcgtctacgaataccccaccggcatgctgatcaccgacctgatctacgaggtggccggtggcatccgcgggggtaaaaagctcaaggccgtcatcccgggcggaagctccacgccgcccctgcgggccgacatgatcgacggcgtgaccatggacgccgagtcgctgcgcgaggccggctcgatgatgggcacggctggcctgctcgtgctcgacgaagacaccgacatggtctcgtggctgcggcgcgtggctcacttttacgcgcacgaaagctgcggccagtgcacgccctgccgcgagggcaccggctggctcgaaaacatcctcacgcgcatcgaagaaggcgaaggccgtctgcgcgacctggacctgctgctggacctgtgcgatcagatggaaggccgcacggtctgcgccctggccgacgctgccgcctggcccgtacgctacaccatccttcgcttccgcgaggagttcgaggccaggtgcaagcccagccttgtcccgacgggcatcgatctgacgccaaccggttga

SEQ ID NO: 39349 - protein, 443 aa, Rhodothermus marinus
MATNGAQSKAGDWRNYKRVLLPPIRDLHRLEVYEAHGGYQTLREVLTSDRWDPKSVIEEVKKSKLRGRGGAGFPTGLKWSFMPPVDDRPRFLCCNGDESEPGTFKDRQLMEFNPHQIFEGILIACYAMSVRTCYLYVRGEFARWIEHMERELEKLYAKGYVGKNIMGTDFSADIVIHKGAGAYICGEESSLMESVEGKRAYPRIKPPFPAQRGLWGYPTTINNVETLANVPLILRNGGEWFASIGAPNHPGPVLYGISGHVNRPGVYEYPTGMLITDLIYEVAGGIRGGKKLKAVIPGGSSTPPLRADMIDGVTMDAESLREAGSMMGTAGLLVLDEDTDMVSWLRRVAHFYAHESCGQCTPCREGTGWLENILTRIEEGEGRLRDLDLLLDLCDQMEGRTVCALADAAAWPVRYTILRFREEFEARCKPSLVPTGIDLTPTG

SEQ ID NO: 39350 - DNA, 1395 bp, Homo sapiens
  CDS (1)..(1395)
atgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtccgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttag

SEQ ID NO: 39351 - protein, 464 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGPIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 39352 - DNA, 1425 bp, Nyctotherus ovalis
  CDS (1)..(1425): transl_table=10
atgatagtacgcattggtaagagaacaggaaggctagttcgcttatttgcttcagtagatgcaacaaaggctgaggagaagccaaggagttatggcaatatatcagatcaagacaggatcttcagtaatttgtataaagatcaagatccttttattaatggtgccttgaaaagaggagattggtatagaactaaagatatcctttcttgtcctcaggattttgtcatagatgaaataaagaaatctggtcttcgtggacggggaggagcagggtttccatcaggattgaagtattcgtttatgccaaagaagagtgatggacgtccttcttacttagtagtaaatgctgacgaatcagaaccagcaacctgcaaagatagagaaatcatgagacatgatcctcataagttagttgaaggagcacttattgttggttatgcaatgagagctaaagctgcctacgtttatattcgcggtgaattctggcatgaagctcaacaattggaaagagcggtggcggaggcatatgaaaaaggatttatagggaagaatgcttgtggatcaggatatgattttgatatttacgtgcatagaggagcaggagcttatgtttgtggtgaggaaacttcaatgttaagcagtattgaaggagttgtagggaaacctcgaatgaaacctccatatccagctggcacaggactttatggttgtcctacaactgtaactaatgtggaaacagtctctactgttcctaccataatgcgtcgaggtggaagttggttcgcaagctttggaagaaagaacaatcacggaaccaaactttattccctaagtgggcatataaacaatccttgtacagtggaagatgagatgagtatatctgtgcgcgaattaattgaaagacatggaggaggagtaagaggtggatgggataaccttctaggagtaattcctggtggctcatcaactcctataatctctaaagaactatgtgaaactgcactaatggactttgattcgttgattgaagctggttcagcatttgggacagctggagttatagtgttggataaatctacagatgtaattgatgcgatattgagattatcaaagttttatctgcatgagagttgtggccagtgtacaccatgtcgtgaaggaactggatggcttgtcgatatgcttgagcgaatgaagatagggaaggcagattatggagagatagaccaattatacgagcttacaaaacaaatagaaggacacacaatttgtgcgttaggagaagcagcagcatggccagtacaaggacttatcaaacattacagacctgttatggaagatcgtatggacaagtatcatagtcaacatcctgtagtagcagaaggtccattttcatctcatcatcctgttgcaggatctcattaa

SEQ ID NO: 39353 - protein, 474 aa, Nyctotherus ovalis
MIVRIGKRTGRLVRLFASVDATKAEEKPRSYGNISDQDRIFSNLYKDQDPFINGALKRGDWYRTKDILSCPQDFVIDEIKKSGLRGRGGAGFPSGLKYSFMPKKSDGRPSYLVVNADESEPATCKDREIMRHDPHKLVEGALIVGYAMRAKAAYVYIRGEFWHEAQQLERAVAEAYEKGFIGKNACGSGYDFDIYVHRGAGAYVCGEETSMLSSIEGVVGKPRMKPPYPAGTGLYGCPTTVTNVETVSTVPTIMRRGGSWFASFGRKNNHGTKLYSLSGHINNPCTVEDEMSISVRELIERHGGGVRGGWDNLLGVIPGGSSTPIISKELCETALMDFDSLIEAGSAFGTAGVIVLDKSTDVIDAILRLSKFYLHESCGQCTPCREGTGWLVDMLERMKIGKADYGEIDQLYELTKQIEGHTICALGEAAAWPVQGLIKHYRPVMEDRMDKYHSQHPVVAEGPFSSHHPVAGSH

SEQ ID NO: 39354 - DNA, 1875 bp, Clostridium saccharoperbutylacetonicum
  CDS (1)..(1875): transl_table=11
atgcttcttaatagaaatgatttgattaatacaagagaactttataaaaaaagtttaataaaagaaaaaaagaaaattttaatatgtgctggtactggttgtgtagcaggtggatcactagatatttatgaagaatttataaagttaatgaaagaaaaagaaataaattgtgaagtgagccttgagaaagaaccacatgatgaaactgttggaattaaaaaaagtggatgtcatgggttttgtgagatgggacctcttgtaagaattgagccttttggatatttatacataaaggtaaagccagaagattgtgctgaaatccttgaaaaaactataattaatgatgaatgtgtcgaaagacttgcatatactaaaaatggtgagatatataaaaaacaagaagaaataccattttataaaaaacaaactagacttgcacttgagcactgtggacatattgatgcaacttcaattgaagaataccttgctatagatgggtattcagcctttgaaaaggtgctgtttgatatgaaagcagatgaagttattaaggaaatagaagaatcaaatttaagaggtcgtggaggcggtggttttccagcaggtcgtaaatggtctcaagtaagtcgccaaaaagaagaaattagatatattgtttgtaatggtgatgaaggagatccaggtgcatttatggatagaagcataatggaaggagatcctcatagaatgcttgaaggcatgatgattgctggtgtagcttgtggtgcacaaaaaggatatatatatgttcgtgcagagtaccctttagcagtaagcagactttcaaatgcaattgagcaggcaagaaagtatggaatattaggagaaaatattttaggaactggatttagctttgatcttcaaataaatagaggtgccggagcatttgtatgtggtgaaggaagtgcacttactgcttctattgaaggaaaaagaggaatgccaagagtaaaaccaccaagaactgttgaacaaggtctttttggaaagcctacagtacttaataatgttgaaacttttgctaatgtacctatagttattaataaaggtgctgaatggtatagatctattggacctgaaaatagtccgggaacaaaagcttttgccttaacagggaatattgaaaatactggtcttatagaggttccaatgggaacaaccttgagggaagtaatttttgatattggcggtggaataagagatggtaaacggtttaaagccgtgcaaattggtggaccatcaggaggatgtctaacagctgaacaccttgatctaccgttagattttgattctcttaaaaaagcaggtgcaatgataggatctggtggtcttgtagttatggatgaagatacatgtatggttgaagttgcacgtttctttatgaatttcacaaagaatgaatcttgtggaaaatgtgttccttgtcgtgaaggtactaaacgtatgcttgtaatacttgaaggaattgttgctggtaaaggtaaattagaagatatggatatgttacttgaacttgcagacacaatttcagctacagcactttgtggactaggaaaaacagcgccatcacctgttgttagcacaattaagaatttcaaagatgaatatataaaacatattgtcgataaaaaatgtccatcaaagacttgtcaaaagcttaagacaatattaattgacccttctatgtgtaagggatgttcaaaatgttcaaaagtttgtcctgtaggggcaatttcaggaaaaattaaagaaccattcgtaatagatcaaaacaagtgtataaaatgtggagcttgtttggaaacttgcccatttaaagctataaaggaggattaa

SEQ ID NO: 39355 - protein, 624 aa, Clostridium saccharoperbutylacetonicum
MLLNRNDLINTRELYKKSLIKEKKKILICAGTGCVAGGSLDIYEEFIKLMKEKEINCEVSLEKEPHDETVGIKKSGCHGFCEMGPLVRIEPFGYLYIKVKPEDCAEILEKTIINDECVERLAYTKNGEIYKKQEEIPFYKKQTRLALEHCGHIDATSIEEYLAIDGYSAFEKVLFDMKADEVIKEIEESNLRGRGGGGFPAGRKWSQVSRQKEEIRYIVCNGDEGDPGAFMDRSIMEGDPHRMLEGMMIAGVACGAQKGYIYVRAEYPLAVSRLSNAIEQARKYGILGENILGTGFSFDLQINRGAGAFVCGEGSALTASIEGKRGMPRVKPPRTVEQGLFGKPTVLNNVETFANVPIVINKGAEWYRSIGPENSPGTKAFALTGNIENTGLIEVPMGTTLREVIFDIGGGIRDGKRFKAVQIGGPSGGCLTAEHLDLPLDFDSLKKAGAMIGSGGLVVMDEDTCMVEVARFFMNFTKNESCGKCVPCREGTKRMLVILEGIVAGKGKLEDMDMLLELADTISATALCGLGKTAPSPVVSTIKNFKDEYIKHIVDKKCPSKTCQKLKTILIDPSMCKGCSKCSKVCPVGAISGKIKEPFVIDQNKCIKCGACLETCPFKAIKED

SEQ ID NO: 39356 - DNA, 1290 bp, Trichomonas vaginalis
  CDS (1)..(1290)
atgcttgcagcatacggccatcgcttccagacaaaattccttgacccaaaggatcgcattttccccaatctctttggtgacgagggcgctgatttggcttctgcacaaaagcgtggagactggaatcaaacagaagaacttatcaagaagggcaaagagttcattctcaacgaagtcaagaagtccgaaatccgtggacgtggtggtgctggtttctcaacaggccagaaatggagtttcgttccaaagccaagtggcatcccacattatctctgcatcaacgccgatgaaggtgaaccaggcacatgcaaggatcgccagattctcacaaacgagccacacaagctcgtagaaggcgctcttctcgcttcatacacaatccacgctcacacagcctacgtttacgttcgtggtgaattccgccatgaaattgcctgcttacagaaggctattgatgaggcctacgctgctggactcatcggcaagaacaacaaattcggatgggatttcgatatgtacatccactccggtgctggcgcttacgtttgcggtgaagagacagccctcctcaactccattgaaggtaaggcaggccgcccacgctttaaaccaccgtacccagctgcaaagggtcttttccagaagccaaccatcatcaacaacgtcgagaccatctcctccgtcccaacaatctgcaagcgcggtggtgactggttctcatccatcggtatcaagggctcaaagggcacaaagatctacgctatctctggccacgtcaaccacccatgcgttgttgaagaagctatgggtatcccaatcaaggacctcatcaacaagtacgctggtggtgtccgcggcggctgggataacctcctctgcttgatcccaggtggtctctcctgcccaatcctcacaaaggagcagtgcgagacagcagtcatgggttacaacgagctctccgctatgggctctgctctcggcacaggtgctatcatcgttatggataagtctacaaacctttacgaggctttcagacgcgtttctcacttctacatgcatgaatcttgcggtcagtgcggtccatgccgtgaaggaacagctaaactctccgacatcatggacaaattcgctgagggaaaggccacaaagcacgatttacttatgcttaagaaggtcgcttaccagacatctaactgcatctgcgccctcgctggtgcttcttctgacccaatcaagggactcctcaagcagttcagaccagagctcgaaaaggcttgcgtcgctgagtaa

SEQ ID NO: 39357 - protein, 429 aa, Trichomonas vaginalis
MLAAYGHRFQTKFLDPKDRIFPNLFGDEGADLASAQKRGDWNQTEELIKKGKEFILNEVKKSEIRGRGGAGFSTGQKWSFVPKPSGIPHYLCINADEGEPGTCKDRQILTNEPHKLVEGALLASYTIHAHTAYVYVRGEFRHEIACLQKAIDEAYAAGLIGKNNKFGWDFDMYIHSGAGAYVCGEETALLNSIEGKAGRPRFKPPYPAAKGLFQKPTIINNVETISSVPTICKRGGDWFSSIGIKGSKGTKIYAISGHVNHPCVVEEAMGIPIKDLINKYAGGVRGGWDNLLCLIPGGLSCPILTKEQCETAVMGYNELSAMGSALGTGAIIVMDKSTNLYEAFRRVSHFYMHESCGQCGPCREGTAKLSDIMDKFAEGKATKHDLLMLKKVAYQTSNCICALAGASSDPIKGLLKQFRPELEKACVAE

SEQ ID NO: 39358 - DNA, 2109 bp, Drosophila melanogaster
  CDS (1)..(2109)
atgatatcgtttctgttaaaacgccgagcttgtgatgcttacaagatttcattaggactaactcgtgcatatagagccttaacagaagtaaaaagccttcaaaatgccttacgacctggtaataaaactggaaatatcaagctggtaaacatataccgaacttctagcatacaaaatgtgaagaagaaccaactaagtgacgctgaaagcgttattccactcttattgcggccagccaaacctgtgctgattatgagagaaggatctcaaaccgattgtaacgacgatttgctgtcctctgagcaaagagccaaaaaaagggaaagcatacaaaaatccgaagtagattgcccaaaatttccagctgagaaacttccgcccacaacgaaatttcctattaatgaaaatgccaagaaggttttagatccagccgaccaaagagaactcgaggccaatttgttaaaaaggcttaaagatatggctaaaagaaagaaatctcgactagataagaaagttgacgagctgagggataattttataggctggaattatgctgctctacaaggaagaactattgtgactgtagatgccaaggaatcaactccaccgaaaggatctgggccggccaccccggcaggctctcctccacctaaaaatgtttctgcaccgccgacgggcggttctccgcctgccaaaagcggtgctccaccacccccaaaggggccaccgcccggaactccaccaccgcagacgaaaactacttttggaccacttgctgatgctgatcgaatctttaccaatttatacggacggcacgattggcgattgaaggcagcaatgaagcgcggtgactggtacaagacgaaggagatcatagccaagggtgacaagtggatagtcaacgagattaagacatctggactgcgaggacgcggtggcgccggatttcccagtggacttaagtggtcatttatgcataaaccgcctgatggaagaccaaagtttctggtggtcaatgcggatgaaggagagcccggtacgtgcaaggatcgtgagataatgcgtcatgatccacacaaactggtagagggatgtctcattgctggacgggctatgggtgccaacactggttttatttacattcgcggagagttttacaacgaagcttgcaatcttcagtatgccattattgaggcctataaggctggctacctgggaaagaatgcctgcggttctgggttcgatttcgatctttatgtgcaacgtggagcaggagcctatatttgcggtgaggaaacctctctgattgaatccctggagggcaaggcgggtaagccaaggaacaagcctccctttccggctgatatcggcgtctttggctgtccgtctacggtgaccaatgtggaaacggtggccgtgtctcccactatttgccggcgtggtggcaattggtttgccagctttggacgtacccgaaactctggcaccaagctgttcaatatctctggtcatgtttgcaacccttgtaccgtcgaggaggagatgtccatgccaaccagagagcttatcgaacgccatgctggcggagtgatcgggggctgggacaatctactggccatcattccgggtggctcctccactccctgcattaccaaggagcacgcttcgagtgcgattcacgactacgatgggctgatggcagtgcgttcgtccatgggaacgggtgccttaattgttatgaataaggatacggacattatcaaggccattgcccgattatcggctttctataagcacgagagctgcggccagtgcactccttgccgcgagggtctccactgggtgaacatgatcatgcatagatttgtgacaggacaggcgcaaattgcagagatcgatatgctgttcgaactgacgaagcagatcgagggccataccatttgtgccctggccgatggtgctgcttggccgccccaaggactcatccggaacttccgaccggtcatcgaggagaggatcaagaagcgggcggccgaggaccaagctaaagctgaagcactcgaagccgaacgtttcccttgtcaaacggtgactccttgtccagaataa

SEQ ID NO: 39359 - protein, 702 aa, Drosophila melanogaster
MISFLLKRRACDAYKISLGLTRAYRALTEVKSLQNALRPGNKTGNIKLVNIYRTSSIQNVKKNQLSDAESVIPLLLRPAKPVLIMREGSQTDCNDDLLSSEQRAKKRESIQKSEVDCPKFPAEKLPPTTKFPINENAKKVLDPADQRELEANLLKRLKDMAKRKKSRLDKKVDELRDNFIGWNYAALQGRTIVTVDAKESTPPKGSGPATPAGSPPPKNVSAPPTGGSPPAKSGAPPPPKGPPPGTPPPQTKTTFGPLADADRIFTNLYGRHDWRLKAAMKRGDWYKTKEIIAKGDKWIVNEIKTSGLRGRGGAGFPSGLKWSFMHKPPDGRPKFLVVNADEGEPGTCKDREIMRHDPHKLVEGCLIAGRAMGANTGFIYIRGEFYNEACNLQYAIIEAYKAGYLGKNACGSGFDFDLYVQRGAGAYICGEETSLIESLEGKAGKPRNKPPFPADIGVFGCPSTVTNVETVAVSPTICRRGGNWFASFGRTRNSGTKLFNISGHVCNPCTVEEEMSMPTRELIERHAGGVIGGWDNLLAIIPGGSSTPCITKEHASSAIHDYDGLMAVRSSMGTGALIVMNKDTDIIKAIARLSAFYKHESCGQCTPCREGLHWVNMIMHRFVTGQAQIAEIDMLFELTKQIEGHTICALADGAAWPPQGLIRNFRPVIEERIKKRAAEDQAKAEALEAERFPCQTVTPCPE

SEQ ID NO: 39360 - DNA, 1389 bp, Nilaparvata lugens
  CDS (1)..(1389)
atggcgagtgccctttcattgtgtaggattggacatcttcaaaaagttaatttatgtcctgttctaagtaccgttcaagttagaagcaattcagatgctgcaccaactaaaacgaaatacgggccattgaacgatagcgaccgtatcttcacgaacttgtacggtcgccatgactggcggttgaagggagctctcaagcggggagactggtacaagaccaaggaaatcgttcttaagggggccgacttcattatcaatgaagtgaaagcttcaggtctgaggggccgaggaggagctggattcccctccggtctcaaatggagtttcatgaacaaaccatccgatggcaggccgaagtacctgtgcgtgaacgccgacgagggtgagccgggcacatgcaaggaccgggagatcatgcgccatgacccccacaagttggtcgagggctgccttatcgctggtcgagccatgggtgctcaggccgcctacatctacattcgcggcgagttctacaacgaggcgtccaacatgcaggttgccatcagtgaggcgtaccaggcgggactgattggcaagaacgcatgtggcacaggcttcgactttgacgtgtacatgcacaggggcgcaggcgcctacatctgcggcgaggagacggcgctcatcgagtcgatcgagggcaaacagggcaagccccgcctcaagccccccttccccgccgatgtcggtctcttcggctgccccaccactgtcaccaatgtggagacggtcgccgttgcaccgacaatctgtcgtcggggcggcgcgtggttcgcgtcgttcggtcgtccgcgcaacacgggcaccaaactgttcaacatctcgggccatgtgaaccggccgtgcaccgtcgaggaggagatgtcggtgccgctgcgggagctgatcgaacggcatgcgggaggagtgaggggcggatgggataatctgctcgccgtcataccgggcggatcgtcgacaccgcttataccgaaacgtgtgtgcgacgacgtgctgatggactttgacgcgttgatcgcggccgagacgagtttcggcacggcggccgtcatcgttatggacaagagcaccgacatcattaaggcgatcgcacgactgatcgtgttctacaagcacgagtcgtgcggccagtgcacgccgtgtcgcgagggcatcgcctggatgcacaagatgatgcagcgatttgtgaagggtgacgcgaggccggctgaaattgacatgctgtgggagatcagcaagagattgagggacacactatttgcgcgctgggtgacggggctgcggtggccggtacagggcttgattcgtcacttcagaccagaaatcgagaacagaatgaaggcagttttctga

SEQ ID NO: 39361 - protein, 462 aa, Nilaparvata lugens
MASALSLCRIGHLQKVNLCPVLSTVQVRSNSDAAPTKTKYGPLNDSDRIFTNLYGRHDWRLKGALKRGDWYKTKEIVLKGADFIINEVKASGLRGRGGAGFPSGLKWSFMNKPSDGRPKYLCVNADEGEPGTCKDREIMRHDPHKLVEGCLIAGRAMGAQAAYIYIRGEFYNEASNMQVAISEAYQAGLIGKNACGTGFDFDVYMHRGAGAYICGEETALIESIEGKQGKPRLKPPFPADVGLFGCPTTVTNVETVAVAPTICRRGGAWFASFGRPRNTGTKLFNISGHVNRPCTVEEEMSVPLRELIERHAGGVRGGWDNLLAVIPGGSSTPLIPKRVCDDVLMDFDALIAAETSFGTAAVIVMDKSTDIIKAIARLIVFYKHESCGQCTPCREGIAWMHKMMQRFVKGDARPAEIDMLWEISKRLRDTLFARWVTGLRWPVQGLIRHFRPEIENRMKAVF

SEQ ID NO: 39362 - DNA, 1296 bp, uncultured bacterium 463
  CDS (1)..(1296)
atgagcctgactacacctctcacccgcaatgtgcgcgatgaccgccgtcctactgacatggctgcctacgaagccaacggcggctaccagggtctgcgggcggcacttgctcagtcgccagaagattgcctgcaagttcttaaagactctaatctccgtggccgcggtggtgcaggctttccgacgggaatgaagtggagcttcgttcctatgggcgacaagtgcagcccggggcataaatacctgatctgcaacgccgatgaaatggaaccgggcacctttaaagatcgactattattggaatgcgacccccatcagcttatcgaaggcatgatcgtttccgcttatacattgcaggccgatgtcgcctatatttttattcgcgctgagtatcatcaagccacgcgcctgctgcaggaagcaattgccgcctgtcatgagaaaggttatctgggacaagatatcctcgggacgggctatcaacttgagatgcacgtccactcgagcgcagggcgctacatctgcggcgaggaaaccgcattgatcagctcattggaaggtaagcgagccaacccccgagcgaagcctcctttcccccaggtgagcggtctgtgggggcgaccaactatcgtcaacaacgtggaaacattgtgtaacgtccatcacatcattgaacgcggtgccgagtggttcaagtcgctaggactgaccgaagatgccggcaccaaattgtatggcgttagcggccgggtcaagaacccagggtgctgggagctgccaatgggtacaccggtacgccagatcatcgaggagtacgccggcggcatggaagacggctacaacctcaagggttttcttcccggaggtggctctaccgatttcttgactgaggagcatctggacctggcgatggactatgacaccattggcaaggccggttcacgcatgggcactggcaccatgattattctggacgacaaaacctgtccagtcggttttgtcaaaaacctggtggcgttttttgcacgtgagtcctgtggcttctgcaccccctgccgggatggactgccctggtcggcccaggtattagacgatatccagaatggccgcggccaggaagaagacatggacaccctggcgcgtcaggtgaagtttattggcgctatcggcaacacccattgcgcgctcgcgcccggggcgatggaacctctgcaaagcgcaatgaaatactttccggaagcctttgaaaatcacctgagcggcaactgtccccactgtaacgggggaactcactaa

SEQ ID NO: 39363 - protein, 431 aa, uncultured bacterium 463
MSLTTPLTRNVRDDRRPTDMAAYEANGGYQGLRAALAQSPEDCLQVLKDSNLRGRGGAGFPTGMKWSFVPMGDKCSPGHKYLICNADEMEPGTFKDRLLLECDPHQLIEGMIVSAYTLQADVAYIFIRAEYHQATRLLQEAIAACHEKGYLGQDILGTGYQLEMHVHSSAGRYICGEETALISSLEGKRANPRAKPPFPQVSGLWGRPTIVNNVETLCNVHHIIERGAEWFKSLGLTEDAGTKLYGVSGRVKNPGCWELPMGTPVRQIIEEYAGGMEDGYNLKGFLPGGGSTDFLTEEHLDLAMDYDTIGKAGSRMGTGTMIILDDKTCPVGFVKNLVAFFARESCGFCTPCRDGLPWSAQVLDDIQNGRGQEEDMDTLARQVKFIGAIGNTHCALAPGAMEPLQSAMKYFPEAFENHLSGNCPHCNGGTH

SEQ ID NO: 39364 - DNA, 1455 bp, Chlamydomonas reinhardtii
  CDS (1)..(1455)
atgcagcgcaccggtggtctggttagccagcttgcgggagcgcagctgactggcgcgctgcaggagctgaagactggggtgcttcgggccttcagcactgccgctcccgcggctggtgctccccctccgcctcctccgcctcctgctaagaccagctttggtggtctgaaggatgaggaccgcattttccagaacatttacggtcgccatgacctcagcatcaagggcgccatgtcccgtggcgactggtacatgaccaaggagatcatcgggaagggccgggactggatcatcgaccaaatgaagaagtcgggactgcgcggccgcggcggcgccggcttcccctccggcctcaagtggagcttcatgcccaaggcctctgacagccgccccatctacctggtggtgaacggcgacgagtcggagccgggcacgtgcaaagaccgcgagatcatgcgccacgagccgcacaagctggtggagggctgcctcatggcgggagtggccatgggcgcgcgcgcaggctacatctacatccgtggcgagttcgtgcaagagcgccgcgctgtggagcgcgccattagcgaggcgtacgccaagggcttcctgggcaagaacgcgtgcggcagcggtgtggactttgacctgatggtgcactacggcgccggcgcctacatctgcggcgaggagacggcgctgatcgagtcgctggagggcaagcagggcaagccccgcctcaagcccccgttccccgcgggtgtgggcctgtacggctgccccaccaccgtgaccaatgtggagaccgttgcggtgagccccaccattctgcgccgcggccccgagtggttcagctcttttggccgcaagaacaacgccggcaccaagctgttctgcatcagcggccacgtgaaccggccggtgacggtggaggaggagatgtccattccgctcaaggagctcatcgagcgccacgcgggcggtgtgcgcggcggctgggacaacctgctggccatcatccccggaggcagctccgtgccgctgctgcccaagaagatctgcgacggcgtgctgatggacttcgacgcgctcaaggaggcgcagtcgggcctgggcaccgccgccgtcatcgtcatggacaagtccaccgacgtgatcgacgccatcgcgcgcctgtcctacttctacaagcacgagtcgtgcggccagtgcacgccctgccgcgagggcaccggctggctgtacgacatcatgacgcgcatgaagaagggtgacgcccgcctggaggagatcgacatgctgtgggagatcaccaagcagatcgagggacacaccatctgcgcgctgggcgacgccgcggcgtggcccgtgcagggcctgatccgccacttccgtggcgagatggaggagcgcatcaagagcgccggcggcaagaagaagcttgccgcgaccgcgtaa

SEQ ID NO: 39365 - protein, 484 aa, Chlamydomonas reinhardtii
MQRTGGLVSQLAGAQLTGALQELKTGVLRAFSTAAPAAGAPPPPPPPPAKTSFGGLKDEDRIFQNIYGRHDLSIKGAMSRGDWYMTKEIIGKGRDWIIDQMKKSGLRGRGGAGFPSGLKWSFMPKASDSRPIYLVVNGDESEPGTCKDREIMRHEPHKLVEGCLMAGVAMGARAGYIYIRGEFVQERRAVERAISEAYAKGFLGKNACGSGVDFDLMVHYGAGAYICGEETALIESLEGKQGKPRLKPPFPAGVGLYGCPTTVTNVETVAVSPTILRRGPEWFSSFGRKNNAGTKLFCISGHVNRPVTVEEEMSIPLKELIERHAGGVRGGWDNLLAIIPGGSSVPLLPKKICDGVLMDFDALKEAQSGLGTAAVIVMDKSTDVIDAIARLSYFYKHESCGQCTPCREGTGWLYDIMTRMKKGDARLEEIDMLWEITKQIEGHTICALGDAAAWPVQGLIRHFRGEMEERIKSAGGKKKLAATA

SEQ ID NO: 39366 - DNA, 1611 bp, Thiocapsa roseopersicina
  CDS (1)..(1611): transl_table=11
atgaacctcgacgatctgaccgacctggccgagaaataccgggaagccgaagccggcgtggatcgcgaggtgcgtgtctgcctcgcggccagctgtcagtcatccggtgccgtccccgtcttcgatgcactggtcgccgagctcggcgacaccaaaccctcctgcaaggtcaaaggggtcgggtgtatgggcctatgttcggccgggccgctggtcgctgtcgccgatcgcgaggcggacctccaaggctccgtgctctatcgcgacgtgaccgcggacgacgccgaggacatcgtcgccagcatcgatggcccgcctgtggagcgcttacgttgtccgaccaatcagcccttcttcgcgcgtcagcagaagatcgtgctcgaaaatgccggcatcatcgatcccgacagtttcaagggctatgtcgccgtcggcggatactccgcgctgatccgggccttaagcgagatgacccccgccgatgtcttgcgcgaagtgaccgacagcggtctgcgcggacgcggcggcggcggctatccgaccggcttgaaatggtcgaccgtcgcgaagatgccggcgacccagaaatacgtcatctgcaacgcggacgagggcgacccgggcgccttcatggaccgggcgatcctggagtcagacccgcatcgtgtccttgagggcatggcgatcgccgcctacgcgatcggggccaacaaggcctatgtctatgtccgcgccgagtacccgctcgcggtcgagcgacttcagacggccattcgcaaagccaagcgctcggggcttttgggcaacaagatcggcgatacccaattcagcctggaggtagagatccgcctcggcgccggggccttcgtctgcggcgaagaaaccgcactcatggcctccatcgaaggactacgtggacaaccgcgcccgcgtccgccgtaccccgccgaggcgggactctggggctaccccacgctcatcaacaacgtcgagaccttcgccaacatcgccccgatcgtgcgcgaggggggcgattggttcgcctcgatcggcaccgaacgatcgaaagggaccaaggtgtttgcgctggccggaaccatcacgaacaccggcctcatcgaggtcccgatgggcacctctctgcgcgacatcatcgaggtcatcggcgggggcatcccaggcggcaaggctttcaaggccgtgcagaccggcggcccctcgggcggttgtatcccggcgcagcacctcgacatcgccgtggactacgacagcctcaaaacgctcggcaccatgatgggctcaggcggcatgatcgtcatggacgagacctccagcatggtcgacgtcgcacgctatttcatggaattctgcatgaccgaatcgtgcggaaagtgcatcccctgccgcaccgggacgcaacagatgcacagcatcctcgaccggctggccaagtcgcaggccacacgggccgagctcacactgctggaagagctctgcgaagtggtgcaggcaaccagcctctgcggactgggccagacggcgcccaatcccgtgctgagtaccatgcgctatttccgcgacgaatacgaagcgaagctcggcgaggtttag

SEQ ID NO: 39367 - protein, 536 aa, Thiocapsa roseopersicina
MNLDDLTDLAEKYREAEAGVDREVRVCLAASCQSSGAVPVFDALVAELGDTKPSCKVKGVGCMGLCSAGPLVAVADREADLQGSVLYRDVTADDAEDIVASIDGPPVERLRCPTNQPFFARQQKIVLENAGIIDPDSFKGYVAVGGYSALIRALSEMTPADVLREVTDSGLRGRGGGGYPTGLKWSTVAKMPATQKYVICNADEGDPGAFMDRAILESDPHRVLEGMAIAAYAIGANKAYVYVRAEYPLAVERLQTAIRKAKRSGLLGNKIGDTQFSLEVEIRLGAGAFVCGEETALMASIEGLRGQPRPRPPYPAEAGLWGYPTLINNVETFANIAPIVREGGDWFASIGTERSKGTKVFALAGTITNTGLIEVPMGTSLRDIIEVIGGGIPGGKAFKAVQTGGPSGGCIPAQHLDIAVDYDSLKTLGTMMGSGGMIVMDETSSMVDVARYFMEFCMTESCGKCIPCRTGTQQMHSILDRLAKSQATRAELTLLEELCEVVQATSLCGLGQTAPNPVLSTMRYFRDEYEAKLGEV

SEQ ID NO: 39368 - DNA, 1854 bp, Leptospirillum ferrooxidans
  CDS (1)..(1854)
atgttaaccgaggtgcttgaagattcttctttgcagctggaagagcgttcatccctgccggtcattcatatcggaatggctacttgtggtttggcatcaggggcgaaagctttgcacgagttaatcctgaaagaagttgcttccagaaatctggctgttaaggttgttccaaccggttgtatcggaatgtgtcacaacgaacctcttgtagatataaccatgccaggtaaaaacagggtttcttacaggaatgtcaaacccaataccctgacacaaatccttgatgcgcacttcaataaaaatgaatttgcaaaaaaatatgctgtttgccagattcctgttcctggtgcagagccttttgccggactgccattgatgcaggagattccattttttaagggacaggtaaagattgtttccaaaccgttgggaatgatcgacccattgagcattgatgactatattgcaatggacgggtatgcagcattaagaaaagttctttcatcgatgactcccgaacaggttattgatgaggtaacaaaatcagggcttcgcggaagagggggcggtggttttcccactggtgtgaagtggaatttgacgcgtaaggctcccggtcctgaaaaatacgttgtttgtaatgctgatgagggtgatcccggtgcgtttatggacagatccgttctggaaggtgatccccattctgtcatagaagggatgatccttgccgcttttgcagtcgggcatgcccgtaagggatatatctactgccgtgccgagtatcccctggctatcaaacgattacagaaagcgatcaatgatgccagggagagaaattttctgggagacaacattttaggatctgacctgtcttttgacctcgagatcaaggagggagcaggtgcctatgtatgcggtgaggaaacggctcttcttgcctcccttatgggggaacgcggaatgccatggcccaaacccccttttcctgctcaaaaaggagtctggggaaagccgtcagttattaataacgttgaaacactggcaaacatcggccatatcattctgggcggtggtgaatggtatgcatcctatggaagtgaaaaaaccaaagggacaaaaacctttgcgctcacaggctcaattaaaaatactggcctgatcgaggttcccgcaggaacccccttgagagagattgttttttccattggcggcggaatggttgagaagaagataccgttcaaggcagcccagctgggtgggccgtctggaggatgtattcccacaagcggacttgatacacccgttgattttgaaaatgttgtttcggcgggcgcaatcatgggttcgggcggaatcgttgttatggatgaggcagcctgtattgtggacactgccaagttctttctgaagtttacccaggatgagtcttgtggggaatgtactccctgcagggtaggctcaaaaattatgctggatatcctgactcgcattaccgaaggtaaggggcaggaaggggacctcgatgagctggtccgtctttccatgtatatcaagtccaactctctctgcggacttggtggagcagctccaaacccggttctctcaactattcgatatttcagggaagagtacgaggcacatattcgggacaagcgttgtccgggtaccgtatgtaacgatctgatcaagtatgttgtgattgaggaagattgtacgacctgcgggctttgcgagccagtatgtccatccggatcggtgacatgggaaaaaggtgaggttgcgcatatagatctcacgacatgcattcgctgcaaggcttgtgtcgatgcctgcaaattcagggctatcatttag

SEQ ID NO: 39369 - protein, 617 aa, Leptospirillum ferrooxidans
MLTEVLEDSSLQLEERSSLPVIHIGMATCGLASGAKALHELILKEVASRNLAVKVVPTGCIGMCHNEPLVDITMPGKNRVSYRNVKPNTLTQILDAHFNKNEFAKKYAVCQIPVPGAEPFAGLPLMQEIPFFKGQVKIVSKPLGMIDPLSIDDYIAMDGYAALRKVLSSMTPEQVIDEVTKSGLRGRGGGGFPTGVKWNLTRKAPGPEKYVVCNADEGDPGAFMDRSVLEGDPHSVIEGMILAAFAVGHARKGYIYCRAEYPLAIKRLQKAINDARERNFLGDNILGSDLSFDLEIKEGAGAYVCGEETALLASLMGERGMPWPKPPFPAQKGVWGKPSVINNVETLANIGHIILGGGEWYASYGSEKTKGTKTFALTGSIKNTGLIEVPAGTPLREIVFSIGGGMVEKKIPFKAAQLGGPSGGCIPTSGLDTPVDFENVVSAGAIMGSGGIVVMDEAACIVDTAKFFLKFTQDESCGECTPCRVGSKIMLDILTRITEGKGQEGDLDELVRLSMYIKSNSLCGLGGAAPNPVLSTIRYFREEYEAHIRDKRCPGTVCNDLIKYVVIEEDCTTCGLCEPVCPSGSVTWEKGEVAHIDLTTCIRCKACVDACKFRAII

SEQ ID NO: 39370 - DNA, 1560 bp, Methylobacterium extorquens
  CDS (1)..(1560): transl_table=11
gtgagcatcaccgtttacgtcccgcaggacgccgtcgccctcgggctcggtgccaaccgcgtcgcccgggcgatcttcgccggtgccgagcggcgcggtctcgacgtgcgcatcgtccgcaccggcacccgcggcctgctctggctcgagccgatggtcgaggtcgcgacccctgagggccgcatcgcctacggtccggtgaccccggccgatgtcgagggcctgctcgatgccgggctcaccgaggggggcgaacacgcgctccgcctcggcaagccggaagaaattccgttcctggccaagcagcaccggctcactttccaccgctgcggcgtggtcgatccggtctcggtcgaggattaccgggcccatggcggctaccgtggtttggaggccgcgctgaagctcgacgccaagggcatcgtcgcccaggtgcgcgattcgggactgcgcgggcgcggcggtgccggcttcccggccggcatcaagtggaacacggtgatgctggcccagtcggaccagaaatacgtggtctgcaacgccgacgagggcgattccggcaccttcgccgaccggatcatgatggagggtgaccccttcaacctgatcgagggcatgaccatcgccgccgtcgcgaccggcgccactcgcggctacatctactgccgctcggagtacccgcagagcttcaagaccctgcgcgacgccatcgccaacggcgtgcgggccggcgtcctcggcgacaacattctgggctccggcaagagcttccacctggaagtgcggctgggcgccggcgcctatatctgcggcgaggaaacctcgctgctggagagccttgagggcaagcgcggcatcgtccgggccaagccgccgatcccggcgctgaagggctttctcggcaagccgacgctggtcaacaacgtcatgaccttcacggccgtgccgtacatcctggagcacggcgccaagtcttacgccgagtacggcatgggccgctcgctcggcaccctgccgatccaactcgccggcaacatccggcagggcggcctgatcgagtacgccttcggcatcaccatccggcaggtgatcgaggatttcggcggcggcacggcctcggaccggccggtccgcgcggtgcaggtcggcggcccgctcggggcctacttccccgacgacttgctcgacacgccgctggattacgaggcgatggcggccaagaagggcctcgtcggccatggcggcatcgtcgtgttcgacgacaccgtggacatggccaagcaggctcgcttcgccttcgagttctgcgccaccgaatcctgcggcaagtgcaccccctgccgggtcggcgccacccgcggcgtcgagaccatggacaaggtcatctccggcatccgcccggaggccaatctcaagctcgtcgaagatctctgcgagatcatgaccgacggctcgctctgcgccatgggcggcctgacgcccatgcccgtgatgagcgcgatcaccaacttccccgaggattttcggcgcgcgggcgatctgcccgtcgcggccgagtga

SEQ ID NO: 39371 - protein, 519 aa, Methylobacterium extorquens
MSITVYVPQDAVALGLGANRVARAIFAGAERRGLDVRIVRTGTRGLLWLEPMVEVATPEGRIAYGPVTPADVEGLLDAGLTEGGEHALRLGKPEEIPFLAKQHRLTFHRCGVVDPVSVEDYRAHGGYRGLEAALKLDAKGIVAQVRDSGLRGRGGAGFPAGIKWNTVMLAQSDQKYVVCNADEGDSGTFADRIMMEGDPFNLIEGMTIAAVATGATRGYIYCRSEYPQSFKTLRDAIANGVRAGVLGDNILGSGKSFHLEVRLGAGAYICGEETSLLESLEGKRGIVRAKPPIPALKGFLGKPTLVNNVMTFTAVPYILEHGAKSYAEYGMGRSLGTLPIQLAGNIRQGGLIEYAFGITIRQVIEDFGGGTASDRPVRAVQVGGPLGAYFPDDLLDTPLDYEAMAAKKGLVGHGGIVVFDDTVDMAKQARFAFEFCATESCGKCTPCRVGATRGVETMDKVISGIRPEANLKLVEDLCEIMTDGSLCAMGGLTPMPVMSAITNFPEDFRRAGDLPVAAE

SEQ ID NO: 39372 - DNA, 1416 bp, Xenopus laevis
  CDS (1)..(1416)
atgctttccctaagacatatagtgagaattcctcttccctctcctgcttccaccattgttcttgccagattcaactctagtggacctgatcagactccaaaaaagacaaaatttggacctcttagtgacgaagatcgaatatttaccaacttatatggacgtcatgactggggattgaaaggtgctttaagtagaggagactggtacaagaccaaggagattttgttgaagggagtagactggattcagggtgaggttaaaacttctggcctgcgtggcagaggaggagctggcttcccaacaggtcttaaatggagctttatgaataaaccatcagatggaaggcccaaatatcttgtagtcaatgcagatgaaggtgaacctggaacatgtaaggatcgggagatcatgagacacgacccccacaaacttgtggagggttgtctagttgctggacgtagcatgggagctcgtgcagcatacatctacattcgaggagaattctacaatgaagcatccaatctacaggtagctgtgcgggaggcatactctgcggggcttattgggcgtaatgcctgtggctcagggtatgattttgatgtgtttgtggtgagaggcgctggggcatacatctgtggtgaagagactgcattgattgagagcattgaaggaaaacaaggaaaaccccgccttaagcctccctttcctgctgatgttggtgtttttggttgtccaacaacagttgccaatgtggaaactgttgcagttgccccgaccatttgcaggcgtggaggttcctggtttgctagctttggtcgtgaaagaaactctggtaccaaactgttcaacatatcgggacatgtaaacaatccatgtactgtggaggaagaaatgtctataccacttaaagagctcattgaaaggcatgcaggaggagttactggtggctgggataatcttcttgctgtaatccccggaggctcctccacaccacttataccacgatctgtgtgtgaaacagttcttatggattttgatgctctagtccaggctcagactggtcttggtacagcagcgatcattgtcatgaataaatcaactgacattgtccgtgcaattgcacgccttattgaattctacaaacatgagagctgtggtcagtgtactccctgcagggaaggtgttgactggatgaacaaagttatgtggcgtatgtgtcgaggtgatgcccatgtagatgagatcgacatgttgtgggagattagcaagcagattgaaggacacaccatttgtgcattgggagatggggctgcctggcctgtccagggtttgattcgtcatttccgccctgagttggagcagcgcatgaaactttttgacaccgcaaagagacagcaagctagcaaaacattttag

SEQ ID NO: 39373 - protein, 471 aa, Xenopus laevis
MLSLRHIVRIPLPSPASTIVLARFNSSGPDQTPKKTKFGPLSDEDRIFTNLYGRHDWGLKGALSRGDWYKTKEILLKGVDWIQGEVKTSGLRGRGGAGFPTGLKWSFMNKPSDGRPKYLVVNADEGEPGTCKDREIMRHDPHKLVEGCLVAGRSMGARAAYIYIRGEFYNEASNLQVAVREAYSAGLIGRNACGSGYDFDVFVVRGAGAYICGEETALIESIEGKQGKPRLKPPFPADVGVFGCPTTVANVETVAVAPTICRRGGSWFASFGRERNSGTKLFNISGHVNNPCTVEEEMSIPLKELIERHAGGVTGGWDNLLAVIPGGSSTPLIPRSVCETVLMDFDALVQAQTGLGTAAIIVMNKSTDIVRAIARLIEFYKHESCGQCTPCREGVDWMNKVMWRMCRGDAHVDEIDMLWEISKQIEGHTICALGDGAAWPVQGLIRHFRPELEQRMKLFDTAKRQQASKTF

SEQ ID NO: 39374 - DNA, 1719 bp, Methylobacterium extorquens
  CDS (1)..(1719): transl_table=11
atgagtgaggcaagtgggactgtccggagcttcgcgcatccgggccgtggccgtaacgtcgcccgcgccgtgccgaaggggcgtcaggtcgatccccacgccaaggtcgagatcgaggagctgctcggcacccgcccgcgccagcgcgacctgctgatcgagcacctgcacctgatccaagacacctacggccagatcagcgccgatcatctcgcggcgctggccgacgagatgagcctcgccttcgccgaggtgttcgagaccgcgaccttctacgcgcatttcgatgtggtgaaggagggcgaggccgacatcccgcgcctgacgatccgggtttgcgacagcatcacctgcgccatgttcggcgccgacgagctgctggagacgctgcagcgcgagctggcctcggatgcggtccgcgtcgtgcgcgcgccctgtgtcggcctgtgcgaccacgccccggcggtcgaggtcgggcacaacttcctgcaccgggccgacctcgcctccgtgcgcgccgcggtcgaggccgaggacacccacgcccacatccccacttacgtcgattacgacgcctaccgggccggcggcggctacgcgaccctggagcggctgcgcagcggcgaactgccggtcgatgacgtgctgaaggtgctcgacgacggcggcctgcgcggcctcggcggcgccggctttcccaccggccgcaagtggcgctccgtgcgcggcgagcccggaccccggctgatggcggtcaacggcgacgagggcgagcccggcaccttcaaggatcagctctacctcaacaccgatccgcaccgctttctggaaggcatgctgatcggcgcccacgtcgtcgaggccgccgacgtctacatctacctgcgcgacgagtacccgatctcccgcgagatcctggcccgcgagatcgcgaagctccccgagggcggcacccgcatccacctgcgccgtggggccggcgcctatatctgcggcgaggaatcctcgctgatcgagtcgctggagggcaagcgcggcctgccgcggcacaagccgcccttccccttccaggtcggcctgttcaaccggccgacgctgatcaacaacatcgagacgctgttctgggtgcgcgacctgatcgagcgcggcgccgaatggtggaagagccacgggcgcaacggccgcgtcggcctgcgctcgtactcggtttcgggccgggtcaaggagccgggcgtcaagctcgcgcccgccggcctgaccatccaggaactcatcgacgagtattgcggcggcatctctgacggccacagcttcgcggcctacctgccgggcggagcctcgggcggcatcctgccggcctcgatgaacgacatcccgctcgatttcggcacgctggaaaaatacggctgcttcatcggctcggccgcggtcgtgatcctgtccgatcaggacgatgtgcgcggtgccgcgttgaacctgatgaagttcttcgaggacgagtcctgcgggcagtgcacgccctgccgctcgggcacgcagaaggcccgcatgctgatggagaacggcgtgtgggacaccgatctcctcggcgagctggcgcaatgcatgcgcgacgcctcgatctgcggtctcggtcaggcggcctcgaaccccgtcagcaccgtgatcaagtacttccctgatctcttcccggagccgcgggccgtggcggccgagtga

SEQ ID NO: 39375 - protein, 572 aa, Methylobacterium extorquens
MSEASGTVRSFAHPGRGRNVARAVPKGRQVDPHAKVEIEELLGTRPRQRDLLIEHLHLIQDTYGQISADHLAALADEMSLAFAEVFETATFYAHFDVVKEGEADIPRLTIRVCDSITCAMFGADELLETLQRELASDAVRVVRAPCVGLCDHAPAVEVGHNFLHRADLASVRAAVEAEDTHAHIPTYVDYDAYRAGGGYATLERLRSGELPVDDVLKVLDDGGLRGLGGAGFPTGRKWRSVRGEPGPRLMAVNGDEGEPGTFKDQLYLNTDPHRFLEGMLIGAHVVEAADVYIYLRDEYPISREILAREIAKLPEGGTRIHLRRGAGAYICGEESSLIESLEGKRGLPRHKPPFPFQVGLFNRPTLINNIETLFWVRDLIERGAEWWKSHGRNGRVGLRSYSVSGRVKEPGVKLAPAGLTIQELIDEYCGGISDGHSFAAYLPGGASGGILPASMNDIPLDFGTLEKYGCFIGSAAVVILSDQDDVRGAALNLMKFFEDESCGQCTPCRSGTQKARMLMENGVWDTDLLGELAQCMRDASICGLGQAASNPVSTVIKYFPDLFPEPRAVAAE

SEQ ID NO: 39376 - DNA, 1605 bp, Synechococcus sp
  CDS (1)..(1605): transl_table=11
atgacggatttagcggaattgtttgaaattgcggaagcggaacaggacagccacacaaaaattcagattcgctgttgtacggcggcgggttgtatgtcctccggcagtttggcggtgaaggaggaactggaaaaacagattaaggaaaaaaatttgggtgatcgcctggaggtggttcccgtcggttgtatgaaactctgtggctttgcgccgttggtggatgtgagcgatgagacttgtttccagcaggtgatgccagaagttgccccagagatcgtcgatgtagcattgggggaaacgccctcggataagctggaaatttgcgatcgccaagcgccatttttcacgttacaaaaacccgtggtgctggaaaatagcggcaaaattgaccccgaacggattgaagcgtacattgcgcggggcggctatcggtcattgcaccaagtgctcgaagatctgaccccgatggcggtggtggaagaaattacccagagcggcctacgggggcgtggcggcggcggctatcccacgggattgaaatgggcgaccgtcgcgaaaatgccgggggatcaaaaatatgtcgtctgtaacgccgacgaaggggatccgggggcatttatggatcgggcggtgctcgaaagtgacccccaccgggttctcgaagggatggcgatcgccggctatgccgtgggcgcaaaccacggatatatttacattcgggcagaatatcccctcgcgatccaacgcctcgaaaaagcaatcaaacaagccaaaagtaagggtttactcggtagccagatttttaattcccccttcaatttcaccatcgacatccgcattggcgcaggggcattcgtttgtggcgaagaaaccgccctaattgcctccatcgaaggcggacggggaacccccagacccagacccccctaccccgcccagtccggactgtggggacatcccaccctaatcaacaacgttgaaacctacgccaacatcgtcccgatcatccgtgaaggggcagactggtttagcagcatcggcaccgaaaaaagcaaaggcacaaaagtctttgccctcaccggaaaagtgaaaaataatggcttgatcgaagtgccgatgggaacccccgtccggcaaattgtcgagcaaatgggcggtggcatccccgacagtggcacagtcaaatctgtccaaaccggagggccctctggcggttgtattccggcggactaccttgatacgcccatcgaatatgattctttgatcaaactcggcacaatgatgggttccggcggcatgatcgttatggacgaagccactaacatggttgatgtggcgaagttttacatggaattttgccagtgcgaatcctgcggtaaatgtatcccctgccgtgccggaacggtgcagatgtcgggactgttaagcaaaatgctcaagggacaggctgaacccaaggacattgaactgctcgaacaactttgtcacatggtcaaggaagcaagtttatgtgggttaggacagagtgcgcccaatccaattttgagtaccctgcgctatttccgcgcggaatatgatgccctcgtggggagtaacgccgattaa

SEQ ID NO: 39377 - protein, 534 aa, Synechococcus sp
MTDLAELFEIAEAEQDSHTKIQIRCCTAAGCMSSGSLAVKEELEKQIKEKNLGDRLEVVPVGCMKLCGFAPLVDVSDETCFQQVMPEVAPEIVDVALGETPSDKLEICDRQAPFFTLQKPVVLENSGKIDPERIEAYIARGGYRSLHQVLEDLTPMAVVEEITQSGLRGRGGGGYPTGLKWATVAKMPGDQKYVVCNADEGDPGAFMDRAVLESDPHRVLEGMAIAGYAVGANHGYIYIRAEYPLAIQRLEKAIKQAKSKGLLGSQIFNSPFNFTIDIRIGAGAFVCGEETALIASIEGGRGTPRPRPPYPAQSGLWGHPTLINNVETYANIVPIIREGADWFSSIGTEKSKGTKVFALTGKVKNNGLIEVPMGTPVRQIVEQMGGGIPDSGTVKSVQTGGPSGGCIPADYLDTPIEYDSLIKLGTMMGSGGMIVMDEATNMVDVAKFYMEFCQCESCGKCIPCRAGTVQMSGLLSKMLKGQAEPKDIELLEQLCHMVKEASLCGLGQSAPNPILSTLRYFRAEYDALVGSNAD

SEQ ID NO: 39378 - DNA, 1461 bp, Arabidopsis thaliana
  CDS (1)..(1461): n means a or g or c or t/u, s means g or c
atggcacccgtgagggggattcttggcttgcaaagggcagtgtccatttggaaggaaagtaacagactgactccagctttgagatcattcagcactcaagctgcatccacttccaccactccacagcctcctccacctcctccgcctccggaaaagactcatttcggtggtctcaaggatgaagatcggatttttactaatctctatggtctgcatgacccatttctcaaaggcgcgatgaagagaggtgattggcataggaccaaagatttggtgctcaagggtactgattggattgtcaatgaaatgaagaaatctggacttcgtggacgtggtggtgctggtttcccttctggtcttaagtggtcctttatgcctaaagtttctgatggccgtccctcctatttggttgtcaatgctgatgagagtgagcctggaacttgtaaagatagggagatcatgcgtcatgaccctcacaaattgttggaagggtgtttgattgctggtgttggaatgagagctagtgctgcgtatatttacatcaggggtgaatatgtgaatgagcgtttgaatctagagaaggctagaagagaagcgtatgcagctggtctcttggggaagaatgcatgtggttctggttatgattttgaagtttatatccactttggtgctggtgcgtacatttgtggtgaagagactgcgcttcttgaaagccttgaagggaagcaaggaaaacctaggttgaagcctccgttccctgctaatgctggtttatatggttgtcccacaactgttaccaatgtggaaacagtggctgtttcgcctaccattttaaggcgtggacctgagtggttttctagtttcggtaggaagaataacgctgggacaaagctcttttgtatatcavgccatgtaaacaagccatgcacggtggaagaggagatgagtatacctctcaaggaactgattgagaggcattgtggaggtgttaggggtggatgggacaatctacttgctatcatccctggtggttcatctgttcctctgatccctaagaacatttgcgaggatgtgctgatggatttcgatgcgctcaaggctgtccaatcagggttaggaactgcagcagtcattgtgatggataaatcaaccgatgttgtggatgcaattgcaaggctctcttacttctacaagcatgaaagctgtgggcagtgcactccttgcagagagggaacaggttggctttggatgatcatggagagaatgaaagttggcaatgcaaagctggaagagattgatatgctgcaggaggtaaccaaacagatcgaaggacacacaatctgtgcattgggtgatgcagctgcatggcctgtgcaaggtctgataagacactttaggccagagctcgagagaaggatcagggaacgcgctgaaagggagttgctacaggctgctgcttaa

SEQ ID NO: 39379 - protein, 486 aa, Arabidopsis thaliana
  Xaa in position 303 is unknown
MAPVRGILGLQRAVSIWKESNRLTPALRSFSTQAASTSTTPQPPPPPPPPEKTHFGGLKDEDRIFTNLYGLHDPFLKGAMKRGDWHRTKDLVLKGTDWIVNEMKKSGLRGRGGAGFPSGLKWSFMPKVSDGRPSYLVVNADESEPGTCKDREIMRHDPHKLLEGCLIAGVGMRASAAYIYIRGEYVNERLNLEKARREAYAAGLLGKNACGSGYDFEVYIHFGAGAYICGEETALLESLEGKQGKPRLKPPFPANAGLYGCPTTVTNVETVAVSPTILRRGPEWFSSFGRKNNAGTKLFCISXHVNKPCTVEEEMSIPLKELIERHCGGVRGGWDNLLAIIPGGSSVPLIPKNICEDVLMDFDALKAVQSGLGTAAVIVMDKSTDVVDAIARLSYFYKHESCGQCTPCREGTGWLWMIMERMKVGNAKLEEIDMLQEVTKQIEGHTICALGDAAAWPVQGLIRHFRPELERRIRERAERELLQAAA

SEQ ID NO: 39380 - DNA, 1389 bp, Drosophila melanogaster
  CDS (1)..(1389)
atgttgcggcagaagcttaaaaactatttaccgtctgtttgggaacagcaactgcgtctcgtccaaactgccaagaaagcgggaggtagcaaaaagctgggtcccgataggcctcccattatcgatccgcccaagggatatgagcccaattgcaagaccaaatttggtccgctggacgattgtgatcgtgtgtttcagaatctctatggacgccacgattggcgcttgcatggagcatgccaacgtggggattggcatcgcaccgctgagttgctggagcagggtcccgaatggatcatgaagcagtgggaatttctacgccagaccaagtccgagaaggtgcccaaaatggtcatcgtgaactgtgcagagggagagcccggaacctgcaaggaccgtgatatcctgcgacatgaaccccacaaactgatagaaggtatccttctggtaggtgtggccatgggatgcggtagagccattgtgtacattcgaaatcgcttctacaacgaggcctgcaacctgcactttgccttggcggaggcctatcatcatggtttgttgggaaacagtgtctgtggcacgggcatcaagttcgatgtgatggtccagcgtggagatcggtacttatgtggcgaggaaaccgccatgatcaactgtttgatgggtaaactgggaagaccacgacgtcgtccgcccttccttacggaaaagggctacttcgagcatcccagtttggtaatcaatgccgagtcgattgcagtagtgcccaccattctgcgaagaggttcacagtggtgggctggattgggtcgcagttacaacacgggaaccaaactttactgtctcagcggtcaggtgaataatccctgcactgtggaggaagaaatgtccatacccctgaaggaccttatagaacgacatgctggtggagtaaaaggtggttgggacaatctcgcagcagtatttccaggtggtttgtccacgccattgttggatccatcaactgccggaaaggttctcatggatttcgatagtttgacggatgcaggcagtggtttcgggtgcggagcggttattgtgatgaccaaggactgtgatcctctggcaataatgttgcgatcaattcagtttttcgaaaagcacacttgcaaacagtgctcctattgtcgcgatggtgccatatggctgccggagatattcgcccgctttgttaagggtcagacacatccccacgagatcgattggacgctggtcattgccgataaaatgaggaatagtaagcccatttgcgcactcgcttatagccaagtcagcgtggccgaaagtttggtgcgaatgtttagccggcagatcgaggaacgccttttaaaatatgccaagggatcttaa

SEQ ID NO: 39381 - protein, 462 aa, Drosophila melanogaster
MLRQKLKNYLPSVWEQQLRLVQTAKKAGGSKKLGPDRPPIIDPPKGYEPNCKTKFGPLDDCDRVFQNLYGRHDWRLHGACQRGDWHRTAELLEQGPEWIMKQWEFLRQTKSEKVPKMVIVNCAEGEPGTCKDRDILRHEPHKLIEGILLVGVAMGCGRAIVYIRNRFYNEACNLHFALAEAYHHGLLGNSVCGTGIKFDVMVQRGDRYLCGEETAMINCLMGKLGRPRRRPPFLTEKGYFEHPSLVINAESIAVVPTILRRGSQWWAGLGRSYNTGTKLYCLSGQVNNPCTVEEEMSIPLKDLIERHAGGVKGGWDNLAAVFPGGLSTPLLDPSTAGKVLMDFDSLTDAGSGFGCGAVIVMTKDCDPLAIMLRSIQFFEKHTCKQCSYCRDGAIWLPEIFARFVKGQTHPHEIDWTLVIADKMRNSKPICALAYSQVSVAESLVRMFSRQIEERLLKYAKGS

SEQ ID NO: 39382 - DNA, 1794 bp, Eubacterium acidaminophilum
  CDS (1)..(1794): transl_table=11
atggattataaaaacactattttggtttgtgcgggaactggatgtatgtcttcttcttcacttaaaatacttaagagactagaggaccttatggctgagaagggtattcttgagcagactaagattgtaaagactggctgctttggactttgctctgtaggaccgatagtaatagtataccctgaaggcgcattctacgctcacgttcaggaagaagatgcagacagaatagttaacgagcacctgataggcggcaaaatagtaaaagaccttctttacaaggaagctttgcttgaaaacggagaaataagaccttttgaggaggttcctttctacaacaagcaggtgaggatagcgcttgagcattgcggacgtatacaggctgaagacataaacgactatattgaaactgcagaaggctacgaggcaatcaaaaaagctataacaaaaatgacaagagaagatgtaatagaggaaatcaaaagatcaggccttagaggaagaggcggcggcggcttccctacaggactcaagtggcagttcgcatacaatgcgccgggagatcaaaaatacgttatatgtaacgctgacgaaggtgacccgggagcattcatggacagatcagtgcttgaaggagaccctcacgctgtaatagaggccatgatgataactggttacgccataggagctaaccacggatatatatatataagagccgagtatcctgttgctataaagagacttgagatagcattggcacaggcaagagagtcaggataccttggcaagaatgtaatgggaacagattttgaatttgacatcgagctgaaactcggagccggagctttcgtatgcggtgaggagactgctcttatcaactctatagaaggaaaacgtggaatggcaaatccaaagccaccgttcccggcaaacgaaggcgtatggaaaaaacctacaataataaacaacgtagagacgcttgcaaacgttccaaagataatacttaaaggagcagactggtttgcttcaataggaactgaaaaatctaagggaactaaggttttcgctcttggcggaaagataaacaacgttggactagttgaggttccaatgggaactacactaagagagataatatatgaagtaggcggaggaattccaaacggcaaggcgttcaaagccgttcaaaccggaggaccatcaggaggatgtataacagctgactatcttgacactcaaatagatttcgactcgcttaccgctctaggttctatgatgggttcaggcggtatgatagttatggacgaagacaactgcatggttgacatagccaaattcttccttgactttacagtggaagagtcatgcggaaaatgtactccttgtagagaaggcacaaagagaatgcttgaaatacttgagagaatatcagagggacatggaactcttgaagaccttgacaagcttgaaagacttgcaaatacaatcaagtcaactgctctttgcggacttggacagacagctccaaacccagtactttcaactcttaaatacttcagagatgagtacgtggctcacgttgttgacaagaagtgcccagcgggggtttgtacagcgcttctagagtacttcataacagacaagtgcataggctgtactaagtgcgctagagtgtgtccggttactgctataagcggcaaggttaaggaaaagcacgtaatagatacagataagtgcataaagtgcggcgcttgtatggatgcttgtcctgtaaacgctataattaagaaataa

SEQ ID NO: 39383 - protein, 597 aa, Eubacterium acidaminophilum
MDYKNTILVCAGTGCMSSSSLKILKRLEDLMAEKGILEQTKIVKTGCFGLCSVGPIVIVYPEGAFYAHVQEEDADRIVNEHLIGGKIVKDLLYKEALLENGEIRPFEEVPFYNKQVRIALEHCGRIQAEDINDYIETAEGYEAIKKAITKMTREDVIEEIKRSGLRGRGGGGFPTGLKWQFAYNAPGDQKYVICNADEGDPGAFMDRSVLEGDPHAVIEAMMITGYAIGANHGYIYIRAEYPVAIKRLEIALAQARESGYLGKNVMGTDFEFDIELKLGAGAFVCGEETALINSIEGKRGMANPKPPFPANEGVWKKPTIINNVETLANVPKIILKGADWFASIGTEKSKGTKVFALGGKINNVGLVEVPMGTTLREIIYEVGGGIPNGKAFKAVQTGGPSGGCITADYLDTQIDFDSLTALGSMMGSGGMIVMDEDNCMVDIAKFFLDFTVEESCGKCTPCREGTKRMLEILERISEGHGTLEDLDKLERLANTIKSTALCGLGQTAPNPVLSTLKYFRDEYVAHVVDKKCPAGVCTALLEYFITDKCIGCTKCARVCPVTAISGKVKEKHVIDTDKCIKCGACMDACPVNAIIKK

SEQ ID NO: 39384 - DNA, 1068 bp, Homo sapiens
  CDS (1)..(1068)
atgaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttag

SEQ ID NO: 39385 - protein, 355 aa, Homo sapiens
MKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 39386 - DNA, 1470 bp, Candida tropicalis
  CDS (1)..(1470): transl_table=12
atgcttcgcaatttcaaaatacagcctcgtacaatggtacgtggattagccactgcagctgatccagcatctatcccaaatagagtacatggaggattaaaagatcaagatcgtatatttcaaaatgtctatggtaactatggccatgacttaaaatcagcacaaaaaatgggtgattggtataaaaccaaagaaatcatattgaaaggtgataaatggattatcgatgaaatgaagaaatctggtttaagaggtagaggtggtgcaggtttcccatctggtttgaaatggtcattcatgaacccacctggttgggaaaagaatgtaggtccaagatatttggttgtcaatgcagatgaaggggaaccaggtacttgtaaagatagagaaattattagaaaagatccacataaattggttgaagggtgtttgttggctggtagagccatgaatgctactgctgcttatatttatattagaggagaattctacaatgaaactgtaattttacaaaatgccattaacgaagcttacaaagccggtttaattggtaagaacgcttgtggatcaggttatgattttgatgtctatattcaccgtggtatgggtgcttatgtctgtggtgaagaaaccgctttgattgaatctatcgaaggtaaagctggtaaaccaagattaaagcctcctttcccagctggtgttggtttatttggtagaccaaccactgttgccaatgttgagagtgtttccgtcgccccaactattttaagaagaggtggtgattggtttgcttcttttggtcgtgaaagaaactctggtactaaattgttctgtatttctggtcacgtcaatgaaccatgtactgttgaagaagaaatgtctattccattaaaagaattgttagaaaagcactgtggtggtatcaaaggtggttgggataacttgttgggtgttattccaggtggttcttctgttccaattatgccaaaagaaacctgtgaccacgttttgatggattacgatgctttaagagatgttggttccggtttaggtaccgcagctgtcattgtcatgaacaaacaaactgatattataagagccattcaaagattctcccatttctataaacatgaatcctgtggtcaatgtactccatgtcgtgaaggtactacttggttgcaaagaatgatggatagattttacaaaggtcaagccactgaaaaagaaattgatatgattttcgaattaaccaaagaaatcgaaggtcacaccatttgtgccttgggtgatgctgctgcttggccagtgcaaggtttgatcaaatcattcagaccagttatggttgacagaattaaacaattccaagaacaacacgccggtgataagattgaatatggnggttgggtngaaggtggtaaagtaaaagacggtgttgttgttgacaacccaatgccatctgctcatcattaa

SEQ ID NO: 39387 - protein, 489 aa, Candida tropicalis
MLRNFKIQPRTMVRGLATAADPASIPNRVHGGLKDQDRIFQNVYGNYGHDLKSAQKMGDWYKTKEIILKGDKWIIDEMKKSGLRGRGGAGFPSGLKWSFMNPPGWEKNVGPRYLVVNADEGEPGTCKDREIIRKDPHKLVEGCLLAGRAMNATAAYIYIRGEFYNETVILQNAINEAYKAGLIGKNACGSGYDFDVYIHRGMGAYVCGEETALIESIEGKAGKPRLKPPFPAGVGLFGRPTTVANVESVSVAPTILRRGGDWFASFGRERNSGTKLFCISGHVNEPCTVEEEMSIPLKELLEKHCGGIKGGWDNLLGVIPGGSSVPIMPKETCDHVLMDYDALRDVGSGLGTAAVIVMNKQTDIIRAIQRFSHFYKHESCGQCTPCREGTTWLQRMMDRFYKGQATEKEIDMIFELTKEIEGHTICALGDAAAWPVQGLIKSFRPVMVDRIKQFQEQHAGDKIEYGGWVEGGKVKDGVVVDNPMPSAHH

SEQ ID NO: 39388 - DNA, 1626 bp, Anabaena variabilis
  CDS (1)..(1626): transl_table=11
atggatctatcagagttaattgaaattgcccaaaaagaacgtgcttctgaaaaacccgtacaaattcgctgttgtgttgctgctggttgtttgtctgcaaattcacaagccgtcaaagaacgtctagaagaaactgtaacggcaaaaaatttaacggcaaaagtggaagttcgcggtgttggctgtatgcgtttgtgttgtcaagggccattagtcgaagtcaggagtcaggaggagtctcagcaatttccacaaaaaaaattgtatgaaaaagtaacgcctgatgatgcaccttcaattgttactgctgtgaatggggaagagacaacagttaaacaaggaaatttaagtcatccattttttacatatcaaatgccgattgttttagaaaacagtggcaaagtcgatccagaacgcattcaatcttacattgccgcccaaggttatcgatcgctttaccatgtcttgcgggagatgacagccaatgaagtggtggataccattacccgcagtggtttacgaggacgtggtggtgctggttatcccacgggtttgaaatgggcaacggtggcgaaagcacaaggagaacgcaaatttgtcatctgtaacgccgatgaaggagatcccggtgcgtttatggatcgcagcgtcctagaaagcgatccccatcgcgttttagaaggaatggcgatcgctgcctatgccgtacgcaaacaaggctacatctacatccgggcagaatatcctgttgccatcaatcgcctgcaaactgcaattcgccaagcccaacgtctggggattttgggtactcaaatttttgattctcgctttgattttaaaattgatattcgtatcggtgctggcgcttatgtttgtggtgaagaaactgctttaatggcttccattgaaggtaaacgcggtacacctcatccccgcccgccttatccggccgagtctggtttatggggttatcctactttaattaataatgtcgaaacctatgccaatgttgcaccaattatccgtaaaggtgctgaatggttcgccagtattggcacagaaaaaagcaaaggtacaaaggtttttgccttggcaggtaaaatccgtaacacgggtttaattgaagtaccaatgggaacttcattgaagcaaattgtagaagcaatgggtggtggcgtgccagataatggtgtagtcaaagccgtgcaaactggtggcccttccggaggatgtattcccgcatcagcttttgagagcatagtggattatgaatcactgactcaactcggctcaatgatgggttccggtggcatgattgtcatggatgaaaccaccaacatggtggatgtcgcccgcttttttatggaattttgcatggatgaatcttgcggtaaatgtattccttgtcgggtaggaacggtgcagttacataaattgttaaccaagattagtcaaggtaaagcatccttagctgacttggaactgttagaagaattatgcgatatggtgaaaaacaccagcttgtgcggtcttggtcaatctgcaccaaatccagtatttagtaccttgcgttattttcgcgatgaatatttggccctatgcgctattcctgacctcaacaaataa

SEQ ID NO: 39389 - protein, 541 aa, Anabaena variabilis
MDLSELIEIAQKERASEKPVQIRCCVAAGCLSANSQAVKERLEETVTAKNLTAKVEVRGVGCMRLCCQGPLVEVRSQEESQQFPQKKLYEKVTPDDAPSIVTAVNGEETTVKQGNLSHPFFTYQMPIVLENSGKVDPERIQSYIAAQGYRSLYHVLREMTANEVVDTITRSGLRGRGGAGYPTGLKWATVAKAQGERKFVICNADEGDPGAFMDRSVLESDPHRVLEGMAIAAYAVRKQGYIYIRAEYPVAINRLQTAIRQAQRLGILGTQIFDSRFDFKIDIRIGAGAYVCGEETALMASIEGKRGTPHPRPPYPAESGLWGYPTLINNVETYANVAPIIRKGAEWFASIGTEKSKGTKVFALAGKIRNTGLIEVPMGTSLKQIVEAMGGGVPDNGVVKAVQTGGPSGGCIPASAFESIVDYESLTQLGSMMGSGGMIVMDETTNMVDVARFFMEFCMDESCGKCIPCRVGTVQLHKLLTKISQGKASLADLELLEELCDMVKNTSLCGLGQSAPNPVFSTLRYFRDEYLALCAIPDLNK

SEQ ID NO: 39390 - DNA, 1356 bp, Pseudomonas fluorescens
  CDS (1)..(1356): transl_table=11
atgaccctgacttccttcgggcccgccaaccgcatccagcgttcggccgaaacccatcccctgacctggcgcctgcgtgacgacggcgaagcggtatggctggacgagtaccaggccaagaacggctacgccgctgcgcgcaaggcgttcagcgacatggcccaggacgacatcgtccagaccgtgaaagactccggcctcaagggccgtggcggcgcgggcttccccacgggtgtgaagtggggcctgatgcccaaggacgaatccatcaacatccgctacctgctgtgcaacgcggatgaaatggagcccaacacctggaaagaccgcatgctgatggagcaactgccccatctgctgatcgaaggcatgctgatcagcgcccgcgcgctgaaaacctaccgtggctatatcttcctgcgtggcgaatacaccaccgccgccaagcacctgaaccgtgccgtggaagaagccaaggccgccggcctcttgggcaagaacatcctgggctcgggctttgatttcgagctgttcgtccacaccggtgccggacgctacatctgcggtgaagaaaccgcactgatcaactccctggaaggccgtcgcgccaacccacgttccaagccgcccttccctgccgctgtaggcgtgtggggcaagccgacctgcgtgaacaacgtcgagaccctgtgcaacgtgccggcgatcatcgccgacggcgtggactggtacaaatccctggcccgtgacggcagcgaagacatgggcaccaagctcatgggcttctccggcaaggtcaagaaccctggcctgtgggaactgccgttcggcgtcaccggccgcgagctgttcgaagactatgctggcggcatgcgcgacggctacaagctcaagtgctggcagcctggcggcgccggtaccgggttcctgttgccggaacacctggacgcccaaatgtacgccggcggcatcgccaaggtcggcacccgcatgggcaccggcctggccatggcggtggacgacagcgtgaacatggtgtcgctgctgcgcaacatggaagagttcttctcccgtgagtcgtgcggtttctgcaccccttgccgcgatggcctgccatggagcgtcaagctgctgcgggcccttgaaaacggcgaaggccaggccggcgacattgagaccctgctgggtctggtgggtttcctcggcccaggcaagaccttctgtgctcacgcaccgggtgccgtggagccgttgggcagcgcgatcaaatacttccgtccagagttcgaagccggcatcgcgcccaccagcgccgtcgtcccgcctctggcaaagccgatcgtagtcggcgcgtaa

SEQ ID NO: 39391 - protein, 451 aa, Pseudomonas fluorescens
MTLTSFGPANRIQRSAETHPLTWRLRDDGEAVWLDEYQAKNGYAAARKAFSDMAQDDIVQTVKDSGLKGRGGAGFPTGVKWGLMPKDESINIRYLLCNADEMEPNTWKDRMLMEQLPHLLIEGMLISARALKTYRGYIFLRGEYTTAAKHLNRAVEEAKAAGLLGKNILGSGFDFELFVHTGAGRYICGEETALINSLEGRRANPRSKPPFPAAVGVWGKPTCVNNVETLCNVPAIIADGVDWYKSLARDGSEDMGTKLMGFSGKVKNPGLWELPFGVTGRELFEDYAGGMRDGYKLKCWQPGGAGTGFLLPEHLDAQMYAGGIAKVGTRMGTGLAMAVDDSVNMVSLLRNMEEFFSRESCGFCTPCRDGLPWSVKLLRALENGEGQAGDIETLLGLVGFLGPGKTFCAHAPGAVEPLGSAIKYFRPEFEAGIAPTSAVVPPLAKPIVVGA

SEQ ID NO: 39392 - DNA, 1143 bp, Yarrowia lipolytica
  CDS (1)..(1143)
atggagggtccccgatatctggttgtcaacgccgatgagggagagcccggaacctgcaaggaccgagaaattatgcgaaaggatccccacaagctcgtcgagggctgtctgctggccggccgagccatgaacgccaccgcagcctacatctacattcgaggcgagttctacaacgaggccgccgtgctgcagaccgccatcaacgaggcttacgccgccggtctcatcggtaaggacgcctgtggctccggctacgattttgacgtgtacatccaccgtggaatgggtgcctacgtctgcggagaggagacctctctgatcgagtctctggagggcaaggctggtaagccccgtctcaagcccccgttccctgccggtgtcggtctgttcggccgaccctccaccgtcactaacgtcgagaccgtggccgtggctcctaccattctgcgacgaggaggagactggtttgcctcctttggccgagagcgaaactccggaaccaagcttttctgtatctccggaaacgtcaacgaaccctgcacagtcgaggaggagatgtccatccctctgcgagagcttctggagaagcactgcggcggaatcaagggtggctgggacaacttactgggtgtgattcccggtggatgctccgtccccattctccccaagaacatttgtgaggacgttctgatggactttgacgccctcaaggacgtgcagtccggtctgggaaccgctgctgtcattgtcatcaacaagcagcaggatgtcattcgagccatccagcgtttcgcagccttctacaagcacgagtcgtgtggtcagtgcaccccctgccgagagggaactacctggctgctcaaggccatggaccgattccgaaccggccaggccaaggagcgggagattgacatgctgtacgagctgactaaggacattgagggccacaccatttgcgctctcggtgatgccgccgcatggcctatccagggtctcattcgaaacttccgaccggaaatggagactcgaatgaagaagttccacgacgaggttggtgctgtttctgtcggtggctggatgaaggacgcacgagtggagaagggtaaggttgttggagcccctcttcccggcgttcatcattag

SEQ ID NO: 39393 - protein, 380 aa, Yarrowia lipolytica
MEGPRYLVVNADEGEPGTCKDREIMRKDPHKLVEGCLLAGRAMNATAAYIYIRGEFYNEAAVLQTAINEAYAAGLIGKDACGSGYDFDVYIHRGMGAYVCGEETSLIESLEGKAGKPRLKPPFPAGVGLFGRPSTVTNVETVAVAPTILRRGGDWFASFGRERNSGTKLFCISGNVNEPCTVEEEMSIPLRELLEKHCGGIKGGWDNLLGVIPGGCSVPILPKNICEDVLMDFDALKDVQSGLGTAAVIVINKQQDVIRAIQRFAAFYKHESCGQCTPCREGTTWLLKAMDRFRTGQAKEREIDMLYELTKDIEGHTICALGDAAAWPIQGLIRNFRPEMETRMKKFHDEVGAVSVGGWMKDARVEKGKVVGAPLPGVHH

SEQ ID NO: 39394 - DNA, 1296 bp, Paracoccus denitrificans
  CDS (1)..(1296): transl_table=11
atgctgaacgatcaggaccggatctttacgaacctttacggcatgggcgaccgcagcctggccggcgcgaaaaagcgcggccattgggacggcaccgccgcgatcatccagcgcgggcgcgacaagatcatcgacgagatgaaggcctcgggcctgcgcggccgtggcggcgccggcttcccgaccggcatgaaatggtccttcatgcccaaggaatcggacggccgcccctcttacctggtcatcaatgccgacgaatccgagcccgcgacctgcaaggaccgcgagatcatgcgccacgatccgcacacgctgatcgagggcgcgctgattgccagcttcgccatgggcgcccatgccgcctatatctatatccgcggcgagttcatccgcgagcgcgaggcgctgcaggccgccatcgacgaatgctacgacgcgggccttctgggccgcaatgccgccggttcgggctgggatttcgacctatacctgcatcacggcgccggcgcctatatctgcggcgaggaaaccgcgctgctggaatcgctggaaggcaagaagggcatgccgcgcatgaagccgcccttcccggcgggcgcgggcctttacggctgcccgaccacggtgaacaacgtcgaatcgatcgccgtggtgccgaccatcctgcgccgcggcgccgagtggttcgccagcttcggccggccgaacaatgcgggcgtgaagctgttcggcctgaccggccatgtcaacactccttgcgtggtcgaagaggccatgtcgattcccatgcgcgagctgatcgaaaagcatggcggtggcatccgcggcggctggaagaacctcaaggcggtgatccccggcggcgcttcctgcccggtgctgaccgccgagcaatgcgaaaacgccatcatggactatgacggcatgcgcgacgtgcgctcgtccttcggcaccgcctgcatgatcgtcatggaccagtcgaccgacgtggtgaaggcgatctggcggctgtccaagttcttcaagcacgaaagctgcggccagtgcaccccctgccgcgaaggcaccggctggatgatgcgggtgatggagcgcttggtgcgcggcgatgccgaggtcgaggaaatcgacatgctcttcgacgtgaccaagcaggtcgaaggccataccatctgcgccttgggcgatgcggcggcctggccgatccagggcctgatccgcaatttccgcgaagagatcgaggaccgcatcaaggccaagcgcaccggccgcatgggcgcgatggcggcggagtaa

SEQ ID NO: 39395 - protein, 431 aa, Paracoccus denitrificans
MLNDQDRIFTNLYGMGDRSLAGAKKRGHWDGTAAIIQRGRDKIIDEMKASGLRGRGGAGFPTGMKWSFMPKESDGRPSYLVINADESEPATCKDREIMRHDPHTLIEGALIASFAMGAHAAYIYIRGEFIREREALQAAIDECYDAGLLGRNAAGSGWDFDLYLHHGAGAYICGEETALLESLEGKKGMPRMKPPFPAGAGLYGCPTTVNNVESIAVVPTILRRGAEWFASFGRPNNAGVKLFGLTGHVNTPCVVEEAMSIPMRELIEKHGGGIRGGWKNLKAVIPGGASCPVLTAEQCENAIMDYDGMRDVRSSFGTACMIVMDQSTDVVKAIWRLSKFFKHESCGQCTPCREGTGWMMRVMERLVRGDAEVEEIDMLFDVTKQVEGHTICALGDAAAWPIQGLIRNFREEIEDRIKAKRTGRMGAMAAE

SEQ ID NO: 39396 - DNA, 1317 bp, Thermus thermophilus
  CDS (1)..(1317): transl_table=11
atgactggccccattctttccggactggacccccggtttgaaaggaccctctacgcccacgtggggaaggaggggtcctggaccctggactactacctccggcacggggggtacgagacggcgaagcgggtgctcaaggagaagaccccggacgaggtcatagaggaggtgaagcgctccgggcttaggggccggggcggggcgggcttccccacggggcttaagtggagcttcatgcccaaggacgacgggaagcagcactacctcatctgcaacgccgacgagtccgagcccgggagcttcaaggaccgctacatcctggaggacgtcccccacctcctcattgaggggatgatcctcgccgggtacgccatccgggccacggtgggctacatctacgtccgcggggagtaccgcagggcggcggaccggctagaacaagccatcaaggaggcccgggcccggggctacctggggaagaacctcttcggcacggacttctcctttgacctccacgtccaccggggggccggggcctacatctgcggcgaggagacggccctcatgaactccctggagggcctaagggcgaacccccgcttgaagccccccttccccgcccagtcgggcctttggggcaagcccaccaccatcaacaacgtggagaccctggcctccgtggtgcccatcatggaacggggcgccgactggttcgcccagatgggcacggagcagtccaaggggatgaagctctaccagatctccgggcccgtgaagcgccccggggtgtacgagctccccatgggcaccacgttccgcgagctcatctacgagtgggcgggtgggcccctggagcccatccaggccatcatccccggggggtcctccaccccgcctctgcccttcaccgaggaggtcctggacacccccatgagctacgagcacctccaggccaagggctccatgctggggacggggggcgtgatcctcatccccgagcgggtgagcatggtggacgccatgtggaacctcacccgcttctacgcccacgagtcctgcggcaagtgcaccccctgccgcgagggcgtggcggggttcatggtgaacctcttcgccaagatcggcaccggccagggggaggagaaggacgtggagaacctggaagccctcctccccctcattgaggggcggagcttctgccccttggcggacgcggcggtgtggccggtgaagggctcgctaaggcacttcaaggaccagtacctggccctggcgcgggagaagcgccccgtgcccaggccttccctctggaggtga

SEQ ID NO: 39397 - protein, 438 aa, Thermus thermophilus
MTGPILSGLDPRFERTLYAHVGKEGSWTLDYYLRHGGYETAKRVLKEKTPDEVIEEVKRSGLRGRGGAGFPTGLKWSFMPKDDGKQHYLICNADESEPGSFKDRYILEDVPHLLIEGMILAGYAIRATVGYIYVRGEYRRAADRLEQAIKEARARGYLGKNLFGTDFSFDLHVHRGAGAYICGEETALMNSLEGLRANPRLKPPFPAQSGLWGKPTTINNVETLASVVPIMERGADWFAQMGTEQSKGMKLYQISGPVKRPGVYELPMGTTFRELIYEWAGGPLEPIQAIIPGGSSTPPLPFTEEVLDTPMSYEHLQAKGSMLGTGGVILIPERVSMVDAMWNLTRFYAHESCGKCTPCREGVAGFMVNLFAKIGTGQGEEKDVENLEALLPLIEGRSFCPLADAAVWPVKGSLRHFKDQYLALAREKRPVPRPSLWR

SEQ ID NO: 39398 - DNA, 1535 bp, Bos taurus
  CDS (79)..(1473)
aattcgcgtctgagcctcagagctgtgaaggtgacagcgggcggtcactggcttgcctttcctccccccatccccgcgatgctggcggcacggcggctgctcggcgggtcgctccccgcgcgggtgtctgtgcgattcagcggcgacacgacagcgcccaagaaaacctcatttggctcgctgaaggacgaagaccggatcttcaccaacctgtatggccgccatgactggaggcttaaaggtgcccagagtcgaggtgactggtacaagacgaaggagattctgctgaaggggcctgactggatcctgggtgaggtcaagacgtcgggcttgcggggccgtggaggtgctggcttccccactggccttaaatggagcttcatgaataagccctcagatggcaggcccaagtatctggtggtgaacgcggatgagggggagccaggcacgtgcaaggaccgagagatcatccgccacgacccccacaagctggtggaaggctgcctagtagggggccgggccatgggcgctcgtgccgcctacatctacatccgcggggagttctacaacgaggcctccaatctgcaggtagccatccgagaggcctacgaggctggtctgattggcaagaatgcctgcggctccggctacgatttcgacgtgtttgtggtgcgtggggccggggcctacatctgcggggaggagacggcgctcatcgagtccatcgagggcaaacagggcaagccccgcctgaagccgcctttccctgcagacgtgggagtgtttggctgccctacaactgtggccaatgtggagactgtggccgtgtcccctaccatctgccgccgtgggggtgcctggtttgccagcttcggccgagagcgcaactcaggcaccaaactgttcaacatctctggccacgtcaacaacccctgcaccgtggaggaggagatgtctgtgccgctgaaggagctgattgaaaagcacgccgggggtgtcacgggtggctgggacaacctccttgctgtgatccctggcggctcgtccaccccgctgatccccaagtccgtgtgtgagacggtgctgatggacttcgacgcgctgatccaggcgcagacggggctgggcacggctgccgtgatcgtcatggaccgctcgacggacattgtgaaagccatcgcccgcctcatcgagttctacaagcatgagagctgtggccagtgtaccccgtgccgcgagggtgtggactggatgaacaaggtgatggcccgctttgtgaggggagatgcccggccggcagagatcgactctctgtgggagatcagcaagcagatcgagggccacaccatctgcgccctgggcgatggggctgcgtggcccgtgcagggcctgatccgacacttccggccggagctcgaggagcggatgcagcagtttgcccagcagcaccaggccaggcaagcagctttctgagcccacggggctggtgtccgtctgtctggatggctggacaataaagctagcgatacccactc

SEQ ID NO: 39399 - protein, 464 aa, Bos taurus
MLAARRLLGGSLPARVSVRFSGDTTAPKKTSFGSLKDEDRIFTNLYGRHDWRLKGAQSRGDWYKTKEILLKGPDWILGEVKTSGLRGRGGAGFPTGLKWSFMNKPSDGRPKYLVVNADEGEPGTCKDREIIRHDPHKLVEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGAWFASFGRERNSGTKLFNISGHVNNPCTVEEEMSVPLKELIEKHAGGVTGGWDNLLAVIPGGSSTPLIPKSVCETVLMDFDALIQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQQFAQQHQARQAAF

SEQ ID NO: 39400 - DNA, 1395 bp, Homo sapiens
  CDS (1)..(1395)
atgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttag

SEQ ID NO: 39401 - protein, 464 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 39402 - DNA, 1395 bp, Macaca fascicularis
  CDS (1)..(1395)
atgctggcagcacggcggctgctcggcgggtcgctcccctctcgggtatctgtgcgtttcagcggcgacacgacagcacccaagaaaacctcatttggctcgctgaaggatgaagaccggatcttcaccaacctgtacggccgccatgactggaggctgaaaggtgccctgagtcgaggtgactggtacaagacaaaagagatcctgctgaaggggcccgattggatcctgggtgagatcaagacatcgggtttgcggggccgtggaggcgctggcttccccactggcctcaagtggagcttcatgaataagccctcagatggcaggcccaagtatctggtggtgaacgcagacgagggggagccaggcacctgcaaggaccgggagatcatacgccatgatcctcacaagctggtggaaggctgcctggttgggggccgggccatgggtgcccgcgccgcctatatctacatccgaggggaattctacaatgaggcctccaatctgcaggtggccatccgagaggcctatgaggcaggtctgattggcaagaatgcctgtggatctggctatgattttgacgtgtttgtggtgcgcggggctggggcctacatctgtggagaggagacagcgctcatcgagtccatcgagggcaagcagggcaagccccgcctgaagccccccttccctgcagacgtgggagtgtttggctgccccacaactgtggccaacgtggagacagtggcagtgtcccccaccatctgccgccgtgggggcacctggtttgctggctttggcagagagcgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgattcctggtggctcgtctactccactgatccccaagtctgtgtgtgagacggtgctgatggacttcgacgcgctggtgcaggcacagacaggcttgggcacagctgcggtgatcgtcatggaccgctcgacggacatcgtgaaagccatcgcccgcctcattgagttctataagtacgagagctgtggccagtgcaccccatgccgcgagggtgtggactggatgaacaaggtgatggctcgtttcgtgaggggggacgcccggccggccgagattgactccctgtgggagatcagcaagcagatagaaggccacaccatttgtgctctgggtgacggggctgcctggcctgtgcagggtctgatccgccactttcggccggagcttgaggaacggatgcagcggtttgcccagcagcatcaggcccggcaggctgcctcttag

SEQ ID NO: 39403 - protein, 464 aa, Macaca fascicularis
MLAARRLLGGSLPSRVSVRFSGDTTAPKKTSFGSLKDEDRIFTNLYGRHDWRLKGALSRGDWYKTKEILLKGPDWILGEIKTSGLRGRGGAGFPTGLKWSFMNKPSDGRPKYLVVNADEGEPGTCKDREIIRHDPHKLVEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKYESCGQCTPCREGVDWMNKVMARFVRGDARPAEIDSLWEISKQIEGHTICALGDGAAWPVQGLIRHFRPELEERMQRFAQQHQARQAAS

SEQ ID NO: 39404 - DNA, 1395 bp, Mus musculus
  CDS (1)..(1395)
atgctagcggcacggcattttctcggcgggttggttcccgtgcgggtatctgtgcgtttcagcagcggcacgacagcacccaagaaaacctcatttggctcactgaaggatgaagaccggatctttaccaacctgtatgggcgccatgactggaggctgaaaggtgccctgagacggggtgactggtacaagacaaaggagatcctgctgaaggggcctgactggatcttgggtgagatgaagacatcaggtttacggggccgtggtggtgctggcttccccactggcctcaagtggagcttcatgaataagccctcagatggcaggcccaagtatctggtggtgaatgctgacgagggagagccaggcacctgtaaggaccgagagatcatgcgtcatgaccctcacaagctggtggaaggctgccttgtgggaggccgggccatgggagcccgggccgcctatatctacatccgaggggaattctacaacgaggcctccaatttgcaggtagctatccgagaggcctatgaagcaggtctgattggcaagaatgcttgtggctccgactatgattttgatgtgtttgtggtgcgtggggctggggcctacatctgtggagaagagacggcacttattgaatccattgaaggcaagcagggaaagccacgcctgaagccgccctttccagcagatgtgggagtgtttggatgccccacaactgtggccaatgtggagacagtggctgtgtcccccaccatttgccgtcgtgggggcacctggtttgctggctttggccgagaacgcaattcaggtaccaaattgtttaacatctctggccatgtcaaccacccctgcactgtggaggaagagatgtctgtgccactgaaagagctgattgagaaacatgctggtggtgtcacaggtggctgggacaacctccttgctgtgattcctggtggctcatctactccactgattcccaaatctgtgtgtgagaccgtgctaatggacttcgatgcactggtgcaggctcagacaggcctgggcacggctgcagttattgttatggatcgctcgacagacattgtgaaagccatcgctcgtctcattgagttctacaagcatgagagctgtggccagtgtaccccgtgccgtgagggcgttgactggatgaacaaggtgatggcccgatttgtgaagggagatgcccggccagctgagattgactccctgtgggagatcagcaagcagatagaaggccacaccatttgtgctctgggtgatggggctgcctggccagtacagggtctgatccgacatttcaggccagagcttgaggatcggatgcaacggtttgcccagcagcaccgggcctggcaggcagcctcgtga

SEQ ID NO: 39405 - protein, 464 aa, Mus musculus
MLAARHFLGGLVPVRVSVRFSSGTTAPKKTSFGSLKDEDRIFTNLYGRHDWRLKGALRRGDWYKTKEILLKGPDWILGEMKTSGLRGRGGAGFPTGLKWSFMNKPSDGRPKYLVVNADEGEPGTCKDREIMRHDPHKLVEGCLVGGRAMGARAAYIYIRGEFYNEASNLQVAIREAYEAGLIGKNACGSDYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVKGDARPAEIDSLWEISKQIEGHTICALGDGAAWPVQGLIRHFRPELEDRMQRFAQQHRAWQAAS

SEQ ID NO: 39406 - DNA, 1482 bp, Neurospora crassa
  CDS (1)..(1482)
atgctttcacgtaccgcggcgcccaccaaggcgtcggccaggaccctctcgcgcgccgccgccgagcaatgccgcacctttgcgaccgtccaagatggctctgccaatcccgtacgccactacggcggtctcaaggaccaggatcgcatcttccagaacctctacggccgttacccgcccgacctgaagcatgcgaaaaagatgggcgactggcacaagaccaaggagattctcctcaagggtcacgactggatcattggcgaggtcaaggcctctggtcttagaggccgtggtggagctggtttcccctcgggactcaaatggtcgttcatgaacttcaaggattgggacaaggacgacaagccccgttatctggtcgtcaatgccgatgagggtgagccgggtacctgcaaggaccgcgagatcatgcgcaaggatccccacaaacttgtcgaaggctgcttggtcgccggccgtgccatgaacgccaccgctgcctacatctacatccgcggcgagttcatccaggaggctgccatcttacagaacgccatcaacgaggcttatgctgatgggcttatcggaaagaacgcctgcggctcaggctacgatttcgatgtctacctccaccgcggtgccggtgcctatgtgtgcggcgaggagaccagcttgatcgagtctcttgagggcaagcccggaaaaccccgtctgaagcctcctttccctgccgccgtcggtctgttcggttgcccttcgactgttgccaacgtcgagactgtcgctgtcgctcccaccatctgccgccgcggtggcaactggtttgccggcttcggccgtgagcgcaaccagggtaccaagcttttctgcatcagcggccacgtcaacaacccctgcactgtcgaggaggagatgagcatcccgatgcgtgagcttattgataagcactgcggcggtgtccgcggtggctgggacaaccttttggccgtcattcccggtggatcctcaacacctatcctgcccaagcacatctgcgatacccagttgatggacttcgatgcgctcaaggacagccagtccggtctgggtaccgccgcccttatcgtcatggacaagagcactgatgtcgtccgcgccatttcccgactaagccacttctaccgccatgaatcctgcggccagtgcacaccttgccgtgaaggcagcaagtggactgagcagattatgaagcgtttcgagaagggtcagggccgcgagagggagattgatatgctccaggagttgactaagcaggttgaaggtcacactatttgcgctctcggcgaagcttttgcctggcctattcaaggcctcatccgccacttccggcccgagctggaggcccgtatacggaagtttgcccaggagaacggtggtgaggctcttgccggtggctggcaacgcaatgccagacaacagggcaagctcgtctcgcctggcatgtaa

SEQ ID NO: 39407 - protein, 493 aa, Neurospora crassa
MLSRTAAPTKASARTLSRAAAEQCRTFATVQDGSANPVRHYGGLKDQDRIFQNLYGRYPPDLKHAKKMGDWHKTKEILLKGHDWIIGEVKASGLRGRGGAGFPSGLKWSFMNFKDWDKDDKPRYLVVNADEGEPGTCKDREIMRKDPHKLVEGCLVAGRAMNATAAYIYIRGEFIQEAAILQNAINEAYADGLIGKNACGSGYDFDVYLHRGAGAYVCGEETSLIESLEGKPGKPRLKPPFPAAVGLFGCPSTVANVETVAVAPTICRRGGNWFAGFGRERNQGTKLFCISGHVNNPCTVEEEMSIPMRELIDKHCGGVRGGWDNLLAVIPGGSSTPILPKHICDTQLMDFDALKDSQSGLGTAALIVMDKSTDVVRAISRLSHFYRHESCGQCTPCREGSKWTEQIMKRFEKGQGREREIDMLQELTKQVEGHTICALGEAFAWPIQGLIRHFRPELEARIRKFAQENGGEALAGGWQRNARQQGKLVSPGM

SEQ ID NO: 39408 - DNA, 1305 bp, Rhizobium meliloti
  CDS (1)..(1305): transl_table=11
atgcttagagatgaagatcgcatctttaccaacatctacggcctcaaggacaagtcgctgaggggcgcgatggcgcgcggccattgggacggcacgaagcagttcctcgaaaagggccgcgactggatcatcaacgaggtgaaggcctccggccttcgcggccgcggcggcgccggcttcccgaccggtctcaaatggtccttcatgccgaaggaaagcgacgggcgcccccattatctcgtcgtcaatgccgacgagtccgaacccggtacctgcaaggaccgcgacatcatgcgccacgatccgcacacgctgatcgaaggctgcgtgattgcgagcttcgccatgggtgcgcatgccgcctatatctacgtccgcggcgagttcatccgcgagcgtgaagcgctgcaggcggcgatcgacgaatgctatgaatacggcctgctcggcaagaacaacaagctcggctacgacatcgacatttacgtgcatcacggtgccggcgcctatatctgcggcgaggagacggcgctgctcgaaagcctcgaaggcaagaaaggccagccgcgcctgaagccgcctttcccggcgaatatgggcctttatggctgcccgacgacggtcaacaatgtcgagtcgattgcggtgacgccgaccatcctgcgccgcggcgccggctggtacacgagcttcggccgccccaacaaccacggcaccaagctctattcggtttccggccacgtcaatcgcccttgcacggtcgaggacgcgatgtcgatcccgttccatgagctgatcgagaagcactgcggcggcattcgcggcggctgggacaatctgctggcggtcatccccggcggctcttcggtcccctgcgtgcccggcgcgcagatgaaggacgcgatcatggactatgacggcctgcgcgagctcggctcgggcctcggcacggctgccgtcatcgtcatggacaagtcgaccgacatcatcaaggcgatctggcggctgtcggccttctacaagcacgagagctgcggccagtgcacgccctgccgcgaaggcaccggttggatgatgcgcgtcatggagcgcatggtgcagggccgcgcccagaagcgcgagatcgacatgctcttcgacgtgacgaagcaggtcgagggccacacgatctgcgcgctcggcgatgcggcggcatggccgatccagggccttatcaagcatttccgtccggaaatggagaagcggatcgacgaatacacgcgcaatgcgacctcgcatggcgccgtgctggaggcggcggagtaa

SEQ ID NO: 39409 - protein, 434 aa, Rhizobium meliloti
MLRDEDRIFTNIYGLKDKSLRGAMARGHWDGTKQFLEKGRDWIINEVKASGLRGRGGAGFPTGLKWSFMPKESDGRPHYLVVNADESEPGTCKDRDIMRHDPHTLIEGCVIASFAMGAHAAYIYVRGEFIREREALQAAIDECYEYGLLGKNNKLGYDIDIYVHHGAGAYICGEETALLESLEGKKGQPRLKPPFPANMGLYGCPTTVNNVESIAVTPTILRRGAGWYTSFGRPNNHGTKLYSVSGHVNRPCTVEDAMSIPFHELIEKHCGGIRGGWDNLLAVIPGGSSVPCVPGAQMKDAIMDYDGLRELGSGLGTAAVIVMDKSTDIIKAIWRLSAFYKHESCGQCTPCREGTGWMMRVMERMVQGRAQKREIDMLFDVTKQVEGHTICALGDAAAWPIQGLIKHFRPEMEKRIDEYTRNATSHGAVLEAAE

SEQ ID NO: 39410 - DNA, 1266 bp, Rhizobium meliloti
  CDS (1)..(1266): transl_table=11
atgttcgagcctgtcctgctcaggaatgtcgatgtgccggacggtcatctgctgtcgacgtacgaggccggcggcggctaccgggcgctcaggaaggcgctcggcgaatatacgcccgacgagatcgtcgagctcgtcaaggagtccaacctgcgcggccgcgggggtgccgggttcccgacgggcatgaagtggagcttcgtgccgaaagcggccggcaagccgaaatacctctgctgcaatgccgatgaaggggaacccggcaccttcaaggaccgcatcatcatggagcgtgacccgcatcagctcatcgaggggctggcggtcagcgcctatgcaatcggagccgagacggcttacgtctacattcgcggagaatatgtgacggctatacgccgcatggaacaggcgatcgccgaggcacatgaaaacggctatctgggcatcggcattcttggctcgggcttcaatttcatggtccacatccatcgcggtgccggcgcctatatctgcggcgaggagaccgcaatgctcgagtcactcgagggcaagcgagcgcagccgcgactgaagccgccgtttccggccgtggccgggctctatgccagccccactgtcatcaacaatgtcgagacgcttgcctgcgtgccgcatatcgtgatgcgcggatcggcatggttccgcggcatagggccggacaggagccccggcccgaaactctactgcctcagcggtcaggttcgcaaacccggcctctatgagctgccgatgggcatatcgctgcgggagctcgtcgaggagcacgccggcggacccctgccggggcgaaaggtcaaggcggtgattcccggtggggtatcggcgccggttatcccggagggcgagctcgaggtgggcatggatttcgactcgctcactgccgccggttcgatgctcggctcggcaggcgtggtcgtgatcgacgactcgacctgcatggtcaagctcgccacgcggatcatcgagttcttccaccatgagtcctgcggcaagtgcacgccatgccgggaaggattggactggactgtgaaagtcctgcggcgcatcgaggcaggcgagggtgaaaccggcgacctggagcagttggagatgctctgcaagggcattttcggcaacacgttttgtgccctgggcgacggcgcggccatgggattgcgggccgcgctcaagcatttccgcgcggagttcgtcgcccacatcgaagagcggaggtgccctttccactga

SEQ ID NO: 39411 - protein, 421 aa, Rhizobium meliloti
MFEPVLLRNVDVPDGHLLSTYEAGGGYRALRKALGEYTPDEIVELVKESNLRGRGGAGFPTGMKWSFVPKAAGKPKYLCCNADEGEPGTFKDRIIMERDPHQLIEGLAVSAYAIGAETAYVYIRGEYVTAIRRMEQAIAEAHENGYLGIGILGSGFNFMVHIHRGAGAYICGEETAMLESLEGKRAQPRLKPPFPAVAGLYASPTVINNVETLACVPHIVMRGSAWFRGIGPDRSPGPKLYCLSGQVRKPGLYELPMGISLRELVEEHAGGPLPGRKVKAVIPGGVSAPVIPEGELEVGMDFDSLTAAGSMLGSAGVVVIDDSTCMVKLATRIIEFFHHESCGKCTPCREGLDWTVKVLRRIEAGEGETGDLEQLEMLCKGIFGNTFCALGDGAAMGLRAALKHFRAEFVAHIEERRCPFH

SEQ ID NO: 39412 - DNA, 1281 bp, Aquifex aeolicus
  CDS (1)..(1281): transl_table=11
atgagatcctatcccgctatacctaggatttacgctgaaactacccttaatatgctcctcaagagggctaaaaagcccagagttcattccatagatgagtacttaaaagatgggggataccaggctttagaaaaagccctgaacatgtcccccgaggaaatcatagactgggttgacaaaagtacgctgcggggtagaggaggagcaggattcccaaccgggaagaagtggaaattcgcggttcagaaccccggacccaggtactttatatgcaacgcggacgagtcagaaccgggaacctttaaggacaggataataatagagagggatccccacctcctgatagagggaataatcatatcctcctatgcgattggggcaaacgaagcatacatatacataaggggagagtaccccgcgggctattacatactgagggatgcaatagaggaggcgaaaaagaagggatttttaggaaagaacatcttgggttcgggatttgaccttgagatatacgtggcaaggggtgcgggtgcctacatatgcggtgaggaaaccgctctgatagaaagccttgagggtaaaaggggacacccgaggttaaaacccccataccccgtccagaagggactctggggaaaaccgacggtagtgaacaacgtagaaaccatagctaacgttccctttataatttccatgggctgggaggagtacaggtacataggcccgagtgactacgctggaccaaaactctttcccgtaagcggtaaggtgaaaaaacccggggtttacgagcttcccatgaacacaacactcagggaagtcatattcaagtatgcgggcggaaccctcggaaacaaaaaggtgaaggctgtattttccggggctcttgactgcttttcctcggaagaactcgacattcccatggactactctcctctcgggtttggcggaacgggaacggttatagtgctcacggaagaggacgacatagtggaagcagctctaaaaattgcagagttctacgaacacgaaacctgcggacagtgcaccccttgcagggtagggtgctacgaacaggcaaacctccttgagaaaatatacaagggtgaagctacagagcaggactgggaaggttttgactttgtaaacaggaacattcaacccacttctatatgcggtctcggggctgttgcgggaaggcttatcagacaaacacttgagaaattcccggaggagtgggaaaagtacagaaagaaatctgcttcccttcccctttaa

SEQ ID NO: 39413 - protein, 426 aa, Aquifex aeolicus
MRSYPAIPRIYAETTLNMLLKRAKKPRVHSIDEYLKDGGYQALEKALNMSPEEIIDWVDKSTLRGRGGAGFPTGKKWKFAVQNPGPRYFICNADESEPGTFKDRIIIERDPHLLIEGIIISSYAIGANEAYIYIRGEYPAGYYILRDAIEEAKKKGFLGKNILGSGFDLEIYVARGAGAYICGEETALIESLEGKRGHPRLKPPYPVQKGLWGKPTVVNNVETIANVPFIISMGWEEYRYIGPSDYAGPKLFPVSGKVKKPGVYELPMNTTLREVIFKYAGGTLGNKKVKAVFSGALDCFSSEELDIPMDYSPLGFGGTGTVIVLTEEDDIVEAALKIAEFYEHETCGQCTPCRVGCYEQANLLEKIYKGEATEQDWEGFDFVNRNIQPTSICGLGAVAGRLIRQTLEKFPEEWEKYRKKSASLPL

SEQ ID NO: 39414 - DNA, 1335 bp, Buchnera aphidicola subsp
  CDS (1)..(1335): transl_table=11
atgaatagaattttacgaatttcagaaacgcaccctttaacttggcggttaagagatgatcaaaaaactgtttggattaaagaatattgtgataaaaatggttatttatctttaaagaaagcattaaaagaaatgcttccagaagatgttattaatatagtaaaagaatctggtttaaaaggaagaggaggtgcaggattttctactggattaaaatggagtctaatgtctcaaaaccattcttatacaagagaacgtggttacttaatatgtaatgctgatgaaatggaacctggtacgtataaagatagattattaattgaaaagattcctcatcaattaattgaaggaataatattgtccgcatacgcattaaacgtttctcgtgcttatatttttttaagaggagaatatgttcaagctgagcatattttaaaacaatctatacaggaagcaattaattttggttttattggattaaatatcttaggaagcaattttaatatcgagttagttttacatactggggctggacgatatatttgtggagaagaaactgctttaattaattctttagaaggtcgtagagctaatcctagatcgaagccgccatttccagcagtatttggtttgtggggaaaacctacttgtgtgaataatgttgaaacactgtctaatgttccatgtattatattgaacggtgtaagttggtataaaaatttatctaaaagttctgatacaggtactaaattaatggggttctcaggaaatgtaagaaatcccggtgtttgggaattaccttttggcaccactgctcgtgaaattttagaagattatgctcatggaatgaagtccggtttttctttaaaagcttggcagccaggtggcgcgggaacagatttcttgcttgaagaacatttagacttgccaatggattttaaaaatatcagtcaggctggaagtcgtttaggaactgctctttctatggctgttgataataaaactagcatggtttctcttgtatataatatagaaaaatttttttcacgagaatcatgtggtttgtgtacaccatgtcgagatgggttgccttggattgtaaaaatattaaaaagtttagaacaaaataaaggtcataaaaatgatgtgaaaaacttagaaaaactatgctctcatttaagtccaggaaaaacattttgtgctcatgcgcccggggcaatagaaccattgcaaagtgctattaaatattttcgatctgaatttgaatctggaatcaatataagaaaaagagatttaaataaaaaaattattgggattcaatctaattgtatttaa

SEQ ID NO: 39415 - protein, 444 aa, Buchnera aphidicola subsp
MNRILRISETHPLTWRLRDDQKTVWIKEYCDKNGYLSLKKALKEMLPEDVINIVKESGLKGRGGAGFSTGLKWSLMSQNHSYTRERGYLICNADEMEPGTYKDRLLIEKIPHQLIEGIILSAYALNVSRAYIFLRGEYVQAEHILKQSIQEAINFGFIGLNILGSNFNIELVLHTGAGRYICGEETALINSLEGRRANPRSKPPFPAVFGLWGKPTCVNNVETLSNVPCIILNGVSWYKNLSKSSDTGTKLMGFSGNVRNPGVWELPFGTTAREILEDYAHGMKSGFSLKAWQPGGAGTDFLLEEHLDLPMDFKNISQAGSRLGTALSMAVDNKTSMVSLVYNIEKFFSRESCGLCTPCRDGLPWIVKILKSLEQNKGHKNDVKNLEKLCSHLSPGKTFCAHAPGAIEPLQSAIKYFRSEFESGINIRKRDLNKKIIGIQSNCI

SEQ ID NO: 39416 - DNA, 1344 bp, Buchnera aphidicola subsp
  CDS (1)..(1344): transl_table=11
atgaataatattatccccactgaggagacacatccgttaacatggagattaagaaatgatcgagaaacagtttggattgaagaatattgtaaaaaaaatggttattttagtttaaaaaaagcattaaaaactatgtgtccagaagatgttgtacatttgataaaagaatcaggtttaaaaggaagaggaggagctggtttttctacaggtttaaaatggagtttaatgtctaaagacaatagctctaaaattcgttatttattatgcaacgctgatgaaatggaacctggaacttataaagatagatttttaatggaaaatatacctcatcaattaattgaaggaatgttattatcagcgtttgccttaaatgtttctcgtggttatatttttttacggggtgaatatattaaagctgaatatattttaaaaaaatctatacaagaagcaattaattttggttttattggttctaatattttaaatagtggttttaattttgaactttttttacatactggagctggtcgttatatttgtggcgaagaaactgctttaattaattcgctagagggacgtagagctaatccaagagctaagccaccttttcctgcagtatttgggctatggggaaaacctacttgtgttaacaatgttgaaacattatctaatgttccttctattgtattacatggtgttaattggtataaaaaactatctaaaagtactgatactactggtactaagttaatgggattttcaggaaaagtaaataatcctggtgtttgggaattaccttttggaactactgcacgtgaaattttagaagattatgcacgtggaatgaaatcaggtttatttttaaaatcttggcaacctggtggagcaggaacagattttctcattgaaaaacatttagatttaccgatggattttacaagtattgcaaaagccggaagtcgtttaggaacagctattgctatggctgtagataataaaactaatatgatttctttagtttgcaatatagaaaagtttttttctcgtgaatcatgtggtttatgtacaccatgcagagaaggattaccctggattgtaaagatattagaaagtttagagaaaaaagaaggtcataaaaatgatgtcaaaaatttagagaggttatgtttagatttaagtccaggaaaaacattttgtgctcatgcacctggtgcagtagaacctttacaaagtgctataaaatattttcgtttagagtttgaagctggtattagcataaaaaaattaaaaaaatgttcaaatattcttggaattcaatcaaatgaatttacttcaaaagtttaa

SEQ ID NO: 39417 - protein, 447 aa, Buchnera aphidicola subsp
MNNIIPTEETHPLTWRLRNDRETVWIEEYCKKNGYFSLKKALKTMCPEDVVHLIKESGLKGRGGAGFSTGLKWSLMSKDNSSKIRYLLCNADEMEPGTYKDRFLMENIPHQLIEGMLLSAFALNVSRGYIFLRGEYIKAEYILKKSIQEAINFGFIGSNILNSGFNFELFLHTGAGRYICGEETALINSLEGRRANPRAKPPFPAVFGLWGKPTCVNNVETLSNVPSIVLHGVNWYKKLSKSTDTTGTKLMGFSGKVNNPGVWELPFGTTAREILEDYARGMKSGLFLKSWQPGGAGTDFLIEKHLDLPMDFTSIAKAGSRLGTAIAMAVDNKTNMISLVCNIEKFFSRESCGLCTPCREGLPWIVKILESLEKKEGHKNDVKNLERLCLDLSPGKTFCAHAPGAVEPLQSAIKYFRLEFEAGISIKKLKKCSNILGIQSNEFTSKV

SEQ ID NO: 39418 - DNA, 1335 bp, Buchnera aphidicola subsp
  CDS (1)..(1335): transl_table=11
atgaaaaaactattatcgcgaacttcagaaacacatccattaacgtggcgtttaaatgcacaacaagatacggtttggattaaagaatataaacgtaaaaatggatatcgtgcttttgaaaaagtagttaatcatatgacctctgaggatgtgattgatttaataaaacaatcaggacttaagggacgtggaggtgcagggtttttaacaggtttaaagtggagtttaatgccacctttaaatgatgaatatggttatactagatatttgttatgtaatgcggatgaaatggaaccgggtacgtataaggatagatttttaatggaaaaggttcctcatcaattgttagaaggaatattaataagtgcatttgctttgagtgttactaaaagttatatctttttaagaggggaatatgttaatactgagcgtattctaaaacaatcaattattgaagctactaattatggttatttaggtaaaaatgtttgtggatctaatctaacctttgaaatttttatacatactggagcaggtcgttatatttgcggtgaagaaactgctttaattaattctttagaaggtcgtagagctaatcctagatttaaacctccatttcctgcttatgttggtctttggggaaagcctacatgtgttaataatgttgaaactttgtctaatgttccagcaatttttctaaatggtgttaagtggtataaaggtttgtctaaaagtcttgatactggtacaaagatgatgggtttttcaggatcagtaaaatttcctggaatttgggaattaccttttggaataacagcgcgcgaaatatttgaaaggtatgctggaggtatgaaaaataataaaaagctaaaagtgtggcaacctggaggtgcaagtacaagttttttgattgataaacatttagatgtacctatggattttgttaatattaaaaaagttggtagcagattgggaactgcattagctatggctgtagatgattctgtaagtatagtatctttagtacgaaacatagaagaatttttttctagagaatcatgtggattttgcacgccatgtagggatggtttaccatggattgttaaaattttaaaagttttagaacaaaaaataggagttcctgaagatattgaaatattagaacaattgtgtgagcaattaggtcctggacgtactttttgcgcacacgctccgggagcaatagagcccttaaagagtgctttaaaatattttagattagaattcgaattgtgtgtcaattccaattctacaataaaatgtaaatatattcatagttctatatcagaatattag

SEQ ID NO: 39419 - protein, 444 aa, Buchnera aphidicola subsp
MKKLLSRTSETHPLTWRLNAQQDTVWIKEYKRKNGYRAFEKVVNHMTSEDVIDLIKQSGLKGRGGAGFLTGLKWSLMPPLNDEYGYTRYLLCNADEMEPGTYKDRFLMEKVPHQLLEGILISAFALSVTKSYIFLRGEYVNTERILKQSIIEATNYGYLGKNVCGSNLTFEIFIHTGAGRYICGEETALINSLEGRRANPRFKPPFPAYVGLWGKPTCVNNVETLSNVPAIFLNGVKWYKGLSKSLDTGTKMMGFSGSVKFPGIWELPFGITAREIFERYAGGMKNNKKLKVWQPGGASTSFLIDKHLDVPMDFVNIKKVGSRLGTALAMAVDDSVSIVSLVRNIEEFFSRESCGFCTPCRDGLPWIVKILKVLEQKIGVPEDIEILEQLCEQLGPGRTFCAHAPGAIEPLKSALKYFRLEFELCVNSNSTIKCKYIHSSISEY

SEQ ID NO: 39420 - DNA, 1338 bp, Mycobacterium bovis
  CDS (1)..(1338): transl_table=11
atgaccacgcaggccaccccgttgaccccggtgatcagccgccactgggacgacccggagtcgtggaccctggccacttatcaacgccacgatcgctatcggggctatcaggcgttgcagaaagccctgacgatgccgcccgacgacgtgatcagcatcgtcaaggattccgggttacgcggacgcggcggcgcgggctttgccaccgggaccaagtggtcgttcatcccgcagggcgacaccggcgccgcggccaagccgcactacctggtggtcaacgccgacgagtccgaacccggtacgtgcaaagacattccgttgatgctggcgacgccacatgtgctcatcgaaggcgtcatcatcgccgcctacgcgatccgcgcccatcacgcgttcgtctacgtacgcggtgaggtggtgccggtattgcgccggctgcacaacgcggtggccgaggcctatgccgccggcttcctaggccgcaacatcggaggttccggattcgatctggagctggtggtacacgccggcgcgggcgcctacatctgcggcgaggagaccgccctgctcgactcgctggaaggccggcgcggccagccgcggctgcggccccccttccccgcggtggccggtctgtatggctgcccgaccgtgatcaacaacgtcgaaacgatcgccagtgtcccatcgatcatcctgggcggcatcgactggttccggtcgatgggcagcgagaaatcgcctggcttcaccctgtattcgctgtccggccacgtcacccgccccggccagtacgaggcgccgctgggcattacgctgcgcgagttgctcgactacgcaggcggggtgcgcgccgggcaccggctgaagttctggacaccgggcggctcgtcgaccccgctgctcaccgacgagcatctggatgtgccgctggactacgagggtgtgggtgcggccggctcgatgctggggaccaaggcgctggagatcttcgacgagaccacctgcgtggtgcgcgcggtgcgccgctggaccgagttctacaagcacgaatcgtgtgggaaatgcacgccgtgccgggagggcaccttctggctggataagatctacgagcggctggaaaccggccggggtagccatgaagacattgacaaactgttggacatttccgattccatcttgggaaagtcgttctgcgcgttgggcgacggtgccgcgagtccggtgatgtcgtcgatcaagcacttccgcgacgagtacctggcccacgtcgaaggaggcggttgcccattcgacccccgagactccatgctcgtcgcgaacggagtggacgcgtga

SEQ ID NO: 39421 - protein, 445 aa, Mycobacterium bovis
MTTQATPLTPVISRHWDDPESWTLATYQRHDRYRGYQALQKALTMPPDDVISIVKDSGLRGRGGAGFATGTKWSFIPQGDTGAAAKPHYLVVNADESEPGTCKDIPLMLATPHVLIEGVIIAAYAIRAHHAFVYVRGEVVPVLRRLHNAVAEAYAAGFLGRNIGGSGFDLELVVHAGAGAYICGEETALLDSLEGRRGQPRLRPPFPAVAGLYGCPTVINNVETIASVPSIILGGIDWFRSMGSEKSPGFTLYSLSGHVTRPGQYEAPLGITLRELLDYAGGVRAGHRLKFWTPGGSSTPLLTDEHLDVPLDYEGVGAAGSMLGTKALEIFDETTCVVRAVRRWTEFYKHESCGKCTPCREGTFWLDKIYERLETGRGSHEDIDKLLDISDSILGKSFCALGDGAASPVMSSIKHFRDEYLAHVEGGGCPFDPRDSMLVANGVDA

SEQ ID NO: 39422 - DNA, 1296 bp, Rhodobacter capsulatus
  CDS (1)..(1296): transl_table=11
atgctcaacgatcacgatcgcatcttcaccaacatctacgggatgcacgaccgctcgctgaagggcgcgatggcgcgtggtcactgggatggcacggcggcgatccttggcaatggccgcgactggatcatcgagcaggtcaaggcctcggggctgcgcggccgcggcggtgcgggctttccgaccgggctcaagtggtccttcatgccgaagcaatccgacgggcgcccctcgtttctggtgatcaacgccgatgaatccgagccgggcacctgcaaggaccgcgaaatcatgcgccacgatccgcatacgctgatcgaaggcgcgctgatcgccggtttcgccatgggcgcgcgggcggcctatatctatattcgcggcgaatatgtccgcgaaaaggaggccctgcaggccgccatcgacgaatgctacgaggccgggctgatcggcaagaacgcctgccgctcggactatgatttcgacgtctatctgcaccacggtgcgggcgcctatatctgcggcgaggaaaccgcgcttctggaaagccttgagggcaagaaggggatgccgcggatgaaaccgccgttcccggcgggctcggggctttatggctgcccgacgacggtgaacaacgtcgaatccatcgccgtcgtgccgacgatcctgcgccgtggtggtgcctggttcgcgggcatcgggcggccgaacaacaccggcgtcaagctgttcgcgatgtcggggcacgtcaacaccccctgcgtcgtcgaagaagccatgtcgatcagcatgaaggagctgatcgaaaagcacggcggcggcgtccgcggcggctggaagaacctgaaagcggtgatccccggcggcgcctcctgcccggtcattccggcgcatctgtgcgaagacgcgatcatggattacgacggcatgcgcgaaaagcagtcgtccttcggcaccgcctgtctgatcgtgatggatcagcagaccgacatcatcaaggcgatcgcgcggctgtcgaaattcttcaagcacgagagctgcggccagtgcacgccctgccgcgaggggacctcgtggatgtggcgggtgatggagcgactggtcaccggcgaggccgaggtcgaggagatcgacatgctgttttcggtgacgaaacaggtcgagggccacacgatctgcgccctgggcgatgccgccgcctggccgatccaggggctgatccggcattaccgcgaggagatcgaggaccggatcaaggcgcgcaagaccggccgcatgggcgcgatggcggcggagtga

SEQ ID NO: 39423 - protein, 431 aa, Rhodobacter capsulatus
MLNDHDRIFTNIYGMHDRSLKGAMARGHWDGTAAILGNGRDWIIEQVKASGLRGRGGAGFPTGLKWSFMPKQSDGRPSFLVINADESEPGTCKDREIMRHDPHTLIEGALIAGFAMGARAAYIYIRGEYVREKEALQAAIDECYEAGLIGKNACRSDYDFDVYLHHGAGAYICGEETALLESLEGKKGMPRMKPPFPAGSGLYGCPTTVNNVESIAVVPTILRRGGAWFAGIGRPNNTGVKLFAMSGHVNTPCVVEEAMSISMKELIEKHGGGVRGGWKNLKAVIPGGASCPVIPAHLCEDAIMDYDGMREKQSSFGTACLIVMDQQTDIIKAIARLSKFFKHESCGQCTPCREGTSWMWRVMERLVTGEAEVEEIDMLFSVTKQVEGHTICALGDAAAWPIQGLIRHYREEIEDRIKARKTGRMGAMAAE

SEQ ID NO: 39424 - DNA, 1266 bp, Rickettsia conorii
  CDS (1)..(1266): transl_table=11
atgctaaaagaagaagacaaaatttttactaacctgcatgggcagcaaagccatgatttgaaatctagcaagaagcgaggcgattgggagaatactaaagctttgcttgataaaggtagagatttcatcgttgaagaggttaagaaatcagggcttagagggcgaggaggtgccggattttctaccggtatgaaatggtcatttatgcctaaaaatttagagaagtcttgctatttagtagtaaatgccgacgagtctgagcctggcacttgtaaggatcgtgatatattaaggtttgagccgcacaaattaatagaaggttgcttgcttgcaagctttgctataggagcgaataattgttatatctatattagaggtgagttttataatgaagcctctaatattcagcgtgccttagatgaagcctataaagaagggttaataggaaagaattcttgcggttcgggctttgattgtaatatttatttacatcgtggggcgggtgcttatatttgtggcgaagaaacggcattgcttgaaagcttagagggcaaaaaaggtatgcctcgtttaaagccgccttttcctgccggctttgggttatatggctgtccgactactataaataatgttgagtctatcgcagtagtgccaaccattttaagacgaggagctagttggtttgctggtataggtaaacctaacaatacgggcactaagattttctgcatatcagggcatgttaacaagccttgtaatgttgaggaagcaatgggcatttcgttaaaagaattgattgagaaatatgcgggtggtgttcgtggtggatgggataatcttaaagccataatcccgggcggttcttccgtgcctttacttcctaagtcattatgtgaagtggatatggattttgatagtttaagaacagcaggttctggacttggtacaggcggtattatagttatggatcaatctaccgatattatttatgcaatagcaaggcttagtaaattttacatgcatgaatcttgcgggcaatgtactccttgccgtgagggtacgggctggatgtggcgagttatgatgcgactagttaaaggtaatgtcaaaaaatctgagatagacgaactccttaacgttacgaaagaaatagaggggcatactatctgtgctttaggtgatgcggcagcttggccgattcaagggctgatacgccattttagaagcgagattgaggcaaggataaagagtgatagtgtggtttga

SEQ ID NO: 39425 - protein, 421 aa, Rickettsia conorii
MLKEEDKIFTNLHGQQSHDLKSSKKRGDWENTKALLDKGRDFIVEEVKKSGLRGRGGAGFSTGMKWSFMPKNLEKSCYLVVNADESEPGTCKDRDILRFEPHKLIEGCLLASFAIGANNCYIYIRGEFYNEASNIQRALDEAYKEGLIGKNSCGSGFDCNIYLHRGAGAYICGEETALLESLEGKKGMPRLKPPFPAGFGLYGCPTTINNVESIAVVPTILRRGASWFAGIGKPNNTGTKIFCISGHVNKPCNVEEAMGISLKELIEKYAGGVRGGWDNLKAIIPGGSSVPLLPKSLCEVDMDFDSLRTAGSGLGTGGIIVMDQSTDIIYAIARLSKFYMHESCGQCTPCREGTGWMWRVMMRLVKGNVKKSEIDELLNVTKEIEGHTICALGDAAAWPIQGLIRHFRSEIEARIKSDSVV

SEQ ID NO: 39426 - DNA, 1266 bp, Rickettsia prowazekii
  CDS (1)..(1266): transl_table=11
atgctaaaagaagaagacaaaatttttactaacttgtatgggcagcaaagctatgatttgaaatctagtcaaaagcgaggggattggtataatactaaggcattgattgataaaggtagagacttcattattgatgaggttaagaaatcagggcttagagggcgcggtggtgctgggttttctactggtatgaaatggtcatttatgcctaaaaattcagagaagccttgttatttagtagtaaatgcggatgaatctgagcctggtacttgtaaagatcgtgatatattaaggtttgaaccgcacaaattaatagaaggttgtttgattgcaagctttgctataggagcgaatacttgttatatttatattagaggtgaattttataatgaagcttctaatatgcagcgtgccttagatgaagcttataaagaagggttaataggcaagaatgcttgtggttcgggtttcgattgtaatatttatttacatcgtggtgcaggtgcttatatttgcggtgaagaaactgcgttacttgagagcttagaaggtaaaaaaggtatgccacgacttaagccaccttttcctgctgggtttggtttatatggttgtccaactactataaataatgttgagtctattgcagtagtgccaacaattttaagacgaggagcaagttggtttgctgcaatcggtaaacctaacaatactggcactaaggttttttgcatatctggtcatgttaataagccttgcaatattgaagaagtaatgggggttccattaaaagaattgattgagaaatatgctggcggtgtgcgtggtggatggaataatcttaaagcaataatcccaggtggtgcttctgtacctttactccctaaatcattatgtgaagtagagatggattttgatagtttaagaacagtagggtctggacttggtacaggtggtattattgttatggataaatctactgacattatttatgcaatagcacgtctaagtaaattttatatgcatgaatcatgtgggcaatgtaccccttgtcgagagggtactggttggatgtggcgagttatgatgcgcctagttaatggtaatgcaaaaaaaaatgaaatagatactctgttgaatgttacgaaagaaatagagggacatactatttgtgctttgggggatgctgcagcttggccaatccaagggttgatacggcattttagagatgaaattgagcagaggataaagagttttggtatcgcttaa

SEQ ID NO: 39427 - protein, 421 aa, Rickettsia prowazekii
MLKEEDKIFTNLYGQQSYDLKSSQKRGDWYNTKALIDKGRDFIIDEVKKSGLRGRGGAGFSTGMKWSFMPKNSEKPCYLVVNADESEPGTCKDRDILRFEPHKLIEGCLIASFAIGANTCYIYIRGEFYNEASNMQRALDEAYKEGLIGKNACGSGFDCNIYLHRGAGAYICGEETALLESLEGKKGMPRLKPPFPAGFGLYGCPTTINNVESIAVVPTILRRGASWFAAIGKPNNTGTKVFCISGHVNKPCNIEEVMGVPLKELIEKYAGGVRGGWNNLKAIIPGGASVPLLPKSLCEVEMDFDSLRTVGSGLGTGGIIVMDKSTDIIYAIARLSKFYMHESCGQCTPCREGTGWMWRVMMRLVNGNAKKNEIDTLLNVTKEIEGHTICALGDAAAWPIQGLIRHFRDEIEQRIKSFGIA

SEQ ID NO: 39428 - DNA, 1350 bp, Streptomyces coelicolor
  CDS (1)..(1350): transl_table=11
gtgatgaccgtggcagccgagatcaggggcagcaacccggagaagctgctcgcacccgtgctgtcggccttctgggacgaggacgagtcgtggactctcgacgtctaccggaggcacgaagggtacgaggggctccgcaaggcgctggcgatggcgccggacgacctgatcgcgtacgtcaaggagtccggtctgcgtggacgcggcggtgccgggttcccgacggggatgaagtggcagttcattcctcagggggacggcaagcctcactatctagttgtcaacgccgacgaatcggagcccgggacctgcaaggacatcccgctcctcttcgcgaacccgcacagcctcatcgagggcatcgtcatcgcgtgttacgccatcaggtcttcgcatgccttcatctatctgcgtggtgaagtcgtcccagtgctgcggcggttgcacgaggccgtgcgcgaggcctacgcggccggcttcctcggcgagaacatcctgggcagcggactcgatctcaccctcaccgtgcacgcgggcgcgggcgcgtacatctgcggtgaggagaccgcactgctcgactcgctcgaaggccgccggggtcaaccgcggctccgtcccccctttcctgccgtcgcgggcctctatgcgtgcccgactgtggtgaataacgtcgaatcgatcgcttcagttcccgcgatcctgaacaagggcaaggactggttcaggtcgatgggcagcgagaagtccccgggcttcacgctctactcgctcagcggccacgtcgcgggccccggccagtacgaggccccgctcggcatcacgctgcgccagctcctcgacatgagcggcggcatgcgccccggccaccggctcaagttctggacgcccggcgggtcctcgacgccgatgttcaccgacgagcacctcgacgtccccctcgactacgaaggagtgggcgccgccggttccatgctcggcaccaaggcgctccagtgcttcgacgagacgacctgcgtcgtgcgggccgtcacccgctggaccgagttctacgcccacgagtcctgcggcaagtgcacaccgtgccgcgaaggcacgtactggctcgtccagttgctgcgcgacatcgaggccggcaagggacagatgtccgacctcgacaagctgaacgacatcgccgacaacatcaacggcaagtccttctgcgccctcggcgacggtgccgcctcgccgatcttctcctcgctcaagtacttccgcgaggagtacgaggagcacatcacgggccgcggctgccccttcgacccggccaagtcgacggcctgggccgaccgcacggaggtgaaggcatga

SEQ ID NO: 39429 - protein, 449 aa, Streptomyces coelicolor
MMTVAAEIRGSNPEKLLAPVLSAFWDEDESWTLDVYRRHEGYEGLRKALAMAPDDLIAYVKESGLRGRGGAGFPTGMKWQFIPQGDGKPHYLVVNADESEPGTCKDIPLLFANPHSLIEGIVIACYAIRSSHAFIYLRGEVVPVLRRLHEAVREAYAAGFLGENILGSGLDLTLTVHAGAGAYICGEETALLDSLEGRRGQPRLRPPFPAVAGLYACPTVVNNVESIASVPAILNKGKDWFRSMGSEKSPGFTLYSLSGHVAGPGQYEAPLGITLRQLLDMSGGMRPGHRLKFWTPGGSSTPMFTDEHLDVPLDYEGVGAAGSMLGTKALQCFDETTCVVRAVTRWTEFYAHESCGKCTPCREGTYWLVQLLRDIEAGKGQMSDLDKLNDIADNINGKSFCALGDGAASPIFSSLKYFREEYEEHITGRGCPFDPAKSTAWADRTEVKA

SEQ ID NO: 39430 - DNA, 25 bp, Artificial sequence
  (1)..(25): primer
atgaaaaacattatccgtactcccg

SEQ ID NO: 39431 - DNA, 21 bp, Artificial sequence
  (1)..(21): primer
ttaccagcgctctttcagcag

SEQ ID NO: 39432 - protein, 478 aa, Artificial sequence
  Variant (2)..(9): xaa in position 2 to 9 is any amino acid
  Variant (10)..(62): xaa in position 10 to 62 is any or no amino acid
  Variant (64)..(69): xaa in position 64 to 69 is any amino acid
  Variant (71)..(72): xaa in position 71 to 72 is any amino acid
  Variant (73)..(80): xaa in position 73 to 80 is any or no amino acid
  Variant (83)..(84): xaa in position 83 to 84 is any or no amino acid
  Variant (86)..(87): xaa in position 86 to 87 is any or no amino acid
  Variant (89)..(89): xaa in position 89 is any or no amino acid
  Variant (105)..(106): xaa in position 105 to 106 is any amino acid
  Variant (108)..(114): xaa in position 108 to 114 is any amino acid
  Variant (115)..(128): xaa in position 115 to 128 is any or no amino acid
  Variant (132)..(132): xaa in position 132 is any amino acid
  Variant (137)..(137): xaa in position 137 is any amino acid
  Variant (142)..(143): xaa in position 142 to 143 is any amino acid
  Variant (146)..(146): xaa in position 146 is any amino acid
  Variant (149)..(151): xaa in position 149 to 151 is any amino acid
  Variant (154)..(154): xaa in position 154 is any amino acid
  Variant (159)..(160): xaa in position 159 to 160 is any amino acid
  Variant (164)..(164): xaa in position 164 is any amino acid
  Variant (167)..(168): xaa in position 167 to 168 is any or no amino acid
  Variant (170)..(171): xaa in position 170 to 171 is any amino acid
  Variant (181)..(183): xaa in position 181 to 183 is any amino acid
  Variant (184)..(187): xaa in position 184 to 187 is any or no amino acid
  Variant (189)..(190): xaa in position 189 to 190 is any or no amino acid
  Variant (193)..(194): xaa in position 193 to 194 is any or no amino acid
  Variant (196)..(196): xaa in position 196 is any amino acid
  Variant (197)..(198): xaa in position 197 to 198 is any or no amino acid
  Variant (200)..(200): xaa in position 200 is any amino acid
  Variant (203)..(206): xaa in position 203 to 206 is any amino acid
  Variant (207)..(207): xaa in position 207 is any or no amino acid
  Variant (209)..(214): xaa in position 209 to 214 is any or no amino acid
  Variant (216)..(216): xaa in position 216 is any or no amino acid
  Variant (218)..(219): xaa in position 218 to 219 is any amino acid
  Variant (234)..(234): xaa in position 234 is any amino acid
  Variant (240)..(240): xaa in position 240 is any amino acid
  Variant (242)..(242): xaa in position 242 is any amino acid
  Variant (245)..(245): xaa in position 245 is any amino acid
  Variant (248)..(248): xaa in position 248 is any or no amino acid
  Variant (253)..(254): xaa in position 253 to 254 is any amino acid
  Variant (259)..(259): xaa in position 259 is any amino acid
  Variant (262)..(262): xaa in position 262 is any amino acid
  Variant (264)..(264): xaa in position 264 is any amino acid
  Variant (269)..(269): xaa in position 269 is any amino acid
  Variant (271)..(274): xaa in position 271 to 274 is any amino acid
  Variant (277)..(278): xaa in position 277 to 278 is any amino acid
  Variant (280)..(281): xaa in position 280 to 281 is any amino acid
  Variant (284)..(286): xaa in position 284 to 286 is any amino acid
  Variant (288)..(292): xaa in position 288 to 292 is any amino acid
  Variant (293)..(296): xaa in position 293 to 296 is any or no amino acid
  Variant (302)..(302): xaa in position 302 is any amino acid
  Variant (306)..(306): xaa in position 306 is any amino acid
  Variant (308)..(313): xaa in position 308 to 313 is any amino acid
  Variant (315)..(322): xaa in position 315 to 322 is any amino acid
  Variant (326)..(327): xaa in position 326 to 327 is any amino acid
  Variant (328)..(329): xaa in position 328 to 329 is any or no amino acid
  Variant (333)..(335): xaa in position 333 to 335 is any amino acid
  Variant (336)..(340): xaa in position 336 to 340 is any or no amino acid
  Variant (342)..(344): xaa in position 342 to 344 is any amino acid
  Variant (347)..(347): xaa in position 347 is any amino acid
  Variant (349)..(351): xaa in position 349 to 351 is any amino acid
  Variant (353)..(360): xaa in position 353 to 360 is any amino acid
  Variant (361)..(362): xaa in position 361 to 362 is any or no amino acid
  Variant (367)..(367): xaa in position 367 is any amino acid
  Variant (369)..(371): xaa in position 369 to 371 is any amino acid
  Variant (372)..(374): xaa in position 372 to 374 is any or no amino acid
  Variant (384)..(388): xaa in position 384 to 388 is any amino acid
  Variant (391)..(398): xaa in position 391 to 398 is any amino acid
  Variant (400)..(402): xaa in position 400 to 402 is any amino acid
  Variant (407)..(407): xaa in position 407 is any amino acid
  Variant (413)..(413): xaa in position 413 is any amino acid
  Variant (415)..(418): xaa in position 415 to 418 is any amino acid
  Variant (419)..(423): xaa in position 419 to 423 is any or no amino acid
  Variant (426)..(426): xaa in position 426 is any amino acid
  Variant (427)..(430): xaa in position 427 to 430 is any or no amino acid
  Variant (432)..(432): xaa in position 432 is any or no amino acid
  Variant (434)..(436): xaa in position 434 to 436 is any or no amino acid
  Variant (439)..(440): xaa in position 439 to 440 is any amino acid
  Variant (442)..(443): xaa in position 442 to 443 is any amino acid
  Variant (445)..(447): xaa in position 445 to 447 is any amino acid
  Variant (449)..(450): xaa in position 449 to 450 is any amino acid
  Variant (451)..(455): xaa in position 451 to 455 is any or no amino acid
  Variant (457)..(457): xaa in position 457 is any amino acid
  Variant (462)..(463): xaa in position 462 to 463 is any amino acid
  Variant (465)..(466): xaa in position 465 to 466 is any amino acid
  Variant (469)..(471): xaa in position 469 to 471 is any amino acid
  Variant (474)..(474): xaa in position 474 is any amino acid
  Variant (476)..(477): xaa in position 476 to 477 is any amino acid
LXXXXXXXXXXXXXXXXXXXXXXXXXXXXXXXXXXXXXXXXXXXXXXXXXXXXXXXXXXXXXYXXXXXXLXXXXXXXXXXIIXXVXXSXLRGRGGAGFPTGLKWXXMXXXXXXXXXXXXXXXXXXXXXYLVXNADEXEPGTXXDRXIMXXXPHXLIEGXXIAGXAMXXAXXGYIYIRGEYXXXXXXXLXXAIXXAXXXGXLGXXXXXSXXXXXXLXVXXGAGAYICGEETALLXSLEGKXGXPRXKPXPFPAXXGLYGXPTXVXNVETXAXXXXILXXGXXWFXXXGXXXXXXXXXGTKLFXISGXVXXXXXXEXXXXXXXXELIXXXXGGVXXXXXXXXAXXXGGXSXXXLXXXXXXXXXXMDFDXLXXXXXXLGTGAVIVMXXXXXMVXXXXXXXXFXXXESCGXCTPCRXGXXXXXXXXXILXXXXXGXGXXXDIXXLXXLXXXIXXXXXXXTXCALGXXAXXPVXXXIRXFXXE

SEQ ID NO: 39433 - protein, 12 aa, Artificial sequence
  Variant (4)..(5): xaa in position 4 to 5 is Ala or Gly
  Variant (7)..(7): xaa in position 7 is Pro or Ser
  Variant (8)..(8): xaa in position 8 is Ala, Ser or Thr
  Variant (10)..(10): xaa in position 10 is any amino acid
RGGXXFXXGXKW

SEQ ID NO: 39434 - protein, 50 aa, Artificial sequence
  Variant (2)..(4): xaa in position 2 to 4 is any amino acid
  Variant (6)..(6): xaa in position 6 is Ala, Cys, Gly, Ser or Thr
  Variant (9)..(9): xaa in position 9 is any amino acid
  Variant (10)..(10): xaa in position 10 is Asp or Glu
  Variant (11)..(11): xaa in position 11 is Pro or Ser
  Variant (12)..(12): xaa in position 12 is Ala, Gly or Asn
  Variant (13)..(13): xaa in position 13 is Ala, Ser or Thr
  Variant (14)..(15): xaa in position 14 to 15 is any amino acid
  Variant (18)..(19): xaa in position 18 to 19 is any amino acid
  Variant (20)..(20): xaa in position 20 is Ile, Leu or Met
  Variant (21)..(23): xaa in position 21 to 23 is any amino acid
  Variant (25)..(26): xaa in position 25 to 26 is any amino acid
  Variant (27)..(27): xaa in position 27 is Phe, Ile, Leu, Met or Val
  Variant (28)..(28): xaa in position 28 is Phe, Ile, Leu or Val
  Variant (29)..(29): xaa in position 29 is any amino acid
  Variant (30)..(30): xaa in position 30 is Ala or Gly
  Variant (31)..(32): xaa in position 31 to 32 is any amino acid
  Variant (33)..(33): xaa in position 33 is Ile, Leu, Met or Val
  Variant (34)..(34): xaa in position 34 is Ala, Cys, Gly, Ser, Thr or Val
  Variant (35)..(35): xaa in position 35 is Ala, Cys, Gly, Ser or Thr
  Variant (36)..(36): xaa in position 36 is any amino acid
  Variant (37)..(37): xaa in position 37 is Ala, Gly, Ser, Thr or Val
  Variant (38)..(49): xaa in position 38 to 49 is any amino acid
  Variant (50)..(50): xaa in position 50 is Ala, Glu or Gly
YXXXNXDEXXXXXXXDRXXXXXXPXXXXXXXXXXXXXXXXXXXXXXXXXX

SEQ ID NO: 39435 - protein, 45 aa, Artificial sequence
  Variant (3)..(4): xaa in position 3 to 4 is any or no amino acid
  Variant (6)..(6): xaa in position 6 is Ile or Val
  Variant (7)..(7): xaa in position 7 is Ala or Cys
  Variant (11)..(11): xaa in position 11 is Ser or Thr
  Variant (12)..(12): xaa in position 12 is Ala or Ser
  Variant (13)..(13): xaa in position 13 is any amino acid
  Variant (14)..(14): xaa in position 14 is Phe, Ile, Leu or Met
  Variant (15)..(15): xaa in position 15 is Ala, Asp, Glu, Gly, Asn or Ser
  Variant (17)..(17): xaa in position 17 is Ile, Leu or Val
  Variant (20)..(21): xaa in position 20 to 21 is any amino acid
  Variant (22)..(22): xaa in position 22 is Ala or Gly
  Variant (23)..(23): xaa in position 23 is any amino acid
  Variant (24)..(24): xaa in position 24 is Pro or Val
  Variant (25)..(26): xaa in position 25 to 26 is any amino acid
  Variant (27)..(27): xaa in position 27 is Lys or Arg
  Variant (30)..(30): xaa in position 30 is any amino acid
  Variant (31)..(31): xaa in position 31 is Pro or Val
  Variant (32)..(34): xaa in position 32 to 34 is any amino acid
  Variant (36)..(39): xaa in position 36 to 39 is any amino acid
  Variant (41)..(41): xaa in position 41 is Ser or Thr
  Variant (42)..(44): xaa in position 42 to 44 is any amino acid
GAXXYXXGEEXXXXXSXEGXXXXXXXXPPXXXXXGXXXXPXXXXN

SEQ ID NO: 39436 - protein, 16 aa, Artificial sequence
  Variant (2)..(4): xaa in position 2 to 4 is any amino acid
  Variant (9)..(9): xaa in position 9 is any amino acid
  Variant (15)..(15): xaa in position 15 is any amino acid
FXXXESCGXCTPCRXG

SEQ ID NO: 39437 - DNA, 1152 bp, Escherichia coli
  CDS (1)..(1152)
atgatggctaacagaatgattctgaacgaaacggcatggtttggtcggggtgctgttggggctttaaccgatgaggtgaaacgccgtggttatcagaaggcgctgatcgtcaccgataaaacgctggtgcaatgcggcgtggtggcgaaagtgaccgataagatggatgctgcagggctggcatgggcgatttacgacggcgtagtgcccaacccaacaattactgtcgtcaaagaagggctcggtgtattccagaatagcggcgcggattacctgatcgctattggtggtggttctccacaggatacttgtaaagcgattggcattatcagcaacaacccggagtttgccgatgtgcgtagcctggaaggactttccccgaccaataaacccagtgtaccgattctggcaatccccaccacagcaggcactgcggcagaagtgaccattaactacgtgatcactgacgaagaaaaacggcgcaagtttgtttgcgttgatccgcatgatatcccgcaggtggcgtttattgacgctgacatgatggatggtatgcctccagcgctgaaagctgcgacgggtgtcgatgcgctcactcatgctattgaggggtatattacccgtggcgcgtgggcgctaaccgatgcactgcacattaaagcgattgaaatcattgctggggcgctgcgaggatcggttgctggtgataaggatgccggagaagaaatggcgctcgggcagtatgttgcgggtatgggcttctcgaatgtggggttagggttggtgcatggtatggcgcatccactgggcgcgttttataacactccacacggtgttgcaaacgccatcctgttaccgcatgtcatgcgttataacgctgactttaccggtgagaagtaccgcgatatcgcgcgcgttatgggcgtgaaagtggaaggtatgagcctggaagaggcgcgtaatgccgctgttgaagcggtgtttgctctcaaccgtgatgtcggtattccgccacatttgcgtgatgttggtgtacgcaaggaagacattccggcactggcgcaggcggcactggatgatgtttgtaccggtggcaacccgcgtgaagcaacgcttgaggatattgtagarctttaccataccgcctggtaa

SEQ ID NO: 39438 - protein, 383 aa, Escherichia coli
MMANRMILNETAWFGRGAVGALTDEVKRRGYQKALIVTDKTLVQCGVVAKVTDKMDAAGLAWAIYDGVVPNPTITVVKEGLGVFQNSGADYLIAIGGGSPQDTCKAIGIISNNPEFADVRSLEGLSPTNKPSVPILAIPTTAGTAAEVTINYVITDEEKRRKFVCVDPHDIPQVAFIDADMMDGMPPALKAATGVDALTHAIEGYITRGAWALTDALHIKAIEIIAGALRGSVAGDKDAGEEMALGQYVAGMGFSNVGLGLVHGMAHPLGAFYNTPHGVANAILLPHVMRYNADFTGEKYRDIARVMGVKVEGMSLEEARNAAVEAVFALNRDVGIPPHLRDVGVRKEDIPALAQAALDDVCTGGNPREATLEDIVELYHTAW

SEQ ID NO: 39439 - DNA, 1251 bp, Archaeoglobus fulgidus DSM 4304
  CDS (1)..(1251): transl_table=11
gtgttgtgtatggctgaatggccgatggacagacctgagttgagaaccatcataacgacctacagcgttccagagtcgaagcttctgctgaactcattcatcatgccgaagaccttctacgggttggccggtttgcagatgtttgctggagccatggtgcagttcggaagaaggagggctttcatagtcaccgataagggagtgagagcccttgctctgacagtgcaaaaaatgcttaagggtgtcggcattgaagtcgagattttcgacgaagcgaagcctgaggtgccgttgagctcgataaagcccgctgcagaaaaaatggaagccctccagcccgacttgattgtggcagttggtggtggaagcgttatggacatggcgaaggcctcgtggattctctacgaggctccgcagacagacctgacaaacgtcgatgcgatgcagccgatcgggctgaggagaaaggcgtttctggcgtgcatcccaacaactgccggaacgggaagcgaggcaacaaacgttgcggtcattacagatgacactgtggagccgcacaggaaagagggtgttgtgcatcctgagctttatcctgacttcgccgtcctcgacccgcgatttgttttgaaaatgcctccgaatctcacacttgggacggggctggatgccctgtcgcatgcagttgactgctacctctgcaggtcgagcaacgaaatttccgacgctctggcggtgagagcgacaaagctcgttttcaagtacctcccgttagccctgaagtaccccgacaacccgcagatcaggctcaaaactcagattgccgccatgattgcaggttcagccttttcgaacggcggaataggaacgacccacgcagttgcgcacaacataggcgcgctcttcgaggttcaccacggtatggcgtgtggggttacaataccctacgtcatcaagttctacgcggaggtggatgataagtacctcagctttgccgaggagcttggcgtgagaggaggcagcaacgaagaaacgctgaaaaagctcatagacattttcatggacttctacaggaaaataggggcaccaacgactatgagagaccttggcataaaagaggatgacttcaaggagaagctcgacaccttcgcacagtacgttgttaaagacccaacagggcccttcgctccgaggcagcttactgttgaggaggcgaaggagttgttgatggatatgtattatgggaggttgtga

SEQ ID NO: 39440 - protein, 416 aa, Archaeoglobus fulgidus DSM 4304
MLCMAEWPMDRPELRTIITTYSVPESKLLLNSFIMPKTFYGLAGLQMFAGAMVQFGRRRAFIVTDKGVRALALTVQKMLKGVGIEVEIFDEAKPEVPLSSIKPAAEKMEALQPDLIVAVGGGSVMDMAKASWILYEAPQTDLTNVDAMQPIGLRRKAFLACIPTTAGTGSEATNVAVITDDTVEPHRKEGVVHPELYPDFAVLDPRFVLKMPPNLTLGTGLDALSHAVDCYLCRSSNEISDALAVRATKLVFKYLPLALKYPDNPQIRLKTQIAAMIAGSAFSNGGIGTTHAVAHNIGALFEVHHGMACGVTIPYVIKFYAEVDDKYLSFAEELGVRGGSNEETLKKLIDIFMDFYRKIGAPTTMRDLGIKEDDFKEKLDTFAQYVVKDPTGPFAPRQLTVEEAKELLMDMYYGRL

SEQ ID NO: 39441 - DNA, 1188 bp, Archaeoglobus fulgidus DSM 4304
  CDS (1)..(1188): transl_table=11
atgaacattgaaaaacattttatattgttcaatcatcctctcatcatgtggtggtttgttgtaccaaagacagttttcggtgacgatgccattgagcacctgcagagcgagagagcagagagggtgctgattgtaactgacaaggttctgagcgagatgagctaccttgaggaggtaaagaaaaatctcaaggcggagagaatagaggttttcgacgaggtagagccggagccgagcatagaaactgccctaaaatgctcaaaagtggcgagagagcttgatgcgcagctcataatcgctctcggtggtggcagcgttatggacgttgcgaagatggcgaggatactgatggagcttgacgtcgatccagagttcatcacgccctttacagatctctatgagctcggttttcaaaagaaagcaaagctcatcgccattccgacaaccagcggcacgggagcggatgcaacatgggcaatggtgcttaccgacaccaaggaaaagagaaaagttcttcctgcgaacagagaagcgataccggatttaacaatactcgactacaggtttgttgaaaaccttccgcccaagctcgtagccggcacgggaatggatgcgctaacccatgcaatcgagggtgctctggctccgtggagaaacgacttcagcgatgcaatgtgcgagaaggcaattgaattaatcttcgacaaccttgagaagtcttacaacggggacaaggaggcgagggctaagatgcaccacgccgcaacgatggccggaatgggattcggaaactctcaggtggggccggtgcactccttgggccatgctttcggagcctacttcaaggtgcaccacggcatttgcgttgcggtgttcctcccctacgttttgcagttctaccttaacgatgaaggctcgagggcaatgatggattatctggctggtagggttggattggagagcggagagtctatggtggagaaagtaatggacctcatgaagaagatagaggctccgacaaaggtttcagacattgttggtgagaaggagtactttggggcaattgaggatatatggagccatgctatcaacgatgcgtgcatgattacctctccgagatgtccagacaccgagcaaacgaggaagctgcttgagtacgcattctacggaaagagggttgacttctga

SEQ ID NO: 39442 - protein, 395 aa, Archaeoglobus fulgidus DSM 4304
MNIEKHFILFNHPLIMWWFVVPKTVFGDDAIEHLQSERAERVLIVTDKVLSEMSYLEEVKKNLKAERIEVFDEVEPEPSIETALKCSKVARELDAQLIIALGGGSVMDVAKMARILMELDVDPEFITPFTDLYELGFQKKAKLIAIPTTSGTGADATWAMVLTDTKEKRKVLPANREAIPDLTILDYRFVENLPPKLVAGTGMDALTHAIEGALAPWRNDFSDAMCEKAIELIFDNLEKSYNGDKEARAKMHHAATMAGMGFGNSQVGPVHSLGHAFGAYFKVHHGICVAVFLPYVLQFYLNDEGSRAMMDYLAGRVGLESGESMVEKVMDLMKKIEAPTKVSDIVGEKEYFGAIEDIWSHAINDACMITSPRCPDTEQTRKLLEYAFYGKRVDF

SEQ ID NO: 39443 - DNA, 1173 bp, Mesorhizobium loti MAFF303099
  CDS (1)..(1173): transl_table=11
atgtccaaactcatctccaaatggaactaccccaccaccgtccgcttcggcgccgggcgtatcaaggaattgcctgaggtgctcgaggccaccggtatcaagcggccgctcttcgtcaccgatccgggcctggcgaaactgccggtcgtcgcttcgacgctgaagatcctcgacgatgccaaggtgccttacggtgtgttttccgaggtgaagccgaatccggtcgattccaacctcaccgccggcatcgccgtgttcaagaagggcaagcatgacggcgtcatcgccttcggcggcggctcggcgctcgatctcggcaagctgatcgccttccaggccggccagacgcggccggtgtgggatttcgaggatgtcggcgactggtggacgcgcgccaattcggatgcgatcgcgccgatcatcgccgtgccgacgacggccggcaccggctcggaagtcggccgcgccggcgtcatcaccaatgaggagacgcacaccaagaaggtcatcttccatccgaagctcttgccggcgatcgtcattgccgatccggaactgtcggtcggcatgcccgccttcatcaccgccggcaccggcatggatgcgcttgcccactgcctcgaggcctattgcgcgccgggttaccatccgatggctgacggcatcgcggtggaaggcatccggctggtgtttgaaaacctgccgaaggcctatgccaacggcaaggacctggtcgcgcgtgcccatatgatgagcgcggccgccatgggcgccgccgccttccagaaggggctgggcgccatccactcgctgtcgcacccgatcggcgcgctctacgacacccatcacggcatgaccaatgcggtgttcatgccttatgtgctcgccttcaatcgtgactccatcgaggagcgtatcgcccggctcgccgcctattgcggcatcaagggcggcttcgacggcttcgccaaggcgatcatcaagctgcgcaaggagttgaaggtgccgcacgcgctgccgggcctgatcaaggggctcgacatggacaagaagcgcaaggcgctgatcgccgacatggcggtggtcgatccgaccgccggcggcaacccggtcaagctgaccaagaaggcggcgctgacgctgctggaaaacgctatcgccggcacgatctga

SEQ ID NO: 39444 - protein, 390 aa, Mesorhizobium loti MAFF303099
MSKLISKWNYPTTVRFGAGRIKELPEVLEATGIKRPLFVTDPGLAKLPVVASTLKILDDAKVPYGVFSEVKPNPVDSNLTAGIAVFKKGKHDGVIAFGGGSALDLGKLIAFQAGQTRPVWDFEDVGDWWTRANSDAIAPIIAVPTTAGTGSEVGRAGVITNEETHTKKVIFHPKLLPAIVIADPELSVGMPAFITAGTGMDALAHCLEAYCAPGYHPMADGIAVEGIRLVFENLPKAYANGKDLVARAHMMSAAAMGAAAFQKGLGAIHSLSHPIGALYDTHHGMTNAVFMPYVLAFNRDSIEERIARLAAYCGIKGGFDGFAKAIIKLRKELKVPHALPGLIKGLDMDKKRKALIADMAVVDPTAGGNPVKLTKKAALTLLENAIAGTI

SEQ ID NO: 39445 - DNA, 1227 bp, Mesorhizobium loti MAFF303099
  CDS (1)..(1227): transl_table=11
atgagcctcttcgccgccctccggcttccgcgtgaaatccttttcgggaaaggccagcgccacgcactgtcgacagtcgccggcaggttcggccggcacgccctggtctgtaccgacgagcgtttcgccggcacggcggtgttcgcggaaattgtccaatcgctccaggccgcctcgatcgaggtgctggtgcatgaccgcgtgcttcccgacgtgccacgtgacagcgtcggcatttgcgtcgacgaggccgagaaattccagcccgagatggtgatcggcatcggcggcggcagctgcctcgatttcgccaaatgcgccgacttgctgctcagccatggcggcaagcttcaggactactatggggagttcaaggtgcccggcccgacgctgccgctgatcgccgtgcccacgacagcgggcaccggctccgaagtgacgcccgtcgcggtgatctccgatccggatcggacgctcaaggtcggcatatcgagcccctatctaatcgcggcagttgccttgtgcgaccccgaactgacgatgacctgcccccctgccctgactgcgatagccggcgccgacgccctgacccatgcgatcgaggccttcaccgcgaagcagcgcggcgaggaccccagcctggcgcaacagcatgtcttcatcggcaagaccgcgctgaccgaccatttcgccctcctggccataaagctgctgggccgcagcctggagaaagcctgcaccgacggcacggatgccgatgcgcgcgccgatgtgatgatgggcgcactggcggcgggctgcgcattcggcaccgccggcactgcggcggcgcatgccgtgcaatatcccgcgggcgccctcacccacaccgcgcacggattgggcgtggcgacgatgatgccttacgtcatgacctacaacagccgcgtggtcgccgccgaaatggccgagatcggcgacgcgcttggccttgaggccaaggggcggagcgccgaggagatggcggacgccaccatcaaggaaatccggcggctattcacggcgatcggcatcacgccgacgctggccgatctcggccttcccgccgacaagctcgactggaccgccgatcaggcgctcggcatcgaccgcctgatcaagaacaacccgcgccccttcgatctcaccgccatgcgacgcctggtccaggccgcccatgacggcgacctcgcagcctgcgccatgtaa

SEQ ID NO: 39446 - protein, 408 aa, Mesorhizobium loti MAFF303099
MSLFAALRLPREILFGKGQRHALSTVAGRFGRHALVCTDERFAGTAVFAEIVQSLQAASIEVLVHDRVLPDVPRDSVGICVDEAEKFQPEMVIGIGGGSCLDFAKCADLLLSHGGKLQDYYGEFKVPGPTLPLIAVPTTAGTGSEVTPVAVISDPDRTLKVGISSPYLIAAVALCDPELTMTCPPALTAIAGADALTHAIEAFTAKQRGEDPSLAQQHVFIGKTALTDHFALLAIKLLGRSLEKACTDGTDADARADVMMGALAAGCAFGTAGTAAAHAVQYPAGALTHTAHGLGVATMMPYVMTYNSRVVAAEMAEIGDALGLEAKGRSAEEMADATIKEIRRLFTAIGITPTLADLGLPADKLDWTADQALGIDRLIKNNPRPFDLTAMRRLVQAAHDGDLAACAM

SEQ ID NO: 39447 - DNA, 1128 bp, Pyrococcus abyssi GE5
  CDS (1)..(1128): transl_table=11
atgaggttctttttaaagacgacaattctcatgggtaggggatcccttgagaacgtgaagaggataatctcggagggggagagggttctaatattctcttcaagatcaatggatagacttggcttcttaagcgaagtcgccgattacgtggaggaagccggaggagtttacgaaacgattatcggtttaccacctgaacctagcgttgagaacgttgaggaggttcttcccaaggttgaggaattttcaccagaaactttcatagcactaggcggtggaagtgtaatagacgttgcaaaggccgttaaagttttttacgatgctcctgggcttgattttgacagtgtggcaatatttagcaggttcaagaaggctcaacccctgccaaagcttaagactaggctaatagctatcccctcaacgagcggtgctggaagcgaagtttcggctgctagtgtcataaagaagggggataccaagtacacgatagttagcccagagttatgtccagattatgctatcttagaccctagactacctgagaaaatgcccagggaagttgccaggaattccggactagacgttctcgtccatgctattgaagcttacgtctcaaaggcctcaacgcccttcagcgatgccctcgcggttaaagctgctagaataatattcgagaggcttgaagatagcgtcaacggcgatgcaaaggccagagaggaagtacactatgccgcaaccatggctggaatagcattcttaaacggtagattaggcctagtccatgcgatgagtcacaaatctgcttggattggccctcatgggttggttaacgcaatattcctaccctacgttatggagtttaacatggagagggccagggaaaagtacgatgcgatggcaagagagctagggctttccagtgcggatgaactactagagaaggttaaggaacttaatgaaaagcttggagttccgaagctttcggagatagtgaaggaggaggaattcctgggcaaggtagaggatatgagcaggaaaacctacgaagatccactcgttagctttaacccagttgagccgagcgttgaagatataaagaatctctacctgagggccctccatgactga

SEQ ID NO: 39448 - protein, 375 aa, Pyrococcus abyssi GE5
MRFFLKTTILMGRGSLENVKRIISEGERVLIFSSRSMDRLGFLSEVADYVEEAGGVYETIIGLPPEPSVENVEEVLPKVEEFSPETFIALGGGSVIDVAKAVKVFYDAPGLDFDSVAIFSRFKKAQPLPKLKTRLIAIPSTSGAGSEVSAASVIKKGDTKYTIVSPELCPDYAILDPRLPEKMPREVARNSGLDVLVHAIEAYVSKASTPFSDALAVKAARIIFERLEDSVNGDAKAREEVHYAATMAGIAFLNGRLGLVHAMSHKSAWIGPHGLVNAIFLPYVMEFNMERAREKYDAMARELGLSSADELLEKVKELNEKLGVPKLSEIVKEEEFLGKVEDMSRKTYEDPLVSFNPVEPSVEDIKNLYLRALHD

SEQ ID NO: 39449 - DNA, 1128 bp, Pyrococcus horikoshii OT3
  CDS (1)..(1128): transl_table=11
atgacattcttcctaaagactaccatattaatgggtaggggatcccttgaaaatataaaaaagcttgtatctgaaggtgagagggtactcgtcttttcttcaaagtctatggataggcttggctttttaaaagaggtaattgactatttagacgaagcaggtgcaacctatgaaagtattacgggattaccttccgagccaagcattgaaaacgttgaggaattgctcccaaaggtcaaggatttctctccggaaaccttcatagcactcggtggagggagcgtgatagatatctcaaaagccctgaaagttttctatgatgctcctgaacttgattttgacagtgttgcaatatttagcagatttaaaaaagctcaacctcttccaaagcttaaaacaaagcttatagccgttccttctacgagtggtgcagggagtgaagtatccgctgcgaccgtgataaagaagggggatatcaagtacacgatagtgagtccagagctttgtccaaattatgcaatcttggatccgagactccccgagaacatgcccagggaagtagctaggaactctggattagatgtattagttcatgccatagaagcttacgtttcaaaggcatcaacaccttttagtgatgctatggccgtaaaagcagcaaggacaattcttgaaaagcttgaagatagcgttaatggcgatcctaccgctagagaagaagttcattatgccgccactatggccggaatagccttcctaaatggtagacttggactcgtccatgcaatgagtcataaagcagcgtggattggccctcatggattgattaatgcgatactactcccatatgtaatggagttcaatatggaaaaagctagagaaaagtacgatgcaatggccaaggaacttgggctttccaatgctgaagaacttcttcagaaggttaaagagctcaatgaaagattaaacgttccaaagttatcggaaatagttagcgaggaagatttcacttcaaggcttgatgagatgagcagaaaggcttacgaagatcccctggttaacttcaatccagtggaaccaagcgttgatgatataaagaacatctatctgagggccttccatgattga

SEQ ID NO: 39450 - protein, 375 aa, Pyrococcus horikoshii OT3
MTFFLKTTILMGRGSLENIKKLVSEGERVLVFSSKSMDRLGFLKEVIDYLDEAGATYESITGLPSEPSIENVEELLPKVKDFSPETFIALGGGSVIDISKALKVFYDAPELDFDSVAIFSRFKKAQPLPKLKTKLIAVPSTSGAGSEVSAATVIKKGDIKYTIVSPELCPNYAILDPRLPENMPREVARNSGLDVLVHAIEAYVSKASTPFSDAMAVKAARTILEKLEDSVNGDPTAREEVHYAATMAGIAFLNGRLGLVHAMSHKAAWIGPHGLINAILLPYVMEFNMEKAREKYDAMAKELGLSNAEELLQKVKELNERLNVPKLSEIVSEEDFTSRLDEMSRKAYEDPLVNFNPVEPSVDDIKNIYLRAFHD

SEQ ID NO: 39451 - DNA, 1200 bp, Aeropyrum pernix K1
  CDS (1)..(1200): transl_table=11
gtgatgttttctttaggtggaccccgtttggttgactttgttttcccccgtaggatagtgtataatgagagcctccctagggctcttgagacgcttctaggggataagggtgttaaacatgtcctagtggttactgacggtaaagtcgcagctatgagctggtttaaagaagcggttgagcatgtagccagtctcggtgtagaagtgtgtatctttgacggtgttacccctgagccggagtttgatgtgggagacgctatagcatcggaggctaggaggtgccgggctgaggctatagtggctgtgggtggaggcagtgtaatagacgcggctaaggctgggtttgtgaagtttgtcaggcctgatgccgacctggagggcctagcgcccttcaactacctaggccttgaagactctggcatagtactggtagctgttcccacgacgagcggtactggcagcgacgccagctatggtatagtcctcacaaagcgggttaacggtggtagagagaagattgctgtgggcagctacgaggtagtaccctacgcctcaatactcgacccctcaataacacttggcatgccggaaagattgaccgtaggtacggctgttgacgcgctggctcacagtgtggaggctatagcctccacaaacgccaacccgctctccgacgctttagcggctaaggcggctgagatagtcttcaggaggctgccagaggttgtgaatgacccaggcaactatgatgctagggctgagatgcatatcgcagccacaatggctggtatggcgttcacaaactccggcctcggcctagcccacgcgatagcacaccccctcggcgcgaggcttggaacgcaccatggagccacagtgggtatggttctcccccatgtggtcaggttcaacgagtcaaggagtgactatgcgaggaggaagtattgggagctaaagctactgctcgagtccctacttggccttgaagaaagggggagcctagccgaccatatagaagaattatatgccagggtggggcagcccacgagggttagagagcttgcgggtattgagagggaaagatatcttaccttggccgacgaggttgcagaagccgccttcagagacccggaactggccttcaaccctgttatgccaactatggaagatgtaaaaacgctactgtacaatatgtattaa

SEQ ID NO: 39452 - protein, 399 aa, Aeropyrum pernix K1
MMFSLGGPRLVDFVFPRRIVYNESLPRALETLLGDKGVKHVLVVTDGKVAAMSWFKEAVEHVASLGVEVCIFDGVTPEPEFDVGDAIASEARRCRAEAIVAVGGGSVIDAAKAGFVKFVRPDADLEGLAPFNYLGLEDSGIVLVAVPTTSGTGSDASYGIVLTKRVNGGREKIAVGSYEVVPYASILDPSITLGMPERLTVGTAVDALAHSVEAIASTNANPLSDALAAKAAEIVFRRLPEVVNDPGNYDARAEMHIAATMAGMAFTNSGLGLAHAIAHPLGARLGTHHGATVGMVLPHVVRFNESRSDYARRKYWELKLLLESLLGLEERGSLADHIEELYARVGQPTRVRELAGIERERYLTLADEVAEAAFRDPELAFNPVMPTMEDVKTLLYNMY

SEQ ID NO: 39453 - DNA, 2577 bp, Clostridium acetobutylicum ATCC 824
  CDS (1)..(2577): transl_table=11
atgaaagttacaaatcaaaaagaactaaaacaaaagctaaatgaattgagagaagcgcaaaagaagtttgcaacctatactcaagagcaagttgataaaatttttaaacaatgtgccatagccgcagctaaagaaagaataaacttagctaaattagcagtagaagaaacaggaataggtcttgtagaagataaaattataaaaaatcattttgcagcagaatatatatacaataaatataaaaatgaaaaaacttgtggcataatagaccatgacgattctttaggcataacaaaggttgctgaaccaattggaattgttgcagccatagttcctactactaatccaacttccacagcaattttcaaatcattaatttctttaaaaacaagaaacgcaatattcttttcaccacatccacgtgcaaaaaaatctacaattgctgcagcaaaattaattttagatgcagctgttaaagcaggagcacctaaaaatataataggctggatagatgagccatcaatagaactttctcaagatttgatgagtgaagctgatataatattagcaacaggaggtccttcaatggttaaagcggcctattcatctggaaaacctgcaattggtgttggagcaggaaatacaccagcaataatagatgagagtgcagatatagatatggcagtaagctccataattttatcaaagacttatgacaatggagtaatatgcgcttctgaacaatcaatattagttatgaattcaatatacgaaaaagttaaagaggaatttgtaaaacgaggatcatatatactcaatcaaaatgaaatagctaaaataaaagaaactatgtttaaaaatggagctattaatgctgacatagttggaaaatctgcttatataattgctaaaatggcaggaattgaagttcctcaaactacaaagatacttataggcgaagtacaatctgttgaaaaaagcgagctgttctcacatgaaaaactatcaccagtacttgcaatgtataaagttaaggattttgatgaagctctaaaaaaggcacaaaggctaatagaattaggtggaagtggacacacgtcatctttatatatagattcacaaaacaataaggataaagttaaagaatttggattagcaatgaaaacttcaaggacatttattaacatgccttcttcacagggagcaagcggagatttatacaattttgcgatagcaccatcatttactcttggatgcggcacttggggaggaaactctgtatcgcaaaatgtagagcctaaacatttattaaatattaaaagtgttgctgaaagaagggaaaatatgctttggtttaaagtgccacaaaaaatatattttaaatatggatgtcttagatttgcattaaaagaattaaaagatatgaataagaaaagagcctttatagtaacagataaagatctttttaaacttggatatgttaataaaataacaaaggtactagatgagatagatattaaatacagtatatttacagatattaaatctgatccaactattgattcagtaaaaaaaggtgctaaagaaatgcttaactttgaacctgatactataatctctattggtggtggatcgccaatggatgcagcaaaggttatgcacttgttatatgaatatccagaagcagaaattgaaaatctagctataaactttatggatataagaaagagaatatgcaatttccctaaattaggtacaaaggcgatttcagtagctattcctacaactgctggtaccggttcagaggcaacaccttttgcagttataactaatgatgaaacaggaatgaaataccctttaacttcttatgaattgaccccaaacatggcaataatagatactgaattaatgttaaatatgcctagaaaattaacagcagcaactggaatagatgcattagttcatgctatagaagcatatgtttcggttatggctacggattatactgatgaattagccttaagagcaataaaaatgatatttaaatatttgcctagagcctataaaaatgggactaacgacattgaagcaagagaaaaaatggcacatgcctctaatattgcggggatggcatttgcaaatgctttcttaggtgtatgccattcaatggctcataaacttggggcaatgcatcacgttccacatggaattgcttgtgctgtattaatagaagaagttattaaatataacgctacagactgtccaacaaagcaaacagcattccctcaatataaatctcctaatgctaagagaaaatatgctgaaattgcagagtatttgaatttaaagggtactagcgataccgaaaaggtaacagccttaatagaagctatttcaaagttaaagatagatttgagtattccacaaaatataagtgccgctggaataaataaaaaagatttttataatacgctagataaaatgtcagagcttgcttttgatgaccaatgtacaacagctaatcctaggtatccacttataagtgaacttaaggatatctatataaaatcattttaa

SEQ ID NO: 39454 - protein, 858 aa, Clostridium acetobutylicum ATCC 824
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVAIPTTAGTGSEATPFAVITNDETGMKYPLTSYELTPNMAIIDTELMLNMPRKLTAATGIDALVHAIEAYVSVMATDYTDELALRAIKMIFKYLPRAYKNGTNDIEAREKMAHASNIAGMAFANAFLGVCHSMAHKLGAMHHVPHGIACAVLIEEVIKYNATDCPTKQTAFPQYKSPNAKRKYAEIAEYLNLKGTSDTEKVTALIEAISKLKIDLSIPQNISAAGINKKDFYNTLDKMSELAFDDQCTTANPRYPLISELKDIYIKSF

SEQ ID NO: 39455 - DNA, 1191 bp, Clostridium acetobutylicum ATCC 824
  CDS (1)..(1191): transl_table=11
ttgaaaaatacatattatcgtcttcagcaatatatgtttagtaaggctcaaagacttcttccttggcgtatgccgaacatcatatctggaagcaaaagtatctgtaaactgccttataaggtaaaaaatgacggtgtaaaaaaggtcttagttattacaactgctggatcaataaagcgcggcagtttaaatgaaatgtttgatgagttaaaaaaagaaaatatatcttatgtaatatatgatgatgtacaacctgatccaaccattgaatgtatcgaggctgttgtaaagttctataaaaaagaagcttgcgaaggaatcatagcagtaggtggtggttctgtaatggactgcgctaaggttactggtgctagaattgtaaaaccgaaaaaaagtgtaagtcaaatggcaggtcttatgaaaatcagaaaagagcttcctccactatacactgttcctacaactgccggtaccggatcagaaacaacagtagctgcagttgtaacagacagttcaactcacctaaaatatgcggtaagcgatttatgtctaattccaaaatacgcagtactagatcctgaattaacctgtggacttcccaaaaatctcacagcaatcacaggaatggatgctcttacacatgcagttgaagcatataccaataaatatagttctaaagaatcaagaaaatatgctttagatgctgtcaaactaatatttgaaaatcttaaaaaagcctatgataatggaaaacacatagaagtgcgtgaaaatatgttaaaagcttcctactatgctggtgttgcttttactagatcctacgtaggatatgttcatgcaattgcacatgcagtaggcggtttgtatggagttcctcatggtatggcaaatgcagttatattacccgtagtgctagaagcttacggtgaggctatttacaaaaatcttgctgaattagctgatgctactagtgttcctggaaaaactcagatggaaaaagctaaaaattttatcttgtcaattaggaaaatgaatcaatctatggagattcctgataaattagattctataaaaaaagaagatattcctgaaatcattaatagagctatgaaggaagctaatcctagctatcctgtgccagtaatctgggacaaaatacaatttgaaaaagttgttgaatcattgaaataa

SEQ ID NO: 39456 - protein, 396 aa, Clostridium acetobutylicum ATCC 824
MKNTYYRLQQYMFSKAQRLLPWRMPNIISGSKSICKLPYKVKNDGVKKVLVITTAGSIKRGSLNEMFDELKKENISYVIYDDVQPDPTIECIEAVVKFYKKEACEGIIAVGGGSVMDCAKVTGARIVKPKKSVSQMAGLMKIRKELPPLYTVPTTAGTGSETTVAAVVTDSSTHLKYAVSDLCLIPKYAVLDPELTCGLPKNLTAITGMDALTHAVEAYTNKYSSKESRKYALDAVKLIFENLKKAYDNGKHIEVRENMLKASYYAGVAFTRSYVGYVHAIAHAVGGLYGVPHGMANAVILPVVLEAYGEAIYKNLAELADATSVPGKTQMEKAKNFILSIRKMNQSMEIPDKLDSIKKEDIPEIINRAMKEANPSYPVPVIWDKIQFEKVVESLK

SEQ ID NO: 39457 - DNA, 1164 bp, Aquifex aeolicus VF5
  CDS (1)..(1164): transl_table=11
atgactgttgtaaatgagtacagacccgttgaagttttcttcggcgaaggagcggtaaaaaaagcgggagaagtagggagacgctttggcttcaaagccctgatagttactggaagaaaaagcacaaaggaaagcggtgcactggataaattgataaactccttaaaacaaaatcaaatagagtacgtggtatttgacgagataactcccaacccgacggacaaacaggtaaacaaaggtgcagagatagccgtaaacgaaaaagtggactttatcgtaggtatcggaggaggaagtgtcttggacgccgcgaaagcaatttccatagtatcttccaacgaaggttacgcctgggattacgtaaggtatccggaagggagcaggctgattccctttctgaacagacccgtgataacgataccgacaacggcgggaacgggaagcgaggtaaacaggtattccgtactcacaaacccgatgacaaaagaaaaaatggtaatttcccacagcctgaactacccgaaggttgcactcgtggacccggagctaacttatagtatgcctcctagactcaccgccctcacaggctttgatgccctgatgcacgcccttgagagtttgacgaataaaagagaaaacttcatagctgaagagtactcggtaaaggcgatagagcttataaggaagtggcttcccgtagcctttgaagagccagaaaataaagaagcaaggcggtacatgagttacgcagctatgcttgcggggatagctatagaccacctcggagttgccctcatacacgcaatggaacaccccgtttcgggacactaccccgaggtggcacatgcggaaggactttcggcgctcgctccttacataaccgcctttaattacagaggaaaccctgagaagtacgccctctttgcaagactgatgggagaagaagaaaaacctcacaaagcggtggacgctctcgttaagttcatagaaaggttttctctcccaaaaaccctgaaggagcttggagtagaaaaggaaaaactcccgagacttgccgaagacgtttacatgtgcgcaaggcactcctttgccgttaaccctgtagaagtaggtatggaagaagtagaggaactctacgaaagggcttacgaaggaagattatga

SEQ ID NO: 39458 - protein, 387 aa, Aquifex aeolicus VF5
MTVVNEYRPVEVFFGEGAVKKAGEVGRRFGFKALIVTGRKSTKESGALDKLINSLKQNQIEYVVFDEITPNPTDKQVNKGAEIAVNEKVDFIVGIGGGSVLDAAKAISIVSSNEGYAWDYVRYPEGSRLIPFLNRPVITIPTTAGTGSEVNRYSVLTNPMTKEKMVISHSLNYPKVALVDPELTYSMPPRLTALTGFDALMHALESLTNKRENFIAEEYSVKAIELIRKWLPVAFEEPENKEARRYMSYAAMLAGIAIDHLGVALIHAMEHPVSGHYPEVAHAEGLSALAPYITAFNYRGNPEKYALFARLMGEEEKPHKAVDALVKFIERFSLPKTLKELGVEKEKLPRLAEDVYMCARHSFAVNPVEVGMEEVEELYERAYEGRL

SEQ ID NO: 39459 - DNA, 2685 bp, Vibrio cholerae O1 biovar eltor str. N16961
  CDS (1)..(2685): transl_table=11
atgcctgttactaatctggctgaacttgatgctctggttgctcgcgttaaagcagctcaagctgaatttgctactttctctcaagaacaagtagacaaaatcttccgcgcagcctctctagcagcaaaccaagcacgtatcccgttagcacaaatggcggtagaagaatcaggtatgggtattgttgaagataaagtaatcaaaaaccactttgcttctgagtttatctacaacaagtacaaggacgaaaaaacctgtggcatcctcgaagaagatgacaacctaggtactatgactatcgctgagcctgttggcatcatctgtggtatcgtcccaacgactaacccaacctcaaccgcgatcttcaaatcactgatttctctgaagactcgtaacggtatcatcttctctccacacccacgtgcgaaaaactcaaccaacgcagcagcgaaactggttctggatgccgcaatcgcagcgggtgcaccaaaagacatcatcggttggattgaccaaccttcagttgagctgtcaaatgctctgatgaaacacgatggtatcgcactgatccttgcgacgggtggtcctgggatggtgaaagcggcttactcttctggtaaaccagccatcggtgtaggtgcaggtaacgttccagttgttatcgatgaaactgcagatatcaaacgtgcggttgcttctatcctgatgtctaaaacgttcgacaacggtgtagtgtgtgcttctgagcaagcggctatcgtagtgagcgaagtttacgacgaagtgaaagagcgtttcgcaacgcacaaagcgcacgtcctgagcaaagcggatgcagacaaagtgcgtaaagtgctgctgattgatggcgctctgaacgcgaagatcgtaggtcaacctgctgctgctatcgctgaaatggcaggcgtaaaagtacctgcagatactaaagtgctggtgggtgaaggtctgggcaaagtctcttatgacgatgaattcgctcacgagaaactgtctccaacacttggcctgttccgtgctgacaacttcgaagacgcggttgctcaagcggtgactatggttgagatcggcggtatcggtcacacctcaggtctgtacaccaaccaagacgttaacgcagaccgtatccgttactttggtgataaactgaaaactgcccgtattcttgtcaacatcccgaccactcacggtggtatcggtgatctgtacaacttcaacgttgcaccgtctctgactctgggttgtggttcttggggtggtaactcaatctctgagaacgtaggtcctaagcacctaatcaacaagaaaactgttgcgaagcgagctgaaaacatgttgtggcacaaactacctaagtctatctacttccgccgtggtagccttccaatcgccctgagcgacctagaaggtaaaaaacgcgcattcctagttactgaccgtttcctattcaacaacggttatgcagacgatgtggttgccctgctgaaagcacaaggcatggaagttcagacattcttcgaagtagaagcggatccaacactgtctgtcgtagaaaaaggcgctgcagcaatgcaaagcttccaaccagatgtgattcttgcgctaggtggtggttcaccaatggatgcggcgaagatcatgtgggtaatgtacgagcacccagatactcactttgaagaactggctatgcgctttatggacatccgtaagcgtatctacaagttccctaaaatgggtaaaaaagcagagcttgtttgtatcactaccacttcaggtacggggtcagaagttacaccattcgcggttgtgactgacgacaagactggcgctaagtacccactggcagactacgaactgacaccacaaatggcgatcgtagatgcgaaccttgtgatgaacatgcctaagtctctgaccgctttcggtggttacgatgcggtaactcacgcactcgaagcttatgtatccgttcttgcgaacgaatactcagacggtcaagcactacaagcgctgaagatgctgaaagagtacctaccttctagctacgcgaatggtgcgaaagatccaatcgctcgtgagaaagtacacaacgcagccactatcgctggtatcgcattcgcgaacgcgttcttgggtgtatgtcactcaatggcgcacaaaatcggtgctgagttccacctaccacacggtttggcgaacgctctgctgattgctaacgtagtacgttacaacgcgaacgacaacccaaccaaacaaacggcattctctcaatacgaccgtccacaagcacgtcgtcgttacgcagaagtggcggaccacttaggtctgagccaaccgggtgaccgtactgcacagaagattgagcgtctgctgacttggttggatgaactgaaagttaacctagacattccaaaatcaatccaagctgcaggtgtagcagaagcagacttccttgcaaaagtggatgagctagcggttgaagcgtttgatgaccaatgtactggtgcaaacccacgctacccactgatcgctgagctgaaagaagttctgctggcttcttactacggtaagccattcgttgaaggtcaaactttcgaaggcaccactgttatcgtaaagaaagcagatcaagaagcggcgaaagcgccaaaagcgaaaaagtaa

SEQ ID NO: 39460 - protein, 894 aa, Vibrio cholerae O1 biovar eltor str. N16961
MPVTNLAELDALVARVKAAQAEFATFSQEQVDKIFRAASLAANQARIPLAQMAVEESGMGIVEDKVIKNHFASEFIYNKYKDEKTCGILEEDDNLGTMTIAEPVGIICGIVPTTNPTSTAIFKSLISLKTRNGIIFSPHPRAKNSTNAAAKLVLDAAIAAGAPKDIIGWIDQPSVELSNALMKHDGIALILATGGPGMVKAAYSSGKPAIGVGAGNVPVVIDETADIKRAVASILMSKTFDNGVVCASEQAAIVVSEVYDEVKERFATHKAHVLSKADADKVRKVLLIDGALNAKIVGQPAAAIAEMAGVKVPADTKVLVGEGLGKVSYDDEFAHEKLSPTLGLFRADNFEDAVAQAVTMVEIGGIGHTSGLYTNQDVNADRIRYFGDKLKTARILVNIPTTHGGIGDLYNFNVAPSLTLGCGSWGGNSISENVGPKHLINKKTVAKRAENMLWHKLPKSIYFRRGSLPIALSDLEGKKRAFLVTDRFLFNNGYADDVVALLKAQGMEVQTFFEVEADPTLSVVEKGAAAMQSFQPDVILALGGGSPMDAAKIMWVMYEHPDTHFEELAMRFMDIRKRIYKFPKMGKKAELVCITTTSGTGSEVTPFAVVTDDKTGAKYPLADYELTPQMAIVDANLVMNMPKSLTAFGGYDAVTHALEAYVSVLANEYSDGQALQALKMLKEYLPSSYANGAKDPIAREKVHNAATIAGIAFANAFLGVCHSMAHKIGAEFHLPHGLANALLIANVVRYNANDNPTKQTAFSQYDRPQARRRYAEVADHLGLSQPGDRTAQKIERLLTWLDELKVNLDIPKSIQAAGVAEADFLAKVDELAVEAFDDQCTGANPRYPLIAELKEVLLASYYGKPFVEGQTFEGTTVIVKKADQEAAKAPKAKK

SEQ ID NO: 39461 - DNA, 1149 bp, Bacillus halodurans C-125
  CDS (1)..(1149): transl_table=11
atgaatatcaataaatttgtaacaccagagattattttcgggggtcatgcaataaggcaagcaggggatgcttgtgttcggcttggtgcgaaaaaagtgttgattgttagtgataggggcgtcgcaaatgccggatggttagaaaaagtaatggaactttgtaaagagtcacatctaccatttgccacgtttgtcggtgtgacgacagacccgaaagatcgcgaggttgaacaagggtgtcaagtgtttgtgcaacatgaatgtgatgccattattggggttggaggaggaagtgtgttagatgtagcgaaagcgatcgccatccttgcaacgaacggtggagctattagtgattatgaaggaatcgataaaataaaaaaaccccttcctccaatgattatgattatgacaactgcaggatccggttctgaagtatcgcaattttcaatcatagttgattctaatcgaaaaaagaaaatgaccattgtatcaaaaacattggttcccgatattgccattattgatccttacacactcgtgacgaaggacagtagcctaaccgctacaacggggatggatgtgctgacacatgccatcgaagcgtatgtcagtattgcggccaccccgcttacagatgtccaggccaaaaatgccctcatcttgtgtgctcaatacttgcgaccctctgttgcttccaaaacgaatacagaggcgaaggaagcgatggcaatggctagcttacaagcaggacttgctttctcaaatgccattttaggggcagcgcatgcaatatcccatgcgattggagggaagtttcccttaccgcatggagaaataaacgctattcttctcccatatgtgatggattttaattttatcgcaacacctaagcgatttttagacatagcgacatgtttaggtattgatacaaggggattgacggaacgggaagcaggaaatgctgcaatccattttgtcaaagagctgtcctttgacatcggtattcccacaagatttagagaggtagggataacacaagaaatgattcatcacattagcgaagtagcgttagaagatgcctgtatgattacgaatcctcgtgacatgaatgttgagcaagtaaagcaagtattaaaaaatgttttatag

SEQ ID NO: 39462 - protein, 382 aa, Bacillus halodurans C-125
MNINKFVTPEIIFGGHAIRQAGDACVRLGAKKVLIVSDRGVANAGWLEKVMELCKESHLPFATFVGVTTDPKDREVEQGCQVFVQHECDAIIGVGGGSVLDVAKAIAILATNGGAISDYEGIDKIKKPLPPMIMIMTTAGSGSEVSQFSIIVDSNRKKKMTIVSKTLVPDIAIIDPYTLVTKDSSLTATTGMDVLTHAIEAYVSIAATPLTDVQAKNALILCAQYLRPSVASKTNTEAKEAMAMASLQAGLAFSNAILGAAHAISHAIGGKFPLPHGEINAILLPYVMDFNFIATPKRFLDIATCLGIDTRGLTEREAGNAAIHFVKELSFDIGIPTRFREVGITQEMIHHISEVALEDACMITNPRDMNVEQVKQVLKNVL

SEQ ID NO: 39463 - DNA, 2628 bp, Pasteurella multocida subsp. multocida str. Pm70
  CDS (1)..(2628): transl_table=11
atgatgagtcatactgctgaaattgaaatcagcccagcacaagcagaagtgaatgtactggttgaaaaaggattgctggcattagaagcattccgtcagcttaatcaacagcaagtggattacattgtggcaaaagcctcagtagctgctttagatcaacatggggtgcttgctatgcatgcttatgaagaaacagggcgcggggtatttgaagataaagccaccaaaaatctgtttgcctgtgaatatgtagtcaacaatatgcggaatttgaaaaccgtgggggtgatcagtgaggatgatgtcacagggatcaccgaaattgcagaccctgttggcgtggtttgcggaattaccccaacgaccaacccgacgtccaccaccattttcaaagcccttatctcgctaaaaacccgtaaccccatcgtctttgcattccatccttccgcacaacaatgttctgctcatgcggcacgcgtagtctatgaggcagccgttgcagcgggggcgccagaacattgtattcaatggattgaaaccccgtcgatggaaggcaccgcagcgctgatgaaacacccaggcattgctaccattcttgctacgggcggcaatgcgatggttgaggcggcgtattcttgtggtaaaccagctcttggcgtaggagcgggtaacgtacctgcttatgtggaaaaaagcgcaaatatcaaacaagctacacatgatattgtgatgtcaaaagcctttgataacggcatgatttgtgcctctgaacaagccgccattgtcgatcaagaggtgtacgatgaatttgtggcagaaatgcagtcttatggtgcttactttgtaaataaaaaagaaaaagccttgttagaaacatttcttttcggcgtcaaagccaacagtacaaattgtgctaacgcaaaattaaatgccgcggttgtgggaaaacctgccacatggatcgccgaacaagcgggcttcaaagtgccagaaaaaaccaatattttggtggcagcctgtcaagaagtgggcgaaaacgaaccccttacccgtgaaaaactttccccagtcctcgcgatattaaaatccacgtcaacagaacatggctttgcgttatctgaagccatggtgaatttccatggtttaggacattccgccgccattcatactaaagaggcaagcattgccaaagcctttggcgaacgcgtgaaagccattcgtgtgatctggaactcgcctgcgacctttgggggcattggcgatgtgtataatgccttcctcccgtcactcacactcggttgtggttcctacgggaaaaactccgtcggtaacaatgtcagtgcagccaatttattaaatattaaacgtgtgggaagacggagaaataacatgcaatggttcaaagtgccttcaaaaatctattttgaacgcgattcaattcaatatttacaatcaatgaaaggcatggaacgcgtggtgattgtcactgacagaaccatggtggatctaggctttgtggaaaaaattgctaaacaaattaccgcgcgtggtaaccatgtgacctaccaattgtttgctgatgtagaaccggatccatctatcgaaacggtacgccgtggcgcagcattaattcgcaactaccaacccgatacgattattgcgttaggtggtggatcggcaatggatgcagcaaaagtcatgtggttgttctatgaacaacctgaagtggatttccgtgatttagtccaaaaattcatggatattcgcaaacgggcgttcaaattcccacaattagggcgcaaagcgcgctttatcggcattccaacgacttcaggcacaggttcagaagtcacgccatttgcggtcatcaccgaaggcgataaaaaatacccgatcgctgactactcgctcaccccaacagtcgccattgtggatccggcttttgtgatgagtgtgccggcacatgttgctgcggataccggactagacgtgttaacccatgccacggaagcttatgtgtcagtgctcgccaacgactttaccgacggtttagccctacaagcgatcaagctcgtgtttgaacatttagaacgctccgtgaaagacaaagatcccgaagcgcgtgaaaaaatgcacaatgcgtccaccatggcagggatggcatttgctaacgccttcttgggcatgaaccattcccttgcacacaaaattggcgggcgtttccacactccacatggtcgtaccaatgcggtcttaatgccacatgtgattcgttataacggcacacgtccacaaaaaacggcaacgtggccaaaatacaattactacaaagcggatgtgaaataccaagatatcgcgcgtatgctcggtttaccttgtgccacaccagaagaaggggtgaaatcctttgcacaagcgtgctatgacttagccattcgcgtgggtatcaagatgtccttcaaagagcaaggtattgatgaaaaagaatggatggacgctcgtcgccaagtcgcgttactcgcctttgaagaccaatgttcgccagccaacccacgtttacctgtggtaagcgatatggaggtgatcttaaccaatgcctactatggttatgatgccaatcaatactga

SEQ ID NO: 39464 - protein, 875 aa, Pasteurella multocida subsp. multocida str. Pm70
MMSHTAEIEISPAQAEVNVLVEKGLLALEAFRQLNQQQVDYIVAKASVAALDQHGVLAMHAYEETGRGVFEDKATKNLFACEYVVNNMRNLKTVGVISEDDVTGITEIADPVGVVCGITPTTNPTSTTIFKALISLKTRNPIVFAFHPSAQQCSAHAARVVYEAAVAAGAPEHCIQWIETPSMEGTAALMKHPGIATILATGGNAMVEAAYSCGKPALGVGAGNVPAYVEKSANIKQATHDIVMSKAFDNGMICASEQAAIVDQEVYDEFVAEMQSYGAYFVNKKEKALLETFLFGVKANSTNCANAKLNAAVVGKPATWIAEQAGFKVPEKTNILVAACQEVGENEPLTREKLSPVLAILKSTSTEHGFALSEAMVNFHGLGHSAAIHTKEASIAKAFGERVKAIRVIWNSPATFGGIGDVYNAFLPSLTLGCGSYGKNSVGNNVSAANLLNIKRVGRRRNNMQWFKVPSKIYFERDSIQYLQSMKGMERVVIVTDRTMVDLGFVEKIAKQITARGNHVTYQLFADVEPDPSIETVRRGAALIRNYQPDTIIALGGGSAMDAAKVMWLFYEQPEVDFRDLVQKFMDIRKRAFKFPQLGRKARFIGIPTTSGTGSEVTPFAVITEGDKKYPIADYSLTPTVAIVDPAFVMSVPAHVAADTGLDVLTHATEAYVSVLANDFTDGLALQAIKLVFEHLERSVKDKDPEAREKMHNASTMAGMAFANAFLGMNHSLAHKIGGRFHTPHGRTNAVLMPHVIRYNGTRPQKTATWPKYNYYKADVKYQDIARMLGLPCATPEEGVKSFAQACYDLAIRVGIKMSFKEQGIDEKEWMDARRQVALLAFEDQCSPANPRLPVVSDMEVILTNAYYGYDANQY

SEQ ID NO: 39465 - DNA, 1164 bp, Pseudomonas aeruginosa PAO1
  CDS (1)..(1164): transl_table=11
atgagccacgacctcagccaactgcgtaaattcgtctcgcccgagatcatcttcggcgccggctgccggcacagcgtcgccaactacgtgaagaccttcggtgcgcgcaaggtcctgctggtctccgaccccggcgtgctcgccgccggctgggtcgccgacatccaggcaagcctggaggggcagggcatcgactactgcctgtataccgacgtttcgcccaacccccgggtcgacgaggtgatgctcggcgccgagttctatcgcagcgagggctgcaatgtgatcgtcgcggtgggcggcggcagcccgatggattgcgccaagggcatcggcatcgtcgccgcccatggccgcagcatcctcgagttcgaaggcgtcgaccggctgcgggtgccgagtccgccgctgatcctgatcccgaccaccgccgggacttcggcggacgtctcgcagttcgtgatcatttccaaccaggacgagcgcatgaagttctccgtggtgagcaaggcggttgtgcctgacgtctcgctgatcgacccggaaaccacgttgaccatggatcccttcctttcggcctgtaccggcatcgatgcactggtacacgccatcgaggcgttcgtctccaccggccacgggccgctgaccgatccccacgcgctggaagcgatgcgcctgatcgatggcaatctggtacagatgatcgccaatcccggcgacatcgccctgcgcgagaagatcatgctcgggagcatgcaggccgggctggccttctccaacgccatcctcggcgcggtgcatgccatgtcgcacagcctcggcggctatctcgacctgccccacggcctgtgcaacgcggcgctggtcgaacacgtggtggcgttcaactacagcgccgcgccggaacgcttcaaggtgatcgccgagaccttcggcatcgattgccgcggtctgacccaggggcaggtccgccagcgcctggtggaccacctgatcgccttcaagcacgccgtgggtttccacgagagcctcgccctgcacggggtcggcagctccgacattcctttcctctcgcgccacgcgatgcaggacccgtgcatccttaccaacccgcgcgagtcgagccagcgcgatgtcgaggtggtctatggcgaggccctctga

SEQ ID NO: 39466 - protein, 387 aa, Pseudomonas aeruginosa PAO1
MSHDLSQLRKFVSPEIIFGAGCRHSVANYVKTFGARKVLLVSDPGVLAAGWVADIQASLEGQGIDYCLYTDVSPNPRVDEVMLGAEFYRSEGCNVIVAVGGGSPMDCAKGIGIVAAHGRSILEFEGVDRLRVPSPPLILIPTTAGTSADVSQFVIISNQDERMKFSVVSKAVVPDVSLIDPETTLTMDPFLSACTGIDALVHAIEAFVSTGHGPLTDPHALEAMRLIDGNLVQMIANPGDIALREKIMLGSMQAGLAFSNAILGAVHAMSHSLGGYLDLPHGLCNAALVEHVVAFNYSAAPERFKVIAETFGIDCRGLTQGQVRQRLVDHLIAFKHAVGFHESLALHGVGSSDIPFLSRHAMQDPCILTNPRESSQRDVEVVYGEAL

SEQ ID NO: 39467 - DNA, 1164 bp, Pseudomonas aeruginosa PAO1
  CDS (1)..(1164): transl_table=11
atgcaagctttcagtttcgccactaccgcgcagatcctctgcgaggccggctccgccatccgcctggcggaactctgccgcgagcgaagggcgcgccgcgtgttgatcgtgaccgacccggggatcacccggctcggcttgctggatgcgatcctgcccggcttcccgcgcctgggcctggccgtcgaggtgtacgaccaggtgctcgccgatccgcccgagtcggtggtcgaggccgcgctcgggcgggcgcggggcatggctgccgagctggtggtcggtttcggcggcggcagctccatggacgtagccaagctggtcgcgctgctcgcccacccagaagcagggcaggggctcggcgaggtcttcggggtcggcaacgcacgcgggccgcgcctgccgctgatccaggtgccgaccaccgccgggaccggctccgaggtgacgccgatcgccatcgtcaccaccggcgagaccaccaagatgggcgtggtctcgccccacttgctgcccgacctggcgctgctcgacgccgacctgaccctcggcttgccgccggcggtcaccgcggcgaccggtatcgacgcgatggtgcatgcgatcgagagctataccagcaaactgaagaagaacccgctgtccgacctgctggcgcgggaggcgttgcgcctgctggcggccaacctggaacgcgcggtaggcgacggcggcgaccgcgaggcgcgccaggccatgctgctgggcgcctgcttggccgggcaggccttcgccaatgcgccggtggcggcggtgcatgccctggcctatccgctgggagggcatttccacattccccacggcctgagcaatgcgctggtgctaccggaggtgatccgtttcaacgctcccgctgccgctggactctatgccgagctggcgccgctgctgctgggcgaccgcttgcgtccgggcgatcgcgacgcgcttaccgtgcagctgatcgacgaactggcccagctcagtccgcgcaacggcctgccgagccgcttgcgcgacgccggggtggacgaggcgatgctgccgcgcctggccgccgacgcgatgctccagcagcgtctgctggtcaacaacccgcgcgaggtcggcgaggcggatgccctggcgatctatcgcgcggcatactga

SEQ ID NO: 39468 - protein, 387 aa, Pseudomonas aeruginosa PAO1
MQAFSFATTAQILCEAGSAIRLAELCRERRARRVLIVTDPGITRLGLLDAILPGFPRLGLAVEVYDQVLADPPESVVEAALGRARGMAAELVVGFGGGSSMDVAKLVALLAHPEAGQGLGEVFGVGNARGPRLPLIQVPTTAGTGSEVTPIAIVTTGETTKMGVVSPHLLPDLALLDADLTLGLPPAVTAATGIDAMVHAIESYTSKLKKNPLSDLLAREALRLLAANLERAVGDGGDREARQAMLLGACLAGQAFANAPVAAVHALAYPLGGHFHIPHGLSNALVLPEVIRFNAPAAAGLYAELAPLLLGDRLRPGDRDALTVQLIDELAQLSPRNGLPSRLRDAGVDEAMLPRLAADAMLQQRLLVNNPREVGEADALAIYRAAY

SEQ ID NO: 39469 - DNA, 1026 bp, Methanothermobacter thermautotrophicus str. Delta H
  CDS (1)..(1026): transl_table=11
gtgaccgacagggggttaatgaagactggattcgttgaggatgtcagctcctcccttgaggaggagggcctcgaatatgtcatctttgatgatgtgacgcccaacccccgtgaccatgaggtcatggagggtgctgaggtcttcgatgccgaggaatgcaacatgatagttgccctgggtggtggaagccccattgactgtgcaaaggccatgggtgctgttgtatccaacaggatgcacgtacttgactttgagggtgttgatatgatcccgaccccctcggttcccataatatgcatccccacaactgcagggacaggagcggacgtctcccagtttgcaatcatcctcgacacccggaggatggtgaagatagccatcataagcaaggccatgatacccgacgcatcactcatagaccctgagaccaccgtcaccatggaccgggaactgacagcttcaacaggtatggatgcccttgcccattccatcgaagcctatgtatccaatgcaagcttccatctgactgacctcaacgccctggacgccatcagaatcataagcaggtgcctcccatctgccgttgatgaacccgagaacatggagtaccgtgagggtatgatgcttgcaagcctcgaggctggccttgcattctcaaatgccagtctgggacttgtccatgcaatggcccacagccttggaggcaaacttgacatggcccacggtgaggccaatgcactgctacttgaacacgtgatagaattcaactaccctggagccactgaacggtaccatgaaatcgcacgggcaatgggcctcaggggctcggggcccgccgagctcattgattacatccgggaattcaggtccagcatagggatcgacatgaccctggaggatctcggcgtcggggaggacgacatacctgaacttgcagaggcctcaatgaaggacccctgcattgtaacaaaccctgtacggccctcaattgaagatgttgaggccatattcaggagggccctctga

SEQ ID NO: 39470 - protein, 341 aa, Methanothermobacter thermautotrophicus str. Delta H
MTDRGLMKTGFVEDVSSSLEEEGLEYVIFDDVTPNPRDHEVMEGAEVFDAEECNMIVALGGGSPIDCAKAMGAVVSNRMHVLDFEGVDMIPTPSVPIICIPTTAGTGADVSQFAIILDTRRMVKIAIISKAMIPDASLIDPETTVTMDRELTASTGMDALAHSIEAYVSNASFHLTDLNALDAIRIISRCLPSAVDEPENMEYREGMMLASLEAGLAFSNASLGLVHAMAHSLGGKLDMAHGEANALLLEHVIEFNYPGATERYHEIARAMGLRGSGPAELIDYIREFRSSIGIDMTLEDLGVGEDDIPELAEASMKDPCIVTNPVRPSIEDVEAIFRRAL

SEQ ID NO: 39471 - DNA, 2676 bp, Escherichia coli O157:H7 EDL933
  CDS (1)..(2676): n means a or g or c or t/u, s means g or c
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaacagctatcttcaaatcgctgatcagtctgaagacccgtaacgccattatcttctccccgcacccgcgtgcaaaagatgcgaccaacaaagcggctgatatcgttctgcaggctgctatcgctgccggtgctccgaaagatctgatcggstggatcgatcaaccttctgttgaactgtctaacgcactgatgcaccacccagacatcaacctgatcctcgcgactggtggtccgggcatggttaaagccgcatacagctccggtaaaccagctatcggcgtaggcgcgggcaacactccggttgttatcgatgaaactgctgatatcaaacgtgcagttgcatctgtactgatgtccaaaaccttcgacaacggcgtaatctgtgcttctgaacagtctgttgttgtcgttgactctgtttatgacgcagtacgtgaacgtttcgcaacccacggcggctatctgttgcagggtaaagagctgaaagctgttcaggacgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggtggtatcggtcatacctcttgcctgtacactgaccaggataaccaaccggctcgcgtttcttacttcggtcagaaaatgaaaacggctcgtatcctgattaacaccccggcttctcagggtggtatcggtgacctgtataacttcaaactcgcaccttccctgactctgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaagagctggcgctgcgctttatggatatccgtaaacgtatctacaagttcccgaaaatgggcgtgaaagcgaaaatgattgctgtcaccaccacttctggtacaggttctgaagtcactccgtttgcggttgtaactgacgacgctactggtcagaaatacccgctggcggactatgcgctgaccccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcarcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacctgggtctgagcgcaccgggcgaccgtactgctgctaagatcgagaaactgctggcatggctggaaacgctgaaggctgaactgggtattccgaaatctatccgtgaagctggcgttcaggaagcagacttcctggcgaacgtggataaactgtctgaagatgcattcgatgaccagtgcactggcgctaacccgcgttacccgctgatctccgagctgaaacagattctgctggatacctactacggtcgtgattatgtagaaggtgaaactgcagcgaaaaaagaagccgctccggctaaagctgagaaaaaagcgaaaaaatccgcttaa

SEQ ID NO: 39472 - protein, 891 aa, Escherichia coli O157:H7 EDL933
  Xaa in position 707 is unknown
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAXTIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 39473 - DNA, 1215 bp, Escherichia coli O157:H7 EDL933
  CDS (1)..(1215): transl_table=11
gtgggcgagagaaagcggaggggctatatgcaaaatgaattgcagaccgcgctctttcaggcgttcgataccctgaatctgcaacgggtaaaaacatttagcgttccaccggtgacgctttgcggtccgggctcggtgagcagttgcggacagcaagcgcaaacgcgtgggctgaaacatctgttcgtgatggcagacagctttttgcatcaggcagggatgaccgccgggctgacgcgtagcctggccgttaaaggtatcgccatgacgctctggccatgtccggtgggcgaaccgtgcattaccgacgtgtgtgcagccgtggcgcagttgcgtgagtcaggttgtgacggggtgatcgcatttggcggcggctcggtgctggatgcggcgaaagccgtggcgttgctggtgacgaacccggatagcacgctggcagagatgtcagaaaccagcgttctgcaaccgcgcttgccgctgattgccattccaactaccgccggaaccggctctgaaaccaccaatgtaacggtgattatcgacgcggtgagcgggcgcaagcaggtgttagcccatgcctcgctgatgccggatgtggcgatcctcgacgccgcattgaccgaaggtgtgccgtcgcatgtcacggcgatgaccggcattgatgcgttaacccatgccattgaagcatacagcgccctgaacgctacaccgtttaccgacagtctggcgattggtgccattgcgatgattggcaaatcgctgccgaaagcggtgggctacggtcacgaccttgccgcgcgcgagagcatgttgctggcttcatgtatggcgggaatggcgttttccagtgcgggtcttgggttgtgccacgcgatggcgcatcagccgggcgcggcgctgcatattccgcacggtctcgcgaacgctatgttgctgccaacggtgatggagtttaaccggatggtttgtcgcgaacgctttagtcagattggtcgggcactgcgaactaaaaaatccgacgatcgtgacgctattaacgcggtaagtgagctgattgcggaagttgggattggtaaacgactgggcgatgttggcgcgacatctgcgcattacggtgcatgggcgcaggccgcgctggaagatatttgtctgcgcagcaacccgcgtaccgccagcctggaacagcttgtcggcctgtacgcagcggcgcaataa

SEQ ID NO: 39474 - protein, 404 aa, Escherichia coli O157:H7 EDL933
MGERKRRGYMQNELQTALFQAFDTLNLQRVKTFSVPPVTLCGPGSVSSCGQQAQTRGLKHLFVMADSFLHQAGMTAGLTRSLAVKGIAMTLWPCPVGEPCITDVCAAVAQLRESGCDGVIAFGGGSVLDAAKAVALLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRERFSQIGRALRTKKSDDRDAINAVSELIAEVGIGKRLGDVGATSAHYGAWAQAALEDICLRSNPRTASLEQLVGLYAAAQ

SEQ ID NO: 39475 - DNA, 1188 bp, Escherichia coli O157:H7
  CDS (1)..(1188): transl_table=11
atgcaaaatgaattgcagaccgcgctctttcaggcgttcgataccctgaatctgcaacgggtaaaaacatttagcgttccaccggtgacgctttgcggtccgggctcggtgagcagttgcggacagcaagcgcaaacgcgtgggctgaaacatctgttcgtgatggcagacagctttttgcatcaggcagggatgaccgccgggctgacgcgtagcctggccgttaaaggtatcgccatgacgctctggccatgtccggtgggcgaaccgtgcattaccgacgtgtgtgcagccgtggcgcagttgcgtgagtcaggttgtgacggggtgatcgcatttggcggcggctcggtgctggatgcggcgaaagccgtggcgttgctggtgacgaacccggatagcacgctggcagagatgtcagaaaccagcgttctgcaaccgcgcttgccgctgattgccattccaactaccgccggaaccggctctgaaaccaccaatgtaacggtgattatcgacgcggtgagcgggcgcaagcaggtgttagcccatgcctcgctgatgccggatgtggcgatcctcgacgccgcattgaccgaaggtgtgccgtcgcatgtcacggcgatgaccggcattgatgcgttaacccatgccattgaagcatacagcgccctgaacgctacaccgtttaccgacagtctggcgattggtgccattgcgatgattggcaaatcgctgccgaaagcggtgggctacggtcacgaccttgccgcgcgcgagagcatgttgctggcttcatgtatggcgggaatggcgttttccagtgcgggtcttgggttgtgccacgcgatggcgcatcagccgggcgcggcgctgcatattccgcacggtctcgcgaacgctatgttgctgccaacggtgatggagtttaaccggatggtttgtcgcgaacgctttagtcagattggtcgggcactgcgaactaaaaaatccgacgatcgtgacgctattaacgcggtaagtgagctgattgcggaagttgggattggtaaacgactgggcgatgttggcgcgacatctgcgcattacggtgcatgggcgcaggccgcgctggaagatatttgtctgcgcagcaacccgcgtaccgccagcctggaacagcttgtcggcctgtacgcagcggcgcaataa

SEQ ID NO: 39476 - protein, 395 aa, Escherichia coli O157:H7
MQNELQTALFQAFDTLNLQRVKTFSVPPVTLCGPGSVSSCGQQAQTRGLKHLFVMADSFLHQAGMTAGLTRSLAVKGIAMTLWPCPVGEPCITDVCAAVAQLRESGCDGVIAFGGGSVLDAAKAVALLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRERFSQIGRALRTKKSDDRDAINAVSELIAEVGIGKRLGDVGATSAHYGAWAQAALEDICLRSNPRTASLEQLVGLYAAAQ

SEQ ID NO: 39477 - DNA, 1152 bp, Escherichia coli O157:H7
  CDS (1)..(1152): transl_table=11
atggcatcttcaactttctttattccttctgtgaatgtcatcggcgctgattcattgactgatgcaatgaatatgatggcagattatggatttacccgtaccttaattgtcactgacagtatgttaacgaaattaggtatggcgggcgatgtgcaaaaagcactggaagaacgcaatatttttagcgttatttatgatggcacccaacctaaccccaccacggaaaacgtcgccgcaggtttgaaattacttaaagagaataattgcgatagcgtgatctccttaggcggtggttctccacacgactgcgcaaaaggtattgcgctggtggcagccaatggcggcgatattcgcgattacgaaggcgttgaccgctctgcaaaaccgcagctgccgatgatcgccatcaataccacggcgggtacggcctctgaaatgacccgtttctgcatcatcactgacgaagcgcgtcatatcaaaatggcgattgttgataaacatgtcactccgctgctttctgtcaatgactcctctctgatgattggtatgccgaagtcactgaccgccgcaacgggtatggatgccttaacgcacgctatcgaagcgtatgtttctattgccgccacgccgatcactgacgcttgtgcactgaaagccgtgaccatgattgccgaaaacctgccgttagccgttgaagatggcagtaatgcgaaagcgcgtgaagcaatggcttatgcccagttcctcgccggtatggcgttcaataatgcttctctgggttatgttcatgcgatggcgcaccagctgggcggtttctacaacctgccacacggtgtatgtaacgccgttctgctgccgcatgttcaggtattcaacagcaaagtcgccgctgcacgtctgcgtgactgtgccgctgcaatgggcgtgaacgtgacaggtaaaaacgacgcggaaggtgctgaagcctgcattaacgccatccgtgaactggcgaagaaagtggatatcccggcaggcctacgcgacctgaacgtgaaagaagaagatttcgcggttctggcggctaatgccctgaaagatgcctgtggctttactaacccgatccaggcaactcacgaagaaattgtggcgatttatcgcgcagcgatgtaa

SEQ ID NO: 39478 - protein, 383 aa, Escherichia coli O157:H7
MASSTFFIPSVNVIGADSLTDAMNMMADYGFTRTLIVTDSMLTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHIKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVDIPAGLRDLNVKEEDFAVLAANALKDACGFTNPIQATHEEIVAIYRAAM

SEQ ID NO: 39479 - DNA, 2652 bp, Streptococcus pneumoniae TIGR4
  CDS (1)..(2652): transl_table=11
atggctgataaaaaaactgtgacaccagaggaaaagaaactcgttgctgaaaaacacgtagatgagttggttcaaaaagctctagttgcccttgaagaaatgcgtaaattggatcaagaacaagttgactacatcgttgccaaagcatcagtagcagctttggatgcccacggagaattggctttacatgcctttgaagaaacaggacgtggtgtatttgaagacaaagcaactaagaacttgtttgcctgtgaacacgtagtaaacaacatgcgccacactaagacagttggcgttatcgaagaagacgatgtaacaggattgactcttattgctgaaccagttggtgttgtttgtggtattactccaacaacaaacccaacatcaacagcaatcttcaaatcattgatttcattgaagacacgtaacccaatcgtctttgccttccatccatcagcacaagaatcatctgctcatgcagctcgtatcgtccgcgatgcagctatcgcagctggtgctcctgaaaactgtgtgcaatggattactcaaccatctatggaagcaacaagtgcccttatgaaccacgaaggtgttgcgacaatccttgcaacaggtggtaatgccatggttaaggcggcttattcatgtggtaaaccagctcttggggtaggtgccggaaacgttccagcttatgttgaaaaatcagcaaacattcgtcaagcagcacacgatatcgtcatgtctaaatcatttgataacggtatggtctgtgcatctgaacaagcagttatcattgataaagaaatttacgatgaatttgtagcagagttcaaatcttaccacacttactttgtaaacaaaaaagaaaaagctcttcttgaagagttctgcttcggcgtcaaagcaaacagcaaaaactgtgctggtgcaaaattgaacgctgacatcgttggtaaaccagcaacttggattgcagaacaagcaggatttacagttccagaaggaacaaacattcttgctgcagaatgtaaagaagttggcgaaaatgagccattgactcgtgaaaaattgtcaccagttattgcagttttgaaatctgaaagccgtgaagatggtattactaaggctcgtcaaatggttgaatttaacggtcttggacactcagcagctatccacacagctgacgaagaattgactaaagaatttggtaaagctgttaaagctattcgtgttatctgtaactcaccttctacttttggtggtatcggggacgtttacaatgccttcttgccatcattgacacttggatgtggttcttacggacgcaactcagttggggataacgttagtgccattaacctcttgaatatcaaaaaagtcggaagacggagaaataacatgcaatggatgaaacttccttcaaaaacatactttgaacgtgattcaattcaataccttcaaaaatgtcgtgacgttgaacgtgtcatgatcgttactgaccatgccatggtagagcttggtttccttgatcgtatcatcgaacaactggaccttcgtcgcaataaggttgtttaccaaatctttgcggatgtagaaccggatccagatatcacaactgtaaaccgtggtactgagattatgcgtgccttcaaaccagataccatcatcgcactcggtggtgggtctccaatggatgctgccaaagtaatgtggctcttctacgagcaaccagaagtggacttccgtgaccttgtccaaaaattcatggatatccgtaaacgtgccttcaagttcccattgcttggtaagaagactaaattcatcgcgattccaactacatctggtacaggatctgaagtaacaccatttgccgttatctctgataaagcaaacaaccgtaaatacccaatcgctgactactcattgacaccaactgtggcaatcgtagatcctgctttggtattgacagttccaggatttgttgctgctgatactggtatggacgtattgactcacgcgacagaagcatacgtatcacaaatggctagtgactacactgatggtttagcacttcaagccattaaattggtctttgaaaatctcgaaagctcagttaagaatgcagacttccactcacgtgagaaaatgcataacgcttcaacaatcgctggtatggcctttgccaatgccttcctaggtatttctcactcaatggcccataagattggtgcgcaattccacacaatccacggtcgtacaaatgctatcttgcttccatacgttatccgttacaacggtacacgtccagctaagacagcaacatggcctaagtacaactactaccgtgcagatgaaaaataccaagatatcgcacgcatgcttggacttccagcttctactccagaagaaggggttgaatcttacgcaaaagctgtctacgaactcggtgaacgtattgggatccaaatgaattttagagaccaaggaattgacgaaaaagaatggaaagaacattctcgtaaattagccttcctggcttatgaagaccaatgttcaccagctaacccacgtcttccaatggtagaccatatgcaagaaatcatcgaagatgcatactatggctacaaagaaagaccaggacgccgtaaataa

SEQ ID NO: 39480 - protein, 883 aa, Streptococcus pneumoniae TIGR4
MADKKTVTPEEKKLVAEKHVDELVQKALVALEEMRKLDQEQVDYIVAKASVAALDAHGELALHAFEETGRGVFEDKATKNLFACEHVVNNMRHTKTVGVIEEDDVTGLTLIAEPVGVVCGITPTTNPTSTAIFKSLISLKTRNPIVFAFHPSAQESSAHAARIVRDAAIAAGAPENCVQWITQPSMEATSALMNHEGVATILATGGNAMVKAAYSCGKPALGVGAGNVPAYVEKSANIRQAAHDIVMSKSFDNGMVCASEQAVIIDKEIYDEFVAEFKSYHTYFVNKKEKALLEEFCFGVKANSKNCAGAKLNADIVGKPATWIAEQAGFTVPEGTNILAAECKEVGENEPLTREKLSPVIAVLKSESREDGITKARQMVEFNGLGHSAAIHTADEELTKEFGKAVKAIRVICNSPSTFGGIGDVYNAFLPSLTLGCGSYGRNSVGDNVSAINLLNIKKVGRRRNNMQWMKLPSKTYFERDSIQYLQKCRDVERVMIVTDHAMVELGFLDRIIEQLDLRRNKVVYQIFADVEPDPDITTVNRGTEIMRAFKPDTIIALGGGSPMDAAKVMWLFYEQPEVDFRDLVQKFMDIRKRAFKFPLLGKKTKFIAIPTTSGTGSEVTPFAVISDKANNRKYPIADYSLTPTVAIVDPALVLTVPGFVAADTGMDVLTHATEAYVSQMASDYTDGLALQAIKLVFENLESSVKNADFHSREKMHNASTIAGMAFANAFLGISHSMAHKIGAQFHTIHGRTNAILLPYVIRYNGTRPAKTATWPKYNYYRADEKYQDIARMLGLPASTPEEGVESYAKAVYELGERIGIQMNFRDQGIDEKEWKEHSRKLAFLAYEDQCSPANPRLPMVDHMQEIIEDAYYGYKERPGRRK

SEQ ID NO: 39481 - DNA, 1152 bp, Streptococcus pneumoniae TIGR4
  CDS (1)..(1152): transl_table=11
atggctatattttatgttccggcagtcaaccttattggaaaaggtgttgtaaatgaagtgggtccttatatcaaggaacttggctataaaaaggcacttttggtgacagataagtacatcgaaggcagtgatattttacctaagactttaaaaccactggatacagaaggaatcgaatatgtcatctttagcgatgtagagccaaaccctacttgtaaaaatgtcacagatggggtagctgctttgcaagaacatggctgtgactttatcatcagtcttggcgggggttctccacaggatgcagctagttgtatttctatcatggctacaaatggtggaaaaccacaggattatgaagggcttcataagtctgctaaaaaaggcttgccagttgtggctatcaatacaacggcaggtacatcagcagaaattaccattaactatgtgattactgatgaagaacgcaaggttaagatggtaatggttgacaagaatagccttgctcttatctctgttaatgaccctgaactcatgctttccaaacctaaaggcctgactgctgctactggtatggatgctctgactcatgctgttgaagctttggtaacacctggtgcttatgatgtaaccaagaaactgtctattggtgctattgagcttatcaaggaatatcttcctcgtgctgtagaaaatggacatgatattgaagcgcgtgaaggtatggtcaatgccatcttccttggtggtatgagctttaataatgctggtcttggctatgttcactcaatggctcaccaactcggtgcagtatataatttgccacatggcgtgtgctgtgccatgttgctaccagttatagaacgtgaaaatgctaaacgtgtaccagaagctttccgcaatgttgccaaagccttgggacttcatgtagaaggtaaatcagatcaagaatgtgccgattatgcgattgctgagattgagaagctttctgagacagtaggtattcctaagaaactgactgaacttggtattgaagaaaaagatttcgactttgaatacctttctaagaatgccttgattgatgcctgcgcaccaggaaatccatttatgccaaccttagaagaaacgattgccttttataaagagttattttag

SEQ ID NO: 39482 - protein, 383 aa, Streptococcus pneumoniae TIGR4
MAIFYVPAVNLIGKGVVNEVGPYIKELGYKKALLVTDKYIEGSDILPKTLKPLDTEGIEYVIFSDVEPNPTCKNVTDGVAALQEHGCDFIISLGGGSPQDAASCISIMATNGGKPQDYEGLHKSAKKGLPVVAINTTAGTSAEITINYVITDEERKVKMVMVDKNSLALISVNDPELMLSKPKGLTAATGMDALTHAVEALVTPGAYDVTKKLSIGAIELIKEYLPRAVENGHDIEAREGMVNAIFLGGMSFNNAGLGYVHSMAHQLGAVYNLPHGVCCAMLLPVIERENAKRVPEAFRNVAKALGLHVEGKSDQECADYAIAEIEKLSETVGIPKKLTELGIEEKDFDFEYLSKNALIDACAPGNPFMPTLEETIAFYKELF

SEQ ID NO: 39483 - DNA, 1251 bp, Agrobacterium tumefaciens str. C58
  CDS (1)..(1251): transl_table=11
ttgctggaccggcgtcaaggaaaccggccgtggcggttcgctctccgtcctcggtttccagaatctgacccgcccgaaatcctaccatctgaagaaagtcacgaaatgaatatcgtcgccaactggagttatcccaccgccgtcaagcttggccgtggccggatcaaggaactggcggaagcctgcaaaacgctcggcatcaggaagccgctgctcgtcacggatcgtggccttgccaatatggcgatcaccgcgcatgcgctggatgtgctggaagaggcgggtcttggccgggcgatctttgccgatgtcgatccgaaccccaacgaaatcaacatggaagccggcgtcaaggcttaccgcgatggcggtcatgacggcgtcgtcgcctttggcggcggctcgggcctcgatctcggcaagatgatcgccttcatggccgggcagacacgtccggtctgggatttcgaggatatcggtgattggtggacacgcgctgatgcgtcgaagatcgcgcccatcgtcgcagtcccgacgacggctggcaccggttcggaagtcggccgcgccagcgtcatcaccaattcgcagacgcatgtgaagaagatcatcttccatcccaagctgcttcccggtgtcgtcatctgcgatccggaactgacggtcggcatgccgaaggtcatcacggccggcaccggcatggatgccttcgcccattgcctcgaagcgtattcgtcaccgttcttccacccgatgagtgctggtgtcgcgcttgagggcctgcgtctcgtcaaggaattcctgccgcgcgcctataaggatggcacggatatcgaagcccgcaccaatatgatggcggcggcggcgatgggggcggttgccttccagaagggtctcggggccattcattcgctctcgcatccgatcggggcggtctacaacacccatcacggcatgaccaatgccgtcgtcatgccggcggtgctgcgtttcaaccgtcctgccatcgaagacaagatcgcgcgtgctgccgcctatctcggcatttccggcggttttgacggtttttatgactacgtgctggatcttcgcagggaactcggcgtgccggaaaacctgaccgccatgggcatcaagcctgatcgtatcgacgagctggcggcagaagcgatcaaggatccgagctgcggtggtaatccggtgccgatgacgcttgagaataccaaggcgctttttgaggcttgcttttaa

SEQ ID NO: 39484 - protein, 416 aa, Agrobacterium tumefaciens str. C58
MLDRRQGNRPWRFALRPRFPESDPPEILPSEESHEMNIVANWSYPTAVKLGRGRIKELAEACKTLGIRKPLLVTDRGLANMAITAHALDVLEEAGLGRAIFADVDPNPNEINMEAGVKAYRDGGHDGVVAFGGGSGLDLGKMIAFMAGQTRPVWDFEDIGDWWTRADASKIAPIVAVPTTAGTGSEVGRASVITNSQTHVKKIIFHPKLLPGVVICDPELTVGMPKVITAGTGMDAFAHCLEAYSSPFFHPMSAGVALEGLRLVKEFLPRAYKDGTDIEARTNMMAAAAMGAVAFQKGLGAIHSLSHPIGAVYNTHHGMTNAVVMPAVLRFNRPAIEDKIARAAAYLGISGGFDGFYDYVLDLRRELGVPENLTAMGIKPDRIDELAAEAIKDPSCGGNPVPMTLENTKALFEACF

SEQ ID NO: 39485 - DNA, 2673 bp, Streptococcus pneumoniae R6
  CDS (1)..(2673): transl_table=11
ttgaaagctatggaggaaaatatggctgataaaaaaactgtgacaccagaggaaaagaaactcgttgctgaaaagcacgtagatgagttggttcaaaaagctctagttgcccttgaagaaatgcgtaaattgaatcaagagcaagttgactacatcgttgccaaagcatcagtagcagctttggatgcccatggagaattggctttacatgcctttgaagaaacaggacgtggtgtatttgaagataaagcaactaagaacttgtttgcttgtgaacacgtagtaaacaacatgcgccacactaagacagttggtgttatcgaagaagacgatgtaacaggattgactcttattgctgaaccagttggtgttgtttgtggtattactccaacaacaaacccaacatcaacagcaatcttcaaatcattgatttcattgaagacacgtaacccaatcgtctttgccttccatccatcagcacaagaatcatctgctcatgcagctcgtatcgtccgcgatgcagctatcgcagctggtgctcctgaaaactgtgtgcaatggattactcaaccatctatggaagcaacaagtgcccttatgaaccacgaaggtgttgcgacaatccttgcaacaggtggtaatgccatggttaaagccgcatactcatgtggtaaaccagctcttggggtaggtgccggaaacgttccagcttatgttgaaaaatcagcaaacattcgtcaagcagcacacgatatcgtcatgtctaaatcatttgataacggtatggtctgtgcatctgaacaagcagttatcattgataaagaaatttacgatgaatttgtagcagagttcaaatcttaccacacttactttgtaaacaaaaaagaaaaagctcttcttgaagagttctgcttcggcgtcaaagcaaacagcaaaaactgtgctggtgcaaaattgaacgctgacatcgttggtaaaccagcaacttggattgcagaacaagcaggatttacagttccagaaggaacaaacattcttgctgcagaatgtaaagaagttggcgaaaatgagccattgactcgtgaaaaattgtcaccagttattgcagttttgaaatctgaaagccgtgaagatggtattactaaggctcgtcaaatggttgaatttaacggtcttggacactcagcagctatccacacagctgacgaagaattgactaaagaatttggtaaagctgttaaagctattcgtgttatctgtaactcaccttctacttttggtggtatcggggacgtttacaatgccttcttgccatcattgacacttggatgtggttcttacggacgcaactcagttggggataacgttagtgccattaacctcttgaatatcaaaaaagtcggaagacggagaaataacatgcaatggatgaaacttccttcaaaaacatactttgaacgtgattcaattcaataccttcaaaaatgtcgtgacgttgaacgtgtcatgatcgttactgaccatgccatggtagagcttggtttccttgatcgtatcatcgaacaactggaccttcgtcgcaataaggttgtttaccaaatctttgcggatgtagaaccggatccagatatcacaactgtaaaccgtggtactgagattatgcgtgccttcaaaccagataccatcatcgcactcggtggtgggtctccaatggatgctgccaaagtaatgtggctcttctacgagcaaccagaagtggacttccgtgaccttgtccaaaaattcatggatatccgtaaacgtgccttcaagttcccattgcttggtaagaagactaaattcatcgcgattccaactacatctggtacaggatctgaagtaacaccatttgccgttatctctgataaagcaaacaaccgtaaatacccaatcgctgactactcattgacaccaactgtggcaatcgtagatcctgctttggtattgacagttccaggatttgttgctgctgatactggtatggacgtattgactcacgcgacagaagcatacgtatcacaaatggctagtgactacactgatggtttagcacttcaagccattaaattggtctttgaaaatctcgaaagctcagttaagaatgcagacttccactcacgtgagaaaatgcataacgcttcaacaatcgctggtatggcctttgccaatgccttcctaggtatttctcactcaatggcccataagattggtgcgcaattccacacaatccacggtcgtacaaatgctatcttgcttccatacgttatccgttacaacggtacacgtccagctaagacagcaacatggcctaagtacaactactaccgtgcagatgaaaaataccaagatatcgcacgcatgcttggacttccagcttctactccagaagaaggggttgaatcttacgcaaaagctgtctacgaactcggtgaacgtattgggatccaaatgaattttagagaccaaggaattgacgaaaaagaatggaaagaacattctcgtgaattagccttcctggcttatgaagaccaatgttcaccagctaacccacgtcttccaatggtagaccatatgcaagaaatcatcgaagatgcatactatggctacaaagaaagaccaggacgccgtaaataa

SEQ ID NO: 39486 - protein, 890 aa, Streptococcus pneumoniae R6
MKAMEENMADKKTVTPEEKKLVAEKHVDELVQKALVALEEMRKLNQEQVDYIVAKASVAALDAHGELALHAFEETGRGVFEDKATKNLFACEHVVNNMRHTKTVGVIEEDDVTGLTLIAEPVGVVCGITPTTNPTSTAIFKSLISLKTRNPIVFAFHPSAQESSAHAARIVRDAAIAAGAPENCVQWITQPSMEATSALMNHEGVATILATGGNAMVKAAYSCGKPALGVGAGNVPAYVEKSANIRQAAHDIVMSKSFDNGMVCASEQAVIIDKEIYDEFVAEFKSYHTYFVNKKEKALLEEFCFGVKANSKNCAGAKLNADIVGKPATWIAEQAGFTVPEGTNILAAECKEVGENEPLTREKLSPVIAVLKSESREDGITKARQMVEFNGLGHSAAIHTADEELTKEFGKAVKAIRVICNSPSTFGGIGDVYNAFLPSLTLGCGSYGRNSVGDNVSAINLLNIKKVGRRRNNMQWMKLPSKTYFERDSIQYLQKCRDVERVMIVTDHAMVELGFLDRIIEQLDLRRNKVVYQIFADVEPDPDITTVNRGTEIMRAFKPDTIIALGGGSPMDAAKVMWLFYEQPEVDFRDLVQKFMDIRKRAFKFPLLGKKTKFIAIPTTSGTGSEVTPFAVISDKANNRKYPIADYSLTPTVAIVDPALVLTVPGFVAADTGMDVLTHATEAYVSQMASDYTDGLALQAIKLVFENLESSVKNADFHSREKMHNASTIAGMAFANAFLGISHSMAHKIGAQFHTIHGRTNAILLPYVIRYNGTRPAKTATWPKYNYYRADEKYQDIARMLGLPASTPEEGVESYAKAVYELGERIGIQMNFRDQGIDEKEWKEHSRELAFLAYEDQCSPANPRLPMVDHMQEIIEDAYYGYKERPGRRK

SEQ ID NO: 39487 - DNA, 1152 bp, Streptococcus pneumoniae R6
  CDS (1)..(1152): transl_table=11
atggctacattttatgttccggcagtcaaccttattggaaaaggtgttgtaaatgaagtgggtccttatatcaaggaacttggctataaaaaggcacttttggtgacagataagtacatcgaaggcagtgatattttacctaagactttaaaaccactggatacagaaggaatcgaatatgtcatctttagcgatgtagagccaaaccctacttgtaagaatgtcacagatggggtagctgctttgcaagaacatggatgtgattttatcatcagtcttggcgggggttctccacaggatgcagctagttgtatttctatcatggctacaaatggtggaaaaccacaggattatgaagggcttcataagtctgctaaaaaaggcttgccagttgtggctatcaatacaacggcaggaacttctgcagaaatcactattaactatgtgattactgatgaagaacgcaaggttaagatggtaatggttgacaagaatagccttgccttgatttctgttaatgacccggaactcatgctttccaaacctaaaggcctgactgctgctactggtatggatgctctgactcacgctgttgaagctttggtaacacctggtgcttatgatgtaaccaagaaactgtctattggtgctattgagcttatcaaggaatatcttcctcgtgctgtagcaaacggacatgatattgaagcgcgtgaaggtatggtcaatgccatcttccttggtggtatgagctttaataatgctggtcttggttatgttcactcaatggctcaccaactcggtgcagtatataatttgccacatggtgtttgctgtgccatgttgctaccagttatagaacgtgaaaatgctaaacgtgtaccagaagctttccgcaatgttgccaaagccttgggacttcatgtagaaggtaaatcagatcaagagtgtgccgattatgcgattgctgagattgagaagctttctgagacagtaggtattcctaagaaattgactgaacttggtattgaagaaaaagatttcgactttgaatacctttctaagaatgccttgattgatgcctgcgcaccaggaaatccatttatgccaaccttagaagaaacgattgccttttataaagagttattttag

SEQ ID NO: 39488 - protein, 383 aa, Streptococcus pneumoniae R6
MATFYVPAVNLIGKGVVNEVGPYIKELGYKKALLVTDKYIEGSDILPKTLKPLDTEGIEYVIFSDVEPNPTCKNVTDGVAALQEHGCDFIISLGGGSPQDAASCISIMATNGGKPQDYEGLHKSAKKGLPVVAINTTAGTSAEITINYVITDEERKVKMVMVDKNSLALISVNDPELMLSKPKGLTAATGMDALTHAVEALVTPGAYDVTKKLSIGAIELIKEYLPRAVANGHDIEAREGMVNAIFLGGMSFNNAGLGYVHSMAHQLGAVYNLPHGVCCAMLLPVIERENAKRVPEAFRNVAKALGLHVEGKSDQECADYAIAEIEKLSETVGIPKKLTELGIEEKDFDFEYLSKNALIDACAPGNPFMPTLEETIAFYKELF

SEQ ID NO: 39489 - DNA, 1146 bp, Sinorhizobium meliloti 1021
  CDS (1)..(1146): transl_table=11
atgaccatcaccgccaactggagctatccgaccgccgtcaaattcggcgccggccggatcaaggagcttgccgaccactgcaaggcgctcggcatcaagaagccgctgctcgtaacggatcgcggacttgccccgatggcgatcacgcagcaggcgctcgatattctggaagcgggtggcctcggacgggcgatcttcgcggacgtcgatccgaaccccaacgacaggaacctcgaagccggcgtgaaagcgttccgtgacggcggccatgacggcgtcgtcgccttcggcggcggctcgggcctcgacctcggcaagtgcgtcgccttcatggccggccagacgcggccggtctgggatttcgaggatatcggcgactggtggacccgcgcgagcgtcgaaggtatcgcgccgatcgtcgccgttccgacgaccgccggtaccgggtccgaagtggggcgcgccagcgtcatcaccaattcggcaagtcacgtgaaaaaggtgatcttccatccgaagtttttgcctggcgtcacgatctgcgatccggaactcacggtcggcatgcccaaggtgatcaccgccggcacgggcatggatgcctttgcccattgcctcgaagcctattcgtcccccttctatcacccgatgtcggccgggatcgcgctcgagggcatgcggctcgtcaaggaatacctgccgcgcgcctataaggacggagcggacctcgaagcccgtgccaatatgatgagcgcggcggcgatgggggcggtcgcgttccagaagggcctcggcgcgatccactcgctgtcgcatcccgtcggcgcgatctacaacacccatcacggcatgaccaacgccgtggtgatgcccccggtcctgcggttcaaccgctccgcgatcgaggaaaagatcggtcgcgccgccgcctatctcggcattgcgggcggcttcgacggtttctacgactatgtgctgcggctccgggaggaactcggcgtaccggacaaactttccgcactcggggtcggcacggaccgtatcgacgagatggccgagatggcgatcgtcgatccgacggccggcggcaatcccgtcgaactgacgctcgatgccgcggaaaagctcttcgcagaatgcatttga

SEQ ID NO: 39490 - protein, 381 aa, Sinorhizobium meliloti 1021
MTITANWSYPTAVKFGAGRIKELADHCKALGIKKPLLVTDRGLAPMAITQQALDILEAGGLGRAIFADVDPNPNDRNLEAGVKAFRDGGHDGVVAFGGGSGLDLGKCVAFMAGQTRPVWDFEDIGDWWTRASVEGIAPIVAVPTTAGTGSEVGRASVITNSASHVKKVIFHPKFLPGVTICDPELTVGMPKVITAGTGMDAFAHCLEAYSSPFYHPMSAGIALEGMRLVKEYLPRAYKDGADLEARANMMSAAAMGAVAFQKGLGAIHSLSHPVGAIYNTHHGMTNAVVMPPVLRFNRSAIEEKIGRAAAYLGIAGGFDGFYDYVLRLREELGVPDKLSALGVGTDRIDEMAEMAIVDPTAGGNPVELTLDAAEKLFAECI

SEQ ID NO: 39491 - DNA, 1212 bp, Bacillus subtilis subsp. subtilis str. 168
  CDS (1)..(1212): transl_table=11
atgatgacattaaatatgaaggtagaaagcatgcagaaattccacacatttgaaattccgactgtgattaagcatggaatcggagccatcaagcatacgggtgaggaagtagctgcactgggcgtttcaaaagcgctccttgtcacagaccctgggatttataaagccggtgttgctgatcccgtaatcgaatcacttaaagaagcaggcattgaagtggtactctttaataaagttgagccaaacccgcctgtccgtctggtgaatgaaggatctgagctttacaaaaaagagaactgtaatggtttggtggcagtcggaggcggaagctccatggatacagcaaaagcaatcggagtagaagcgactcacgaaggaagcgtgcttgattatgaagcggcagatgggaaaaaaccgctggaaaaccgcattcctccgctgacgacaattcccactacagctggaaccggatcagaagtaacccaatgggcggttatcacagatgaagaaagagaattcaaattcaacacgggcggtccgctgattgcagcgcacttgacaatcattgatcctgagcttcatgtttcaatgcctccgcatgtaacagctatgacgggaattgatgcgctcgcccatgccattgagtgctatacaatgaaatttgcacagccaatcacggatgcggttgccttaatggcgattgagtatgccgctcattacatcaagagggcatttgctgatggagaggatctggaagcaaggtacggaatggcgcaggctgcgatgcttgccggtctttcttacggaagtgaatcagcgggcgctgctcatgcgatgagccaaacgcttggcggtattatcccagtcgctcacggccaatgtgtagcggcgatgatgggccctgtcatggaatacaactggaagggctatcctgagaagtttgcgcgtattgcgaaagcgttcggtattgatacaagcaagatgacaacagaagaagctgcgaaagcatctgtcaattggatgtatgatctggtcgaagatttagaagtgccgactttagaagagcagggagtatcacctgatatgatcgaacgcttgtctaaagaagcaatgaaagatccgcaaaccttcggaaaccctagagatttaaatgaaaaagcatacaactggatctacaaacgctgctttaaccttacgcctaaaacggtataa

SEQ ID NO: 39492 - protein, 403 aa, Bacillus subtilis subsp. subtilis str. 168
MMTLNMKVESMQKFHTFEIPTVIKHGIGAIKHTGEEVAALGVSKALLVTDPGIYKAGVADPVIESLKEAGIEVVLFNKVEPNPPVRLVNEGSELYKKENCNGLVAVGGGSSMDTAKAIGVEATHEGSVLDYEAADGKKPLENRIPPLTTIPTTAGTGSEVTQWAVITDEEREFKFNTGGPLIAAHLTIIDPELHVSMPPHVTAMTGIDALAHAIECYTMKFAQPITDAVALMAIEYAAHYIKRAFADGEDLEARYGMAQAAMLAGLSYGSESAGAAHAMSQTLGGIIPVAHGQCVAAMMGPVMEYNWKGYPEKFARIAKAFGIDTSKMTTEEAAKASVNWMYDLVEDLEVPTLEEQGVSPDMIERLSKEAMKDPQTFGNPRDLNEKAYNWIYKRCFNLTPKTV

SEQ ID NO: 39493 - DNA, 1200 bp, Agrobacterium tumefaciens str. C58
  CDS (1)..(1200): transl_table=11
gtgctcggccatcggctgagatcacgctgggaggatcagatgaccatcaaccctttcgaattccgcaccgttccctccatgcaggttgcctggggtggcgcccatcgcctcggagagattctttccggcaggtttcaggcgcgcaaggcgctgctgattaccgatgcaggtctcatcaaggccggcctcatcaagccgattgctgacgcccttgcggccagcggctttaacgtcacgatcttcgacaaggtcgttgctgatccgccagagcacatcgttgccgactgcgtcgagtccgcaaggcagatcggcgtcgatatcgttattggtcttggcgggggctcatcgctcgacatcgccaagctcgtggctgtccttctggtttccgaccagacgcttgccgacatgtacgggatcggaaacgttaagggatcacgcctgccgctcgtgctggtgccgaccacggccggtaccggttcggaagtcacaaacatctccatcatcaccacgggagaaaccaccaagatgggggtcgtttctccgcagctttacgctgatttcgttcttctggatgctgaactgacggtgggactgccgcaggtccatacggctgccaccggtatcgatgccatggtgcatgccatcgaggcttacaccagcaaacacaagaagaacccgctatcagatgctctggcgcgcgaggcactgcggctgctcggtgcaaacctgatcgccgcctgcaggaacggggccgaccggaaagcccgtgaaggcatgcttttgggtgcgacattggcaggtcaggctttcgccaactcaccggtggccgccgtccacgcgctcgcttatccgctgggcggccattatcacgtgccacacgggctttccaatgccctgatgctggggccggttttacgctttaacgcgaaggctgcagcgtcgctttatgcggagcttgccgacgtgctgggtgttccgggtgaaggggatgcggcaacccgttcggatgcgttcgttcagcatatggaaacgctgatggacgaaagcggcgcgccgcggcgtctgcgcgatgtcggcgtgacggacaacacgctcgccatgcttgcgtccgacgcaatgaaacagagccgtctgttggtcaataatccggtcgaagtccgcgaagaggatgcgcttgcgctctaccgcgaggcgttctga

SEQ ID NO: 39494 - protein, 399 aa, Agrobacterium tumefaciens str. C58
MLGHRLRSRWEDQMTINPFEFRTVPSMQVAWGGAHRLGEILSGRFQARKALLITDAGLIKAGLIKPIADALAASGFNVTIFDKVVADPPEHIVADCVESARQIGVDIVIGLGGGSSLDIAKLVAVLLVSDQTLADMYGIGNVKGSRLPLVLVPTTAGTGSEVTNISIITTGETTKMGVVSPQLYADFVLLDAELTVGLPQVHTAATGIDAMVHAIEAYTSKHKKNPLSDALAREALRLLGANLIAACRNGADRKAREGMLLGATLAGQAFANSPVAAVHALAYPLGGHYHVPHGLSNALMLGPVLRFNAKAAASLYAELADVLGVPGEGDAATRSDAFVQHMETLMDESGAPRRLRDVGVTDNTLAMLASDAMKQSRLLVNNPVEVREEDALALYREAF

SEQ ID NO: 39495 - DNA, 1215 bp, Escherichia coli K12
  CDS (1)..(1215): transl_table=11
gtgggcgagagaaagcggaggggctatatgcaaaatgaattgcagaccgcgctctttcaggcgttcgataccctgaatctgcaacgggtaaaaacatttagcgttccaccggtgacgctttgcggtccgggctcggtgagcagttgcggacagcaagcgcaaacgcgtgggctgaaacatctgttcgtgatggcagacagctttttgcatcaggcagggatgaccgccgggctgacgcgtagcctgaccgttaaaggtatcgccatgacgctctggccatgtccggtgggcgaaccgtgcattaccgacgtgtgtgcagccgtggcgcagttgcgtgagtcaggctgtgatggggtgatcgcgtttggcggcggctcggtgctggatgcggcgaaagccgtgacgttgctggtgacgaacccggatagcacgctggcagagatgtcagaaaccagcgttctgcaaccgcgcttgccgctgattgccattccaactaccgccggaaccggctctgaaaccaccaatgtaacggtgattatcgacgcggtgagcgggcgcaagcaggtgttagcccatgcctcgctgatgccggatgtggcgatcctcgacgccgcattgaccgaaggtgtgccgtcgcatgtcacggcgatgaccggcattgatgcgttaacccatgccattgaagcatacagcgccctgaacgctacaccgtttaccgacagtctggcgattggtgccattgcgatgattggcaaatcgctgccgaaagcggtgggctacggtcacgaccttgccgcgcgcgagagcatgttgctggcttcatgtatggcgggaatggcgttttccagtgcgggtcttgggttgtgccacgcgatggcgcatcagccgggcgcggcgctgcatattccgcacggtctcgcgaacgccatgttgctgccaacggtgatggaatttaaccggatggtttgtcgtgaacgctttagtcagattggtcgggcactgcgaactaaaaaatccgacgatcgtgacgctattaacgcggtaagtgagctgattgcggaagttgggattggtaaacgactgggcgatgttggtgcgacatctgcgcattacggcgcatgggcgcaggccgcgctggaagatatttgtctgcgcagtaacccgcgtaccgccagcctggagcagattgtcggcctgtacgcagcggcgcaataa

SEQ ID NO: 39496 - protein, 404 aa, Escherichia coli K12
MGERKRRGYMQNELQTALFQAFDTLNLQRVKTFSVPPVTLCGPGSVSSCGQQAQTRGLKHLFVMADSFLHQAGMTAGLTRSLTVKGIAMTLWPCPVGEPCITDVCAAVAQLRESGCDGVIAFGGGSVLDAAKAVTLLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRERFSQIGRALRTKKSDDRDAINAVSELIAEVGIGKRLGDVGATSAHYGAWAQAALEDICLRSNPRTASLEQIVGLYAAAQ

SEQ ID NO: 39497 - DNA, 1149 bp, Salmonella typhimurium LT2
  CDS (1)..(1149): transl_table=11
atggcgaacagaatgattctgaatgaaacggcatggtttggccggggagcggtggacgcattaaccgatgaggtgacgcgccgcggttatcataaagcgctgattgttaccgataaaacgctggtgcaatgcggtgtggtcgataaagtgacaagcagaatggatgccgcagggctggcgtgggagatctatgcgggcgtgatccctaatcctacgatttccgttgtccaggaagggcttaaggtctttacccaaagcggcgcggactatctcatcgccattggcggcggttctccgcaggatacctgcaaagcgatcggtattatcagtaacaatccggaatttgccgatgtgcgcagtctggaagggctatcgccgacccgtaaacccagcgtgccgattatggcgatcccgacaacggcgggaaccgcggcggaagtcactatcaattatgtgattaccgatgaagagaaacggcgcaaattcgtttgtgtcgatccgcatgatattccgcaggcggcatttatcgatgccgatatgatggacggtatgccgcccgcgctgaaagcggcaacgggcgtggatgcgctaacccatgctattgaaggctatattacccgggccgcatgggcgctgacggatgcattacatatcaaagccattgagattattgctggcgcgctgcgcggcgccgtagccggagaaaaagaggccggtgaggcgatggcgctggggcaatacgttgccgggatggggttttccaatgtggggctggggctggtgcatgggatggcgcatccgttgggcgcgttttacaacacgccacacggcgtcgcgaatgctattttgcttccgcatgtgatgcgtttcaatgccgggtctaccaacgagaaattccgtgatatcgcccgggcgatgggggtgaaggtagaaggattgagccttgaagaggcgcgtaatgccgcagtggaagccgtatttacgctaaatcgcgatgtgggaattccgctgcatttgcgtgatgtcggcgttcgaaaagaggatatcccggcgctggcgcaggcggcgttcgatgatgtctgtacgggcggcaatccgcgtgaagcgagtctggcggacattgtcgaactgtatcataccgcctggtaa

SEQ ID NO: 39498 - protein, 382 aa, Salmonella typhimurium LT2
MANRMILNETAWFGRGAVDALTDEVTRRGYHKALIVTDKTLVQCGVVDKVTSRMDAAGLAWEIYAGVIPNPTISVVQEGLKVFTQSGADYLIAIGGGSPQDTCKAIGIISNNPEFADVRSLEGLSPTRKPSVPIMAIPTTAGTAAEVTINYVITDEEKRRKFVCVDPHDIPQAAFIDADMMDGMPPALKAATGVDALTHAIEGYITRAAWALTDALHIKAIEIIAGALRGAVAGEKEAGEAMALGQYVAGMGFSNVGLGLVHGMAHPLGAFYNTPHGVANAILLPHVMRFNAGSTNEKFRDIARAMGVKVEGLSLEEARNAAVEAVFTLNRDVGIPLHLRDVGVRKEDIPALAQAAFDDVCTGGNPREASLADIVELYHTAW

SEQ ID NO: 39499 - DNA, 1119 bp, Listeria monocytogenes EGD-e
  CDS (1)..(1119): transl_table=11
atgaatagctttcaaattaaaacaaaagtagcttttggtacgaatagtttacaagttttaaaagaaattaaaaataaaaatgtctggattatttgcgaccgttttttggctgatggagaggggcttcaaggattaatcggacaattagatgcatccaataatgtgcatattttcaccgatgtagtgcctgatccgcctatttccaaagtagctggaggggttagtgaggcaggcaaaatccaaccgcaagtcatgattgcttttggtggtggttcagcgattgatacggctaaaggaatctactatttcgccaaacgtttggaaaaaatcaatatcagtacttttattgcaattccaaccactagcggtacaggctcggaagtaacagccgcaaccgttattacagatccaacaacgaaaattaaatatccgcttttcttagatgaactaattccggatatggctattttggatgcgcagctagttgttacggtacctccagccattacggcgaacactgggatggatgtcctaacacacgctatcgaagcttatgtctctaaagatgcgagcgattataccgatgctcttggtgaaaaaagtgtgcaattaacgttacgtttcttaacgagttgttatgatgatggtcgtaatttagcggatcgggaaaaaatgcataatgcgtctactatggctggaatggcatttaactgcgccaatttaggtttgaatcacagtattgcgcatcaacttggtgcacagttccacgtaccccacgggctagccaatgcgattctactggatgcagtgattcgttttaacgcctttaaaaatcgcgaaacggaacaaaaatatgcggagatggcgcgcatttgcggcattgcttccagatctgactcgaacgaaacggcagtccgcttacttcgcgaaagaatcgtagcgatgatggaacatatgcaaatgccacggactttaacagatgctggagtagcaaaagaaaaagtctatgcaaaaatggacgaaattgcaacgaatgcactgaaagacgcttgcttaccgactagtccaacgacaccgacacatcaagagctaaaagaaattttagaacaaattatttag

SEQ ID NO: 39500 - protein, 372 aa, Listeria monocytogenes EGD-e
MNSFQIKTKVAFGTNSLQVLKEIKNKNVWIICDRFLADGEGLQGLIGQLDASNNVHIFTDVVPDPPISKVAGGVSEAGKIQPQVMIAFGGGSAIDTAKGIYYFAKRLEKINISTFIAIPTTSGTGSEVTAATVITDPTTKIKYPLFLDELIPDMAILDAQLVVTVPPAITANTGMDVLTHAIEAYVSKDASDYTDALGEKSVQLTLRFLTSCYDDGRNLADREKMHNASTMAGMAFNCANLGLNHSIAHQLGAQFHVPHGLANAILLDAVIRFNAFKNRETEQKYAEMARICGIASRSDSNETAVRLLRERIVAMMEHMQMPRTLTDAGVAKEKVYAKMDEIATNALKDACLPTSPTTPTHQELKEILEQII

SEQ ID NO: 39501 - DNA, 1140 bp, Listeria monocytogenes EGD-e
  CDS (1)..(1140): transl_table=11
atgcaaaaagttagttttaaaacagatctttacattggccaaggagcaacagatcgtttacttgattttaaagacaaacaaatctttatcgtaacggatccatttatggttagttccggaatgattaacgcgattacagacaaaattgatcaatcgaatacatatacgatttttagcgaaattattccagacccaccgattgaaaacgtggtagcaggaatcgaagttctaaatgaatgtgatgcaaacttgatgattgcaattggtggtggctcagcgattgatgcagcgaaagcgatgaaattcttcggtcaaaaacttggtacggtgcgcgcaatgcctttcatcgttatcccgacaactagtggaactggttcagaagtaactagtttttctgttattacaaacaaagaaaaagcaatcaaatacccactaattacagatgctattttaccagatgaagcaattttagacgctgacttagtaaaatctgttccaccagcaatcacagcagatacaggtatggatgtattaacgcatgcgcttgaagcctatgtatctacaaaagcaaatgattactcggatgcaatggcagaaaaagttatccaattagttttcacatacttagaacgtgcttacaaagatggcaatgatttagaagctcgcgaaaaaatgcataatgcgtcttgtcttgcaggaatggcttttaacattacttcgcttggcttaaatcacggtattgcgcatacagctggtgcgaaatttaaaatcccgcatggccgtatgaacacattacttttaccacacgtaattagttataacgctggaattacaagtgattttggtaacaatccagataaccgagcagcagaacgttatacagcaatcgctaaattactgaaaatgccagcatcgaatacacgtcttggcgttcgcagcttaattaatgccattaaacaacttcaaaagaaactcaatatgccaactacattaacagaatgtggtattagccgcactgatttaaatgaaaatattgctcaaatcgctgaaggtgcgctaaatgacggatgcactgcaacaaatccaagaacaccgactgaaacagatgttagcgcgattcttgagaagatgttggcataa

SEQ ID NO: 39502 - protein, 379 aa, Listeria monocytogenes EGD-e
MQKVSFKTDLYIGQGATDRLLDFKDKQIFIVTDPFMVSSGMINAITDKIDQSNTYTIFSEIIPDPPIENVVAGIEVLNECDANLMIAIGGGSAIDAAKAMKFFGQKLGTVRAMPFIVIPTTSGTGSEVTSFSVITNKEKAIKYPLITDAILPDEAILDADLVKSVPPAITADTGMDVLTHALEAYVSTKANDYSDAMAEKVIQLVFTYLERAYKDGNDLEAREKMHNASCLAGMAFNITSLGLNHGIAHTAGAKFKIPHGRMNTLLLPHVISYNAGITSDFGNNPDNRAAERYTAIAKLLKMPASNTRLGVRSLINAIKQLQKKLNMPTTLTECGISRTDLNENIAQIAEGALNDGCTATNPRTPTETDVSAILEKMLA

SEQ ID NO: 39503 - DNA, 2601 bp, Listeria monocytogenes EGD-e
  CDS (1)..(2601): transl_table=11
atggcaattaaagaaaatgcggcccaagaagtattagaagttcaaaaagtgattgacagattagcagacaatggacaaaaagcattgaaagcatttgaaagttacaaccaagaacaagtagacaatatcgttcacgcaatggcacttgccggacttgaccaacatatgccccttgcaaaattagcagtagaagaaactggacgtggattatacgaagataaatgtattaaaaacatcttcgcgacagaatatatttggaacaacattaaaaacaataaaacagtcggagttattaacgaagacttacaaactggtgtgattgaaattgctgaaccagttggcgttgttgccggcgttacacctgtaactaacccaacatctactactcttttcaaagcaattatcgcgattaaaacgcgtaacccaatcatctttgctttccatccaagtgcacaacgttgttcatcagcagcagcgaaagttgtatatgatgcagcaattgcagctggagctccagaacattgtattcaatgggtagaaaaaccttccctagaagcaacaaaacaattaatgaaccatgataaagttgcacttgtacttgcaactggtggtgctggaatggttaaatcagcatactctactggtaaacctgcactaggtgttggaccaggtaacgtaccagcttacattgacaaaacagctaaaatcaaacgttctgttaatgacatcattctttctaaatcttttgaccaaggtatgatttgtgcttctgaacaagcagtaatcgtagacaaagaagtggctaaagaagtaaaagcagaaatggaagcaaacaactgctacttcgttaaaggcgctgaattcaaaaaattagaaagctatgttatcaaccctgaaaaaggaacacttaacccagatgtagttggtaaatcccctgcatggattgcaaaccaagctggcttcaaagttccagaagatacaaaaattcttgtagctgaaattaaaggtgttggcgacaaatacccactatctcacgaaaaattaagcccagttcttgcatttatcgaagctgctaaccaagcagaagcattcgatcgttgtgaagaaatgttagtatatggaggacttggacactccgcagttattcactctactgataaagaagttcaaaaagcatttggtatccgtatgaaagcttgccgtatcattgtaaacgcaccaagcgcacaaggcggtatcggtgacatttataacggcttcatcccttccctaacacttggttgtggatcttatggtaaaaactctgtatcacaaaatgtaagtgcgactaacttgctgaacgttaaacgtatcgcggatcggagaaataatatgcaatggttcaaacttccaccaaaaattttctttgaaaaatattccactcaataccttcaaaaaatggaaggcgttgaacgcgtatttatcgtaactgacccaggaatggttcaattcaaatatgttgatgttgtaatcgaacacttgaaaaaacgtggcaatgacgtatcttaccaagtatttgctgacgttgaaccagatccatctgacgtaacagtttataaaggtgcagaactaatgaaagacttcaaaccggacacaattatcgctcttggtggtggttccgcaatggatgctgccaaaggtatgtggttattctatgaacacccagaagcttcattcttcggcttgaaacaaaaattcttagatattcgtaaacgtactttcaaatatcctaaacttggtggaaaagcaaaattcgtcgcaattccaacaacaagtggtacaggttctgaagtaacaccttttgcggttattacagacaaagaaaataacattaaataccctcttgctgactacgaattaactccagacgttgcgattgtcgatgcacaatatgtaactactgttccagcacacattactgctgatactggtatggacgttttaactcacgcaattgaatcttatgtatccgtaatggcaagcgattatactcgtggattatctatccgcgcaatcgaacttgtttttgaaaacttacgtgaatctgttcttactggtgatccagatgcgcgcgaaaaaatgcataatgcttctgccctagctggtatggcgtttgcaaatgcgttcctaggaatcaaccacagcttggcacacaaaattggacctgaattccacattcctcacggtcgtgccaatgcaatccttatgccacatgttattcgttataacgcacttaaacctaaaaaacatgcgttattcccaagatatgaaagtttccgtgctgatgaagattatgctcgtatctctcgtattatcggcttccctgctgcaactacagaagaaggcgttaaatcacttgtagatgaaatcatcaaacttggtaaagatgttggtatcgacatgagtcttaaaggacaaaatgttgctaaaaaagatttggatgctgttgtagatactcttgcagatcgcgcattcatggaccaatgtactacagccaaccctaaacaacctcttgtaagtgaactaaaagaaatctaccttgaagcttacaaaggtgtttga

SEQ ID NO: 39504 - protein, 866 aa, Listeria monocytogenes EGD-e
MAIKENAAQEVLEVQKVIDRLADNGQKALKAFESYNQEQVDNIVHAMALAGLDQHMPLAKLAVEETGRGLYEDKCIKNIFATEYIWNNIKNNKTVGVINEDLQTGVIEIAEPVGVVAGVTPVTNPTSTTLFKAIIAIKTRNPIIFAFHPSAQRCSSAAAKVVYDAAIAAGAPEHCIQWVEKPSLEATKQLMNHDKVALVLATGGAGMVKSAYSTGKPALGVGPGNVPAYIDKTAKIKRSVNDIILSKSFDQGMICASEQAVIVDKEVAKEVKAEMEANNCYFVKGAEFKKLESYVINPEKGTLNPDVVGKSPAWIANQAGFKVPEDTKILVAEIKGVGDKYPLSHEKLSPVLAFIEAANQAEAFDRCEEMLVYGGLGHSAVIHSTDKEVQKAFGIRMKACRIIVNAPSAQGGIGDIYNGFIPSLTLGCGSYGKNSVSQNVSATNLLNVKRIADRRNNMQWFKLPPKIFFEKYSTQYLQKMEGVERVFIVTDPGMVQFKYVDVVIEHLKKRGNDVSYQVFADVEPDPSDVTVYKGAELMKDFKPDTIIALGGGSAMDAAKGMWLFYEHPEASFFGLKQKFLDIRKRTFKYPKLGGKAKFVAIPTTSGTGSEVTPFAVITDKENNIKYPLADYELTPDVAIVDAQYVTTVPAHITADTGMDVLTHAIESYVSVMASDYTRGLSIRAIELVFENLRESVLTGDPDAREKMHNASALAGMAFANAFLGINHSLAHKIGPEFHIPHGRANAILMPHVIRYNALKPKKHALFPRYESFRADEDYARISRIIGFPAATTEEGVKSLVDEIIKLGKDVGIDMSLKGQNVAKKDLDAVVDTLADRAFMDQCTTANPKQPLVSELKEIYLEAYKGV

SEQ ID NO: 39505 - DNA, 1119 bp, Listeria innocua Clip11262
  CDS (1)..(1119): transl_table=11
atgaatagctttcaaatcaagacaaaagtagcttttggtacgaatagtttacaagttttaaaagaaattaaaaataaaaatgtttggattatttgtgatcgttttttggcggatggagagggacttcaaggtttagttgggcagttagatgcatctaataatgtgcatattttcaccgatgtagttccagatccacccatttcaaaagtagctagtggtgttagtgaagcaggaaaaattcagcctcaagtcatgatcgcttttggcggtggctcagcaattgatacggcaaaaggaatttactacttcgcaaaacgcttagaaaaaattaatattagtacttttatagcgattccaactacaagtggcactggatctgaagtgacagctgctaccgttattactgatccaacgacaaaaattaagtatccacttttcttagatgaacttattccggatatggctattcttgacgcgcaactcgttgtcacagtgccgccagcgattacagcgaatactggaatggatgtattaacacacgcgattgaagcttatgtttctaaagctgcgagtgattatacggacgcattaggtgaaaaaagtgtgcaattaacgctacgctttttaacgagctgttatgacgatggtcgtaatttagctaaccgtgaaaaaatgcataatgcgtcgaccatggcaggtatggcttttaactgtgccaaccttggtttaaatcatagtattgcgcatcaactaggtgcacagttccacgtgccgcacggtctagctaatgcgatattacttgatgcggtcattcgttttaacgccttcaaaaatcgtgatactgaacaaaaatatgctgaactggcgcggatttgcggaatggcttctagatctgattccaatgaaaccgctgtccgtctgcttcgtgaaagaattgtccaaatgatggaacacatgcaaatgccacgaacattgacagatgctggcgtagcaaaagaaaaagtctatgcaaaaatggacgaaattgcaacaaatgcactgaaagacgcttgcttgccaacaagtccgacgacaccgacacatcaagaactaaaagaaattttagaacaaattatttag

SEQ ID NO: 39506 - protein, 372 aa, Listeria innocua Clip11262
MNSFQIKTKVAFGTNSLQVLKEIKNKNVWIICDRFLADGEGLQGLVGQLDASNNVHIFTDVVPDPPISKVASGVSEAGKIQPQVMIAFGGGSAIDTAKGIYYFAKRLEKINISTFIAIPTTSGTGSEVTAATVITDPTTKIKYPLFLDELIPDMAILDAQLVVTVPPAITANTGMDVLTHAIEAYVSKAASDYTDALGEKSVQLTLRFLTSCYDDGRNLANREKMHNASTMAGMAFNCANLGLNHSIAHQLGAQFHVPHGLANAILLDAVIRFNAFKNRDTEQKYAELARICGMASRSDSNETAVRLLRERIVQMMEHMQMPRTLTDAGVAKEKVYAKMDEIATNALKDACLPTSPTTPTHQELKEILEQII

SEQ ID NO: 39507 - DNA, 1140 bp, Listeria innocua Clip11262
  CDS (1)..(1140): transl_table=11
atgcaaaaagttagttttaaaacagatctttacattggccaaggagcaacagatcgtttactggattttaaagacaaacaaattttcatcgtaacagatccatttatggtgagctcaggaatgattaatgctattacggaaaaaattgataagtcgaatacatatactatttttagcgatattattcctgacccgccaattgaaaacgttgtagctggaattgaagttttaaacgaatgtgatgccaacttgatgatcgctatcggtggtggttccgcgattgatgcggcgaaagcgatgaaattctttggtcaaaaacttggtacggtgcgcgcaatgccattcatcgtaatcccaactacaagtggaactggttctgaagttactagtttttctgtcattacgaataaagaaaaagcaattaaatatccacttattactgatgctattttgccggatgaagcgattttagatgcggatttagtgaaatctgtcccacctgcaatcacagcagacactggtatggatgtactcacacatgcgctagaagcatacgtttccacaaaagcaaatgattattcggacgcaatggctgaaaaagtaatccaattagtattcacatacttggagcgcgcttataaagacggaaatgatttagaagcacgcgaaaaaatgcataatgcttcttgtttagcaggtatggcatttaatattacctcacttggtttaaaccatggtatcgctcacacagccggtgctaagtttaaaattccacatggtcgtatgaatactttacttttgccacatgttattagttataatgctggattaacaagtgattttggtaacaatccagataaccgtgctgcagaacgttatacagcaattgccaaattactaaaaatgccagcttccaatacaagacttggcgttcgtagcttaattaacgcaattaaacaacttcaaaagaaactcaatatgccaacaacattatctgaatgtggcgttagtcgtaccgatttaaacgagcatattgcgcaaatcgcggaaggtgcgctgaatgatggttgtactgcaactaatccaagaacaccgacagaaacagatgttagtgcgattctcgaaaaaatgttggcttaa

SEQ ID NO: 39508 - protein, 379 aa, Listeria innocua Clip11262
MQKVSFKTDLYIGQGATDRLLDFKDKQIFIVTDPFMVSSGMINAITEKIDKSNTYTIFSDIIPDPPIENVVAGIEVLNECDANLMIAIGGGSAIDAAKAMKFFGQKLGTVRAMPFIVIPTTSGTGSEVTSFSVITNKEKAIKYPLITDAILPDEAILDADLVKSVPPAITADTGMDVLTHALEAYVSTKANDYSDAMAEKVIQLVFTYLERAYKDGNDLEAREKMHNASCLAGMAFNITSLGLNHGIAHTAGAKFKIPHGRMNTLLLPHVISYNAGLTSDFGNNPDNRAAERYTAIAKLLKMPASNTRLGVRSLINAIKQLQKKLNMPTTLSECGVSRTDLNEHIAQIAEGALNDGCTATNPRTPTETDVSAILEKMLA

SEQ ID NO: 39509 - DNA, 2601 bp, Listeria innocua Clip11262
  CDS (1)..(2601): transl_table=11
atggcaattaaagaaaatgcggcccaagaagtattagaagttcaaaaagtgattgacagattagcagacaatggacaaaaagcattgaaagcatttgaaagttacaaccaagaacaagtagataatatcgtacacgcaatggcgcttgccggacttgaccaacatatgccccttgcaaaattagcagtagaagaaacaggacgtggattatacgaagataaatgtattaaaaacatcttcgcaacagaatatatttggaacaacattaaaaacaacaaaacagtcggagttattaacgaagatactcaaactggtgttatcgaaattgctgaaccagtcggagtagttgccggggttacaccagtaactaacccaacttcaacaacacttttcaaagcaattatcgcgattaaaacgcgtaacccaatcatcttcgctttccatccaagtgcgcaacgttgttcatctgaagcagcaaaagttgtttatgatgcagcagttgcagctggagcaccagaacattgtattcaatgggtagaaaaaccttccctagaagcaacaaaacaattaatgaaccacgataaagtagcacttgtacttgcaactggtggtgctggaatggttaaatcagcatactctactggtaaacctgcactaggtgttggaccaggtaacgtaccagcttacattgacaaaacagctaaaatcaaacgttctgttaatgacatcattctttctaaatcttttgaccaaggtatgatttgtgcttctgaacaagcagttatcgtggacaaagaagttgctaaagaagtaaaagcagaaatggaagcaaacaaatgctacttcgttaaaggtgctgaattcaaaaaactagaaagctatgtaatcaaccctgaaaaaggaacacttaacccagatgtagttggtaaatcccctgcatggattgcaaaccaagctggtttcaaagttccagaagatacaaaaattcttgtagctgaaattaaaggtgttggcgacaaatacccactatctcacgaaaaattaagcccagttcttgcatttatcgaagctgctaaccaagcagaagcattcgatcgttgtgaagaaatgttagtatacggcggacttggacactcagcagttattcactctactgataaagaagttcaaaaagcatttggtatccgtatgaaagcttgccgtatcatcgtaaatgcaccaagcgctcaaggcggtatcggtgacatttataacggcttcatcccttccctaactcttggttgtggatcttatggtaaaaactctgtatcacaaaatgtaagtgcgactaacttgctgaacgttaaacgtatcgcggatcggagaaataatatgcaatggttcaaacttccaccaaaaattttctttgaaaaatattctactcaataccttcaaaaaatggaaggcgttgaacgcgtatttatcgtaactgacccaggtatggttcaattcaaatacgttgatgtagtaatcgaacacctgaaaaaacgtggtaacgacgtagcttatcaagtattcgctgatgttgaaccagatccatctgatgtaacagtttacaaaggtgcagaactaatgaaagacttcaaaccagatacaattatcgctcttggtggtggttccgcaatggatgctgccaaaggtatgtggttattctatgaacacccagaagcttcattcttcggcttgaaacaaaaattcttagatatccgtaaacgtactttcaaatatcctaaacttggtggaaaagcgaaattcgttgcgattccaacaacaagtggtacaggttctgaagtaactccatttgcggttattacagacaaagaaaacaacattaaataccctcttgctgactatgaactaactccagacgttgcgattgtcgatgcacaatatgtaacaactgttccagcacacattactgctgatactggtatggacgttctaactcacgcaattgaatcttatgtatccgtaatggcaagcgattatacacgtggattgtctatccgtgcaatcgaacttgtttttgaaaacttacgtgaatctgttcttactggtgatcctgatgcgcgtgaaaaaatgcataatgcttctgccctagctggtatggcatttgcgaatgcgttcctaggaattaaccacagcttggcacacaaaattggacctgaattccacattcctcacggtcgtgcgaatgcaatccttatgccacacgttatccgttataacgcacttaaacctaaaaaacatgcgttattcccaagatatgaaagcttccgtgctgatgaagattatgctcgtatctctcgtattatcggcttccctgctgcaactacagaagaaggcgttaaatcacttgtagatgaaatcatcaaacttggtaaagatgttggtatcgacatgagtcttaaaggacaaaatgttgctaaaaaagacttggatgcagttgtagatacacttgcagatcgcgcattcatggaccaatgtactactgccaaccctaaacaaccacttgtaagcgaactaaaagaaatttaccttgaagcttacaaaggtgtttaa

SEQ ID NO: 39510 - protein, 866 aa, Listeria innocua Clip11262
MAIKENAAQEVLEVQKVIDRLADNGQKALKAFESYNQEQVDNIVHAMALAGLDQHMPLAKLAVEETGRGLYEDKCIKNIFATEYIWNNIKNNKTVGVINEDTQTGVIEIAEPVGVVAGVTPVTNPTSTTLFKAIIAIKTRNPIIFAFHPSAQRCSSEAAKVVYDAAVAAGAPEHCIQWVEKPSLEATKQLMNHDKVALVLATGGAGMVKSAYSTGKPALGVGPGNVPAYIDKTAKIKRSVNDIILSKSFDQGMICASEQAVIVDKEVAKEVKAEMEANKCYFVKGAEFKKLESYVINPEKGTLNPDVVGKSPAWIANQAGFKVPEDTKILVAEIKGVGDKYPLSHEKLSPVLAFIEAANQAEAFDRCEEMLVYGGLGHSAVIHSTDKEVQKAFGIRMKACRIIVNAPSAQGGIGDIYNGFIPSLTLGCGSYGKNSVSQNVSATNLLNVKRIADRRNNMQWFKLPPKIFFEKYSTQYLQKMEGVERVFIVTDPGMVQFKYVDVVIEHLKKRGNDVAYQVFADVEPDPSDVTVYKGAELMKDFKPDTIIALGGGSAMDAAKGMWLFYEHPEASFFGLKQKFLDIRKRTFKYPKLGGKAKFVAIPTTSGTGSEVTPFAVITDKENNIKYPLADYELTPDVAIVDAQYVTTVPAHITADTGMDVLTHAIESYVSVMASDYTRGLSIRAIELVFENLRESVLTGDPDAREKMHNASALAGMAFANAFLGINHSLAHKIGPEFHIPHGRANAILMPHVIRYNALKPKKHALFPRYESFRADEDYARISRIIGFPAATTEEGVKSLVDEIIKLGKDVGIDMSLKGQNVAKKDLDAVVDTLADRAFMDQCTTANPKQPLVSELKEIYLEAYKGV

SEQ ID NO: 39511 - DNA, 1149 bp, Ralstonia solanacearum GMI1000
  CDS (1)..(1149): transl_table=11
atggccctcatcttctacctcacccacgtccacctcggcttcggcacgctcggcgagctcggcagcgaatgcgcgcgagtcggcatccgccggccgctggtcgtcaccgaccgcggcgtggcggccgccggcctggcccagcgcgccatcgacgccaccggcggcctgcccgtcaccgtgttcgacgagacgccgtccaaccccaccgaggcgatggtcaggaaggccacggcgcaataccgggacgccggctgcgacgggctgatcgccatcggcggcggctcgtcgatcgacctggccaaggggatcgccatcgcagcgacgcaccccgggccgctcaccgcctacgccaccatcgaaggcggcagcggcaagatcaccgatgcggccgcgccgctgatcgccatccccaccacggccggcaccggcagcgaagtggcgcggggcgcgatcctgatcctggaggacggccgcaagctgggcttccactcctggcatctgctgccgaaatcggccctctgcgaccccgcgcttacgctcggcctgccgcccctgctgacggccgccaccgggatggacgccatcgcgcactgcatcgagaccttcctcgcgccggccttcaacccgcccgccgacggcatcgcgctcgacggtctggagcgcgcctgggcccacatcgagcgcgccacgcgcgacggcgccgaccgcgaggcccggctcaacatgatgagcgcctcgatgcagggggcgatggcgttccagaaggggctgggctgcgtgcattcgctgtcgcacccgctgggcggcgtgaaggtggacggcaagaccgggctgcaccacggcacgctcaacgcggtggtgctgccggcggtgctgcgcttcaatgcgacggcggaatcggtggtgcgcgagcatcgctacgcccgcatgcgccgcgcgatgaacctgccggccgacgccgacctcgcccaggccgtgcacgacatgaccgcgcggctgggcctgcccaccggcctgcgccagatgggcgtgccggacgatgcgctggagcacgtggtgcgtggcgccctgctcgaccactgccacaagaccaatccgcgcgaggccacggcggacgattaccgccggatgctggcggagtcgatgtag

SEQ ID NO: 39512 - protein, 382 aa, Ralstonia solanacearum GMI1000
MALIFYLTHVHLGFGTLGELGSECARVGIRRPLVVTDRGVAAAGLAQRAIDATGGLPVTVFDETPSNPTEAMVRKATAQYRDAGCDGLIAIGGGSSIDLAKGIAIAATHPGPLTAYATIEGGSGKITDAAAPLIAIPTTAGTGSEVARGAILILEDGRKLGFHSWHLLPKSALCDPALTLGLPPLLTAATGMDAIAHCIETFLAPAFNPPADGIALDGLERAWAHIERATRDGADREARLNMMSASMQGAMAFQKGLGCVHSLSHPLGGVKVDGKTGLHHGTLNAVVLPAVLRFNATAESVVREHRYARMRRAMNLPADADLAQAVHDMTARLGLPTGLRQMGVPDDALEHVVRGALLDHCHKTNPREATADDYRRMLAESM

SEQ ID NO: 39513 - DNA, 1146 bp, Agrobacterium tumefaciens str. C58
  CDS (1)..(1146): transl_table=11
atgaatatcgtcgccaactggagttatcccaccgccgtcaagcttggccgtggccggatcaaggaactggcggaagcctgcaaaacgctcggcatcaggaagccgctgctcgtcacggatcgtggccttgccaatatggcgatcaccgcgcatgcgctggatgtgctggaagaggcgggtcttggccgggcgatctttgccgatgtcgatccgaaccccaacgaaatcaacatggaagccggcgtcaaggcttaccgcgatggcggtcatgacggcgtcgtcgcctttggcggcggctcgggcctcgatctcggcaagatgatcgccttcatggccgggcagacacgtccggtctgggatttcgaggatatcggtgattggtggacacgcgctgatgcgtcgaagatcgcgcccatcgtcgcagtcccgacgacggctggcaccggttcggaagtcggccgcgccagcgtcatcaccaattcgcagacgcatgtgaagaagatcatcttccatcccaagctgcttcccggtgtcgtcatctgcgatccggaactgacggtcggcatgccgaaggtcatcacggccggcaccggcatggatgccttcgcccattgcctcgaagcgtattcgtcaccgttcttccacccgatgagtgctggtgtcgcgcttgagggcctgcgtctcgtcaaggaattcctgccgcgcgcctataaggatggcacggatatcgaagcccgcaccaatatgatggcggcggcggcgatgggggcggttgccttccagaagggtctcggggccattcattcgctctcgcatccgatcggggcggtctacaacacccatcacggcatgaccaatgccgtcgtcatgccggcggtgctgcgtttcaaccgtcctgccatcgaagacaagatcgcgcgtgctgccgcctatctcggcatttccggcggttttgacggtttttatgactacgtgctggatcttcgcagggaactcggcgtgccggaaaacctgaccgccatgggcatcaagcctgatcgtatcgacgagctggcggcagaagcgatcaaggatccgagctgcggtggtaatccggtgccgatgacgcttgagaataccaaggcgctttttgaggcttgcttttaa

SEQ ID NO: 39514 - protein, 381 aa, Agrobacterium tumefaciens str. C58
MNIVANWSYPTAVKLGRGRIKELAEACKTLGIRKPLLVTDRGLANMAITAHALDVLEEAGLGRAIFADVDPNPNEINMEAGVKAYRDGGHDGVVAFGGGSGLDLGKMIAFMAGQTRPVWDFEDIGDWWTRADASKIAPIVAVPTTAGTGSEVGRASVITNSQTHVKKIIFHPKLLPGVVICDPELTVGMPKVITAGTGMDAFAHCLEAYSSPFFHPMSAGVALEGLRLVKEFLPRAYKDGTDIEARTNMMAAAAMGAVAFQKGLGAIHSLSHPIGAVYNTHHGMTNAVVMPAVLRFNRPAIEDKIARAAAYLGISGGFDGFYDYVLDLRRELGVPENLTAMGIKPDRIDELAAEAIKDPSCGGNPVPMTLENTKALFEACF

SEQ ID NO: 39515 - DNA, 1179 bp, Agrobacterium tumefaciens str. C58
  CDS (1)..(1179): transl_table=11
atgataaaccgtgtcctgatgccccgcgaaatgcttatcggcggcggcagccgatttcgattacccgccgtggtaaaatcgcttggcgtccatcgccccctgctggtctgcgatcccgtattgcagaagctcggccatgccgatgcgcttttgcaggcgctggccgaggaaggcatcgaggccgccgtgttctcggacgtcgtggaagacccgacggatatatccatcgccaccctggtgaaacgcatttccgatggcggccatgacagtctcgtcgcacttggtggcggcagcgccatggatacggccaaggcgggcgccatcgttgcaacgagcggggaggatttgcgcgccctgaaagtgccgcggatcgtggatttcgccgtcatgccggtgattgccattccgacgacggccggtaccggttcggaagtgacccgcgccgccgtcgtcaccgacacggctgccagcgaaaaaatgctgatcctcggcaccgccgctttgccggtcgcggccatcatcgattatgagctgacgctgacatgtccttaccgtgtcacggtcgataccggcatcgatgcgctgacccatgcgctggaagcgctggtcaaccgcaatggtaacgcccattccgaggcgctggcgctttccgccctgaagctgatcggcgccaatcttgaaaaagtggctgataaccctgatgaccgggatgcgcgtgaagcgatgatgctgggcgcgacccatgccgggcttgccgtctccaatacatcgaccgcactgatccatggcctcagccgtccagtcggcgcgtttttccatgtaccgcatggcatgtcgaatgcgatggtgctgccgctggtcacgcagttttcgctgaattccgctcttccgcattatgctgcggccgcgcgggcgctcggctccgccgccgcgacagatagcgatcaggtctccggtgcgaagctggtggaggctttcctcggcctgaacaggcggttgaaggtgccgaccccacaagagttcggtatcgacaggagccgctatctcgatcttgtgccggaaatggtgcggcagggccttgcttcgggtacgccggcaaataacccccgagtgcccacagttgccgaaatgacgaggctatatgaactcgcctatgacggaagcatcgcggaattttaa

SEQ ID NO: 39516 - protein, 392 aa, Agrobacterium tumefaciens str. C58
MINRVLMPREMLIGGGSRFRLPAVVKSLGVHRPLLVCDPVLQKLGHADALLQALAEEGIEAAVFSDVVEDPTDISIATLVKRISDGGHDSLVALGGGSAMDTAKAGAIVATSGEDLRALKVPRIVDFAVMPVIAIPTTAGTGSEVTRAAVVTDTAASEKMLILGTAALPVAAIIDYELTLTCPYRVTVDTGIDALTHALEALVNRNGNAHSEALALSALKLIGANLEKVADNPDDRDAREAMMLGATHAGLAVSNTSTALIHGLSRPVGAFFHVPHGMSNAMVLPLVTQFSLNSALPHYAAAARALGSAAATDSDQVSGAKLVEAFLGLNRRLKVPTPQEFGIDRSRYLDLVPEMVRQGLASGTPANNPRVPTVAEMTRLYELAYDGSIAEF

SEQ ID NO: 39517 - DNA, 1170 bp, Brucella melitensis 16M
  CDS (1)..(1170): transl_table=11
atgaccacattgaccgcgaaatggaactttccgaccactgtgcttttcgggccggggcacatcaaggagcttccagccgtcctgaaagccgcaggcatcgagcacccgcttttcgtcaccgatccgggcctcgccaaactgcctgtggtcgcctcgacattggccgttctggatgcggcgggcgtgcaatatggcgtgttttccgatgtgaaacccaatccggtcgagagcaatcttcatgccggcgtaaaggttttccgggaaggcaggcatgacggcgtcatcgcctttggcggcggttccgcgctcgatctcggcaagctcatcgcctttcaggccggacagacccggcccgtctgggattttgaagatatcggcgactggtggacccgcgccgacagcaacgccatagctcccgtcattgccgtgccgaccaccgcaggcaccggctcggaagtggggcgcgcgggcgttctcaccaatgaatccacccacacgaagaaggtcatcttccaccccaaaatgctgcccgtaacggtgatcgccgatcccgaactttccactggcatgccgcccttcatcacggcgggtacgggcatggatgcactggcgcactgccttgaagcctattgcgcaccgggcttccatcccatggccgatggcattgccgtggagggcatccgccttgtctttgagaacctgcccaaagcctatgccaatggcggggatatcgaagcgcgtgccaatatgatggcagccgctgccatgggcgccacggccttccagaagggcctcggtgcgatccattcgctctcgcaccccatcggcgcgctctatgacacacatcacggcatgaccaatgccgtcttcatgccctatgtgctgcaccacaaccgggctgccatcgaaaagcgcattgcccggctggccgattatctcggcatcgaaggcgggttcgacggctttgccgatgcgatcatgaagctgcgcgccgaacttggcgtgccgcgcaccctgcccgatctcatcaagaaccttcagatggacaatgcccgcaaggagctgatcgccgaaatggcagtggcagatcccaccgcaggcggaaacccggttgaacttacaaaaaacgacgcgctaaagttgctcaatgcagcattggaaggtagataa

SEQ ID NO: 39518 - protein, 389 aa, Brucella melitensis 16M
MTTLTAKWNFPTTVLFGPGHIKELPAVLKAAGIEHPLFVTDPGLAKLPVVASTLAVLDAAGVQYGVFSDVKPNPVESNLHAGVKVFREGRHDGVIAFGGGSALDLGKLIAFQAGQTRPVWDFEDIGDWWTRADSNAIAPVIAVPTTAGTGSEVGRAGVLTNESTHTKKVIFHPKMLPVTVIADPELSTGMPPFITAGTGMDALAHCLEAYCAPGFHPMADGIAVEGIRLVFENLPKAYANGGDIEARANMMAAAAMGATAFQKGLGAIHSLSHPIGALYDTHHGMTNAVFMPYVLHHNRAAIEKRIARLADYLGIEGGFDGFADAIMKLRAELGVPRTLPDLIKNLQMDNARKELIAEMAVADPTAGGNPVELTKNDALKLLNAALEGR

SEQ ID NO: 39519 - DNA, 1155 bp, Clostridium perfringens str. 13
  CDS (1)..(1155): transl_table=11
atggcgaatcaatttattatgccaaaacgtattatttcaggtgaaaatgctttaaatgaaagtaaagcgtatttaaagagttttggtaagagagttttaatagttactgataaagtaatgactgatctaggtaatgtaaaggttttgacagaggtattagatagtgagaatattgagcacgttttatacaatgaaataaatagtgaacctacagatactatgatagaaaaaggaataaagctttataaagaaaatcaatgtgattttctaattggtttaggtggagggagtccaatagattctactaaagccattggagctatgataacaaacgaaggtaagatatctgattatatgggtagagaaatagaaaaagaacttccaccctttgctgtaataccaactacagctggaacaggttcagaagctactcaatttacaataattacagatacaaaaaatgatgttaagatgcttttaaaaggagctaacttattaccaaacttagcaatagtagatccaagatttacaatgacagcacctgctaagataacagcagctacaggattagatgctttaactcatgctatagaggcttatacatctagaaaggcacagccactttcagatagttttgcagtttcagctgtaaaaagaatatttaagtacttacctatagcttttgatactccaaaggatttaaaagcaagagaagagatgtcaattgcagctttagaagctggaatagcatttaataactcttcagttacaatagttcatggaatgagtagaccaataggagctttattccatgtaccacacggattatcaaatgcaatgcttttagaagcttgtttcacatatgtagtagatggtgcttatgatagatttgctcagctagctaaagaaataaatatagctaatgataatatgagtaatgaagaggccgcaaaagcatttatagatgaagtggttaaattaatggttaaattagaaataccaactttagaagagtttggagtagataaaactaagttctttgataatatagaaaaaatggcagctgacgctatggaaagcggaagcccaagtaatacaagaaagattattgaagttgatgatgtgataaaaatctacaataatctttggaggtaa

SEQ ID NO: 39520 - protein, 384 aa, Clostridium perfringens str. 13
MANQFIMPKRIISGENALNESKAYLKSFGKRVLIVTDKVMTDLGNVKVLTEVLDSENIEHVLYNEINSEPTDTMIEKGIKLYKENQCDFLIGLGGGSPIDSTKAIGAMITNEGKISDYMGREIEKELPPFAVIPTTAGTGSEATQFTIITDTKNDVKMLLKGANLLPNLAIVDPRFTMTAPAKITAATGLDALTHAIEAYTSRKAQPLSDSFAVSAVKRIFKYLPIAFDTPKDLKAREEMSIAALEAGIAFNNSSVTIVHGMSRPIGALFHVPHGLSNAMLLEACFTYVVDGAYDRFAQLAKEINIANDNMSNEEAAKAFIDEVVKLMVKLEIPTLEEFGVDKTKFFDNIEKMAADAMESGSPSNTRKIIEVDDVIKIYNNLWR

SEQ ID NO: 39521 - DNA, 1149 bp, Clostridium perfringens str. 13
  CDS (1)..(1149): transl_table=11
atgagttataaattttttatgccagctataagtttaatgggagcagattgcttaaaagacgctggtgatcaagttggagaattaggatttaaaaaagctttaatagtaacagataaagttttaggacaaataggaatagttaaaaaagtaacagatgttttagataataagaatatagaatatgcaatatatgatgaaactaaaccaaacccaacagttaaaaatgttaatgatggtttagcattattaaaagaaaaagaatgtgattttgttatttcattaggaggaggctcagctcatgactgtgctaaaggaatagctttattagctactaatggtggagaaataaaagactatgagggagtagataaatctaaaaaacctcaattaccaatggtaggtataaatacaactgctggtactggtagtgagatgactttattcgctattataactgatgaagaaagacatataaaaatggctttagtagacaagcatttaacaccaataatagcggttaatgaccctatgttaatgcttgctatgccaaaatcattaacagcggctactggtatggatgccttaacacacgctatagaggcttatgtttcaacttctgccacaccaataacagatgcttgtgcagagaaagctatcgaacttataagcaattatttagtgaatgctgttgaaaatggagaaaatgtggaagctagagatatgatggcttatgctgaatatttagcaggaatggcatttaacaatgctagcttaggatatgttcacgctatggctcaccaattaggtggattctacaacttacctcatggagtatgtaatgcaatattattacctcatgttcaagaatataacaaagatacaagtgcttcaagattagctaaaattgctaaaataatgggtggaaacatagaaggattaactgatgagcaaggagcagatctttgcatagatatgataaaatcattatcacaaactataggaattccagagggacttggagtattaggagtaaaagaaagtgattttgaaactttagctactaatgctttaaatgatgcttgttcattaacaaatccaagaaaaggaaacttagaagaagtaatagctatattcagaaaagcaatgtag

SEQ ID NO: 39522 - protein, 382 aa, Clostridium perfringens str. 13
MSYKFFMPAISLMGADCLKDAGDQVGELGFKKALIVTDKVLGQIGIVKKVTDVLDNKNIEYAIYDETKPNPTVKNVNDGLALLKEKECDFVISLGGGSAHDCAKGIALLATNGGEIKDYEGVDKSKKPQLPMVGINTTAGTGSEMTLFAIITDEERHIKMALVDKHLTPIIAVNDPMLMLAMPKSLTAATGMDALTHAIEAYVSTSATPITDACAEKAIELISNYLVNAVENGENVEARDMMAYAEYLAGMAFNNASLGYVHAMAHQLGGFYNLPHGVCNAILLPHVQEYNKDTSASRLAKIAKIMGGNIEGLTDEQGADLCIDMIKSLSQTIGIPEGLGVLGVKESDFETLATNALNDACSLTNPRKGNLEEVIAIFRKAM

SEQ ID NO: 39523 - DNA, 1131 bp, Clostridium perfringens str. 13
  CDS (1)..(1131): transl_table=11
atgaaaaggtttaagattaagacagaaatactttttggagaaggagccttagattacctaaaggaacttaagaataaaaaagtttttatagtaacagatccttttatggttaagtcagggactatagaaaaattaactaataaccttaaatcatctgaggtttttgtatttagtgaaatagttccagatccacctattgagttagttgtaagtggaatagaaatgcttaaagattttaatcctgatgttgttattgctttagggggagggtctgctatagatgcaactaaggcaataatagatttttctaaaaaattagttaaattaaatgatattaagtttatagctataccaacaacaagtggtacaggctcagaagtaacttcattttccgtaataacagataagcaaaaaggagttaaatatcctttagtatcagatgaattattaccagacatagcaattttagatccagaacttgttaaaacagttccaaattttataactgctgatacaggaatggatgtacttactcatgcattagaagcatatgtttctaaaaatgcaacagacttttcagatgctttagctgaaaaagcagctactttagtttttaaatatttattaaaagcttatgaaaatggaaatgatatagaagctagggaaaaaatgcataatgcttcttgtttagccgggttagcctttaatgaggcttctttaggagtaaaccatggtattgcccatgttttaggaggaaaattccatgttcctcatggaagaactaactcaatattattaccacatgtaatagaatataatgcaaacataacaagctataattctaaggaatttagtgaagctgcagaaaaatatgctaaaatagctaaaatggttggattacaaggatcaaatactagaggattagtaaaaaatcttgtaaatgaaattaaaaagatgcaaaaggcaatgaatatgcctacaactttaagagaatgtaaagttaattgtgatgaactaaagagtttagagaatgaaatagctcaattagcattaaaggatgcatgtacagaaagtaatccaagagtgccagatgaaaatgatataatatctattttaaacaaaattaaatag

SEQ ID NO: 39524 - protein, 376 aa, Clostridium perfringens str. 13
MKRFKIKTEILFGEGALDYLKELKNKKVFIVTDPFMVKSGTIEKLTNNLKSSEVFVFSEIVPDPPIELVVSGIEMLKDFNPDVVIALGGGSAIDATKAIIDFSKKLVKLNDIKFIAIPTTSGTGSEVTSFSVITDKQKGVKYPLVSDELLPDIAILDPELVKTVPNFITADTGMDVLTHALEAYVSKNATDFSDALAEKAATLVFKYLLKAYENGNDIEAREKMHNASCLAGLAFNEASLGVNHGIAHVLGGKFHVPHGRTNSILLPHVIEYNANITSYNSKEFSEAAEKYAKIAKMVGLQGSNTRGLVKNLVNEIKKMQKAMNMPTTLRECKVNCDELKSLENEIAQLALKDACTESNPRVPDENDIISILNKIK

SEQ ID NO: 39525 - DNA, 1158 bp, Clostridium perfringens str. 13
  CDS (1)..(1158): transl_table=11
atgagaatgtacgattatttagtaccaagtgtaaactttatgggagctaactcaatatcagtagttggtgaaagatgtaaaatattaggtggaaagaaagctttaatagttacagataaattcttaagaggattaaaaggtggagcagttgaattaactgaaaaatacctaaaagaagcaggaatcgaagttgcttattatgatggagttgaaccaaacccaaaagatacaaacgttaaagatggtttaaaaatattccaagacgaaaactgtgatatgatcgttacagttggtggaggaagctcacatgactgtggtaaaggaataggtatagctgcaactcacgaaggagatctttatgactatgctggaatagaaactttaacaaatccacttcctccaatagtagcagtaaacactacagctggaactgcaagtgaagtaactagacactgtgttataacaaacactaaaactaaagttaaattcgttatagtaagctggagaaacttacctttagtttcaatcaatgacccaatgttaatggttggaaaaccagcaggattaacagctgcaacaggaatggacgctttaactcatgctgtagaagcatacgtatcaaaagatgctaaccctgtaacagatgctgctgcaatacaagctataaaattaatatcaagcaatttaagacaagctgttgctttaggagaaaacttagtagctagagaaaacatggcttacggttcattattagctggtatggcattcaacaatgctaacttaggatatgtacatgctatggctcaccaattaggcggattatatgatatgcctcatggagtagctaacgctatgttattaccacacgtatgtaaatataacttaatatctaacccacaaaaattcgctgatatagctgaatttatgggagaaaacatagaaggattatcagtaatggacgctgctcaaaaagctatagatgcaatgttcagattatcaactgatatcggaataccagcaaaattaagagacatgggagtaaaagaagaagacttcggatacatggctgaaatggctcttaaagatggtaatgcattcagtaacccaagaaaaggtaacgaaagagacatcgttgaaatattcaaagctgcattctaa

SEQ ID NO: 39526 - protein, 385 aa, Clostridium perfringens str. 13
MRMYDYLVPSVNFMGANSISVVGERCKILGGKKALIVTDKFLRGLKGGAVELTEKYLKEAGIEVAYYDGVEPNPKDTNVKDGLKIFQDENCDMIVTVGGGSSHDCGKGIGIAATHEGDLYDYAGIETLTNPLPPIVAVNTTAGTASEVTRHCVITNTKTKVKFVIVSWRNLPLVSINDPMLMVGKPAGLTAATGMDALTHAVEAYVSKDANPVTDAAAIQAIKLISSNLRQAVALGENLVARENMAYGSLLAGMAFNNANLGYVHAMAHQLGGLYDMPHGVANAMLLPHVCKYNLISNPQKFADIAEFMGENIEGLSVMDAAQKAIDAMFRLSTDIGIPAKLRDMGVKEEDFGYMAEMALKDGNAFSNPRKGNERDIVEIFKAAF

SEQ ID NO: 39527 - DNA, 1167 bp, Clostridium perfringens str. 13
  CDS (1)..(1167): transl_table=11
atggcaagatttactttaccaagggacatatatcatggaaaagattccttagaagtattaaagagtttagaaggtaaaaaggcctttatagttattggtggcggatcaatgaaaagatttggctttttagataaggttttaagttatttaaaggaagctaatatggaaacaaaggtttttgaaggagtagaaccagatccatcagtagaaactgttatgaagggtgcaaaggaaatggaggaatttaatccagactggatagtttccataggaggaggttcacctattgatgcagcaaaggctatgtggattttctacgagtatcctgattttacttttgaaaaggccattgttccttttggattacctaagcttagaagaaaagcaaagtttgtagctattccatcaacttctggaactgctacagaggtaactgccttctcagtaataactgattataaggctaagattaaatatcctttagcagattttgaaataactccagatatagctattgttgatcctagcttagcagaaactatgccagagaagttagtagctcacacaggaatggatgccttaactcatgctattgaggcttatactgcaagtttaagatcaaactttacagatcctttagctttaaaggcaattgaaatggttaatatgcacttagtaaattcatataagggagatatggaagctaggggagaaatgcatgaggctcaatgtttagcaggaatggccttctctaatgcccttttaggaatagtacattctatggctcataaggtaggggctgtattccatataccacatggatgtgctaatgctatcttcttgccatatgtaattaaatataatagaaaagcttgtgaaaatagatatgctaacattgcaagacatattggattaaagggagaaagtgaaagagaattaacagatgacctaatagatttaataaataagtttaataaggaattaaatataccttcatcaatgaaagagtatggaatagatgagaatgaatttaaagctaatcttaaatttatagctcataatgctgttttagatccatgcacaggatcaaatccaagggagattaatgatgaaactatggaaaaattatatacttgtgcatattacggcagtgatgtggatttttaa

SEQ ID NO: 39528 - protein, 388 aa, Clostridium perfringens str. 13
MARFTLPRDIYHGKDSLEVLKSLEGKKAFIVIGGGSMKRFGFLDKVLSYLKEANMETKVFEGVEPDPSVETVMKGAKEMEEFNPDWIVSIGGGSPIDAAKAMWIFYEYPDFTFEKAIVPFGLPKLRRKAKFVAIPSTSGTATEVTAFSVITDYKAKIKYPLADFEITPDIAIVDPSLAETMPEKLVAHTGMDALTHAIEAYTASLRSNFTDPLALKAIEMVNMHLVNSYKGDMEARGEMHEAQCLAGMAFSNALLGIVHSMAHKVGAVFHIPHGCANAIFLPYVIKYNRKACENRYANIARHIGLKGESERELTDDLIDLINKFNKELNIPSSMKEYGIDENEFKANLKFIAHNAVLDPCTGSNPREINDETMEKLYTCAYYGSDVDF

SEQ ID NO: 39529 - DNA, 2598 bp, Clostridium perfringens str. 13
  CDS (1)..(2598): transl_table=11
atgaaagtaacaaacgtagatgaattaatgcttagattagagaaagttagagcagctcaaaaagagttctcaaaattctctcaagagcaagtagatgaaatatttagacaagcagcagtagcagctaataatgagagaatcagattagcaaaaatggctgttgaagaatcaggaatgggtatagttgaagataaagttataaaaaaccattttgctgcagaatatatatacaataaatataaagatgaaaaaacttgtggagttatagaaaaagatgaatcatttggtatcactaaaatagctgaaccaataggagttgtagcagcaatcgttcctactacaaacccaacatcaacagctatattcaaagctttaatatcattaaagactagaaacgctgtattcttttcaccacatccaagagctaaaaactcaacaatagaagcagctagagttgttttagaagcagctgttaaagctggagctccaaaagatataatcggatggatagatgagccatcagttgaaatgtcacaagtattaatggcagaagctgatatcatactagctactggtggtccaggaatggttaaagcagcttactcatcaggaaaaccagctatcggggttggagcaggtaatacaccagcaatcatagatgaaacagctcacttaaaaatggcagtaaactcaatattattatcaaaaactttcgataacggtgttatctgtgcatcagagcaaacagtattagttgttgataaagtttatgatgaggtaagaaaagagttcgctgatagaggagcttacttcttaaaagataaagaaatagataaagtaagaaaaacaattttaataaatggtaacttaaatgctaacatagttggtcaatcagcatggaaaatagctgacatggcaggtgttaaggttccaaaagatactaaagttttaattggtgaagttgagtcagttgaattagaagaaccattctcacatgaaaaattatcaccagtattaggaatgtacagagtagctaactttgaagaagctttagttaaagctgaaagattagttgaacttggtggattcggacatacttcagttttatacactgatacaatgaaatcacaagacagagttcaaaaattcggtgcaactatgaaaactggtagaacaataataaatatgccatcaactcaaggagctatcggagatatatacaacttcaagctagcaccatcattaacattaggttgtggatcatggggtggaaactcagtttcagaaaacgttggtcctaaacacttaatgaatgttaagagtgtagctgagaggagagaaaatatgctttggttcagagttccagaaaaagtttacttcaaatatggtgctttaggagttgctcttagagaattaaaagatttaaacaagaaaaaagtatttatagtaacagacaacgtactagctagtctaggatatgttgataaaataacaagtgttttagaagaaataggtgtagatttcagagtattctcagaagttactccagacccaactttagcatgtgctaaaaaaggtgctgaagcaatgagaagctatcaaccagatgcaatcatagctcttggtggaggttcaccaatggacgctgctaagattatgtgggtaatgtatgagcatccagaagttgctttcgaagatttagcaatgagattcatggatataagaaagagagtttacccattcccaactatgggtcaaaaagctatgatgatttcagttccaacatcagctggtactggttcagaagtaacaccattcgcagttataactgatgaagaatcaggagtaaaatatccattagcagattacgagttaactccagatatggctatcatagatgctgagcttatgatgaacatgccaaaaggattaacagctgcatcaggtatagacgcattaactcatgctttagaagcttacgtttcagttttagcatcagagtacactaatggattagctttagaagctataagattaatatttaaatacttaccacaagcttacgctgaaggtactacaaacataaaagcaagagaaaaaatggctcatgcttcaacaatggctggtatggcattcgctaacgcattcttaggagtatgtcactcaatggcacacaaattaggatcagaacaccatatagcacacggagttgctaacggaatcttaatagaccatgtaataagattcaacgctgttgacaacccaagaaaacaagctgcattcccacaatacaaatatccaaatgctaaatggagatatgcagtaatcgctgactacttaggattaggtggaaagaacgaagaagaaaaagttaataacttaatcaaggctatagataaccttaagaaaacagttggaattcctgcaacaatagctgactgtggagtttcaaaagaatcattctacgctacattagaaaaaatgagtgaagatgcattcgatgaccaatgtacaggtgctaacccaagatacccattaataagtgaaatcaagcaaatgtacatcaatgctttcgaaggtaaaaaagacagagtttaa

SEQ ID NO: 39530 - protein, 865 aa, Clostridium perfringens str. 13
MKVTNVDELMLRLEKVRAAQKEFSKFSQEQVDEIFRQAAVAANNERIRLAKMAVEESGMGIVEDKVIKNHFAAEYIYNKYKDEKTCGVIEKDESFGITKIAEPIGVVAAIVPTTNPTSTAIFKALISLKTRNAVFFSPHPRAKNSTIEAARVVLEAAVKAGAPKDIIGWIDEPSVEMSQVLMAEADIILATGGPGMVKAAYSSGKPAIGVGAGNTPAIIDETAHLKMAVNSILLSKTFDNGVICASEQTVLVVDKVYDEVRKEFADRGAYFLKDKEIDKVRKTILINGNLNANIVGQSAWKIADMAGVKVPKDTKVLIGEVESVELEEPFSHEKLSPVLGMYRVANFEEALVKAERLVELGGFGHTSVLYTDTMKSQDRVQKFGATMKTGRTIINMPSTQGAIGDIYNFKLAPSLTLGCGSWGGNSVSENVGPKHLMNVKSVAERRENMLWFRVPEKVYFKYGALGVALRELKDLNKKKVFIVTDNVLASLGYVDKITSVLEEIGVDFRVFSEVTPDPTLACAKKGAEAMRSYQPDAIIALGGGSPMDAAKIMWVMYEHPEVAFEDLAMRFMDIRKRVYPFPTMGQKAMMISVPTSAGTGSEVTPFAVITDEESGVKYPLADYELTPDMAIIDAELMMNMPKGLTAASGIDALTHALEAYVSVLASEYTNGLALEAIRLIFKYLPQAYAEGTTNIKAREKMAHASTMAGMAFANAFLGVCHSMAHKLGSEHHIAHGVANGILIDHVIRFNAVDNPRKQAAFPQYKYPNAKWRYAVIADYLGLGGKNEEEKVNNLIKAIDNLKKTVGIPATIADCGVSKESFYATLEKMSEDAFDDQCTGANPRYPLISEIKQMYINAFEGKKDRV

SEQ ID NO: 39531 - DNA, 1128 bp, Pyrococcus furiosus DSM 3638
  CDS (1)..(1128): transl_table=11
atgtttttcctaaagactaagattatcgagggaaggggaagtttggagtatcttcaaaaggaagctattgggttcgagagggctttaatcttagcgtcaagctctatgaaaaggttagggtttctgaaggaagctgaagactatctaagggaaggtggagttgaggtaatttcaatagcaggccttcctcctgagcccacgaaagacgttgtcgacgagttcctcccaaaagttagggagttttctccagagatcctcattgcaattggtggaggaagtgttatcgatatggccaaagctctaaaggtattttacgatgtcccaggaatttcatttgaggaagttgcaatcaagagtagattttcgaagccgagacccgttccaaagctgaaaactccccttatagctattccctcaacgagcggtgctggaagtgaggtttcagcagcgagcgtgattaaggtaggggacgttaagtacacgattgtaactcccgagatagctcctgaagtggctatacttgaccctagattacccgaaggaatgcccccagaagttgccaggaattctggaatggatgttttagttcatgcgatagaggcttatgtttcaaaggcttcctcaccctttacagatgcaatggcagttaaagcggcaaaagctgtgttggagcatttagaggagagcattagaggagacaaaaatgccagagagaaaatccactatgcagctacaatggctggcatagctttcttaaacgcaaggcttggactcgttcatgcgatgagtcataaggccgcatggataggaccgcatggtctcgtaaatgccattctacttccctatgtgatggagtataacatggcacgcaggagagagaaatatgatgcattggcgagggaattgggatttgacaatgctgaagagctccttgaagagataaaagctctgaacgaaaggcttggaataggacccatctcaagttacgtcagcgaggaggagttcttagcgaagcttgatgaaatggtagagagagcctatgaagatcccctcgttaacttcaacccagttgagccgagaaaagaggacattagaagaatttatgagagggccttctatggagattga

SEQ ID NO: 39532 - protein, 375 aa, Pyrococcus furiosus DSM 3638
MFFLKTKIIEGRGSLEYLQKEAIGFERALILASSSMKRLGFLKEAEDYLREGGVEVISIAGLPPEPTKDVVDEFLPKVREFSPEILIAIGGGSVIDMAKALKVFYDVPGISFEEVAIKSRFSKPRPVPKLKTPLIAIPSTSGAGSEVSAASVIKVGDVKYTIVTPEIAPEVAILDPRLPEGMPPEVARNSGMDVLVHAIEAYVSKASSPFTDAMAVKAAKAVLEHLEESIRGDKNAREKIHYAATMAGIAFLNARLGLVHAMSHKAAWIGPHGLVNAILLPYVMEYNMARRREKYDALARELGFDNAEELLEEIKALNERLGIGPISSYVSEEEFLAKLDEMVERAYEDPLVNFNPVEPRKEDIRRIYERAFYGD

SEQ ID NO: 39533 - DNA, 1119 bp, Fusobacterium nucleatum subsp. nucleatum ATCC 25586
  CDS (1)..(1119): transl_table=11
atgaaagaatttagactacaacctaaaatattatttggagaagattccttagattatttgaaaacattaaaatgtaagaaagttatgatagtgactgatgaagttatgacacagttaagattaacggattttgttacaaatagtttatcttcaacaactgaaataaatatttttgataaagttgaacctaatcccagtgtagcaacgatagaaaatggtttaaaagattttattggttttgagccagaatgtgttattgcattaggaggaggttcttcaatagatgcttgtaaagggattttatattttgcttataaattgtataaaaagttgaatataaataagaagaaaatattttttatagcaattccaacaacaagtggaacaggctcagaagtaacttcctatagtgttgtaactaatggagaacataaaatagccttagcaaatgacttaatgttaccagatgtagcattattgagtacaaaatttttaggtgctttaccagcaaaagttgttgcagatacaggaatggatgttttaactcatgcacttgaagcttatgtttcaacaaatgctaatccattttcaagttcacttgcaataaaatcaattaagatgatttttgaaaatttagtaacacactataatgatagaaaaattgagggtccaaaaagaaatgtccaatttgcctcttgtatggcagggatagcttttgataattcttcacttggaattaaccacagcattgcacatactgttggagcaaagtttcatatagcacatggaagagccaatgctattattatgccttatgtaattgaagttaatactgaggcaaataagaaatattatgaagtttcaagagaattaggcttaccagctaatactattgaggaagggaaatattcacttttaagttttgtgagaattctaaaagaaaaattaggtattgaaaaatgcttaaaagattatggagttgattttgaaacttttaaaagagaaattccgagtatattatcagatataaagaaagatatatgtactatatataatccaaataaattaagtgatgaggaatatataagattacttttaaaaatttattttggtgaataa

SEQ ID NO: 39534 - protein, 372 aa, Fusobacterium nucleatum subsp. nucleatum ATCC 25586
MKEFRLQPKILFGEDSLDYLKTLKCKKVMIVTDEVMTQLRLTDFVTNSLSSTTEINIFDKVEPNPSVATIENGLKDFIGFEPECVIALGGGSSIDACKGILYFAYKLYKKLNINKKKIFFIAIPTTSGTGSEVTSYSVVTNGEHKIALANDLMLPDVALLSTKFLGALPAKVVADTGMDVLTHALEAYVSTNANPFSSSLAIKSIKMIFENLVTHYNDRKIEGPKRNVQFASCMAGIAFDNSSLGINHSIAHTVGAKFHIAHGRANAIIMPYVIEVNTEANKKYYEVSRELGLPANTIEEGKYSLLSFVRILKEKLGIEKCLKDYGVDFETFKREIPSILSDIKKDICTIYNPNKLSDEEYIRLLLKIYFGE

SEQ ID NO: 39535 - DNA, 2643 bp, Streptococcus pyogenes MGAS8232
  CDS (1)..(2643): transl_table=11
atgactgaaggacataatactgttgaaacaacctctgtttctgtgacaattgatgctcttgttcaaaaaggtttagctgctcttgaagagatgcgtaagcttgaccaagaacaagttgattatatcgtagccaaagcttctgttgctgctttggatgctcacggtgaacttgctaaacatgcttatgaagaaacaggtcgcggtgtctttgaagataaagcaacaaaaaatctatttgcttgtgagcatgtggttaataacatgcgccatcaaaaaacagtaggaattattgaagaagatgatgtgacaggtttgacattaattgctgagccggtgggtgttatctgtgggattacaccaacaactaacccaacttcaacagctatctttaaatctttgatctcgttaaaaacacgtaatccaattatttttgcctttcacccatcagcacaagaatcatcagcgcatgccgctcgtattgttcgtgatgctgctattgccgctggtgctcctgaaaattgtgtgcagtgggttgaaacaccatcacttgaagcaacaaatgctttgatgaatcatgacggcattgccactatccttgcgacaggtggaaatgcgatggttaaagcggcatactcatgtgggaaacctgcccttggggtaggtgctggtaacgttccagcttatgttgaaaaatcagctaatatccgtcaagccgctcatgatattgtgatgtctaaatcatttgataatggtatggtctgtgcctctgaacaagctgttatcatcgataaagaaatctatgacaattttgtagcagaattcaaatcttaccacacttattttgttaataaaaaagaaaaagcccttcttgaagaattctgttttggtgcaaaagcaaatagcaaaaactgtgctggtgcaaaattaaatccaaatattgtaggaaaaccagctacttggattgcagcacaagctggatttactgttccagaaggaacaaatattcttgccgcagaatgtactgaagttagtgaaaaagaacctttgacacgggaaaaattatcaccagtcattgctgttttgaaatctgaatcacgtgaagacggtgttgaaaaagctcgtcaaatggttgaatttaatggacttggtcactcagctgccattcatacagcagatgcagagttggcaaaagaatttggaactagaatccgtgctatccgcgtcatctggaattcaccttctacatttggtggtatcggggatgtttacaatgctttcttaccatcattgactcttggttgtggttcgtatggacgtaacgcagttggtgataacgttagtgctataaatctcttgaacatcaaaaaagtaggaagacgtagaaataatatgcaatggtttaaagttccttcaaaaacatacttcgaacgtgattcaattcaatatttgcaaaaatgtcgtgatgttgaacgtgtcatgattgttacagatcacgctatggttgagcttggtttcttggatcgtatcattgaacaacttgatcttcgtcgcaataaagttgtttatcagatctttgctgaagtagaaccagatccagacattacaactgttatgaaaggtactgaattaatgcgtaccttcaaaccagacaccattattgcccttggcgggggatctcctatggatgcagccaaagttatgtggctcttttatgaacaaccagaagttgatttccatgacctcgttcaaaaattcatggatatccgcaaacgtgcgttcaaattcccagaacttggtaagaaaacaaaatttgttgctatcccaacaacttctggaacaggttcagaggtgacaccatttgccgttatctctgacaaagcaaataatcgtaaatatccaatcgctgattactcattaacaccaactgtagccattgttgacccagctttggtattgactgttccaggctttattgctgctgatactggtatggacgttttgacacacgcaaccgaagcttacgtgtcacaaatggccaatgactttacggatggtttagctcttcaagccattaaaattgtttttgataatcttgaaaaatcagttaaaacagccgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacggcgacatggcctaagtataattactaccgtgcggatgaaaaataccaagacattgcgaaattgttagggcttccagcttctacaccagaagaagcagtggaatcttatgcgaaagctgtttatgatctgggttgccgagttggtattcaaatgaacttcaaagctcaaggtatcgacgaaaatgaatggaaagaacattctcgtgaattggcttaccttgcttatgaagaccaatgttcacctgctaacccacgtcttccaatggttgatcacatgcaagaaattattgaagatgcttactatggttatgctgaacgtccaggacgacgtaagtga

SEQ ID NO: 39536 - protein, 880 aa, Streptococcus pyogenes MGAS8232
MTEGHNTVETTSVSVTIDALVQKGLAALEEMRKLDQEQVDYIVAKASVAALDAHGELAKHAYEETGRGVFEDKATKNLFACEHVVNNMRHQKTVGIIEEDDVTGLTLIAEPVGVICGITPTTNPTSTAIFKSLISLKTRNPIIFAFHPSAQESSAHAARIVRDAAIAAGAPENCVQWVETPSLEATNALMNHDGIATILATGGNAMVKAAYSCGKPALGVGAGNVPAYVEKSANIRQAAHDIVMSKSFDNGMVCASEQAVIIDKEIYDNFVAEFKSYHTYFVNKKEKALLEEFCFGAKANSKNCAGAKLNPNIVGKPATWIAAQAGFTVPEGTNILAAECTEVSEKEPLTREKLSPVIAVLKSESREDGVEKARQMVEFNGLGHSAAIHTADAELAKEFGTRIRAIRVIWNSPSTFGGIGDVYNAFLPSLTLGCGSYGRNAVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTELMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVLTVPGFIAADTGMDVLTHATEAYVSQMANDFTDGLALQAIKIVFDNLEKSVKTADFEAREKMHNASTMAGMAFANAFLGISHSMAHKIGAQFHTVHGRTNAILLPYVIRYNGTRPAKTATWPKYNYYRADEKYQDIAKLLGLPASTPEEAVESYAKAVYDLGCRVGIQMNFKAQGIDENEWKEHSRELAYLAYEDQCSPANPRLPMVDHMQEIIEDAYYGYAERPGRRK

SEQ ID NO: 39537 - DNA, 1203 bp, Methanosarcina acetivorans C2A
  CDS (1)..(1203): transl_table=11
ttgttaaacgaagctgttgttaaacaaagctgttgccaaaaggagttgagaagcatgacatatacctatctgaacccgaaagtagctcttatgggggctggttgtgtaaaagaaatcggcaagcatgcaaaagagcttgggggtactaaagccctgatcgtttcaggaaggagcaggcatggagaagaacttgcaggagatatccggaaaatccttgaaaccgccgggctgaaaatagcaatctttccaggagcggatccgaacccgacagacagttcggttatggaaggggcaataatatacgaaaaagagaactgtgacctgatcgttgctgtcggaggtggaagcccgatggattgtgcaaaagccatcggcatcgtagctaaaaacggaggggagattaacgactacgaaggcatcggaaaggtcacgaagggtgtccctccgcttatcacggtaaatacaaccgccggcaccgcaagtgagatgacgagttttacaattattacggacacgaaaagacacatcaaaatggcaatcgttgatccccgcatcacacccgacgtagcagttaacgaccccgaactgatggtaagtatgccaccggcgcttacggctgcaaccggaatggatgctcttacccatgcagttgaagcttatgtttccactattgctactccgaccaccgatgcggcggctatcaaggcaatcgagctaatctcaaaatatctgcccgaagctgttgcccacgggggagatgtgaggacaagagacatgatggctcatgccgaatatcttgcaggcattgctttcaataacgctagccttggctatgtgcactccatggcccaccagctcggcggattatatgacctcccgcacggcatctgcaatgcaattctccttccctatgtggaaatgtacaacaaggaagtctgtcccgaacggtttgccgatattgcaaaggcaatgggagaaaaagttgagggtctgagcccggaagaagctgcagacaaagccatagctgccattaaaaagcttgcagctgacattggaattccctcgggtctgaaagagctcggagccagggaggaagacctcgaactgctggcggaaaatgccatgcaggacgtctgccaccttacaaatccaagagagctctcaaaagaagaggtgattgaaatttacaggaaagcaatgtga

SEQ ID NO: 39538 - protein, 400 aa, Methanosarcina acetivorans C2A
MLNEAVVKQSCCQKELRSMTYTYLNPKVALMGAGCVKEIGKHAKELGGTKALIVSGRSRHGEELAGDIRKILETAGLKIAIFPGADPNPTDSSVMEGAIIYEKENCDLIVAVGGGSPMDCAKAIGIVAKNGGEINDYEGIGKVTKGVPPLITVNTTAGTASEMTSFTIITDTKRHIKMAIVDPRITPDVAVNDPELMVSMPPALTAATGMDALTHAVEAYVSTIATPTTDAAAIKAIELISKYLPEAVAHGGDVRTRDMMAHAEYLAGIAFNNASLGYVHSMAHQLGGLYDLPHGICNAILLPYVEMYNKEVCPERFADIAKAMGEKVEGLSPEEAADKAIAAIKKLAADIGIPSGLKELGAREEDLELLAENAMQDVCHLTNPRELSKEEVIEIYRKAM

SEQ ID NO: 39539 - DNA, 1275 bp, Methanosarcina mazei Go1
  CDS (1)..(1275): transl_table=11
ttgcagagcaaaactttattacttgcagggaaaaaatcagttctattaatattttgtatttttataatagcaccgggaagatttgaacagaacttatcgaggggagtagaaggcatgatagaaaagatgacatacacttacctgaacccaaagatagccctgatgggacctggatgtgtaaacgggatcggcacgcatgcaaaagacctggggggtacgaaagccctgatagtttcaggcaagagcaggcatgggaaagagcttgcagcggatattcgcagaattcttgaacgtgcggggatagaagcagcaatctttccgggagcagacccgaaccctaccgatacttcagttatggaaggggcagacatttacaggaaagaaaactgtaacatgatagttgctgtcggaggcgggagccctatggactgtgcaaaggcaatcggcattgtggtatataatggaggaaggataaatgattacgaaggagtgggtaaagttaccagaggaattcctcctcttatcacggtaaacacgacagcgggcactgcgagcgagatgaccagttttacaattattactgatactgaaaggcacatcaaaatggctatcgtcgacccccggatcacacctgatgtggcggttaacgaccccgaactgatggtcagcatgccgccagcacttacggctgcaacagggatggatgctctgacccatgctgtggaagcttatgtttctaccatggctaccccgactaccgatgcggctgccataaaagcaatagagcttatatcaaaatacctgcccgaagccgtcctccacggggaagatatacgggccagggacatgatggcacacgcagaatatcttgcaggcattgctttcaacaatgcaagtcttgggtatgttcattccatggctcatcagctcggaggcttttatgacctcccgcatggggtctgcaatgccatcctcctgccttatgtggagatgtataacaagcaggtttgccctgaacgttttgcagacatcgcaaaggcaatgggagaaaaagttgagggattgagcccggacgaggcagcggataaagcaatagatgcaatcaaaaagcttgcagcagaaatcggaattccttcaggcctgaaagagctcggggcaagagaagaagaccttgaacttctggctgaaaatgccatgcaggacgtctgccgccttacaaatccaagagaactctcaaaagaagatatcatcgagatttacagaaaagccctgtga

SEQ ID NO: 39540 - protein, 424 aa, Methanosarcina mazei Go1
MQSKTLLLAGKKSVLLIFCIFIIAPGRFEQNLSRGVEGMIEKMTYTYLNPKIALMGPGCVNGIGTHAKDLGGTKALIVSGKSRHGKELAADIRRILERAGIEAAIFPGADPNPTDTSVMEGADIYRKENCNMIVAVGGGSPMDCAKAIGIVVYNGGRINDYEGVGKVTRGIPPLITVNTTAGTASEMTSFTIITDTERHIKMAIVDPRITPDVAVNDPELMVSMPPALTAATGMDALTHAVEAYVSTMATPTTDAAAIKAIELISKYLPEAVLHGEDIRARDMMAHAEYLAGIAFNNASLGYVHSMAHQLGGFYDLPHGVCNAILLPYVEMYNKQVCPERFADIAKAMGEKVEGLSPDEAADKAIDAIKKLAAEIGIPSGLKELGAREEDLELLAENAMQDVCRLTNPRELSKEDIIEIYRKAL

SEQ ID NO: 39541 - DNA, 1149 bp, Yersinia pestis KIM
  CDS (1)..(1149): transl_table=11
atgagtttcatgttggcactaccgaaaatcagcttgcacggcacgggtgcaatcggcgatatggttaaattactcagtgacaaacagtgggggaaagcactgattgttactgacgggcaactggttgaactcggcttattggacagtttattcgcggcgatggcgcagtatcagttaccttacgggctgtttggggaggtattccctaatccaacagaagagttggtccaggccggttttgccgcctttacccagcatcaatgtgactatttgattgccttcggtggcggcagccccattgataccgccaaagccatcaaaatactgactgccaatccggggccatccaccgcttattccggtgtaggtaaagtcaaacaaacgggtgttccgttgatagccatcaataccacggcaggaacggcagcggaattgaccagtaatgcggtgattattgatagccagcggcaagttaaggaggtgattatcgataccaatctcatccctgatattgcggttgacgatccctcagtaatgctcaatattcccgccagtgtcacggcggcgacggggatggatgcccttacccacgctgtcgaagcgtatgtctcgttaggtgcacatacgttaacggaccattcagcgctcgaatcaatccgtcttatcagccaatggttgccattagcggtcgctgacggcaaaaacctacaagcgcgcgaaatgatggcatgtgggcaatatttggcgggtatggcgtttaacagtgctgggctaggtttggttcacgcactggcccaccaaccgggtgccacacataatcttcctcatggcgtctgcaatgctatcttgctgccggtaattgaagaatataatcgcccgcaggctacccgccgttttgcccgaattgcacaggcaatgggggtagacactcaggacatgagtgatgagcaagcaagtcatcaggcgatagcggccattcgtcagttatcgctgcaagttggtattcctgccgggttctccgccttaggtattgaggaaagtgatattgaaggttggttagataaagcgctggctgacccttgtgctccttgtaacccacgttctgcagatcgggaacaaattcgcacactgtacttacaggcactttaa

SEQ ID NO: 39542 - protein, 382 aa, Yersinia pestis KIM
MSFMLALPKISLHGTGAIGDMVKLLSDKQWGKALIVTDGQLVELGLLDSLFAAMAQYQLPYGLFGEVFPNPTEELVQAGFAAFTQHQCDYLIAFGGGSPIDTAKAIKILTANPGPSTAYSGVGKVKQTGVPLIAINTTAGTAAELTSNAVIIDSQRQVKEVIIDTNLIPDIAVDDPSVMLNIPASVTAATGMDALTHAVEAYVSLGAHTLTDHSALESIRLISQWLPLAVADGKNLQAREMMACGQYLAGMAFNSAGLGLVHALAHQPGATHNLPHGVCNAILLPVIEEYNRPQATRRFARIAQAMGVDTQDMSDEQASHQAIAAIRQLSLQVGIPAGFSALGIEESDIEGWLDKALADPCAPCNPRSADREQIRTLYLQAL

SEQ ID NO: 39543 - DNA, 2676 bp, Yersinia pestis KIM
  CDS (1)..(2676): transl_table=11
atggctgtaacgaatgtcgctgaacttaacgagctagtagcacgcgtcaagaaagcccagcgcgagtatgccaacttttcgcaagagcaagttgataaaatcttccgtgctgcagcattagccgctgcggatgcccgtattccactagccaaactggctgtaacagagtctggcatgggtattgttgaagacaaagtgatcaaaaaccactttgcttctgaatatatttacaatgcttataaagatgaaaaaacctgtggtattttgtgtgaagataagaccttcgggacgatcactatcgcagaacctattggtctaatctgcggtatcgtaccaaccactaaccctacgtctaccgctatttttaaagcactgattagcttgaagacacgtaacggtattatcttctccccacatccacgcgctaaagacgcaaccaataaagctgcggatatcgtgcttcaagccgctatcgcagcaggtgcgccagcggatattattggttggattgatgctccaacagttgaattatctaatcaactgatgcatcacccagacattaatcttattctggcaaccggtgggccaggtatggttaaagcggcctatagctctggtaaaccagccatcggcgtaggtgcgggtaatacgccagtcgtcgttgacgaaactgcagatattaaacgtgttgtcgcatctattctgatgtctaaaacctttgataacggtgttatctgcgcgtcagagcagtccatcatcgttgttgactcggtttacgatgcggttcgcgagcgttttgcttctcatggtggctacctgttacaaggtaaagaattgaaagccgttcaggatattatcctgaaaaatggcggtctaaacgcagccatcgtgggccagccagcaactaagatcgctgagatggctggcattaaagtgccaagtaataccaagatacttatcggtgaagtcaaagttgtcgatgaatcagagccatttgctcatgaaaaactgtcgcctacactggcaatgtatcgtgctaaaaactttgaagaagcggttgaaaaagcagagaaactggtggagatgggcggtatcggtcatacctcttgtctgtacaccgaccaagataaccagactgcacgcgttaaatatttcggcgataaaatgaagaccgcccgaattctaatcaacacccctgcctctcaaggtggtatcggtgacttgtataacttcaagctggcaccgtctctgacgctgggttgtggttcttggggtggtaactccatctctgaaaacgtcggtccgaaacacttgatcaacaagaaaactgtggctaagcgagcagaaaacatgttgtggcataaactaccgaaatctatttacttccgtcgcggctctctgcctatagcgttggaagaagtggcaactgacggtgcaaaacgtgccttcatcgtgactgaccgctacttgttcaacaacggttatgcagaccaagtcaccagcgtactgaaatctcacggtattgaaactgaagttttcttcgaagtagaagctgcccctaccctgagtatcgtgcgtaaaggtgcagagcagatgaactccttcaagccagacgttattattgctctgggtggtggttcaccgatggatgctgcaaaaatcatgtgggtaatgtacgaacatcctgaaacgcatttcgaagaactggcattgcgttttatggatatccgtaaacgcatttataagttcccgaaaatgggtgtaaaagcgaaattggtcgctattacaaccacatcaggtaccggttcagaagtcaccccgtttgccgtggttactgatgacgcaacaggccagaaatatccattggcagactatgcattgacaccagatatggccattgttgatgccaaccttgttatgaatatgcctaagtctctgtgtgccttcggtggtctggatgcagtaacgcacgcactggaagcctatgtgtctgtactggctaatgaatactctgacggccaggcgctgcaagcactgaagctgttgaaagaattcttgccagccagctacaacgaaggggctaaaaacccagttgctcgcgaacgtgtacataatgcagcaacaattgccggtatcgcctttgctaacgccttcttgggtgtctgtcactctatggcccacaaactgggttctgagttccatatcccacacggcttggcaaatgctatgttgatttctaacgttattcgctacaacgcgaatgacaacccaacaaaacagactgccttcagccaatatgaccgcccacaagcgcgtcgtcgttatgcagaaattgcagatcatttggggctgagtgcaccgggcgaccgtactgcacaaaaaatccagaaactgctggcttggttagatgaaatcaaagctgaactgggtatcccggcatcgattcgcgaagcgggtgttcaggaagctgacttcttagctaaagtagacaaattgtctgaagatgcatttgatgaccagtgcacaggtgctaacccacgctacccactgatctcagagctgaaacagatccttatggatacttattacggtcgcgaatatgttgaagagtttgaccgcgaagaagaagtcgcggcagctactgcgcctaaagctgagaaaaagaccaaaaagtaa

SEQ ID NO: 39544 - protein, 891 aa, Yersinia pestis KIM
MAVTNVAELNELVARVKKAQREYANFSQEQVDKIFRAAALAAADARIPLAKLAVTESGMGIVEDKVIKNHFASEYIYNAYKDEKTCGILCEDKTFGTITIAEPIGLICGIVPTTNPTSTAIFKALISLKTRNGIIFSPHPRAKDATNKAADIVLQAAIAAGAPADIIGWIDAPTVELSNQLMHHPDINLILATGGPGMVKAAYSSGKPAIGVGAGNTPVVVDETADIKRVVASILMSKTFDNGVICASEQSIIVVDSVYDAVRERFASHGGYLLQGKELKAVQDIILKNGGLNAAIVGQPATKIAEMAGIKVPSNTKILIGEVKVVDESEPFAHEKLSPTLAMYRAKNFEEAVEKAEKLVEMGGIGHTSCLYTDQDNQTARVKYFGDKMKTARILINTPASQGGIGDLYNFKLAPSLTLGCGSWGGNSISENVGPKHLINKKTVAKRAENMLWHKLPKSIYFRRGSLPIALEEVATDGAKRAFIVTDRYLFNNGYADQVTSVLKSHGIETEVFFEVEAAPTLSIVRKGAEQMNSFKPDVIIALGGGSPMDAAKIMWVMYEHPETHFEELALRFMDIRKRIYKFPKMGVKAKLVAITTTSGTGSEVTPFAVVTDDATGQKYPLADYALTPDMAIVDANLVMNMPKSLCAFGGLDAVTHALEAYVSVLANEYSDGQALQALKLLKEFLPASYNEGAKNPVARERVHNAATIAGIAFANAFLGVCHSMAHKLGSEFHIPHGLANAMLISNVIRYNANDNPTKQTAFSQYDRPQARRRYAEIADHLGLSAPGDRTAQKIQKLLAWLDEIKAELGIPASIREAGVQEADFLAKVDKLSEDAFDDQCTGANPRYPLISELKQILMDTYYGREYVEEFDREEEVAAATAPKAEKKTKK

SEQ ID NO: 39545 - DNA, 2658 bp, Thermosynechococcus elongatus BP-1
  CDS (1)..(2658): transl_table=11
atgaatgccccaaccttgaccagtgacccccccgttcaaagccttgccgatctggaagggctgattgagcgcgtccaacgggcgcagagtcagtacgcccaatttacccaagagcaagtggatcacattttccacgaagcagccatggcggccaaccaagcccggattcccctggccaaacaagccgtagccgaaacgggcatgggggttgtcgaagataaagttattaaaaatcactttgcttcggaatacatctacaacaagtacaaaaatgagaaaacctgcggcgtcattgaggatgaccccatctttggtatccaaaaaattgctgaaccggtggggatcattgccggtgtggtgccggtcacgaaccccacttcaacgaccatctttaaggcactgattgccctgaagactcgcaatggcattatcttttcgccccacccccgggcaaaggcctgtacggttgcagcggccaaggtagtgttggatgcagcggtcgctgccggcgcaccccccgatattattggctggattgatgagccgacgattgaactctcccaagccctgatgcagcacccgcagatcaagctgattttggccacggggggaccaggtatggtcaaggcagcctattcctctggccatccggcgatcggggtcggggccgggaatacccccgtgctcattgatgccacagccgatattcccacggcagtgagttcgattctcctcagtaaggcctttgacaatggcatgatctgtgcctcggagcaggcagtgattgttgtggatgagatttatgacgcacttaaagctgagtttcaacggcgaggggcctaccttctctcccctgaggaacggcagcaggtggcacaactactgctgaaggatggtcgcctcaatgccgccattgttggtcaatcggccgccaccattgccgcaatggccaatatccaagtaccgccagaaacccgggtactcattggcgaggtgagtgaagtggggccgcaggagccattttcctatgagaaactctgtccggtattggcgttatatcgggcaccccagttccataaaggggtggagattgcggcccagttggtgaattttgggggcaaggggcatacatctgtgctctataccgatccccgcaatcaagatgatattgcctatttcaaataccgcatgcaaacggcgcgggttctgattaacaccccttcttcccagggggcaattggcgatctctacaacttcaagttagatccgtcgctaacccttggttgtggtacgtggggcggcaacgtcacatcggaaaatgttggtccccgtcacttgctgaatattaaaacggtgagcgatcgccgggaaaatatgctttggtttcgggtgccgcccaagatctacttcaaacccggctgtttgcccattgccctgcgggagctggcggggaaaaaacgcgccttcctcgtgacggataaacccctctttgacttggggatcactgaaccgattgtccataccctcgaagaactgggcatcaagtatgacatcttccatgaagtggaaccagatccaaccctcagtaccgttaaccgcggtctagggttgctgcggcaatatcagccggatgtgattgttgctgtggggggtggctcacctatggatgcagccaaggtgatgtggctgttgtatgagcatccggaggtggagtttgacggccttgcgatgcgcttcatggatattcgcaagcgggtgtatcaactgcctcccttgggtcaaaaggcaatcctggtggctattcccaccacctcggggacgggttcagaggtgaccccctttgccgtggttaccgacgatcgcgtggggattaaatatcccttggcagactatgcccttacgccaacgatggcgattgtggatcccgacttggtgctgcacatgcccaagaaactgacggcctacggtggcattgatgcgctgacccatgccctggaggcctatgtgtcggtgctctcgacggagtttacggagggactggctctagaggccattaaactgctctttacctacctaccccgtgcctatcgcttgggggcggcggatccggaggcacgggagaaggtccactatgcggcgacgatcgctggcatggcctttgcgaatgccttcttgggggtctgccactcgctggcccacaaactaggctccaccttccacgtgccccacggcttggcgaatgcactcatgatttcccatgtgattcgctacaatgccacggatgctcccctgaagcaggcgattttcccgcagtacaagtatccccaagcgaaggagcgctatgcccaaattgccgacttcctcgaattggggggcacgaccccagaggaaaaagtggagcgtctcattgcggcaattgaggatttgaaagcccaattagaaattcccgccacgattaaggaggccctcaacagtgaggatcaagcgttctatgagcaggtggagagcatggccgaactggcctttgacgatcagtgcacgggggccaatccccgctatccgctgatccaagacctcaaggagttgtatatcctggcctatatggggtgtcggcgggatgcggcagcctactatgggggggaggcaacggggagttga

SEQ ID NO: 39546 - protein, 885 aa, Thermosynechococcus elongatus BP-1
MNAPTLTSDPPVQSLADLEGLIERVQRAQSQYAQFTQEQVDHIFHEAAMAANQARIPLAKQAVAETGMGVVEDKVIKNHFASEYIYNKYKNEKTCGVIEDDPIFGIQKIAEPVGIIAGVVPVTNPTSTTIFKALIALKTRNGIIFSPHPRAKACTVAAAKVVLDAAVAAGAPPDIIGWIDEPTIELSQALMQHPQIKLILATGGPGMVKAAYSSGHPAIGVGAGNTPVLIDATADIPTAVSSILLSKAFDNGMICASEQAVIVVDEIYDALKAEFQRRGAYLLSPEERQQVAQLLLKDGRLNAAIVGQSAATIAAMANIQVPPETRVLIGEVSEVGPQEPFSYEKLCPVLALYRAPQFHKGVEIAAQLVNFGGKGHTSVLYTDPRNQDDIAYFKYRMQTARVLINTPSSQGAIGDLYNFKLDPSLTLGCGTWGGNVTSENVGPRHLLNIKTVSDRRENMLWFRVPPKIYFKPGCLPIALRELAGKKRAFLVTDKPLFDLGITEPIVHTLEELGIKYDIFHEVEPDPTLSTVNRGLGLLRQYQPDVIVAVGGGSPMDAAKVMWLLYEHPEVEFDGLAMRFMDIRKRVYQLPPLGQKAILVAIPTTSGTGSEVTPFAVVTDDRVGIKYPLADYALTPTMAIVDPDLVLHMPKKLTAYGGIDALTHALEAYVSVLSTEFTEGLALEAIKLLFTYLPRAYRLGAADPEAREKVHYAATIAGMAFANAFLGVCHSLAHKLGSTFHVPHGLANALMISHVIRYNATDAPLKQAIFPQYKYPQAKERYAQIADFLELGGTTPEEKVERLIAAIEDLKAQLEIPATIKEALNSEDQAFYEQVESMAELAFDDQCTGANPRYPLIQDLKELYILAYMGCRRDAAAYYGGEATGS

SEQ ID NO: 39547 - DNA, 2643 bp, Streptococcus agalactiae 2603V/R
  CDS (1)..(2643): transl_table=11
atgactgaaaaaactaaagcagtagaaactacagatgttgctcttgcaattgatacattggttcaaaatggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtatcacgccaacaaccaacccaacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcaattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacctatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgcagtattgaaagctgaatctacagaagatggtgttgaaaaagctcgtcaaatggttgagtttaatggtctagggcactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaagtaa

SEQ ID NO: 39548 - protein, 880 aa, Streptococcus agalactiae 2603V/R
MTEKTKAVETTDVALAIDTLVQNGLKALDEMRQLNQEQVDYIVAKASVAALDAHGELALHAVEETGRGVFEDKATKNLFACEHVVNNMRHTKTVGVIEEDDVTGLTLIAEPVGVVCGITPTTNPTSTAIFKSLISLKTRNPIIFAFHPSAQESSAHAARIVRDAAIAAGAPENCVQWIEQPSIDATNALMNHDGIATILATGGNAMVKAAYSCGKPALGVGAGNVPAYVEKSANIRQAAHDIVMSKSFDNGMVCASEQAVIIDKEIYKEFVEEFKSYHTYFVNKKEKALLEEFCFGAKANSKNCAGAKLNPNIVGKSAVWIAEQAGFTVPEGTNILAAECTEVSEKEPLTREKLSPVIAVLKAESTEDGVEKARQMVEFNGLGHSAAIHTKDADLAREFGTRIRAIRVIWNSPSTFGGIGDVYNAFLPSLTLGCGSYGRNSVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTDLMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVMTVPGFIAADTGMDVLTHATEAYVSQMANDYTDGLALQAIKIVFDYLERSVKDADFEAREKMHNASTMAGMAFANAFLGISHSMAHKIGAQFHTVHGRTNAILLPYVIRYNGTRPAKTATWPKYNYYRADEKYQDIAKLLGLPAATPEEAVESYAKAVYDLGTRLGIKMNFRDQGIDEKEWKEKSRELAFLAYEDQCSPANPRLPMVDHMQEIIEDAYYGYEERPGRRK

SEQ ID NO: 39549 - DNA, 1200 bp, Oceanobacillus iheyensis HTE831
  CDS (1)..(1200): transl_table=11
atgcaagagtacgcagtttttcgcacaccagaaacgataaattatgggcgaaattcatttaaaaaaatagggatagaagcagcagcatgtggtaataaggcggttattattagcgataaaataatggaaaatctggggtatgtaagtgaatgtagagatctacttcgcaaggaaggaattgaaagcgctatctatttaggtgtggaatccgagccaacagatcgatatgtggaggaagcattgcaattattaaagtctgaacaatgtgatgttgttatttccctgggtggaggaagttgtatcgatacagcaaaagcaattgcagtgattgcaacgaatggtggctatataggagattatatggggatgaagaaattagcagtactgccacctttaccacatatatccattccgacaacagctggtactggatcagaagctactgatgctacgattattaccaatacaagtaataacgtaaagatgatgattaaacaaccagcatttatgccaaatgttgctattgtggatccgatattatcgatatcttctccaaaaactgttacggctgcgactggaattgatgcattaagtcatgcaattgaggcatatatttctcagaaatctcaaccgatgacagaaatgttagcgctttcttcaatggagaaaattgtaaacagcttaaagagagcatatgagaatggagaggatattttagcaagagaagaaatgtctctaggttcattacaagcaggtatgtcttttacgaacgcatcagtttgtctcgtccatgggatgtccaggccgataggagccttgttccatgttccacatggtttttccaatgcgatgttacttcccgctgtgctggaatttagtaaagaacattgtgtggaacgacttgcggatttaggaagattttttcaacctgataatcagattgtatctgatagagaggcagcagatattgcagttgagtcggtaaaacagttgtgtctggaattaaatattccaaacttagaaggatggggaattaaaaaatcggagtttcagcaagccattagtaaaatggcagaagatgcaatagccagtggcagtccagggaataatccgagagtaccaaccaaacaagaaatagagaaactttatcaaacttgttataactatcaattttcatcacaaaagtcggtaagtaattaa

SEQ ID NO: 39550 - protein, 399 aa, Oceanobacillus iheyensis HTE831
MQEYAVFRTPETINYGRNSFKKIGIEAAACGNKAVIISDKIMENLGYVSECRDLLRKEGIESAIYLGVESEPTDRYVEEALQLLKSEQCDVVISLGGGSCIDTAKAIAVIATNGGYIGDYMGMKKLAVLPPLPHISIPTTAGTGSEATDATIITNTSNNVKMMIKQPAFMPNVAIVDPILSISSPKTVTAATGIDALSHAIEAYISQKSQPMTEMLALSSMEKIVNSLKRAYENGEDILAREEMSLGSLQAGMSFTNASVCLVHGMSRPIGALFHVPHGFSNAMLLPAVLEFSKEHCVERLADLGRFFQPDNQIVSDREAADIAVESVKQLCLELNIPNLEGWGIKKSEFQQAISKMAEDAIASGSPGNNPRVPTKQEIEKLYQTCYNYQFSSQKSVSN

SEQ ID NO: 39551 - DNA, 2730 bp, Bifidobacterium longum NCC2705
  CDS (1)..(2730): transl_table=11
gtggcagaagcaaagaagaaggtcgaagctaccaagccgactccagaagagaagcaggccgcagctgaggccgaagttgacgcgctggttgcccgcgccaagaaggctctcgtcgaattcgagaacctcgaccagaagcaagttgatcgtatcgtcgccaaggcctccatcgccgctctgaacaagcacctcgttctcgccaagatggctgtcgacgagaccggccgtggtctcgtggaagacaaggccaccaagaacatcttcgcctgcgagcacgtcaccaactacttggccggccagaagaccgtcggcatcatccgcgaagacgatgtgatgggcatcgatgaggtcgccgagcccgtcggcgtggtcgccggcgtcaccccggtcaccaacccgacctccaccgccatcttcaagtccctcatcgccctgaagacccgttgcccgatcgtcttcggcttccaccccggcgcgcagaagtgctccgtcgaggccgccaagattgtgcgcgacgccgccatcgaagccggtgctcccgagaactgtatccagtggatcgagcacccgtccatccaggccacaggcgccctgatgaagcatccgggcgtggccacgatcctcgccaccggtggtccgggcatggtcaaggccgcttactcctccggcaagcccgccctcggcgtgggtgccggcaacgccccggcctatgttgattccgatgtggacatcgtgcgcgccgccaacgatctggtgctctccaagcacttcgattacggcatgatctgcgccaccgagcaggccatcatcgcccacaaggacgtctacgaccagctcatcaaggagctcaaggtccgtaaggcctacttcgtcaacgccgaagagaaggccaagctggaacagtacatgttcggctgcactgccggttccggcgtcaagcccgtgctgaactccgcggtgccaggcaagtccccgcagttcatcgccaaggctgctggcttcgagattccgtccgacgccaccattctggccgccgagtgcaaggaagtctccgacgacgagcctctgacccacgagaagctcgctccggtgcaggccgtgctcaaggccgacaacaaggagcaggccttcgagatgtgcgagaagatgctcaagctgggtgccggccacaccgccgccatccacaccaacaaccaggagctcgtgcgtgagtacggcgtccgtatgcacgcctgccgcatcatctggaaccagccttcctcccttggcggcatcggcgacatctacaacgccatcgccccgtcgctgaccctgggctgcggctcctacggcggcaactcggtgtccggcaacgtgcaggccgtgaatctcgttaacatcaagcgcattgctcggaggaacaacaacatgcagtggttcaagatcccggccaagacctacttcgagccgaacgccatcaagtacctgcgcgacatgtacggcatcgagaaggccgtcatcgtgtgcgataaggtcatggagcagctcggcattgttgacaagatcatcgaccagctgcgcgcccgctctaaccgtgtgaccttccgcatcatcgactacgtcgagccggagccctccgtcgagaccgtcgaaaagggcgctgagatgatgcgcgaggagttcgagccggacacgatcatcgcggttggcggcggctccccgatggatgcctccaagattatgtggctgctctacgagcacccggaaatcgccttctccgacgtgcgcgagaagttcttcgatatccgtaagcgcgccttcaagatcccgccgctgggcaagaaggccaagctggtgtgcatcccgacctcctccggcaccggttccgaggtcaccccgttcgccgtgatcaccgatcacaagaccggctacaagtacccgatcaccgactacgcgctgaccccgtccgtggccatcgtggacccggtgctggctcgcacccagccgcgcaagctggcctccgacgccggcttcgacgccctgacccactcgatggaagcctacgtgtccgtgtacgcgaacgacttcaccgacggcatggccctgcacgcggccaagctcatctgggacaacctggctgagtccgtcaatggcgagcccggcctggtcaagaccaacgctcaggagaagatgcacaacgccgccaccatggccggcatggcattcggctccgcgttcctcggcatgtgccacggcatggcccacaccatcggtgccctgtgccacatcgcccacggccgtaccaactccatcctgctgccgtacgtgattcgttacaacggccagattcctgaggagcccacttcttggccgaagtacaacaagtacatcgccccggaacgctaccaggatatcgcccgcaacctcggcatcgacaccggcaagaccccggccgaagccgtggagaacctggcgaaggccgtcgaggactaccgtgacaacaagctcggcatgaacaagagcttccaggattgcggtgtggacgaggactacttctggtccgtgctcgatcagatcggcatgcgcgcctacgaggaccagtgcaccccggccaacccgcgcatcccgctgatcaacgacatgaaggacatcgccgtcggtgcttactacggtgtctcccaggcggaaggccacaagctgcgcatcgagcgcgagggtgaggccgccactgaggaagcctccgagcgttga

SEQ ID NO: 39552 - protein, 909 aa, Bifidobacterium longum NCC2705
MAEAKKKVEATKPTPEEKQAAAEAEVDALVARAKKALVEFENLDQKQVDRIVAKASIAALNKHLVLAKMAVDETGRGLVEDKATKNIFACEHVTNYLAGQKTVGIIREDDVMGIDEVAEPVGVVAGVTPVTNPTSTAIFKSLIALKTRCPIVFGFHPGAQKCSVEAAKIVRDAAIEAGAPENCIQWIEHPSIQATGALMKHPGVATILATGGPGMVKAAYSSGKPALGVGAGNAPAYVDSDVDIVRAANDLVLSKHFDYGMICATEQAIIAHKDVYDQLIKELKVRKAYFVNAEEKAKLEQYMFGCTAGSGVKPVLNSAVPGKSPQFIAKAAGFEIPSDATILAAECKEVSDDEPLTHEKLAPVQAVLKADNKEQAFEMCEKMLKLGAGHTAAIHTNNQELVREYGVRMHACRIIWNQPSSLGGIGDIYNAIAPSLTLGCGSYGGNSVSGNVQAVNLVNIKRIARRNNNMQWFKIPAKTYFEPNAIKYLRDMYGIEKAVIVCDKVMEQLGIVDKIIDQLRARSNRVTFRIIDYVEPEPSVETVEKGAEMMREEFEPDTIIAVGGGSPMDASKIMWLLYEHPEIAFSDVREKFFDIRKRAFKIPPLGKKAKLVCIPTSSGTGSEVTPFAVITDHKTGYKYPITDYALTPSVAIVDPVLARTQPRKLASDAGFDALTHSMEAYVSVYANDFTDGMALHAAKLIWDNLAESVNGEPGLVKTNAQEKMHNAATMAGMAFGSAFLGMCHGMAHTIGALCHIAHGRTNSILLPYVIRYNGQIPEEPTSWPKYNKYIAPERYQDIARNLGIDTGKTPAEAVENLAKAVEDYRDNKLGMNKSFQDCGVDEDYFWSVLDQIGMRAYEDQCTPANPRIPLINDMKDIAVGAYYGVSQAEGHKLRIEREGEAATEEASER

SEQ ID NO: 39553 - DNA, 1152 bp, Bifidobacterium longum NCC2705
  CDS (1)..(1152): transl_table=11
atggtgtaccgcatgattttcaaccagactgcatacttcggacgtggcgcgatcaaggagattccggccgtcgccaagcagcacggcttcaccaaggcatttatcgtcaccgacccggtgctgctggagaccggcaccgccgagaaggtcaccaaggttctggatgaggccggcctgccgtacgaggtgttctccaacgtcaagccgaacccgccggtcgagtgcatcaaggacggcgtcgccaagttcgccgagtccggtgcggacttcctgatcggcctgggcggtggctccccgcaagacacctgcaagggcatcggcatcatcaccgccaacccggagttcgccgacgtgctttctctggaaggcgtcgcggataccaagaacccgtccgtcccgatcttcggcgtgccgaccaccgccggcaccgcctcggagacgaccatcaactacgtggtcaccgacacggccaacaagcgcaagttcgtggctgtcgacccgcacgacatcccgatcgtcgctttcgtggacccggatctgaccgactcgatgccgcgcggcctgaaggtcgccaccggacttgacgccctgacccacgccatcgagggttacattaccccgggtgcctggagcctgtccgactgcctgtccatgcagaccatccgcatgattgccaagaacctggccaagtccgccgacggcgacattccggccggcgagcagatggcctacgcgtcctacatcaccggtatggcctactccaacgtgggcctcggtctggtgcacggcatggctcacccgctgggcggccgtctgggcgtggcccacggtgtggccaacggtattctgctggccccggtcatggaatacaacaaggacttcaccggtgagaagtaccgcgacatcgccgatgcgttcggtgttgaggacgcctacaccggcgacctggagaaggtgcgcgaagaggccgtgcaggccgtccacaagctgaccgtggatctgaagaacccgaccacgatttccgaagtgggcgccaccgaggccgaccttgagccgctggctcacgatgccttcaacgacgtgtgcacccccggcaacccgcgtcaggcaaccgaagaggacatcctcgcgatttacaagtcgctgatgtga

SEQ ID NO: 39554 - protein, 383 aa, Bifidobacterium longum NCC2705
MVYRMIFNQTAYFGRGAIKEIPAVAKQHGFTKAFIVTDPVLLETGTAEKVTKVLDEAGLPYEVFSNVKPNPPVECIKDGVAKFAESGADFLIGLGGGSPQDTCKGIGIITANPEFADVLSLEGVADTKNPSVPIFGVPTTAGTASETTINYVVTDTANKRKFVAVDPHDIPIVAFVDPDLTDSMPRGLKVATGLDALTHAIEGYITPGAWSLSDCLSMQTIRMIAKNLAKSADGDIPAGEQMAYASYITGMAYSNVGLGLVHGMAHPLGGRLGVAHGVANGILLAPVMEYNKDFTGEKYRDIADAFGVEDAYTGDLEKVREEAVQAVHKLTVDLKNPTTISEVGATEADLEPLAHDAFNDVCTPGNPRQATEEDILAIYKSLM

SEQ ID NO: 39555 - DNA, 1170 bp, Brucella suis 1330
  CDS (1)..(1170): transl_table=11
atgaccacattgaccgcgaaatggaactttccgaccactgtgcttttcgggccggggcacatcaaggagcttccagccgtcctgaaagccgcaggcatcgagcacccgcttttcgtcaccgatccgggcctcgccaaactgcctgtggtcgcctcgacattggccgttctggatgcggcgggcgtgcaatatggcgtgttttccgatgtgaaacccaatccggtcgagagcaatcttcatgccggcgtaaaggttttccgggaaggcaggcatgacggcgtcatcgcctttggcggcggttccgcgctcgatctcggcaagctcatcgcctttcaggccggacagacccggcccgtctgggattttgaagatatcggcgactggtggacccgcgccgacagcaacgccatagctcccgtcattgccgtgccgaccaccgcaggcaccggctcggaagtggggcgcgcgggcgttctcaccaatgaatccatccatacgaagaaggtcatcttccaccccaaaatgctgcccgtaacggtgatcgccgatcccgaactttccactggcatgccgcccttcatcacggtgggtacgggcatggatgcactggcgcactgccttgaagcctattgcgcaccgggcttccatcccatggccgatggcattgccgtggagggcatccgccttgtctttgagaacctgcccaaagcctatgccaatggcggggatatcgaagcgcgtgccaatatgatggcagccgctgccatgggcgccacggccttccagaagggcctcggtgcgatccattcgctctcgcaccccatcggcgcgctctatgacacacatcacggcatgaccaatgccgtcttcatgccctatgtgctgcaccacaaccgggctgccatcgaaaagcgcattgcccggctggccgattatctcggcatcgaaggcgggttcgacggctttgccgatgcgatcatgaagctgcgcgccgaacttggcgtgccgcgcaccctgcccgatctcatcaagaaccttcagatggacaatgcccgcaaggagctgatcgccgaaatggcagtggcagatcccaccgcaggcggaaacccggttgaacttacaaaaaacgacgcgctaaagttgctcaatgcagcattggaaggtagataa

SEQ ID NO: 39556 - protein, 389 aa, Brucella suis 1330
MTTLTAKWNFPTTVLFGPGHIKELPAVLKAAGIEHPLFVTDPGLAKLPVVASTLAVLDAAGVQYGVFSDVKPNPVESNLHAGVKVFREGRHDGVIAFGGGSALDLGKLIAFQAGQTRPVWDFEDIGDWWTRADSNAIAPVIAVPTTAGTGSEVGRAGVLTNESIHTKKVIFHPKMLPVTVIADPELSTGMPPFITVGTGMDALAHCLEAYCAPGFHPMADGIAVEGIRLVFENLPKAYANGGDIEARANMMAAAAMGATAFQKGLGAIHSLSHPIGALYDTHHGMTNAVFMPYVLHHNRAAIEKRIARLADYLGIEGGFDGFADAIMKLRAELGVPRTLPDLIKNLQMDNARKELIAEMAVADPTAGGNPVELTKNDALKLLNAALEGR

SEQ ID NO: 39557 - DNA, 2676 bp, Shigella flexneri 2a str. 301
  CDS (1)..(2676): transl_table=11
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagcctgaagacccgtaacgccattatcttctccccgcacccgcgtgcaaaagatgcaaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggtaacactccagttgttattgatgaaactgctgatatcaaacgtgcagttgcatctgtactgatgtccaaaaccttcgacaacggcgtaatctgtgcttctgaacagtctgttgttgttgttgactctgtttatgacgcagtacgtgaacgtttcgcaacccacggcggctatctgttgcagggtaaagagctgaaagctgttcaggatgttatcctgaaaaatggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacagctcgtatcctgattaacaccccggcttctcagggtggtatcggtgacctgtataacttcaaactcgcaccttccctgactctgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaagagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatacccgctggcggactatgcgctgaccccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcaactatcgcgggtatcgcatttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacctgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaagatgaaactgcagcgaaaaaagaagccgctccggctaaagctgagaaaaaagcgaaaaaatccgcttaa

SEQ ID NO: 39558 - protein, 891 aa, Shigella flexneri 2a str. 301
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEDETAAKKEAAPAKAEKKAKKSA

SEQ ID NO: 39559 - DNA, 1152 bp, Shigella flexneri 2a str. 301
  CDS (1)..(1152): transl_table=11
atggcatcttcaactttctttattccttctgtgaatgtcatcggcgctgattcattgactgatgcaatgaatatgatggcagattatggatttacccgtaccttaattgtcactgacaatatgttaacgaaattaggtatggcgggtgatgtgcaaaaagcactggaagaacgcaatatttttagcgttatttatgatggcacccaacctaaccccaccacggaaaacgtcgccgcaggtttgaaattacttaaagaaaataattgcgatagcgtgatctccttaggcggtggttctccacacgactgcgcaaaaggtattgcgctggtggcagccaatggcggcgatattcgcgattacgaaggcgttgaccgctctgcaaaaccgcagctgccgatgatcgccatcaataccacggcgggtacggcctctgaaatgacccgtttctgcatcatcactgacgaagcgcgtcataacaaaatggcgattgttgataagcacgtgactccgctgctttctgtcaatgactcctctctgatgattggtatgccgaagtcactgaccgccgcaacgggtatggatgccttaacgcacgctatcgaagcgtatgtttctattgccgccacgccgatcactgacgcttgtgcactgaaagccgtgaccatgattgccgaaaacctgccgttagccgttgaagatggcagtaatgcgaaagcgcgtgaagcaatggcttatgcccagttccttgccggtatggcgttcaataatgcttctctgggttatgttcatgcgatggcgcaccagctgggcggtttctacaacctgccacacggtgtatgtaacgccgttctgctgccgcatgttcaggtattcaacagcaaagtcgccgctgcacgtctgcgtgactgtgccgctgcaatgggcgtgaacgtgacaggtaaaaacgacgcggaaggtgctgaagcctgcattaacgccatccgtgaactggcgaagaaagtggatatcccggcaggcctacgcgacctgaacgtgaaagaagaagatttcgcggttctggcgactaatgccctgaaagatgcctgtggctttactaacccgatccaggcaactcacgaagaaattgtggtgatttatcgcgccgcaatgtaa

SEQ ID NO: 39560 - protein, 383 aa, Shigella flexneri 2a str. 301
MASSTFFIPSVNVIGADSLTDAMNMMADYGFTRTLIVTDNMLTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHNKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVDIPAGLRDLNVKEEDFAVLATNALKDACGFTNPIQATHEEIVVIYRAAM

SEQ ID NO: 39561 - DNA, 1149 bp, Shewanella oneidensis MR-1
  CDS (1)..(1149): transl_table=11
atggctgctaaattttttattccttccgtcaacgtactaggcaaaggcgctgtagatgatgctattggtgatatcaaaaccttaggctttaagcgcgcgcttatcgtaacggataaacctttagtcaatattggtctggtcggtgaagtggccgaaaaactcggccagaatggcattacatcaaccgtatttgatggcgtacaacctaacccaacggttggtaacgttgaagcaggtcttgcgctgttaaaagccaatcaatgtgatttcgtgatttcattaggtggtggctcgccccacgattgcgctaaaggtatcgccctggtggcaactaacggcggtagcattaaagactacgaaggcttagacaaatccactaagccacaactgccgttagtggcaatcaacacgaccgctggtactgccagtgagatgacacgtttctgtatcatcaccgacgaagctcgccatatcaaaatggcaattgtcgataaacacaccacgccaatactttcagtaaatgatccagagttgatgctgaaaaagcctgcaagtctcacagcagcaacgggcatggatgcgctcacccatgcggttgaagcctatgtgtctattgccgcgaatcccattactgatgcctgtgcaattaaggcgattgaactcattcaaggcaacttagtgaatgcggtaaaacaaggccaagatattgaagcccgtgagcaaatggcttatgcgcaattcttagcgggtatggcctttaacaacgccagcttaggttatgtgcacgccatggcgcaccaattaggcggtttctacgatctaccccatggtgtgtgtaacgccctattattaccccatgttcaagaatacaacgctaaagtggtgccacatcgcctaaaagatattgccaaagcgatgggtgtagatgtggcgaagatgaccgatgagcaaggtgcagctgcagctatcaccgccattaaaaccttatccgttgcggtgaatatccctgaaaatctgacattactcggcgtgaaagcagaagatattccaacgttggctgacaacgcattgaaggatgcctgtggtttcacaaaccctaaacaggcaacccatgcagagatctgtcagatctttactaacgcgttataa

SEQ ID NO: 39562 - protein, 382 aa, Shewanella oneidensis MR-1
MAAKFFIPSVNVLGKGAVDDAIGDIKTLGFKRALIVTDKPLVNIGLVGEVAEKLGQNGITSTVFDGVQPNPTVGNVEAGLALLKANQCDFVISLGGGSPHDCAKGIALVATNGGSIKDYEGLDKSTKPQLPLVAINTTAGTASEMTRFCIITDEARHIKMAIVDKHTTPILSVNDPELMLKKPASLTAATGMDALTHAVEAYVSIAANPITDACAIKAIELIQGNLVNAVKQGQDIEAREQMAYAQFLAGMAFNNASLGYVHAMAHQLGGFYDLPHGVCNALLLPHVQEYNAKVVPHRLKDIAKAMGVDVAKMTDEQGAAAAITAIKTLSVAVNIPENLTLLGVKAEDIPTLADNALKDACGFTNPKQATHAEICQIFTNAL

SEQ ID NO: 39563 - DNA, 2601 bp, Shewanella oneidensis MR-1
  CDS (1)..(2601): transl_table=11
atgacagtaacgaatgcccaaaaactggatctcatggtcgagcgcgtagccagagcgcaagccgaatatgccagttttagccaagcacaagttgatgcgattttccgtgccgccgctctcgccgcagcagatgcacggatttcactggcaaaaatggccgctgccgaaactagaatgggggtgattgaagacaaagtgattaaaaaccactttgcctccgagtatatttacaacaagtacaaggatgaaaagacctgtgggattttatccgaagatcctactttcggcacaatcactattgccgagcccgttggcattatctgcggtatcgtccccactactaatccaacgtccactgccatctttaaggcactcatcagccttaaaacccgcaatgcaattattttctcccctcacccaagggcaaaagtctcgaccaccactgcggccaaactggtgttagatgcggccattgccgcaggcgcacccaaagatattatcggttggattgatgagcctagtgttgcgctctcaaaccagctaatgacgcaccctaaagtgaatcttatcctcgccacaggcggcccaggtatggtgaaagcggcctattcttcaggtaaacccgccattggtgtcggcgcaggtaacaccccaattgtgattgatgaaaccgccgacattaaacgcgcagtgagctcgattctgatgtctaaaaccttcgataacggcgttgtgtgtgcctcggagcaagcggtaattgtggtcgacagcatctacgagcaagttaaagagcgctttgcgacccatggcggttatctcttaaatgcggcgcaaactgaagctatgcaacaggttatccttaaaaatggcggtttaaatgccgatatcgtcggccaaagtgctgcgaccatagcgcaaatggcgggaattgaagtcccccacaccactaaggtattgattggtgaagtcaccgatattagtgagacagaagcctttgcccacgaaaaactttcacctttactcggcatgtaccgcgccgctgattttaatgacgccgtcgataaggctgaaacactggtcgccttaggtggcataggccatacatctggcctgtataccgaccaagacacccaaaccgaacgggtcaaatcctttggttttagaatgaaaaccgcacgcattttgatcaataccccagcctctcagggtgggatcggcgatctgtacaactttaaactagccccctcgctcaccttaggttgcggctcttggggcggaaactcgatttctgaaaacgtcggtccaagtcatttgattaacaagaaaaccgtcgctaagagggctgaaaacatgctgtggcacaagcttccttcatctatctacttccgccgtggcagtttaccgattgcgctggaagaactgagtgataagaaacgcgcactgatagtgaccgacccatttctgttcaaccaaggttattgcgatgaaaccttaaaaatccttaaggcacagggtttagaaaccgaagtgttttacgaagttgaagctgaccccactctggccaccgtgcgccaaggcgctaaagtggccaatagctttaaacccgatgtgattattgccttaggtggtggctcacctatggatgcggccaagattatttgggtgatgtacgagcatcccgatgtcgactttgccgatttagccctgcgttttatggatatccgtaaacgtatctataaatttcctaaaatgggcgtaaaagctaccatggtcgcgattcctacgacatcgggtacaggttctgaggtcacccccttcgccgtagtgaccgatgaacaaaccggcaaaaaatatcccattgccgactatcaactcacccctaacatggccattgttgacccgaatctggtgatggatatgcctaaatccttaaccgctttcgggggcatcgatgcaatcacccacgcgctcgaagcctatgttagcgtgatggcgaacgagtacagcgatggtcaagccctgcaagcactcgatctgctgtgcaaatatctgccagatgcctatcagctcggcgctgcatcccccatcgcccgagagaaagtccacaatggcgcaaccatcgctggtatcgcctttgctaacgccttccttgggatctgccactctatggcccacaagctgggcgccgagttccacttagcccatggactggctaacgcgctgctgatcagtaacgtgatccgctttaatgcgaccgacttacccactaagcaagccgcattcagtcaatacgacagacctaaagccctgtgtcgttacgcggccattgccgatcatttagccttaggcggcaactcagatgcacaaaaagttgaaaaattgctggagaaaatcgagcagctcaagaagacgctgggcattcctgcgtcaatccaagaagccggtgttaatgaagccgacttcctcgccaagttagatatgcttgccgaggatgccttcgatgaccaatgtaccggtgcaaatcctcgctatccgttaattagcgagctaaaacagctactactagacagctactacggccgcccttttaccgaacaataa

SEQ ID NO: 39564 - protein, 866 aa, Shewanella oneidensis MR-1
MTVTNAQKLDLMVERVARAQAEYASFSQAQVDAIFRAAALAAADARISLAKMAAAETRMGVIEDKVIKNHFASEYIYNKYKDEKTCGILSEDPTFGTITIAEPVGIICGIVPTTNPTSTAIFKALISLKTRNAIIFSPHPRAKVSTTTAAKLVLDAAIAAGAPKDIIGWIDEPSVALSNQLMTHPKVNLILATGGPGMVKAAYSSGKPAIGVGAGNTPIVIDETADIKRAVSSILMSKTFDNGVVCASEQAVIVVDSIYEQVKERFATHGGYLLNAAQTEAMQQVILKNGGLNADIVGQSAATIAQMAGIEVPHTTKVLIGEVTDISETEAFAHEKLSPLLGMYRAADFNDAVDKAETLVALGGIGHTSGLYTDQDTQTERVKSFGFRMKTARILINTPASQGGIGDLYNFKLAPSLTLGCGSWGGNSISENVGPSHLINKKTVAKRAENMLWHKLPSSIYFRRGSLPIALEELSDKKRALIVTDPFLFNQGYCDETLKILKAQGLETEVFYEVEADPTLATVRQGAKVANSFKPDVIIALGGGSPMDAAKIIWVMYEHPDVDFADLALRFMDIRKRIYKFPKMGVKATMVAIPTTSGTGSEVTPFAVVTDEQTGKKYPIADYQLTPNMAIVDPNLVMDMPKSLTAFGGIDAITHALEAYVSVMANEYSDGQALQALDLLCKYLPDAYQLGAASPIAREKVHNGATIAGIAFANAFLGICHSMAHKLGAEFHLAHGLANALLISNVIRFNATDLPTKQAAFSQYDRPKALCRYAAIADHLALGGNSDAQKVEKLLEKIEQLKKTLGIPASIQEAGVNEADFLAKLDMLAEDAFDDQCTGANPRYPLISELKQLLLDSYYGRPFTEQ

SEQ ID NO: 39565 - DNA, 1152 bp, Shewanella oneidensis MR-1
  CDS (1)..(1152): transl_table=11
atgagtactacattttatatgcctccaatgtctctgatgggacaacatgctatcaaattgttaggcacagaactgcaggcaagaaacttcaacaaggcactgattgttacagataaggcattagtagatatcaagttggtggataagctgacagatgagttatctgcccacgatatcgcattcgcaatttttgatggcgttaagccgaacccaacagaaaaaaatattgttcagggtttagctctgctcgaagcgcaaaaatgtgatttcgttatttcattcggcggaggttcttcacatgactgtgctaaaggcatcgcattggtcgcagccaacggcggtcacattcgtgattactctaaaggggttcatctgtcggctaagccacaacttcctctggtgacggtgaatactacagctggcactgcagcggagatgacgatatttgccatcgtgaccaatgaggaagatgaaactaaatacccgattgtagataaaaacctgaccccaataattgcagtaaacgactcagagctgatggttgcaatgcctaagttcctcacggcagcgactggtatggatgcattgactcatgcggtagaagcttatgtgtcgacggcagcaacgccaataaccgatgcgtcagcaattaaagctattgaacttattgcccaaaacctgaaagcggcagtcgacaatggtgaagatcgtgaagctcgtgaggctatgcaatacggtgagtaccttgccggtatggcattctctaatgcttcattaggttatgtacactcgatggctcaccaactcggtggtgtctatgacctggtgcacggtctctgtaacgccatcttgttaccggtagtgtcacgttttaactcggctgaaaaagtggagcgttttgccgaggtggcgaaagcaatgggtgtagatactgtaggcatgacgttaatcgatgctgctgaatctggcatccttgctatcgagaagctatccgcttcggttggtacagatcagaaactgtctgaccttggtgttaaggaggacaagcttgagtttatggcaatcaacgccctgaatgatgcctgctccttaacaaatccaagaaaggcaaccactgaagatattattaatattttcaagaaagctatgtaa

SEQ ID NO: 39566 - protein, 383 aa, Shewanella oneidensis MR-1
MSTTFYMPPMSLMGQHAIKLLGTELQARNFNKALIVTDKALVDIKLVDKLTDELSAHDIAFAIFDGVKPNPTEKNIVQGLALLEAQKCDFVISFGGGSSHDCAKGIALVAANGGHIRDYSKGVHLSAKPQLPLVTVNTTAGTAAEMTIFAIVTNEEDETKYPIVDKNLTPIIAVNDSELMVAMPKFLTAATGMDALTHAVEAYVSTAATPITDASAIKAIELIAQNLKAAVDNGEDREAREAMQYGEYLAGMAFSNASLGYVHSMAHQLGGVYDLVHGLCNAILLPVVSRFNSAEKVERFAEVAKAMGVDTVGMTLIDAAESGILAIEKLSASVGTDQKLSDLGVKEDKLEFMAINALNDACSLTNPRKATTEDIINIFKKAM

SEQ ID NO: 39567 - DNA, 1164 bp, Pseudomonas putida KT2440
  CDS (1)..(1164): transl_table=11
atgcagcctttcagctttgccaccactgcgcagatcctctgcgaacccggcgcggtgcagcgccttgcaggtctgtgccgtgagcgcggtgccaagcgtgttttgattatcagtgacccgggtatcgcccgccttggcatgctcgatgacctgctgccggggttcacggcagccaaggtcggtgtggcgatcttcagtgaggttacggccgaccccagcgaggcatgcgtgctggcggccgcccagcgcgcccggcatatcggcgccgacctggtggtggggttcggcggcggcagctcgatggatgtggccaagctggttgcgctgctggcccaccgcgattgttcgcagcccatcgccgagctgtacggcatcgacagggccaagggccgccggctgccgttgatccaggtgcccaccacggcaggtaccggttcggaggtgacgccgatcgccatcgtcaccaccggcgccaccaccaagatgggcattgtttcgccgctgctgttgccagacctggcagtgctcgacgccgtctgcaccctcggcctgccatcggcggtgactgctgctaccggtatcgatgccatggtgcatgccatcgaagcctataccagccgcctcaaacgtaacccgctgtccagcctgctggcccgtgaggcgctgcggctgctggcggataaccttgaccaggctgtgcacaacggcggcaacctgcaggcccgccaggccatgctgttgggggcttgcctggccggccaggcctttgccaatgcaccggtggcggcggtgcatgccctggcctatccgctgggtgggcactttcatgttccccatggcctggccaacgcgctggtgttgccgcatgtgctgcgcttcaacctgccggtggcggcagtggactacgccgaattggccgtgccgctgttgggggcccgtttgcagcccggtgatcagcgccagcaggcagaacaattcgtggccgagctggccgcgctgagcagccgctgcgggttacctgaccgcctgcgcgacgccgatgtaccgcgtcatcggcttggccagctggccgaagacgcgatgcaacagcagcgccttttggtcaataacccgcgtgaagtcacccaggccgatgcgttggccatctatgaggcagcctactga

SEQ ID NO: 39568 - protein, 387 aa, Pseudomonas putida KT2440
MQPFSFATTAQILCEPGAVQRLAGLCRERGAKRVLIISDPGIARLGMLDDLLPGFTAAKVGVAIFSEVTADPSEACVLAAAQRARHIGADLVVGFGGGSSMDVAKLVALLAHRDCSQPIAELYGIDRAKGRRLPLIQVPTTAGTGSEVTPIAIVTTGATTKMGIVSPLLLPDLAVLDAVCTLGLPSAVTAATGIDAMVHAIEAYTSRLKRNPLSSLLAREALRLLADNLDQAVHNGGNLQARQAMLLGACLAGQAFANAPVAAVHALAYPLGGHFHVPHGLANALVLPHVLRFNLPVAAVDYAELAVPLLGARLQPGDQRQQAEQFVAELAALSSRCGLPDRLRDADVPRHRLGQLAEDAMQQQRLLVNNPREVTQADALAIYEAAY

SEQ ID NO: 39569 - DNA, 1143 bp, Pseudomonas putida KT2440
  CDS (1)..(1143): transl_table=11
atgtccctgatcaactacatcacccagatccaattcgatatcggtgccatcgcctgcctgcctgccgaatgtgagcgcattggtataaccaggcctttgatcgtgaccgaccgtggcgtgcgtgccgccggtatcgtcgatacggcgttgaacaccttcggcagcgacaccacacaactgccgatctacgacggtacgccacccaaccccaacgagcatgccgtgcgtgaggccgtggccatgttcaaggcaaatggctgtgatggcatcatcgccattggtggtggctcggcgatcgacctggccaagggggtggccgtgtgtgcccggcacgacggcccgttgaagagctttgcggtgatcgagggcggcctggcccggatcaccccggcaaccgcgccggtgattgcggtgccgaccacggccggcacggggagcgaggtcgggcgcggtgccatcctgatactcgatgacgggcgcaaggtgggggtgatctcgccccatgtggtgcccaaggccgccatctgtgacccgtcattgaccctcgggctgccggcacaactcacggctgccaccggcatggacgcgattgcccactgcctggaaaccttcatggcacctgcgttcaacccgcctgccgacggcattgccctggacggcctgtggagggcctggcgcttcatcgaacgagccacccgcgcgccgggcaacctggacgggcgcatcaacatgatgagcgcatcgctgcaaggtgcgctggccttccagaaaggcctgggctgcgtgcacagccttagccacgcgctgggcgggatcaacccgcgcctgcaccacggcaccctcaatgcgatcttcctgcctgccgtcatccgcttcaaccgcacggccgaaacggtggtgaatgaacacaagatgcaacgcatcgcccaggcgatggggctggccgatgacagccagatcgaagatgccattcgccacatgacccgtacgctgggcctgccgaccggccttggcgaactggatgtcaacccggacctgttcccgcgcatcgtccagggtgcgttggccgatcacagccaccgcaccaacccgcgtgaggcatctgccgaggactaccagtggctgcttgaagcgtcgatgtaa

SEQ ID NO: 39570 - protein, 380 aa, Pseudomonas putida KT2440
MSLINYITQIQFDIGAIACLPAECERIGITRPLIVTDRGVRAAGIVDTALNTFGSDTTQLPIYDGTPPNPNEHAVREAVAMFKANGCDGIIAIGGGSAIDLAKGVAVCARHDGPLKSFAVIEGGLARITPATAPVIAVPTTAGTGSEVGRGAILILDDGRKVGVISPHVVPKAAICDPSLTLGLPAQLTAATGMDAIAHCLETFMAPAFNPPADGIALDGLWRAWRFIERATRAPGNLDGRINMMSASLQGALAFQKGLGCVHSLSHALGGINPRLHHGTLNAIFLPAVIRFNRTAETVVNEHKMQRIAQAMGLADDSQIEDAIRHMTRTLGLPTGLGELDVNPDLFPRIVQGALADHSHRTNPREASAEDYQWLLEASM

SEQ ID NO: 39571 - DNA, 1164 bp, Pseudomonas putida KT2440
  CDS (1)..(1164): transl_table=11
atgagccagagtttcagcccccttcgcaagttcgtatcgcctgaaatcatctttggtgccggctgccggcacaatgtggccaattacgccaaaaccttcggtgcgcgcaaggtactggtggtcagcgaccctggcgtgatcgccgccggctgggtggcggatgtggaggccagcctgcaggcccagggtatcgactactgcctgtacacagcggtgtcacccaacccgcgggtcgaggaggtgatgctcggcgccgagatctatcggcagaaccactgtgacgtgatcgtcgccgtcggtggcggcagcccgatggattgcggcaaggccatcggtatcgtggtggcccatgggcgcagcatcctcgaattcgaaggcgtggacatgatccgcgtgcccagcccgccgctgatcctgatcccgaccaccgccggcacctcggcggacgtgtcgcagttcgtgatcatttccaaccagcaggaacgcatgaagttctccatcgtcagcaaggcggtggtgccggacgtgtcgctgatcgacccgcagaccaccctgagcatggacccgttcctgtcggcctgcaccggcatcgatgcgttggtgcatgccatcgaggccttcgtgtctaccggccacgggccgctgaccgacccccatgcgctggaagccatgcgcctgatcaatggcaacctggtggagatgatcgccaaccctactgatattgcgctgcgcgagaagatcatgctcggcagcatgcaggcggggctggcgttctccaatgcgatcctgggcgcagtgcacgccatgtcgcacagcctgggcggcttcctcgacttgccccatggcttgtgcaacgcggtgctggtggagcacgtggtggcgttcaactacagctcggcgccggagcgtttcaaggtgatcgccgaggtgtttggtatcgactgccgcggtctcaatcaccggcagatctgcgggcggctggtggagcacctgattgccctgaagcgtgccatcggcttccatgaaaccctgggcctgcacggggtgcgcacgtctgatatcccgttcctgtcgcaacacgcgatggacgacccgtgcatcctcaccaacccccgtgcgtccagccagcgtgatgtcgaggtggtctatggcgaggccctctga

SEQ ID NO: 39572 - protein, 387 aa, Pseudomonas putida KT2440
MSQSFSPLRKFVSPEIIFGAGCRHNVANYAKTFGARKVLVVSDPGVIAAGWVADVEASLQAQGIDYCLYTAVSPNPRVEEVMLGAEIYRQNHCDVIVAVGGGSPMDCGKAIGIVVAHGRSILEFEGVDMIRVPSPPLILIPTTAGTSADVSQFVIISNQQERMKFSIVSKAVVPDVSLIDPQTTLSMDPFLSACTGIDALVHAIEAFVSTGHGPLTDPHALEAMRLINGNLVEMIANPTDIALREKIMLGSMQAGLAFSNAILGAVHAMSHSLGGFLDLPHGLCNAVLVEHVVAFNYSSAPERFKVIAEVFGIDCRGLNHRQICGRLVEHLIALKRAIGFHETLGLHGVRTSDIPFLSQHAMDDPCILTNPRASSQRDVEVVYGEAL

SEQ ID NO: 39573 - DNA, 1185 bp, Pseudomonas putida KT2440
  CDS (1)..(1185): transl_table=11
atgacaacaattgagcaagaggtacgtatggaattcaagtttctactccccagcaaaatcgtgatggaaccgggcctgcgcgagcgcaccggtgaacacctgcggcaactcggcctggcccgcgtgttgatcgtgaccgatgccggggtcaaggcagcaggcctgctggacagcgtctacgccagcctcgacaaggccggtatcgcctacgaggaagtggcggacatcaaggccaacccgcgcagtgacgacatcaaccacaccgcccagcgctatcggggcacgggtatcgacggcctgctggccgtgggtggcggcagcgcgatggatgcggccaaggccatcagcctgctgctcacccacgacggccgtatcgaggactacgaagggtcgttcacgcttacccatgccatcccgcccatcgtcgccatcccgaccacggccggcaccggcagcgaagtgacctgcttctcggtgatcaccgacaccgcccgccacttcaaaatgaacgtgctggactatcgcatcggcccggtgctggcattgctcgactcccatatcaccgacacgctgccgccgtcgattgcagccgcaaccggcatggatgccctgacccatgccatcgaagcctacacctgccgcgtggcaaacccgatcagcgacggcctggcgctgcatgccatccgcctgatcagccagcacctcaaggcggccgtgcaggagcccgacaaccaggcggcccgggagcagatgctggtggccagcctgattgccggcatggccttcggcaacgccgacgtcggcagcgtgcactgcatttccgaagccatcggcggcatgtacgacacgccccacggtgtgggcaacgcgatcttcctgcccttcgtgttcggtcacaaccgtgatgccgatatcgtccgccatgcccaggtcgcctacgcgttggggatcgaccccacgctgtctccggtcgatgccgccgaggccgccgtcggccatctgttccagatgagcaaggacctgggcatcccccgcttcgccgaggtcaagggtgtgcgcgaggaagacttcccgaccattgccgagaagtccaagcagaacttctcggacgccagcaatgccaaggcgatgtccgtagaggcctaccacgacatcatcaccaccgcttaccacttcgtcgcgtaa

SEQ ID NO: 39574 - protein, 394 aa, Pseudomonas putida KT2440
MTTIEQEVRMEFKFLLPSKIVMEPGLRERTGEHLRQLGLARVLIVTDAGVKAAGLLDSVYASLDKAGIAYEEVADIKANPRSDDINHTAQRYRGTGIDGLLAVGGGSAMDAAKAISLLLTHDGRIEDYEGSFTLTHAIPPIVAIPTTAGTGSEVTCFSVITDTARHFKMNVLDYRIGPVLALLDSHITDTLPPSIAAATGMDALTHAIEAYTCRVANPISDGLALHAIRLISQHLKAAVQEPDNQAAREQMLVASLIAGMAFGNADVGSVHCISEAIGGMYDTPHGVGNAIFLPFVFGHNRDADIVRHAQVAYALGIDPTLSPVDAAEAAVGHLFQMSKDLGIPRFAEVKGVREEDFPTIAEKSKQNFSDASNAKAMSVEAYHDIITTAYHFVA

SEQ ID NO: 39575 - DNA, 2676 bp, Escherichia coli CFT073
  CDS (1)..(2676): transl_table=11
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcttataaagatgaaaaaacctgtggtgttctgtctgaagacgacacttttggtaccatcactatcgctgaacccatcggtattatttgcggtatcgttccgaccactaacccgacttcaactgctatcttcaaatcgctgatcagcctgaagacccgtaacgccattatcttctccccgcacccgcgtgcaaaagatgcaaccaacaaagcggctgatatcgttctacaggctgctatcgctgccggtgctccgaaagatctgatcggctggatcgatcaaccttctgttgagctgtctaacgcactgatgcaccacccagacatcaacctgatcctcgcgactggtggtccgggcatggttaaagccgcatacagctccggtaaaccagctatcggcgtaggcgcgggcaacactccggttgttatcgatgaaactgctgatatcaaacgtgcagttgcatctgtactgatgtccaaaaccttcgacaacggtgtaatctgtgcttctgaacagtctgttgttgttgttgactctgtttatgacgcagtacgtgaacgtttcgcaacccacggcggctatctgttgcagggtaaagagctgaaagctgttcaggacgttatcctgaaaaacggtgcgctgaacgcggctatcgttggtcagccagcctataaaattgctgaactggcaggcttctctgtaccagaaaacaccaagattctgatcggtgaagtgatcgttgttgatgaaagcgaaccgttcgcacatgaaaaactgtccccgactctggcaatgtaccgtgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggctcgtatcctgattaacaccccggcttctcagggtggtatcggtgacctgtataacttcaaactcgcaccttccctgactctgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtattgaaagcagcaggcgttgaaactgaagtcttcttcgaagtagaagctgacccgaccctgagcatcgttcgtaaaggtgcagaactggcaaactccttcaaaccagacgtgattatcgcgctgggtggaggttccccgatggacgctgcgaagatcatgtgggttatgtacgaacatccggaaactcacttcgaagaactggcgctgcgctttatggatatccgtaaacgtatctacaagttcccgaaaatgggtgtgaaagcgaaaatgatcgctgtcaccaccacttctggtacaggttctgaagtcactccgtttgcggttgtaactgacgacactactggtcagaaatatccgctggcagactatgcactgaccccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaacgcgaatgacaacccgaccaagcagactgcattcagccagtatgaccgtccgcaggctcgccgtcgttatgctgaaattgctgaccacctgggtctgagcgcaccgggcgaccgtactgcagctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggcgaaactgcagcgaagaaagaagctgctccggctaaagctgagaaaaaagcgaaaaaatccgcttaa

SEQ ID NO: 39576 - protein, 891 aa, Escherichia coli CFT073
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVIVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDTTGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 39577 - DNA, 1215 bp, Escherichia coli CFT073
  CDS (1)..(1215): transl_table=11
gtgggcgagagaaagcggaggggatctatgcaaagtgaattgcaaacggcgctttttcaggcgttcgataccctgaatctgcaacgggtaaaaacatttagcgttccaccggtgacgctttgcggtccgggcgcggtgagcagttgtgggcagcaagcgcaaacgcgtgggttgaaacatctgttcgtgatggcagacagctttttgcatcaggcagggatgaccgccgggctgacacgtagcctggccgttaaaggtatcgccatgacgctctggccatgtccggtgggcgaaccgtgcatcaccgacgtgtgtgcagccgtggcgcagttgcgtgaatcaggttgtgacggggtgatcgcgtttggcggcggctcggtgctggatgcggcgaaagccgttgcgttgctggtgacgaaccccgatagcacgctggcagaaatgtcagaaaccagcgtcctgcaaccgcgcctgccgttgattgccattccaacgaccgccggaaccggctctgaaacgactaacgtgacggtgattatcgatgcggtaagcgggcgcaaacaggtgttagcccatgcctcgctgatgccggatgtcgcgattctcgacgctgcgctgaccgaaggcgtgccgtcgcatgtcacggcgatgactggcattgatgcgttaacccatgccattgaagcgtacagcgcgctgaacgctacaccgtttaccgacagcctggcgattggtgccattgcgatgattggcaaatcactgccgaaagcggtgggctacggccatgaccttgccgcgcgcgagagcatgttgctggcttcatgtatggcgggaatggcgttttccagcgccgggcttgggttatgccacgcgatggcgcatcagccaggggcggcgctgcatattccgcacggtctggcgaacgccatgttgttgccaacggtgatggaatttaaccggatggtttgtcgtgatcggtttagtcagattggtcgggcgctgcgaactaaaaaatccgacgatcgtgacgctattaacgcggtaagtgagctgattgctgaagttgggattggtaaacgactgggcgatgttggtgcgacatctgcgcattacggcgcatgggcgcaggccgcgctggaagatatttgtctgcgcagtaacccgcgtaccgccagcctggagcagattgtcggcctgtacgcagcggcgcaataa

SEQ ID NO: 39578 - protein, 404 aa, Escherichia coli CFT073
MGERKRRGSMQSELQTALFQAFDTLNLQRVKTFSVPPVTLCGPGAVSSCGQQAQTRGLKHLFVMADSFLHQAGMTAGLTRSLAVKGIAMTLWPCPVGEPCITDVCAAVAQLRESGCDGVIAFGGGSVLDAAKAVALLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRDRFSQIGRALRTKKSDDRDAINAVSELIAEVGIGKRLGDVGATSAHYGAWAQAALEDICLRSNPRTASLEQIVGLYAAAQ

SEQ ID NO: 39579 - DNA, 1152 bp, Escherichia coli CFT073
  CDS (1)..(1152): transl_table=11
atggcagcttcaaccttttttattccttccgtgaatgttattggtgctgattcattgaatgatgcaatgaatatgatggcagattatggatttacccgtaccttaattgtcaccgacaacatattaacgaaattgggtatggcgggtgatgtgcaaaaagcactggaagaacgcaatatttttagcgttatttatgatggcacccaacctaaccccaccacggaaaacgtcgccgcaggtttgaaattacttaaagaaaataattgcgatagcgtgatttccttaggcggtggttctccacacgactgcgcaaaaggtattgcgctggttgcagccaacggcggtgacatccgcgattatgaaggcgttgaccgctctgcaaaaccgcagctgccgatgatcgccatcaacaccacggcgggtacggcctctgaaatgacccgtttctgcatcatcactgacgaagcgcgtcacatcaaaatggcgattgtggataaacatgtaactccgctgctttctgtcaatgactcctctctgatgatcggtatgccgaagtcactgaccgctgcaacgggtatggatgccttaacgcacgctatcgaagcgtatgtttctattgccgccacgccgatcactgacgcttgtgcactgaaagccgtgaccatgattgccgaaaacctgccgttagccgttgaagatggcagcaatgctaaagcgcgtgaagcaatggcttatgcccagttcctcgccggtatggcgttcaataatgcttctctgggttatgttcatgcgatggcgcaccagctgggcggtttctacaacctgccacatggtgtatgtaatgccgttctgctgccacacgttcaggtgttcaacagcaaagtcgctgctgcgcgtctgcgtgactgtgctgctgccatgggcgttaacgtgacaggcaaaaatgacgcggaaggcgcagaagcgtgcatcaatgccatccgtgaactggcgaagaaagtgaatatcccggcaggcctgcgtgacctgaacgtgaaagaagaagatattccagtgctggcaaccaatgccctgaaagatgcgtgtgggtttactaacccgattcaggcaactcacgaagaaattatggcgatttatcgcgcagcgatgtaa

SEQ ID NO: 39580 - protein, 383 aa, Escherichia coli CFT073
MAASTFFIPSVNVIGADSLNDAMNMMADYGFTRTLIVTDNILTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHIKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVNIPAGLRDLNVKEEDIPVLATNALKDACGFTNPIQATHEEIMAIYRAAM

SEQ ID NO: 39581 - DNA, 1119 bp, Escherichia coli CFT073
  CDS (1)..(1119): transl_table=11
atggcccgctattatttttcgtgccccaaaatttattttggtgaagaggcaataacctctctatgccaatttaataataaacgagtcggtattgtcaccgatgattttatgatgtcatcaggtaaaactcgttatttaataagccatatgcctgaggcatcggtatgcattttcggcgaggttactccggatccagatattgatattctgacttccggcgcggcgcgttttaaagcctttaagcccgacgttattatcgccctcggcggcggctcgtcgctggacgctgcgaaaggaattaaagtcacattggaagagtattttggagatcatcaaatcgatctcattgctattcccacaaccagcggatccggctctgaagtgacgtcctacgcgatcatctctgatccgcaaaatggccgcaaatatccgttgatctccgggcaactggtgccggaaatcgccattctcgatcctaacctagtgttaaccgcgccgcgtcatgtcgcggtagataccggcatggacgtgctgacccatgccattgaagcctttgtctctactggctcaaatgactttagcgatgcgctggcggaaaaagccatcgcgttgacctggcgctatctgccgcaggtgtttaacgacgaaaaagacattgcggcgcgcacccacatgcacaatgcctcctgtatggcaggcatggcatttaactccgccgggctggggttggttcacggcatggcacacgccatcggcgggatgctgcatattcctcatggcaaaattaacgccatgctgctgccgattgtcatcgacttcaacagcaaacgggccagcactgaaacccgcgatcgctatcaccgttgcgcgcaaatcataggcattgaccatgcggtaccggagcaggccatcgcgctgatgactcaggagatccgccagatcaatcgccatttctgcatccccgtcactctcagcgaactgggcatcgaccgtgcaaaaatcatcgagttgcgcagcgcactggtgaattcgacgctggccgacggttgtaccgcgtcgaacccgcggcaggtgacgacgcatgatgtcgaagggttgatcgacctgattaccggctag

SEQ ID NO: 39582 - protein, 372 aa, Escherichia coli CFT073
MARYYFSCPKIYFGEEAITSLCQFNNKRVGIVTDDFMMSSGKTRYLISHMPEASVCIFGEVTPDPDIDILTSGAARFKAFKPDVIIALGGGSSLDAAKGIKVTLEEYFGDHQIDLIAIPTTSGSGSEVTSYAIISDPQNGRKYPLISGQLVPEIAILDPNLVLTAPRHVAVDTGMDVLTHAIEAFVSTGSNDFSDALAEKAIALTWRYLPQVFNDEKDIAARTHMHNASCMAGMAFNSAGLGLVHGMAHAIGGMLHIPHGKINAMLLPIVIDFNSKRASTETRDRYHRCAQIIGIDHAVPEQAIALMTQEIRQINRHFCIPVTLSELGIDRAKIIELRSALVNSTLADGCTASNPRQVTTHDVEGLIDLITG

SEQ ID NO: 39583 - DNA, 2661 bp, Vibrio vulnificus CMCP6
  CDS (1)..(2661): transl_table=11
atggctgaactagatgcgatgattgcacgcgttaagaaagcgcaagaagagttcgctacttactctcaagagcaagtagatgcaatcttccgtgcagcttctctagccgctaaccaagctcgtatcccgctagcacaaatggcggttgaagaatctggtatgggtattgttgaagataaagtaatcaagaaccactttgcatctgagtttatctacaacaaatacaaggacgaaaaaacgtgtggcatcctagaagaggatgacaacctaggtacgatgactatcgctgaaccagtaggtatcatctgcggtatcgttccaaccactaacccaacttcgactgcaatcttcaaatcactgatctctttgaagactcgtaacggtatcatcttctcgccacacccacgtgcgaaaaactcgactaacgacgcagcgaaactggttctagaagcagcggtagcagctggcgcaccaaaagacatcatcggttggatcgaccagccatctgtagagctttctaacgcgcttatgaagcacgatgacatcgcacttatccttgcaactggtggtccaggcatggttaaagctgcttactcttctggtaagccagcaatcggtgtaggtgcaggtaacgttcctgttgttatcgatgaaactgcggacatcaaacgtgcagttgcatctatcctaatgtctaagacgttcgataacggcgtagtatgtgcttctgagcaagctgcaatcgttgttgacgcagtatacgacgaagtgaaagagcgttttgcttctcacaaagcatacgtacttagcaaagctgaagcagaaaaagtacgtaaagtactgctaatcgatggcgcactaaatgcgaaaatcgttggccagccagctgcagcaatcgctgaaatggcaggtgttaaagttcctgctgatactaaagttctcgttggtgaaggcctaggcaaagtgtcttacgatgacgcatttgctcacgagaagctatctccaactctaggtctattccgtgctgatgacttcgaagacgcagttgcacaagcagtaaccatggttgaaatcggcggtatcggtcacacatctggtctatacactaaccaagacgtaaacgcagaccgtatccgttacttcggtgacaaactgaagactgcacgtatccttgtaaacatcccaactactcacggtggtatcggtgacctttacaactttaacgttgcaccatctctaactcttggttgtggttcatggggtggtaactctatctctgagaacgtaggtcctaagcacctaatcaacaagaaaactgttgcgaagcgagctgaaaacatgttgtggcacaaactacctaagtcaatctacttccgtcgtggtagccttccaatcgcactaagcgacctagaaggtaagaaacgcgcattcctagtaactgaccgtttcctattcaacaacggttacgcagatgacgtagtacaacttcttaaagctcaaggcatggaagttcaaacattctttgatgttgaagctgacccaacgctatctgttgtagagaaaggcgcagcggcaatgcaaagcttccagccagatgtgattctagcgctaggcggtggttcaccaatggatgctgcgaagatcatgtgggtaatgtacgagcacccagaaactcacttcgaagaacttgcaatgcgctttatggatatccgtaaacgtatctacaagttccctaaaatgggtaagaaagctgaacttgtatgtatcactaccacttcaggtacaggttcagaagttacaccattcgcggttgtgactgacgacaagactggtgctaagtacccactagcggattacgaattgactcctcaaatggcaatcgtagatgcgaacctagtgatgaacatgcctaagtctctaaccgcattcggtggttacgatgcagtgactcacgctctagaagcttacgtatctgttcttgcgaacgaatactcagatggtcaggctctacaagcacttaagatgctaaaagagtacctaccttcaagctacgcgaacggtgcaaaagacccaatcgctcgtgagaaagtacacaacgcagcgaccatcgctggtatcgcattcgcgaacgcgttcttaggtgtatgtcactctatggcgcacaagatcggtgcagagttccacctaccacacggtttggcgaacgctctacttatctctaacgtggtacgttacaacgcgaacgataacccaactaagcaaactgcgttctctcaatacgaccgtccacaagcacgtcgtcgttacgctgaagttgctgaccacctaggcctaagccaagctggtgaccgcactgctcagaagattgaacgtctactagcatggttggatgagctaaaaggtaacctagacatcccaatgtctatccaagcggcaggtgttgctgaagctgacttcctagcgaaagttgatgaactagcagtagaagcgttcgatgaccagtgtactggtgcgaacccacgctacccactaatcgctgagctaaaagaagttctactggcttcttactacggtaaagctttcgttgaaggtgaaactttcgaaggtacgactgtaatcaagaagaaagcagaccaagtagcgccaaaagcgaaaaaataa

SEQ ID NO: 39584 - protein, 886 aa, Vibrio vulnificus CMCP6
MAELDAMIARVKKAQEEFATYSQEQVDAIFRAASLAANQARIPLAQMAVEESGMGIVEDKVIKNHFASEFIYNKYKDEKTCGILEEDDNLGTMTIAEPVGIICGIVPTTNPTSTAIFKSLISLKTRNGIIFSPHPRAKNSTNDAAKLVLEAAVAAGAPKDIIGWIDQPSVELSNALMKHDDIALILATGGPGMVKAAYSSGKPAIGVGAGNVPVVIDETADIKRAVASILMSKTFDNGVVCASEQAAIVVDAVYDEVKERFASHKAYVLSKAEAEKVRKVLLIDGALNAKIVGQPAAAIAEMAGVKVPADTKVLVGEGLGKVSYDDAFAHEKLSPTLGLFRADDFEDAVAQAVTMVEIGGIGHTSGLYTNQDVNADRIRYFGDKLKTARILVNIPTTHGGIGDLYNFNVAPSLTLGCGSWGGNSISENVGPKHLINKKTVAKRAENMLWHKLPKSIYFRRGSLPIALSDLEGKKRAFLVTDRFLFNNGYADDVVQLLKAQGMEVQTFFDVEADPTLSVVEKGAAAMQSFQPDVILALGGGSPMDAAKIMWVMYEHPETHFEELAMRFMDIRKRIYKFPKMGKKAELVCITTTSGTGSEVTPFAVVTDDKTGAKYPLADYELTPQMAIVDANLVMNMPKSLTAFGGYDAVTHALEAYVSVLANEYSDGQALQALKMLKEYLPSSYANGAKDPIAREKVHNAATIAGIAFANAFLGVCHSMAHKIGAEFHLPHGLANALLISNVVRYNANDNPTKQTAFSQYDRPQARRRYAEVADHLGLSQAGDRTAQKIERLLAWLDELKGNLDIPMSIQAAGVAEADFLAKVDELAVEAFDDQCTGANPRYPLIAELKEVLLASYYGKAFVEGETFEGTTVIKKKADQVAPKAKK

SEQ ID NO: 39585 - DNA, 1113 bp, Vibrio vulnificus CMCP6
  CDS (1)..(1113): transl_table=11
atgggcgcaggctgtcttaaagacgcagcagacagcattaaagctcaaggctttaccaaagggcttattgttaccgacaaaattcttaatcaaatcggcgttgtaaaacaagttcaagacctactaagcgagcgtcatgtagaaacggttgtcttcgatggtactcagcccaacccaaccatcggcaacgtcaatgcaggtttggcactactgaagcaaaatgagtgtgattttgtgatttcactcggtggtggttctccgcacgactgtgcaaaaggcattgcgcttgtcgcagcaaacggcggcgagattgcggattacgaaggcgtggacaaatcagcgaaaccaatgctaccgctgatcgcaattaacaccaccgcaggcaccgcatctgaaatgacccgtttctgcatcattaccgatgaagaacgtcatattaaaatggcgatcgtcgataaacacaccacgccactaatctctgtgaacgatccggaactgatgctggcaaaacctgcatcactaactgcggcaacaggaatggacgccttgactcacgcggtagaagcgtacgtttctattgctgcgacgccgattaccgatgcagttgcaatcaaagcgattgagcttatccaagcccatcttcgtactgccgtcgcacacggcgatgatattgaagcgcgtgagcaaatggcgtacgcacagtttatggcaggtatggcgttcaacaatgcctcactaggttacgtacacgcaatggcgcaccaattgggtggcttctacgatctaccacacggtgtttgtaacgcgatcttgttaccacacgtacaacgctacaatgcgcaggtttgtccagagcgtctacgtgatgtggcaaaagcaatgggtgtcaatgtcgaaggcatgagtgcagagcaaggcgcagaagccgccattgatgcgattgtggcactggcgaaagacgtgggtattccagcaggtattcgcgagcttggtgcaaaatctgaagatatcccaaccttggctgacaatgcactcaaagacgcttgtggtttcactaacccgaaacaagccacgcacgaagaaatctctgcgattttcgaagcggcaatgtaa

SEQ ID NO: 39586 - protein, 370 aa, Vibrio vulnificus CMCP6
MGAGCLKDAADSIKAQGFTKGLIVTDKILNQIGVVKQVQDLLSERHVETVVFDGTQPNPTIGNVNAGLALLKQNECDFVISLGGGSPHDCAKGIALVAANGGEIADYEGVDKSAKPMLPLIAINTTAGTASEMTRFCIITDEERHIKMAIVDKHTTPLISVNDPELMLAKPASLTAATGMDALTHAVEAYVSIAATPITDAVAIKAIELIQAHLRTAVAHGDDIEAREQMAYAQFMAGMAFNNASLGYVHAMAHQLGGFYDLPHGVCNAILLPHVQRYNAQVCPERLRDVAKAMGVNVEGMSAEQGAEAAIDAIVALAKDVGIPAGIRELGAKSEDIPTLADNALKDACGFTNPKQATHEEISAIFEAAM

SEQ ID NO: 39587 - DNA, 2610 bp, Staphylococcus epidermidis ATCC 12228
  CDS (1)..(2610): transl_table=11
atgttatctgtaactaaaaaaaatacatatgaatcaaacaaagatgaagtcacacaaatgattgattcattagcagaaaaaggacaagaagctctaaaagaactatctaaaaaatcacaacaagagattaatgacattgtacatcagatgagcatggctgctgttgatcagcatatgcatttagctaaactagcttacgacgaaacaggtagaggtatttatgaagacaaagctatcaaaaatttatatgcctcagagtacatatggaattcaatcaaagacaataaaacagtaggtatcataggtgaagataaacaaaaaggattaacgtatgtagctgaacctataggcgttatttgtggagtgacaccaacgaccaaccctacatctacaactattttcaaagcaatgattgctattaaaacaggtaatccaattattttcgcatttcatccaagtgcacaacaatcatcaaaatatgctgctaaagtcattttagaagctgcaacaaaagcaggtgctcctaaagattgtattcaatggatagaagtgccatcaattgtggcaactaaacaattaatgaatcataaagatattgctttagttctagcgactggaggctctggaatggtaaagtccgcatattcgacaggtaaacctgcattaggagtcggtccaggtaatgttcctacttatattgaaaaaactgctcatatcaaacgtgctgttaatgatatcattggttctaaaacttttgataatggtatgatttgtgcttctgaacaagtcatggttgttgataaagaagtatacactgacgtcgttaaagaattcaaattacaccaaacatattttgttaataaaaatgaactacaacaattagaagatgccatcatgaatgaagataaaactgcagttaaacctgatatagttggtaaatctgctgtagatatagcgaaattgtcaggaattagtgttccagaaaaaacaaaattattagtcgcagaaattgatggaattggaaaagattatcctttatcacgtgaaaaattatcacctgtactcgcaatggtaactgcaaaatcaacaggacatgcactacaaatttgtgaagacacattaaaatttggtggtttaggtcacactgctgtaattcacaccgaggatagtcaattacaacaaaaattcggtctaaaaatgaaagcttgccgtgtattggtaaatacaccttctgctgtcggaggaattggaaatatgtataatgaactcattccttcactcacgttaggttgtggttcacatggtagaaattctatttctcataatgtaagcgcagtagacttattaaatattaaaacaatagcaaaacgtcgtaataatatgcaatggtttaaactcccacctaaagtttattttgaagaaaattcagttatgtatttgacagagatggataatgttgaacgtgtaatgatagtttgtgatccaggaatggttaatattggttatactgatatagttgaacaagtgctgagacgccgagaaaaccaaccacaaatcaaagtgtttaacgaagttgaacctaatccatcaactcatacagtctataaggggttagaaatgtttataaatttccaacctgatactattattgcactcggtggcggttcggcaatggatgcagccaaagcaatatggatgttctttgagcatccagaaacttcattttttggggcaaaacaaaagttcttagatattcgtaaacgtacttataaaattaccaaacctaaaaacgcaaaatttatatgtataccaacgacatcaggaactggttctgaagtgacaccttttgcagtaattactgatagcgagacacacgttaagtatccactagcagattatgcgttaactcccgatattgctatcgtcgatccacaattcgtattaagtgtacctaaagatgttaccgcagatacaggaatggatgttttgacacatgccattgaatcttacgtctctgtcatggcttcagattatacaagaggcttaagcttacaagcaataaagttaacttttgattatctaaaatcatcagttcaagaaaatgacaaacactcacgagaaaaaatgcataatgcttcaacaatggccggtatggcatttgccaatgcttttttaggaatttctcattctatcgcacataaaattggtggtgaatatggtattccccacggcagaacaaatgctattttattaccacatgtcattcgctataatgccaaagatccacaaaaacatgcactgtttcctaaatatgatttctttagagcagatactgactatgctgacattgcaaaatttttaggactcaaaggtaatacaactgatgaattagtggatgctctagctaatgcggtgtatgatttaggatgttcagttggtattgatatgaatttaaaatcacaaggcgtaactgaagagcttcttcactctactatagacagaatggctgaattagcatttgaagatcaatgtacaactgctaatccaaaagaaccgctaattagtgaacttaaaggcattatcgaaacagcatatgattatgaaagataa

SEQ ID NO: 39588 - protein, 869 aa, Staphylococcus epidermidis ATCC 12228
MLSVTKKNTYESNKDEVTQMIDSLAEKGQEALKELSKKSQQEINDIVHQMSMAAVDQHMHLAKLAYDETGRGIYEDKAIKNLYASEYIWNSIKDNKTVGIIGEDKQKGLTYVAEPIGVICGVTPTTNPTSTTIFKAMIAIKTGNPIIFAFHPSAQQSSKYAAKVILEAATKAGAPKDCIQWIEVPSIVATKQLMNHKDIALVLATGGSGMVKSAYSTGKPALGVGPGNVPTYIEKTAHIKRAVNDIIGSKTFDNGMICASEQVMVVDKEVYTDVVKEFKLHQTYFVNKNELQQLEDAIMNEDKTAVKPDIVGKSAVDIAKLSGISVPEKTKLLVAEIDGIGKDYPLSREKLSPVLAMVTAKSTGHALQICEDTLKFGGLGHTAVIHTEDSQLQQKFGLKMKACRVLVNTPSAVGGIGNMYNELIPSLTLGCGSHGRNSISHNVSAVDLLNIKTIAKRRNNMQWFKLPPKVYFEENSVMYLTEMDNVERVMIVCDPGMVNIGYTDIVEQVLRRRENQPQIKVFNEVEPNPSTHTVYKGLEMFINFQPDTIIALGGGSAMDAAKAIWMFFEHPETSFFGAKQKFLDIRKRTYKITKPKNAKFICIPTTSGTGSEVTPFAVITDSETHVKYPLADYALTPDIAIVDPQFVLSVPKDVTADTGMDVLTHAIESYVSVMASDYTRGLSLQAIKLTFDYLKSSVQENDKHSREKMHNASTMAGMAFANAFLGISHSIAHKIGGEYGIPHGRTNAILLPHVIRYNAKDPQKHALFPKYDFFRADTDYADIAKFLGLKGNTTDELVDALANAVYDLGCSVGIDMNLKSQGVTEELLHSTIDRMAELAFEDQCTTANPKEPLISELKGIIETAYDYER

SEQ ID NO: 39589 - DNA, 1155 bp, Clostridium tetani E88
  CDS (1)..(1155): transl_table=11
atggcatataaaattaatattcctggaaatattatatatggaaagaatgctctgaaggaatcatcaaaaaacataaaagagctaggaggaaaagctttaatagttactgataaaataatgattgaaataggtaatgttaaaaaagtcagtgaagttcttgatgatattggtataaaatatgaaatatatgacggaattaattcagaacctacagacgtaatggtagataaaggaatagaaatatataataattctcattgtgattttttaattgctataggaggaggaagtcctatagatgcttcaaaggcaattggagctatgataacaaatttaggaaatataaatgactacatgggaaaaataatagaaaatgcctcgccaagcattgtagcaattccaaccactgctggaacaggatcagaagcaaccgaatttacaatcatatcaaatacaaaagacaacataaaaatgttgctaaaaggaaaaagtttaattcctactttggcaatagttgacccgcaattttctataacagtaccccaaaacattacggcaactacaggaatagatgctttgacgcacgccattgaatcatatacatcaaaacatgcaaattcattttcagataccttcgcactatcagcagtaaagcgtatttttaataatttaataaaagcatataaagatgggaagaattttgaagctagaaatgaaatggctctaggtgccttagaagcaggaattgcttttaataattcttcggtaactatagttcatggaatgagtagaccaattggagctttatttaaagtaccacatgggctttctaatgcagtacttttacccaaatgtttagaatttgcaattcaaggggaagaaaaaagatttgcagatattgcaaaagcaatagaaatatgtaaagaagaaacatcagataaagaagctgcagaaaaacttgtaaaagaaattgaaagtttgtgcaaagatattaatataccaaccttggaggagtacggtatagaaaaaaatgaattttatgaagaaataaataagatggcagaagatgcattaaatagtggaagtcctgcaaatactagacgacaacctactaaagaagatattgttaatatatataaacagttgtatatataa

SEQ ID NO: 39590 - protein, 384 aa, Clostridium tetani E88
MAYKINIPGNIIYGKNALKESSKNIKELGGKALIVTDKIMIEIGNVKKVSEVLDDIGIKYEIYDGINSEPTDVMVDKGIEIYNNSHCDFLIAIGGGSPIDASKAIGAMITNLGNINDYMGKIIENASPSIVAIPTTAGTGSEATEFTIISNTKDNIKMLLKGKSLIPTLAIVDPQFSITVPQNITATTGIDALTHAIESYTSKHANSFSDTFALSAVKRIFNNLIKAYKDGKNFEARNEMALGALEAGIAFNNSSVTIVHGMSRPIGALFKVPHGLSNAVLLPKCLEFAIQGEEKRFADIAKAIEICKEETSDKEAAEKLVKEIESLCKDINIPTLEEYGIEKNEFYEEINKMAEDALNSGSPANTRRQPTKEDIVNIYKQLYI

SEQ ID NO: 39591 - DNA, 2631 bp, Clostridium tetani E88
  CDS (1)..(2631): transl_table=11
atgaaggtagaaaatgttcaacagcttatggaaaagatagaaaatgtaagaaaggcacaaaaagaatttgcaaattataatcaaaaacaggtagatgagatatttagaagtgcagctatagctgcaaatgaggcaagaatagaactggctaaactagctgtagaagaaacaggtatgggaattattgaagataaggtaataaaaaatcattttgcatcagaatacatttataataaatataaagatgaaaagacttgtggaattattgaaagggatgaatcctttggaatttctaaggtagcggaaccaagaggagttatagcagctattattccaattactaatccaacatctacaacaatatttaaagcacttatttgtctaaaagctagaaatggaataatattttctccacaccctaaagcaaaaaaatctaccattgctgctgctaaaatagttcttcaagcagcaatagatgctggagctccaaaagaaataatagcatggatagatgaaccttccctagagctttctcaaaaacttatgcatgaaggagatatgattttagctacaggcggacctggaatggttaaagctgcatactcttcaggaaaacctgccataggtgttggtgctggaaatacaccagcaattatagatgaaacagcacatataaaaatggcagtaaactcaataattatgtcaaagagttttgataatggagttatatgtgcatcagaacaatcagtacttgtagtagatgaagtatatgaagatgttaaacaagagtttgaagaaagaggagcttatatattaaaaggagatgaagtagataaactaagaaatataatactaataaatggagcagttaatcctgatattgttggacaacctccttataaaatagcaaaactagcgggagttgaaatacctcaaagcagtagaattattataggagaagttaaatcggtagaaattgatgaaccctttgctcatgaaaaattatcccctgttcttgctatgtatagagtaaaggattttaatgaggcgctagataaagctgtaacattaatagaagatggaggaagagggcatacttcggttttatatacaaatattgtaaagtcaaaagatagagtggacaaatttagtcttactatgaaaacaggaagaacaataataaatatgcctgcatctcaaggtgccatgggagatgtatataattttaaacttcagccatcattaactttaggttgcggtacttggggaggaaactctgtttcagaaaacgttggagttaaacatttaataaatataaaaagtgtagctgagaggagagaaaatatgctatggtttagagttccagaaaagatatattttaaatatggctgtcttgctatggcactaaatgaactaaaggatatgaagaaaaaaagagcctttatagtaacagatagagtactttataatcttggatttgcagaaaaaatagaaaagattttagaggaaattggaattgagttcaaagtattctttgatgttgaatctgacccaacattaaaaacggcaaaaaagggtgctgaagatatgaaaagttttaaaccagatacaattattgccctaggtggtggttcgcctatggatgctgcaaaaatcatgtggataatgtatgaacaccctgatgtgaagtttgaagatcttactatgagatttatggatataagaaaaagagtatacaagtttccgaaaatgggagaaaaagctatgatggttgcaataccaactacagctggaactggctcagaggttactccctttgcagtaattaccgatgagaatacaggaattaagtatcctttagctgattacgagttgactccagatatggctataatagatgctgaattaatgttaaatataccaaaggaattaacagcagcatcaggtatagatgccttaactcatggtatagaagcatatgtatctgtacttgcttcagaatataccaatggtttagccctagaggcaataagacttgtatttaaatatttacccgatgcttataatgaaggagctaataatataaaggcaagagaaaagatggcacatgcatctactatggcaggtatggcttttgccaatgctttcttaggagtatgtcattccatggctcataaattaggagcaatgcataatctatcccatggcctttctaatgctcttcttataaatgaggtaatcaaatttaatgcagttgataaccctagaaaacaagcttcgtatccgcaatataaatatcctaatgctaaatggagatatggaaggatagcagatcatttaaatttaggaggaaatacagatgatgaaaaagtagagcttttaattaaagctattgatgaattaaatgaaaaagtaggaatacctaaaactattagtgaagctggggttcctaaagaaaaattctatgcaactttagatgaaatgagtgaacaagcctttgatgatcaatgcacggtggcaaatccaagatatccacttattagtgaaataaaagagatgtatataaatgtttatgaagatacagataaggagcataagactgaaaagcataagaatgaagaatgcaaataa

SEQ ID NO: 39592 - protein, 876 aa, Clostridium tetani E88
MKVENVQQLMEKIENVRKAQKEFANYNQKQVDEIFRSAAIAANEARIELAKLAVEETGMGIIEDKVIKNHFASEYIYNKYKDEKTCGIIERDESFGISKVAEPRGVIAAIIPITNPTSTTIFKALICLKARNGIIFSPHPKAKKSTIAAAKIVLQAAIDAGAPKEIIAWIDEPSLELSQKLMHEGDMILATGGPGMVKAAYSSGKPAIGVGAGNTPAIIDETAHIKMAVNSIIMSKSFDNGVICASEQSVLVVDEVYEDVKQEFEERGAYILKGDEVDKLRNIILINGAVNPDIVGQPPYKIAKLAGVEIPQSSRIIIGEVKSVEIDEPFAHEKLSPVLAMYRVKDFNEALDKAVTLIEDGGRGHTSVLYTNIVKSKDRVDKFSLTMKTGRTIINMPASQGAMGDVYNFKLQPSLTLGCGTWGGNSVSENVGVKHLINIKSVAERRENMLWFRVPEKIYFKYGCLAMALNELKDMKKKRAFIVTDRVLYNLGFAEKIEKILEEIGIEFKVFFDVESDPTLKTAKKGAEDMKSFKPDTIIALGGGSPMDAAKIMWIMYEHPDVKFEDLTMRFMDIRKRVYKFPKMGEKAMMVAIPTTAGTGSEVTPFAVITDENTGIKYPLADYELTPDMAIIDAELMLNIPKELTAASGIDALTHGIEAYVSVLASEYTNGLALEAIRLVFKYLPDAYNEGANNIKAREKMAHASTMAGMAFANAFLGVCHSMAHKLGAMHNLSHGLSNALLINEVIKFNAVDNPRKQASYPQYKYPNAKWRYGRIADHLNLGGNTDDEKVELLIKAIDELNEKVGIPKTISEAGVPKEKFYATLDEMSEQAFDDQCTVANPRYPLISEIKEMYINVYEDTDKEHKTEKHKNEECK

SEQ ID NO: 39593 - DNA, 1149 bp, Clostridium tetani E88
  CDS (1)..(1149): transl_table=11
gtgtatatgaaagaatttagtattaatacagatgtttattttggagaaggctctttagatagactaaatgaaattaaaaataaaagagtactaattgtatgcgataagtttatggaaacttcaggtatggttacaaaagtacaacaaaagcttactgactgtgaagtaaccatatacagtgatattgttcctgacccatctgtagaagttattgcatctggtattcaaaaattacagagttgtaatgcacagattataatagcccttggcggaggttcatcaattgatggagctaaagctataaaagaatattcaaaaaaagttactggaaaaactatcaatatagaagagttttatgctatacctactacaagtggtacaggctctgaagtaactgaatatgcagtaattacaaataaacaagaaggattaaagtatgcaatcacagataaatcccttcttccaacagttgccattctagatcctcagttggtaaaatcagtacctaaagctataactgctgatacaggaatggatgtaatcacacatgccttggaagcttacgtttcaaaaaatgctacggatttttcagatgcccttgcagaaaaagcttttactttagcatttagatttttaccacaagcctatgctgatggagaggatataatagcaagagaaaaacttcataatgcatcctgtcttgctggtatggcatttaatgcagctggacttggaattacccatagtttagcccatgctgtaggtggaaaattacatatctctcacggaagaagtaatgcaataatacttccgtatgtagttgaatacaatgctaatttaaacaaagaatctttcaatgcagaatatagcatagcagctaaaaaatatcaaaggcttgctaaattattaaagctacatgcaccaaatgtaactattggtgttaataatttaattaagagcattgtaaaacttcaaaatacattgatgattccccaaacattaaaacaacaacgtgaggatataaatttggatgaaacatcaaaagaagaaattattaatgcagctcttagggatgtatgcacaacatcaaatcctagagaaactaaaaaagaagattttctaaaaattctagataaggttttaggataa

SEQ ID NO: 39594 - protein, 382 aa, Clostridium tetani E88
MYMKEFSINTDVYFGEGSLDRLNEIKNKRVLIVCDKFMETSGMVTKVQQKLTDCEVTIYSDIVPDPSVEVIASGIQKLQSCNAQIIIALGGGSSIDGAKAIKEYSKKVTGKTINIEEFYAIPTTSGTGSEVTEYAVITNKQEGLKYAITDKSLLPTVAILDPQLVKSVPKAITADTGMDVITHALEAYVSKNATDFSDALAEKAFTLAFRFLPQAYADGEDIIAREKLHNASCLAGMAFNAAGLGITHSLAHAVGGKLHISHGRSNAIILPYVVEYNANLNKESFNAEYSIAAKKYQRLAKLLKLHAPNVTIGVNNLIKSIVKLQNTLMIPQTLKQQREDINLDETSKEEIINAALRDVCTTSNPRETKKEDFLKILDKVLG

SEQ ID NO: 39595 - DNA, 1170 bp, Clostridium tetani E88
  CDS (1)..(1170): transl_table=11
atgaataattttaaagtagggcctaaagtttatcatggagctttaagtctagaaaaacttaaagaaattaattgtaaaaaagtatttattgttacagatccatttatggtaacctctggaacaataagcaaagttacagaacatttggataaatccaatattgaatatgctattttttcagatatagtgccagatccacctctagaaataatctcaaaaggaattaaggctatggatgaatttaagccagaggcattaattgcattgggaggaggatcagcaattgatgcagcaaaggctataagttattttagatctcttataaataaaggactaaatccagacatggaaaatgaaaaagttttatttattgctataccaacaactagtggtacaggttctgaagttacatcattttccgttataacagataaaaaatataatgttaaatatccattagtagaagaaattatggtaccagatatagcaatattagatccaatccttgtaaaaacagtgccaaattttataacagcagatactggtatggatgttttaactcatgcaatagaggcatatgtatccactgatcattctgattttagtgatgctctagcagaaaaagctataaaattagtctttgattatttagaaaaagcctataaaaatggtgatgatttgacagcaagagaaaagatgcacaatgcttcttgtatagcaggaatggcatttacaaatgcttcacttggaataaatcatagtatggcacatatactaggcggtaaattccatattcctcatggaaaagcaaatgcaatattattaccctatgttatagaatataatgcagatttaagttttaataatagattggaatatagtgatactgccagaagatatgctcaaattgctcaaattttaaatcttacaagtagtaataatgttagagaaggagttaaatctttaataagagctataaattctctaagaaaaactttaggaataccttgtaatattaaggatatgaatataagtaaggaagactttgaatgtaatatagatgacctttcagagattgcattaaaggatagttgtacaaaaactaatccaaaagagcctaatgtagaagaattaaagacattgtttagaattgtatatgaaggaaaataa

SEQ ID NO: 39596 - protein, 389 aa, Clostridium tetani E88
MNNFKVGPKVYHGALSLEKLKEINCKKVFIVTDPFMVTSGTISKVTEHLDKSNIEYAIFSDIVPDPPLEIISKGIKAMDEFKPEALIALGGGSAIDAAKAISYFRSLINKGLNPDMENEKVLFIAIPTTSGTGSEVTSFSVITDKKYNVKYPLVEEIMVPDIAILDPILVKTVPNFITADTGMDVLTHAIEAYVSTDHSDFSDALAEKAIKLVFDYLEKAYKNGDDLTAREKMHNASCIAGMAFTNASLGINHSMAHILGGKFHIPHGKANAILLPYVIEYNADLSFNNRLEYSDTARRYAQIAQILNLTSSNNVREGVKSLIRAINSLRKTLGIPCNIKDMNISKEDFECNIDDLSEIALKDSCTKTNPKEPNVEELKTLFRIVYEGK

SEQ ID NO: 39597 - DNA, 1170 bp, Clostridium tetani E88
  CDS (1)..(1170): transl_table=11
atgaaaagatttacaattccaagagatatttattatggtaaagggtcattagaggtaataaaatctattaagggaaataaagccgttatagtaattggtggcggatcaatgaaaagatttggttttttagataaggttgaaaattatctaaaggaagcaggtatagaaactaaattaatagaaggtgtagagccagatccttcagtagaaacagttatgaagggtgcagaaatcatgagggaatttaagccagattggataatatctataggtggcggatcaccaattgatgcagctaaagctatgtggcttttctatgaacatcctgatttaacttttgaagaagctgcacaaaaagtactttgtcttccagaattgagaagtaaagctaaatttatggctatcccatctaccagtggaacagcttcagaagtaactgctttttcagtaataacagactacaaaaaacaaataaaatatcccctagcagattttaatttaacaccagatatagctatagtagatccagaattggcagaaacaatgccagctaaacttaccgctcatacaggtatggatgccttaactcatgcaatagaagcttatgtggctacagaaaacactagctttacagatccactagcattacaggcaatattaatggttaaagattatttaattaaatcctatgaagaagacaaagaagcaagagaaagaatgcatgaagctcaatgtcttgcaggaatggctttttctaatgcattactcggaataactcatagtatggctcataaaattggtgctgtatttgatataactcatggttgtgctaatgcaatattcttaccttatgttatacaatttaatagtaaggtttgtgaagaaagatatgcaaatattgcaaagtatttaggattagaaggagaatcagataaagatttagtaaattcattgataaatttcattagggatttaaataaaaaattaagcatagataattcattaaaagaatatggaatagatgaaaatgaatttaaagaaaaggttgaatacatggctcacaatgctgtattagatgcttgcacaggagcaaacccaagaaaaataaatgaagaagaaatgaagaacatgtatacttatgcatttaatggaaaagatatagatttttaa

SEQ ID NO: 39598 - protein, 389 aa, Clostridium tetani E88
MKRFTIPRDIYYGKGSLEVIKSIKGNKAVIVIGGGSMKRFGFLDKVENYLKEAGIETKLIEGVEPDPSVETVMKGAEIMREFKPDWIISIGGGSPIDAAKAMWLFYEHPDLTFEEAAQKVLCLPELRSKAKFMAIPSTSGTASEVTAFSVITDYKKQIKYPLADFNLTPDIAIVDPELAETMPAKLTAHTGMDALTHAIEAYVATENTSFTDPLALQAILMVKDYLIKSYEEDKEARERMHEAQCLAGMAFSNALLGITHSMAHKIGAVFDITHGCANAIFLPYVIQFNSKVCEERYANIAKYLGLEGESDKDLVNSLINFIRDLNKKLSIDNSLKEYGIDENEFKEKVEYMAHNAVLDACTGANPRKINEEEMKNMYTYAFNGKDIDF

SEQ ID NO: 39599 - DNA, 1173 bp, Lactobacillus plantarum WCFS1
  CDS (1)..(1173): transl_table=11
atgactgaacgtaattttgatttcttaatgcctagcgttaactttttcggtcctggtgtcattagtaaaatcggcgagcgtgccaaaactcttggtatgcacaagccagtcatcgtcaccgacaaatttcttgaaagtctgccagacggcgccgttgctcaggtgcggcggtcactggatgctgccgggattgactacgtaatttataatcaagttgagcccaaccctaaaattcataacattcaagctgttaaagccttatatcaagccaatcaagcggactccctgattactattggcggtggttctgcccacgataccggaaaaggtgccggcatcatcatgactaacggcgacgatatcactaagttagcggggatcgaaacactcaagaatgccctaccaccactgattgcggtcaacactaccgctgggactggttctgaattgacccgtcactgtgtcattacgaatgaagaaacgcattataagttcgtcgttgcttcatggcgtaacatgccactcgtgtcctttaacgatcccactctcatgctagatgttcctaagggactcacggccgcaactggcatggatgcttttgtccaggctatcgaaccctttgtttctgtcgatcacaatccgattaccgattcacagtgcatccaggccatcaaattaatcgaaacatcattacgcgaagccgtcgccaatgggcataacctagaagcccggacacacatggtcgaagctgaaatgttagccggcatggcctttaacaacgccaatctaggttacgtgcacgccatggcccaccagctcggcggccaatatgacgcaccccacggtgtctgctgcgcgctgctcttaccctacgttgaagaatataatctaatcgcgtgccccgaacgtttcgccgagctcgccaaaattatgggcgaaaacactgatggcttatcgactcgtgatgctgccgaattagctatcaaagcgatgaaacaactcagcgaagacgttggcattccgcattccatcaaggaaattggcgccaagatcgaggacttcgaacacatggcgactaatgcgcttaaagacggtaacgccttctctaacccacgcaaaggtactaaagaagacatcatcaagattttccaagccgcatatgatgccaagtaa

SEQ ID NO: 39600 - protein, 390 aa, Lactobacillus plantarum WCFS1
MTERNFDFLMPSVNFFGPGVISKIGERAKTLGMHKPVIVTDKFLESLPDGAVAQVRRSLDAAGIDYVIYNQVEPNPKIHNIQAVKALYQANQADSLITIGGGSAHDTGKGAGIIMTNGDDITKLAGIETLKNALPPLIAVNTTAGTGSELTRHCVITNEETHYKFVVASWRNMPLVSFNDPTLMLDVPKGLTAATGMDAFVQAIEPFVSVDHNPITDSQCIQAIKLIETSLREAVANGHNLEARTHMVEAEMLAGMAFNNANLGYVHAMAHQLGGQYDAPHGVCCALLLPYVEEYNLIACPERFAELAKIMGENTDGLSTRDAAELAIKAMKQLSEDVGIPHSIKEIGAKIEDFEHMATNALKDGNAFSNPRKGTKEDIIKIFQAAYDAK

SEQ ID NO: 39601 - DNA, 2604 bp, Lactobacillus plantarum WCFS1
  CDS (1)..(2604): transl_table=11
atgattaagacagaaaaaaatcaaacaagcaaagttactgacgaagttgatcaattagttcaacgttctaagaaagcattagctattttgaagtcatatacccaagcacaaatcgatgatttatgtgaaaaggttgcggttgccgcactggacaatcatatgaagttagccaagttggcggttgaggaaaccggtcggggtgttgttgaagataaggcgattaagaacatctacgccagcgaatatatctggaacagcatgcgccatgataagacagtcggcgtcattaaagaagacgatgaagagcaactaatggaaattgctgaaccagttggtatcgtagccggggttacacccgtaacgaatccaacttcaacaacggttttcaagacgttgatctcattaaaggggcgtaacacgatcgtctttggtttccatcctcaagctcagaaatgtagttctgcggctgctgatgtgatgcgggaagcgattaaagctgctggtggtccagctgatgctgttttatacatcgaacacccaagcattgaagcaaccgacgccttgatgcaccatacggatgttgcgacgatcttggctaccggtggtccaagtatggtgacagccgcttactcatcaggtaaaccagcactgggtgttggtcctggtaacggcccaacttatgttgaaaaaacagctgacattaagcaggcggttaacgacattgttttatcgaagacgtttgataatgggatgatttgtgcttctgaaaatagtgccattatcgacaaggaaatttatgctgaagttaaagctgaatttattcgtttgggttgctactacgttaaacctaaagatgtgcaagccttgagtgatgctgtcattgatcctaaccggcacacagttcgtggtccagttgctggtaaaacagcttatcaaatcgcacaaatggctggcttgaaagatgtcgctaaggactgccgggtcttgattgcggagattaatggtgtcggtatcaagtacccattatccggcgaaaaattatcaccagttctgaccgtttacaaagcggattcgcatgaagcggcgttcaaacgggctaatgaattacttcactatggtggcttaggccatactgctgggattcatacgaccgatgatgcattggtcaaagaatttggcttacaaatgccagcttgccggatcttagttaacacgccatcttcagttggtgggttaggtaacatctacaataacatggcgccttcattaactctgggcacgggatcatatggtggcaactcgatttctcataacgttacagatatggatctgattaatatcaaaactgtggcaaaacggcgtaataacatgcaatgggtcaaaatgcctcccaaagtctacttcgaacgcaattccgttcgctacttggaacacatggccgggattaagaaggttttcctagtttgtgatcctgggatggttgaatttggctatgctgatcgagtaacggcggtcttgaacaagcggactgatccggttgatatcgacatcttctcagaagttgaaccgaacccgtcgactgacacagtctacaaaggggttgcccggatgaaggcctttaagccagatacaatcattgcactcggtggtggttctgcaatggacgccgctaaggggatgtggctcttctatgaacacccagaagcttccttcttaggtgctaaacagaagttcctggatatccggaagcggacgtacaaagtaccagtatccgaaaaagtaacttatattgggattccaacgacttctgggactggttctgaagtaacgccatacgcggttattacggactccaagacgcacgtcaaatacccgattacggactacgcaatgcaaccagatattgcgatcgttgacccacaatttgttgaaacggtgccaaagcggacgacggcttggactggtctcgacgtaattacccacgcaaccgaagcatatgtttcaacgatggcttctgacttcacacgcggctggtcaattcaagccttgcaattagccttcaagtacttgaaagcttcttatgatggtgacaagatggctcgtgagaagatgcacaatgcctcaacgttagctgggatggcctttgccaatgccttcttgggtatcaaccactcgatcgcccataaattaggcggggaattcaacttaccacacggattggcaattgcgatcacttatccgcaagtcgttcgttacaatgctgaaatcccaacgaagttagcaatgtggccgaagtacaaccataatactgccttagccgactatgccaacattgcccgggccttagggttaccaggcaagaccgacgaagaactcaaagaaagcttagttaaagcttacattgacttggctcactcaatggatgtgaccttatccttgaaagctaaccgggtcgaaaagaagcactttgacgccaccgtcgacgaattagccgaactggcctatgaagaccaatgcacgaccgctaacccacgcgaacctttaatcagtgaattaaaggcgattattgaacgtgaatgggacggccaaggtactgaaaaatag

SEQ ID NO: 39602 - protein, 867 aa, Lactobacillus plantarum WCFS1
MIKTEKNQTSKVTDEVDQLVQRSKKALAILKSYTQAQIDDLCEKVAVAALDNHMKLAKLAVEETGRGVVEDKAIKNIYASEYIWNSMRHDKTVGVIKEDDEEQLMEIAEPVGIVAGVTPVTNPTSTTVFKTLISLKGRNTIVFGFHPQAQKCSSAAADVMREAIKAAGGPADAVLYIEHPSIEATDALMHHTDVATILATGGPSMVTAAYSSGKPALGVGPGNGPTYVEKTADIKQAVNDIVLSKTFDNGMICASENSAIIDKEIYAEVKAEFIRLGCYYVKPKDVQALSDAVIDPNRHTVRGPVAGKTAYQIAQMAGLKDVAKDCRVLIAEINGVGIKYPLSGEKLSPVLTVYKADSHEAAFKRANELLHYGGLGHTAGIHTTDDALVKEFGLQMPACRILVNTPSSVGGLGNIYNNMAPSLTLGTGSYGGNSISHNVTDMDLINIKTVAKRRNNMQWVKMPPKVYFERNSVRYLEHMAGIKKVFLVCDPGMVEFGYADRVTAVLNKRTDPVDIDIFSEVEPNPSTDTVYKGVARMKAFKPDTIIALGGGSAMDAAKGMWLFYEHPEASFLGAKQKFLDIRKRTYKVPVSEKVTYIGIPTTSGTGSEVTPYAVITDSKTHVKYPITDYAMQPDIAIVDPQFVETVPKRTTAWTGLDVITHATEAYVSTMASDFTRGWSIQALQLAFKYLKASYDGDKMAREKMHNASTLAGMAFANAFLGINHSIAHKLGGEFNLPHGLAIAITYPQVVRYNAEIPTKLAMWPKYNHNTALADYANIARALGLPGKTDEELKESLVKAYIDLAHSMDVTLSLKANRVEKKHFDATVDELAELAYEDQCTTANPREPLISELKAIIEREWDGQGTEK

SEQ ID NO: 39603 - DNA, 1149 bp, Pseudomonas syringae pv. tomato str. DC3000
  CDS (1)..(1149): transl_table=11
atgagcagcacttttttcattcccgcagtgaacatcattggcgctggctgcatcgatgaagccatgctcgccatacgcaaatacggatttctcaaggcgctgatcgtcaccgatgcagggctggccaaggccggtgtggccagccaggtcgccggactgctggtggagcagggcatcgactcggtggtgtatgacggtgccagacccaacccgaccatcgccaacgtcgaaaacggcctggctttgctgcggaaacgtcagtgcgatttcgtgatttctctgggtggtggctcaccccacgactgcgccaagggcattgccctgtgcgccagcaacggcgggcacatcagcgactatgaaggcgtcgaccgttcggcaaagccgcagttgccgctgatcgcgatcaacaccacagccggaaccgccagcgagatgacccgcttctgcatcatcaccgatgaagcgcgtcacgtaaaaatggccatcatcgaccgcaacgtaacacccctgttatccgtaaacgacccgaacatgatggtcgccatgcccaaatcactgaccgccgccaccggtatggatgccttgacccacgccatcgaagcgtatgtgtcgaccgccgccacgccgatcaccgacgcctgcgcattgcaggccatgtcactgatcgccaacaatctgcgcgaggcagtcagcaacgggacaaacatcactgcgcgcgagaacatggcctatgcccagtttctcgccggcatggctttcaacaatgcctcgctgggttacgtgcacgcgatggcgcatcaactgggcggcttctatgatttgccgcatggcgtgtgcaatgccgtgctgctgcctcatgtgcagcgtttcaacgcgagcgtcagtgctgcacgtctgaccgatgttgcccatgcaatgggggccagcgttcgtggtctgtcgccggaagaaggtgcgcacgcggcaatcgaggctattcgggccttgtctgctgcggtagagatcccggcgggcctgactgcactgggcgtcaaggaagaggatttccctgttcttgccgccaatgcattgaaagacgcttgcggtttcaccaacccacgcccggcggatcttgagcagattcaggaactgttccgccaggcactttga

SEQ ID NO: 39604 - protein, 382 aa, Pseudomonas syringae pv. tomato str. DC3000
MSSTFFIPAVNIIGAGCIDEAMLAIRKYGFLKALIVTDAGLAKAGVASQVAGLLVEQGIDSVVYDGARPNPTIANVENGLALLRKRQCDFVISLGGGSPHDCAKGIALCASNGGHISDYEGVDRSAKPQLPLIAINTTAGTASEMTRFCIITDEARHVKMAIIDRNVTPLLSVNDPNMMVAMPKSLTAATGMDALTHAIEAYVSTAATPITDACALQAMSLIANNLREAVSNGTNITARENMAYAQFLAGMAFNNASLGYVHAMAHQLGGFYDLPHGVCNAVLLPHVQRFNASVSAARLTDVAHAMGASVRGLSPEEGAHAAIEAIRALSAAVEIPAGLTALGVKEEDFPVLAANALKDACGFTNPRPADLEQIQELFRQAL

SEQ ID NO: 39605 - DNA, 1191 bp, Vibrio parahaemolyticus RIMD 2210633
  CDS (1)..(1191): transl_table=11
atgttgaaacattgtttgtatcgcagttacaccaaagggctaaaaatcgcagcgcatgtgctgccacttcctcggccgacgttgttttctggttcgggatccgtatctgagttgttggaggcgatatctgatctaggttttcgacgtttgttgctagtgaccgatgagggattagttcgaatcggtatggtaggtaaagtcttggagcaaacgcaggggttgggtttacaggtgggcgtgttttctgaagtaaaaccagacccaacttacgatcaagtggaagatggattacgggcttacaacgcctctcaatcggaagccattttggcattaggtggcggatctgccattgactgtgcaaaagtgattgctgcaagggtaagtaacaaacgctcaatcaaaaagctctcaggacttttcaaagtatggcgaaccccggcgcctctgtttgttattccaaccacttctggcactggttctgaagtgacgatcgcggcagtggtttcagacccaaatacgcatttaaaaacgcccttgatggacccgaaactggtgccgattatggccgcgctcgatcccgacttgcttatcggtttgccagccaaaatcactgctgacacagggattgatgcgttaactcatgcggtagaagcctacatttcgcgcaatgcgacaccagaaactcaagcgtattcagtcgctgcaatcaaattgatatttcgttatttacccaaagcagtggctcaggggggagatattgaagctcgatacaaaatggccatggcgtcttactacgcagggctagcttttaccaaggcaagtcttgggtacgtgcatgctttcgcgcacaacttaggggcaaggtatggtttgccacatggcatggcaaatggattagcgttgctacccgtcttaaagttctctttgcctgaaattgaagatgagctaagaacgcttgccgagaagaccaatatcaatacgaaagacaacccaagtgctgagcatttcttggaacagattaaatccttgtacgatgctattggtatcgaaaaatgtacaacagccataaaacaagatgatatcgaagacttggttgacctgattctgaaagaggcacattggaattaccccgttcccaagtttatgaattctgaagaatgcgctcgcttattgatagaaataagcgcttag

SEQ ID NO: 39606 - protein, 396 aa, Vibrio parahaemolyticus RIMD 2210633
MLKHCLYRSYTKGLKIAAHVLPLPRPTLFSGSGSVSELLEAISDLGFRRLLLVTDEGLVRIGMVGKVLEQTQGLGLQVGVFSEVKPDPTYDQVEDGLRAYNASQSEAILALGGGSAIDCAKVIAARVSNKRSIKKLSGLFKVWRTPAPLFVIPTTSGTGSEVTIAAVVSDPNTHLKTPLMDPKLVPIMAALDPDLLIGLPAKITADTGIDALTHAVEAYISRNATPETQAYSVAAIKLIFRYLPKAVAQGGDIEARYKMAMASYYAGLAFTKASLGYVHAFAHNLGARYGLPHGMANGLALLPVLKFSLPEIEDELRTLAEKTNINTKDNPSAEHFLEQIKSLYDAIGIEKCTTAIKQDDIEDLVDLILKEAHWNYPVPKFMNSEECARLLIEISA

SEQ ID NO: 39607 - DNA, 2703 bp, Vibrio parahaemolyticus RIMD 2210633
  CDS (1)..(2703): transl_table=11
atgcctgtaactaatatggctgaactagatgcaatgattgctcgcgttaagaaagcgcaagaagagttcgctacttactctcaagagcaagtagacaaaatcttccgtgcagcgtctcttgcagctaaccaagctcgtatccctctagcgcaacaagcggtagaagaatctggtatgggtattgttgaagataaagtaatcaagaaccacttcgcttctgagtttatctacaacaaatacaaagacgaacaaacgtgtggcatcctagaagaggatgacaacctaggtactatgactatcgctgaacctgtaggtatcatctgcggtatcgtaccaacaactaaccctacatctacagcgatcttcaaatctctaatctctctgaagactcgtaacggtatcatcttctcaccacacccacgtgcgaaaaactctactaacgatgcagcgaaacttgttctagatgcagcagtagcagcaggtgcaccaaaagacatcatcggttggatcgaccaaccttcagttgagctatcaaacgctctaatgaaacacgatgacatcgcgcttatccttgcaactggtggtccaggcatggttaaagcagcttactcttctggtaagccagcaatcggtgtaggtgcaggtaacgttcctgtagttatcgatgaaacagcagacatcaaacgtgcagttgcttctgtactaatgtctaaaactttcgataacggcgtagtatgtgcttctgagcaggctgtaatcgtagttgacgaagtttacgacgaagtaaaagagcgttttgcttctcataaagctcacgttctatctaaaacagatgctgacaaagtacgtaaagtgcttctaatcgacggcgcgctaaacgcgaaaatcgttggtcaaccagctacagctatcgctgaaatggcgggtgttaaagttcctgcagatactaaagtgcttatcggtgaaggcctaggcaaagtatcttacgatgacgcatttgctcacgagaaactgtctccaactctaggtatgttccgtgctgacaacttcgaagatgcagttgctcaagcagtaacaatggtagagatcggcggtatcggtcacacatctggtctatacactaaccaagacgtgaatgcagaccgcatccgttacttcggtgacaagatgaagaccgctcgtatcctaatcaacatcccgactacacacggtggtatcggtgacttgtacaacttcaacgttgcaccttctctaactctaggttgtggttcatggggtggtaactctatctctgagaacgtaggtcctaagcacctaatcaacaagaaaactgtagcgaagcgagctgaaaacatgttgtggcataaactacctaagtcaatctacttccgtcgtggtagccttccaatcgcacttggcgacctagaaggtaagaaacgcgcattcctagtaactgaccgtttcctattcaacaacggttacgcagatgacgtagtaagcctactgaaagctcaaggcatggaagttcaaacattcttcgatgttgaagctgacccaacactatctgtagtagaaaaaggtgcggctcaaatggctagctaccaacctgacgttatcctagcgctaggtggtggttcaccaatggatgcagcgaaaatcatgtgggtaatgtacgagcacccagaaactcactttgaagaactagcaatgcgctttatggacatccgtaaacgtatctacaagttccctaaaatgggtaaaaaagctgagcttgtatgtatcactacaacttcaggtactggttcagaagttactccattcgcagttgttactgacgacaagactggtgctaagtacccactagctgactacgaaatcacgccaaacatggctatcgttgatgcgaacctagtaatgaacatgcctaagtctctaacagcgttcggtggttacgatgcagtaactcacgctctagaagcttatgtatctgttcttgcgaacgaatactctgacggtcaggctcttcaagcacttaagatgctaaaagaatacctaccatcaagctacgcgaatggtgcaaatgacccaatcgctcgtgagaaagttcacaacgcagcaactatcgctggtgtagcatttgcgaacgcattcctaggtgtttgtcactcaatggcgcacaaactaggtgcagagttccacttgccacacggcctagctaacgcactactaatctctaacgtggtacgttacaacgcgaacgacaacccaactaaacaaactgcgttctctcaatacgaccgtccacaagcacgtcgtcgttacgctgaagttgcagaccacctaggcctaagccaagctggtgaccgcactgctcagaagattgaacgtctactagcatggttggatgaactaaaagttaacctagacatcccaatgtctatccaagcggcaggtgttgctgaagctgacttcgtagcgaaactagacgagctagcggttgaagcgttcgatgaccaatgtactggtgcgaacccacgctaccctctaattagcgagctaaaagacgttctactagcttcttactacggtaaagctttcgttgaaggtgaaactttcgaaggtactacagtaatcaagaagaaagcagaccaagaagcagcgaaatctgctcctaaagctaaaaaagaaaaagctgacgcgtaa

SEQ ID NO: 39608 - protein, 900 aa, Vibrio parahaemolyticus RIMD 2210633
MPVTNMAELDAMIARVKKAQEEFATYSQEQVDKIFRAASLAANQARIPLAQQAVEESGMGIVEDKVIKNHFASEFIYNKYKDEQTCGILEEDDNLGTMTIAEPVGIICGIVPTTNPTSTAIFKSLISLKTRNGIIFSPHPRAKNSTNDAAKLVLDAAVAAGAPKDIIGWIDQPSVELSNALMKHDDIALILATGGPGMVKAAYSSGKPAIGVGAGNVPVVIDETADIKRAVASVLMSKTFDNGVVCASEQAVIVVDEVYDEVKERFASHKAHVLSKTDADKVRKVLLIDGALNAKIVGQPATAIAEMAGVKVPADTKVLIGEGLGKVSYDDAFAHEKLSPTLGMFRADNFEDAVAQAVTMVEIGGIGHTSGLYTNQDVNADRIRYFGDKMKTARILINIPTTHGGIGDLYNFNVAPSLTLGCGSWGGNSISENVGPKHLINKKTVAKRAENMLWHKLPKSIYFRRGSLPIALGDLEGKKRAFLVTDRFLFNNGYADDVVSLLKAQGMEVQTFFDVEADPTLSVVEKGAAQMASYQPDVILALGGGSPMDAAKIMWVMYEHPETHFEELAMRFMDIRKRIYKFPKMGKKAELVCITTTSGTGSEVTPFAVVTDDKTGAKYPLADYEITPNMAIVDANLVMNMPKSLTAFGGYDAVTHALEAYVSVLANEYSDGQALQALKMLKEYLPSSYANGANDPIAREKVHNAATIAGVAFANAFLGVCHSMAHKLGAEFHLPHGLANALLISNVVRYNANDNPTKQTAFSQYDRPQARRRYAEVADHLGLSQAGDRTAQKIERLLAWLDELKVNLDIPMSIQAAGVAEADFVAKLDELAVEAFDDQCTGANPRYPLISELKDVLLASYYGKAFVEGETFEGTTVIKKKADQEAAKSAPKAKKEKADA

SEQ ID NO: 39609 - DNA, 1149 bp, Vibrio parahaemolyticus RIMD 2210633
  CDS (1)..(1149): transl_table=11
atgacaagtacattttttatccctacggtaaacctaatgggcgctggctgcctaaaagacgcagcaaacagcatccaatctcaaggctttaagaaaggtttgatcgttacggataagatccttaaccaaatcggcgtagtaaaacaggttcaagatcttcttactgaacgcggcgtagcaaccgttgtgttcgatggcactcaaccaaaccctacaatcaccaacgttaatgacggcttagctcttctaaaagagaacgaatgtgacttcgtaatttcacttggtggtggctcaccacacgattgtgcaaaaggcatcgcactggttgcatctaacggcggaaaaatcggcgattacgaaggcgtggatcaatcagcaaaaccaatgctgccactaatcgcaatcaacaccacagcaggtactgcatctgaaatgacccgtttctgcatcatcactgatgaagagcgtcatattaagatggcaatcgttgataaacacacaacgcctcttatctctgtaaacgatccagaattaatgcttgctaagccagcgtctttgacggcagcaacaggtatggacgcgctaactcacgcgattgaagcgtacgtatctatcgcggcaacaccaatcactgacgctgttgcaatcaaagcgatcgagttaattcaagcacacctacgcaccgcagtgaaaaacggcgaaaacctagaagctcgtgagcaaatggcatacgcgcagttcatggctggcatggcgtttaacaacgcatctctaggttacgttcacgctatggcgcaccagctaggtggtttctacgacctaccacacggtgtatgtaacgcaatcttgcttcctcacgtacaacgctacaacgcgcaagtatgtccagagcgtctgcgtgatgtcgcgaaagcaatgggtgtggatgtagaaggtatgtcggcagaacatggtgctgcggcagcgatcgacgctatcgttgcgctagcaaaagacgttggtattccagctggtattaaagagcttggtgcgaagctagaagatatcccaacactagcagacaacgcattaaaagacgcgtgtggtttcactaacccgaaacaagcaactcacgaagagatttctgcaatcttcgaagcggcaatgtaa

SEQ ID NO: 39610 - protein, 382 aa, Vibrio parahaemolyticus RIMD 2210633
MTSTFFIPTVNLMGAGCLKDAANSIQSQGFKKGLIVTDKILNQIGVVKQVQDLLTERGVATVVFDGTQPNPTITNVNDGLALLKENECDFVISLGGGSPHDCAKGIALVASNGGKIGDYEGVDQSAKPMLPLIAINTTAGTASEMTRFCIITDEERHIKMAIVDKHTTPLISVNDPELMLAKPASLTAATGMDALTHAIEAYVSIAATPITDAVAIKAIELIQAHLRTAVKNGENLEAREQMAYAQFMAGMAFNNASLGYVHAMAHQLGGFYDLPHGVCNAILLPHVQRYNAQVCPERLRDVAKAMGVDVEGMSAEHGAAAAIDAIVALAKDVGIPAGIKELGAKLEDIPTLADNALKDACGFTNPKQATHEEISAIFEAAM

SEQ ID NO: 39611 - DNA, 2643 bp, Streptococcus pyogenes SSI-1
  CDS (1)..(2643): transl_table=11
atgactgaaggacataatactgttgaaacaacctctgtttctgtgacaattgatgctcttgttcaaaaaggtttagctgctcttgcagagatgcgtaagcttgaccaagaacaagttgattatatcgtagccaaagcttctgttgctgctttggatgctcacggtgaacttgctaaacatgcttatgaagaaacaggtcgcggtgtctttgaagataaagcaacaaaaaatctatttgcttgtgagcatgtggttaataacatgcgccatcaaaaaacagtaggaattattgaagaagatgatgtgacaggtttgacattaattgctgagccggttggtgttatctgtgggattacaccaacaactaacccaacttcaacagctatctttaaatctttgatctcgttaaaaacacgtaatccaattatttttgcctttcacccatcagcacaagaatcatcagcgcatgccgctcgtattgttcgtgatgctgctattgccgctggtgctcctgaaaattgtgtgcagtgggttgaaacaccatcacttgaagcaacaaatgctttgatgaatcatgacggcattgccactatccttgcgacaggtggaaatgcaatggttaaagcggcatactcatgtgggaaacctgcccttggggtaggtgctggtaacgttccagcttatgttgaaaaatctgctaacatccgccaagccgctcatgatattgtgatgtctaaatcatttgataacggtatggtctgtgcgtctgaacaagctgttatcgtggacaaagaaatctatgacgattttgtagcagaattcaaatcttaccatacttattttgtaaataaaaaagaaaaagcccttcttgaagaattctgttttggtgccaaagcaaatagcaaaaactgtgctggtgcaaaattaaatccaaatattgtaggaaaaccagctacttggatttcagcacaagctggatttactgttccagaaggaaccaatattcttgctgcagaatgtaaagaagtttcagaaaatgagcctttaacacgtgaaaaattatctccagtcattgctgttttgaaatctgaatcacgtgaagacggtgttgaaaaagctcgtcaaatggttgaatttaatggactcggtcactcagctgccattcatacagcagatgcagagttggcaaaagaatttggaactagaatccgtgctatccgcgtcatctggaattcaccttctacatttggtggtatcggggatgtttacaatgctttcttgccatcattgactcttggttgtggttcgtatggacgtaacgcagttggtgataacgttagtgctataaatctcttgaacatcaaaaaagtaggaagacgtagaaataatatgcaatggtttaaagttccttcaaaaacatacttcgaacgtgattcaattcaatatttgcaaaaatgtcgtgacgttgaacgtgtcatgattgttacagatcacgctatggttgagcttggtttcttggatcgtatcattgaacaacttgatcttcgtcgcaataaagttgtttatcagatctttgctgaagtagaaccagatccagacattacaactgttatgaaaggtactgaattaatgcgtaccttcaaaccagacaccattattgcccttggcgggggatctcctatggatgcagccaaagttatgtggctcttttatgaacaaccagaagttgatttccatgacctcgttcaaaaattcatggatatccgcaaacgtgcgttcaaattcccagaacttggtaagaaaacaaaatttgttgctatcccaacaacttctggaacaggttcagaggtgacaccatttgccgttatctctgacaaagcaaataatcgtaaatatccaatcgctgattactcattaacaccaactgtagccattgttgacccagctttggtattgactgttccaggctttattgctgctgatactggtatggacgttttgacacacgcaaccgaagcttacgtgtcacaaatggccaatgactttacggatggtttagctcttcaagccattaaaattgtttttgataatcttgaaaaatcagttaaaacagccgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtataattactaccgtgcggatgaaaaataccaagacattgcgaaattgttagggctttcagcttctacaccagaagaagcagtggaatcttatgcgaaagctgtttatgatctgggttgccgagttggtattcaaatgaacttcaaagctcaaggtatcgacgaaaacgaatggaaagaacattctcgtgaattggcttaccttgcttatgaagaccaatgttcacctgctaacccacgtcttccaatggttgatcacatgcaagaaattattgaagatgcttactatggttatgctgaacgtccaggacgacgtaagtga

SEQ ID NO: 39612 - protein, 880 aa, Streptococcus pyogenes SSI-1
MTEGHNTVETTSVSVTIDALVQKGLAALAEMRKLDQEQVDYIVAKASVAALDAHGELAKHAYEETGRGVFEDKATKNLFACEHVVNNMRHQKTVGIIEEDDVTGLTLIAEPVGVICGITPTTNPTSTAIFKSLISLKTRNPIIFAFHPSAQESSAHAARIVRDAAIAAGAPENCVQWVETPSLEATNALMNHDGIATILATGGNAMVKAAYSCGKPALGVGAGNVPAYVEKSANIRQAAHDIVMSKSFDNGMVCASEQAVIVDKEIYDDFVAEFKSYHTYFVNKKEKALLEEFCFGAKANSKNCAGAKLNPNIVGKPATWISAQAGFTVPEGTNILAAECKEVSENEPLTREKLSPVIAVLKSESREDGVEKARQMVEFNGLGHSAAIHTADAELAKEFGTRIRAIRVIWNSPSTFGGIGDVYNAFLPSLTLGCGSYGRNAVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTELMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVLTVPGFIAADTGMDVLTHATEAYVSQMANDFTDGLALQAIKIVFDNLEKSVKTADFEAREKMHNASTMAGMAFANAFLGISHSMAHKIGAQFHTVHGRTNAILLPYVIRYNGTRPAKTATWPKYNYYRADEKYQDIAKLLGLSASTPEEAVESYAKAVYDLGCRVGIQMNFKAQGIDENEWKEHSRELAYLAYEDQCSPANPRLPMVDHMQEIIEDAYYGYAERPGRRK

SEQ ID NO: 39613 - DNA, 1188 bp, Salmonella enterica subsp. enterica serovar Typhi Ty2
  CDS (1)..(1188): transl_table=11
atgcaagctgaactacagacggcgctgtttcaggcattcaacaccctgaatctgcaacgggtgaaaacgttcagcgtaccgccggtcacgctgtgcgggcttggggcgctcggcgcctgcgggcaggaagcgcaagcgcggggcgtaagccatttgtttgtgatggtcgacagcttcctgcatcaggcgggaatgaccgcgccgctggcacgcagcctggcgatgaaaggcgtggcgatgacggtctggccgtgtccgccaggcgagccgtgcatcaccgatgtctgcgcggcggtggcgcaactgcgtgaggcggcgtgcgacggcgtagtggcctttggcggcggttcggtgttggacgcggcgaaagcggtcgccctgctggtgactaaccctgaccagacgctgagcgccatgaccgagcgcagtacattacgcccgcgtctgccgctgattgcggtgccgaccaccgccggaaccggttcagaaaccaccaacgtgacggtgattatcgacgcggtcagcgggcgcaagcaggtgctggcacacgcgtcactaatgccggatgtggcgattcttgatgctgccgtgaccgaaggcgttccgccaaatgtgacggcgatgaccggtatcgatgcgctgacgcatgcgattgaggcctacagcgcgctcaacgccacgccgtttaccgacagcctggcgattggcgcgatagcgatgattggcaaatcgctgccgaaggccgtcggctatgggcaggatctggcggcgcgtgaaaatatgttgctggcctcctgtatggcgggaatggccttttccagcgccggtctggggctgtgtcatgcgatggcgcaccagccaggggcggcgctgcatattccgcacggccaggccaacgccatgctgctgccgacagtcatgggctttaaccggatggtatgccgcgagcgcttcagtcaaatcggtcgggcgttaaccaataagaaatcggacgatcgcgatgcgattgcggcggtgtgcgagctgattgccgaagtggggcagagcaaacggctggctgacgctggcgccaaacccgaacactacagcgcgtgggcgcaagccgcgctggaggatatttgtctgcgcagtaacccacgcaccgccacacaggcacagattatcgacctgtacgcggctgccgggtaa

SEQ ID NO: 39614 - protein, 395 aa, Salmonella enterica subsp. enterica serovar Typhi Ty2
MQAELQTALFQAFNTLNLQRVKTFSVPPVTLCGLGALGACGQEAQARGVSHLFVMVDSFLHQAGMTAPLARSLAMKGVAMTVWPCPPGEPCITDVCAAVAQLREAACDGVVAFGGGSVLDAAKAVALLVTNPDQTLSAMTERSTLRPRLPLIAVPTTAGTGSETTNVTVIIDAVSGRKQVLAHASLMPDVAILDAAVTEGVPPNVTAMTGIDALTHAIEAYSALNATPFTDSLAIGAIAMIGKSLPKAVGYGQDLAARENMLLASCMAGMAFSSAGLGLCHAMAHQPGAALHIPHGQANAMLLPTVMGFNRMVCRERFSQIGRALTNKKSDDRDAIAAVCELIAEVGQSKRLADAGAKPEHYSAWAQAALEDICLRSNPRTATQAQIIDLYAAAG

SEQ ID NO: 39615 - DNA, 1113 bp, Salmonella enterica subsp. enterica serovar Typhi Ty2
  CDS (1)..(1113): transl_table=11
atgaacaccttctcactacaaacgcggttgtacagcggtcagggcagcctggcggtgctcaagcgctttaccaataagcacatctggataatctgcgatggctttctggcacgctcgccgctgctggataccctgtgtaacgcgctgcccgcagataaccgcatcagcgtctttagcgagataacgccggaccccaccatccataccgtggtgcagggcattgcgcaaatgcaggccctgcagccgcaggtggtgattggttttggcggcggctcggcaatggacgcggcgaaagcgattgtctggtttagccaacaaagcggcatcaatatcgaaacctgcgtggcgatcccgaccaccagcggcactggttcggaagtcaccagcgcctgcgtaattagcgatccggataaaggcatcaagtatccgctgttcaacaatgcgctgtatccggatatggcgatcctcgacccggagctggtggtcagcgtaccgccgcagattaccgccaacaccggcatggacgtgctgacccacgccctggaggcctgggtgtcaccgcacgccagcgactttaccgacgcgctggcggaaaaagccgccaaactggtgttccagtatctgccgacggcggtggaaaaaggcgactgcgtggcgacgcgaggaaaaatgcataacgcctcaacgctcgccgggatggccttcagccaggcggggctggggcttaaccacgcgatagcccaccagcttggcggacagtttcatcttccgcatggcctggccaatgcgctgctgctcacgacggtgatccgttttaacgccggagttccgcgcgcagccaaacgctacgcgcggctggccaaagcctgcggtttttgcccggcagaagccaacgatgtcacggcgatcaatgcgctgattcagcaaatcgaactgcttaagcaacgctgtgcccttccctcactggccgttgcgctaaaagaaggaagatccgacttttccgcacgtattccagcgatggtgcaggccgcgctggcggatgtcacgttgcgcaccaacccgcgcccggccagcgccgaggaaattcgtgaactgctggaggaactgctatga

SEQ ID NO: 39616 - protein, 370 aa, Salmonella enterica subsp. enterica serovar Typhi Ty2
MNTFSLQTRLYSGQGSLAVLKRFTNKHIWIICDGFLARSPLLDTLCNALPADNRISVFSEITPDPTIHTVVQGIAQMQALQPQVVIGFGGGSAMDAAKAIVWFSQQSGINIETCVAIPTTSGTGSEVTSACVISDPDKGIKYPLFNNALYPDMAILDPELVVSVPPQITANTGMDVLTHALEAWVSPHASDFTDALAEKAAKLVFQYLPTAVEKGDCVATRGKMHNASTLAGMAFSQAGLGLNHAIAHQLGGQFHLPHGLANALLLTTVIRFNAGVPRAAKRYARLAKACGFCPAEANDVTAINALIQQIELLKQRCALPSLAVALKEGRSDFSARIPAMVQAALADVTLRTNPRPASAEEIRELLEELL

SEQ ID NO: 39617 - DNA, 2679 bp, Salmonella enterica subsp. enterica serovar Typhi Ty2
  CDS (1)..(2679): transl_table=11
atggctgttactaatgtcgctgaacttaacgcactcgtagagcgtgtaaaaaaagcccagcgtgaatatgccagtttcactcaagaacaggtcgacaaaatcttccgcgccgccgctctggcagccgctgatgcccgcattccgctggccaaaatggccgtcgccgaatcaggtatgggtatcgtggaagacaaagtgattaaaaaccacttcgcttctgaatatatttacaatgcctataaagatgaaaaaacctgcggcgtgctgtcagaagacgacaccttcgggaccatcaccattgctgaacctatcggcattatttgcggtatcgttccaaccactaacccgacctctactgcgatcttcaaatcgctgattagcctgaagacccgtaacgccatcatcttttctccgcatccgcgcgctaaagaagcaactaacaaagcggcagacatcgttctgcaagcggctatcgctgccggcgcaccgaaagatctgattggctggatcgatcaaccttccgtagaactgtctaatgcgctgatgcaccacccggatattaacctgatcctcgccactggcggtccaggcatggttaaagctgcatacagctccggtaaaccggcaatcggcgtaggcgcaggtaacaccccggttgtcattgatgaaaccgctgatatcaaacgcgctgtggcgtctgttctgatgtctaaaaccttcgataacggcgtaatctgtgcttctgaacagtctgttgtcgttgttgattccgtctatgatgccgttcgcgaacgtttcgccagccacggcggctacatgctgcagggccaggagctgaaagcggttcaaaacgttattctgaaaaatggcgctctgaacgccgctatcgtcggtcagccagcctacaaaatcgctgaactggcaggcttctccgtaccagaaaccaccaagattctgatcggtgaagttacggtcgttgacgaaagcgaaccgttcgcacacgaaaaactgtctccgactctagcgatgtaccgtgcgaaagatttcgaagaagcggtagaaaaagcagaaaaactggtcgctatgggcggtatcggtcacacctcctgcctgtacactgaccaggataaccagccagaacgcgttgcttacttcggtcagatgatgaaaaccgcgcgtatcctgatcaacaccccggcctctcagggtggtatcggtgacctgtacaacttcaaactcgcaccttccctgacgttgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctctctgcccatcgcgctggatgaagtgattactgatggccacaaacgtgcgctcatcgtgactgaccgcttcctgttcaacaacggctatgcagaccagatcacctctgtgctgaaagcggctggcgttgaaaccgaagtcttcttcgaagttgaagcagacccgacgctttccgttgttcgcaaaggcgctgagctggctaactccttcaaaccggacgtgatcatcgcgctgggcggcggttccccgatggacgccgcgaaaatcatgtgggtcatgtacgaacatccggaaactcacttcgaagaactggcgctgcgctttatggacatccgtaaacgtatctacaagttcccgaaaatgggcgtgaaagcgaaaatgatcgccgtcaccaccacttccggtaccggttctgaagtcacaccgtttgcggttgtgaccgacaatgcaaccggtcagaaatatccgctggctgactatgccctgaccccggatatggcgattgtcgatgccaacctggtgatggatatgccgaagtccctgtgtgcgttcggtggtctggatgcggtaactcacgccctggaagcttacgtttccgtactggcttctgagttctctgacggtcaggctctgcaggctctgaaactgctgaaagaaaacctgccggcgtcttaccacgaagggtctaaaaacccggttgcgcgtgaacgtgttcacagtgcagcgactatcgccggtatcgcgtttgccaacgccttcctcggtgtatgtcactccatggcgcacaaactgggctctcagttccacattccgcacggtctggcgaacgccctgctgatttgtaacgttatccgctacaacgcgaatgacaacccgaccaagcagaccgctttcagccagtacgatcgtccgcaggcacgccgtcgttacgctgaaattgctgaccacctgggcctgagcgcgccgggcgaccgtaccgccgctaagattgaaaaactgctggcatggctggaaagcattaaagctgagctgggcattcctaagtctatacgtgaagcaggcgtgcaggaagctgacttcctggcacacgttgacaaactgtctgaagatgccttcgatgaccagtgcaccggcgctaacccgcgttatccgctgatctccgaactgaaacagattctgctggatacctactacggtcgtgatttcaccgaaggtgaagttgcagcgaagaaagacgtcgttgccgcaccgaaagcagagaaaaaagcgaaaaaatccgcttaa

SEQ ID NO: 39618 - protein, 892 aa, Salmonella enterica subsp. enterica serovar Typhi Ty2
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKEATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFASHGGYMLQGQELKAVQNVILKNGALNAAIVGQPAYKIAELAGFSVPETTKILIGEVTVVDESEPFAHEKLSPTLAMYRAKDFEEAVEKAEKLVAMGGIGHTSCLYTDQDNQPERVAYFGQMMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSVVRKGAELANSFKPDVIIALGGGSPMDAAKIMWVMYEHPETHFEELALRFMDIRKRIYKFPKMGVKAKMIAVTTTSGTGSEVTPFAVVTDNATGQKYPLADYALTPDMAIVDANLVMDMPKSLCAFGGLDAVTHALEAYVSVLASEFSDGQALQALKLLKENLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLESIKAELGIPKSIREAGVQEADFLAHVDKLSEDAFDDQCTGANPRYPLISELKQILLDTYYGRDFTEGEVAAKKDVVAAPKAEKKAKKSA

SEQ ID NO: 39619 - DNA, 1149 bp, Salmonella enterica subsp. enterica serovar Typhi Ty2
  CDS (1)..(1149): transl_table=11
atggcgaacagaatgattctgaatgaaacggcatggtttggccggggagcggtggacgcattaaccgatgaggtgacgcgccgcggttatcataaggcgctgattgttaccgataaaacgctggtgcaatgcggtgtggtcgataaggttacaagcagaatggatgccgcagggctggcgtgggagatctatgcgggcgtgatccctaatcctacgatttccgttgtccaggaagggcttaaggtctttacccaaagtggcgcggactatctcatcgccattggcggcggttctccgcaggatacctgcaaagcggtcggtattatcagtaacaatccggaatttgccgatgtgcgcagtctggaagggctatcgccgacccgtaaacccagcgtgccgattatggcgatcccgacaacggcgggaaccgcggcggaagtcactatcaattatgtgattaccgatgaagagaaacggcgcaaattcgtttgtgtcgatccgcatgatattccgcaggcggcatttatcgatgccgatatgatggacggtatgccgcccgcgctgaaagcggcaacgggcgtggatgcgctaacccatgctattgaaggctatattacccgggccgcatgggcgctgacggatgcattacatatcaaagccattgagattattgctggcgcgctgcgcggcgccgtagccggagaaaaagaggccggtgaggcgatggcgctggggcaatacgttgccgggatggggttttccaatgtggggctgggactggtgcatgggatggcgcatccgttgggcgcgttttacaacacgccgcacggcgtcgcgaatgctattttgctcccgcatgtgatgcgtttcaatgccgggtctaccaacgagaaattccgtgatatcgcccgggcgatgggggtgaaggtagaaggattgagccttgaagaggcgcgtaatgccgcagtggaagccgtatttacgctaaatcgcgatgtgggaattccgctgcatttgcgtgatgtcggcgttcgaaaagaggatatcccggcgctggcgcaggcggcgttcgatgatgtctgtacgggcggcaatccgcgtgaagcgagtctggcggacattgtcgaactgtatcataccgcctggtaa

SEQ ID NO: 39620 - protein, 382 aa, Salmonella enterica subsp. enterica serovar Typhi Ty2
MANRMILNETAWFGRGAVDALTDEVTRRGYHKALIVTDKTLVQCGVVDKVTSRMDAAGLAWEIYAGVIPNPTISVVQEGLKVFTQSGADYLIAIGGGSPQDTCKAVGIISNNPEFADVRSLEGLSPTRKPSVPIMAIPTTAGTAAEVTINYVITDEEKRRKFVCVDPHDIPQAAFIDADMMDGMPPALKAATGVDALTHAIEGYITRAAWALTDALHIKAIEIIAGALRGAVAGEKEAGEAMALGQYVAGMGFSNVGLGLVHGMAHPLGAFYNTPHGVANAILLPHVMRFNAGSTNEKFRDIARAMGVKVEGLSLEEARNAAVEAVFTLNRDVGIPLHLRDVGVRKEDIPALAQAAFDDVCTGGNPREASLADIVELYHTAW

SEQ ID NO: 39621 - DNA, 1149 bp, Salmonella enterica subsp. enterica serovar Typhi Ty2
  CDS (1)..(1149): transl_table=11
atgagctttatgttggcactgccaaaaattagcctgcatggcgctggagcgattgccgatatggtgaacctcgtggcgaataagcaatggggcaaagcgctgatcgttaccgatggtcaactggtaaagctgggcctgctggatagcctgtttagcgcactggatgaacatcaaatgtcttaccacctgtttgatgaggtgttcccaaacccgacagaagagctggtgcagaaaggttttgcggcgtatcagagcgcagaatgtgactacattatcgccttcggcggcggcagcccgatcgataccgcaaaagcggtgaaaattctgaccgccaacccaggtccatctaccgcctactccggcgtcggcaaagtgaaaaacgccggcgtaccgctggtagcgattaacactacggcaggtaccgcggcagagatgaccagcaacgcggtgattatcgactctgcccgtaaggtcaaagaggtgatcatcgacccgaatatcatcccggatattgccgtggatgacgccagcgtcatgctggaaatcccggcgtctgtgaccgccgcaaccggcatggatgccctgacccatgcggtggaagcctatgtctccgttggcgcgcatccgctcaccgacgctaacgcgctggaagcgattcgcttaatcaatgtgtggctaccgaaagcggttgacgatggtcataacctcgaagcccgtgagcaaatggcattcggccagtacctggcgggtatggcgttcaacagcgccggtttggggctggttcacgcgctggcgcaccagccgggcgcaacccacaacctgccgcacggcgtctgcaacgctatcctgctgccaattgtcgagaactttaaccgtccgaacgccgtcgcgcgttttgcccgcatcgcacaggcgatgggcgtggagacgcgcggtatgtctgacgaagtcgcaagtcaggaagcgattaacgctatccgtacgctgagcaaacgcgtcggcattccagaaggtttcagcaagctgggcgtcacaaaagaagatatcgaaggctggctggataaagccctcgccgacccgtgcgcgccgtgtaacccgcgcaccgccagccgcgatgaagttcgcgagctgtacctggaggcgttatga

SEQ ID NO: 39622 - protein, 382 aa, Salmonella enterica subsp. enterica serovar Typhi Ty2
MSFMLALPKISLHGAGAIADMVNLVANKQWGKALIVTDGQLVKLGLLDSLFSALDEHQMSYHLFDEVFPNPTEELVQKGFAAYQSAECDYIIAFGGGSPIDTAKAVKILTANPGPSTAYSGVGKVKNAGVPLVAINTTAGTAAEMTSNAVIIDSARKVKEVIIDPNIIPDIAVDDASVMLEIPASVTAATGMDALTHAVEAYVSVGAHPLTDANALEAIRLINVWLPKAVDDGHNLEAREQMAFGQYLAGMAFNSAGLGLVHALAHQPGATHNLPHGVCNAILLPIVENFNRPNAVARFARIAQAMGVETRGMSDEVASQEAINAIRTLSKRVGIPEGFSKLGVTKEDIEGWLDKALADPCAPCNPRTASRDEVRELYLEAL

SEQ ID NO: 39623 - DNA, 1155 bp, Bacteroides thetaiotaomicron VPI-5482
  CDS (1)..(1155): transl_table=11
atgaatcgcattattctgaatgagacctcttatttcggtgcaggatgccggagtgtaattgctgtggaagcagccagacgtggctttaagaaagcctttttcgtaacagataaagaccttatcaaatttggtgttgcagccgaaatcattaaagtatttgatgacaatcatattccgtatgaactttatagtgatgtaaaggctaaccctaccattgctaatgtgcagaatggtgtggctgcctataaggcttccggtgcagactttatcgtagctttgggtggtggttcttctatcgacacggcaaaggggattggtattgttgtgaataacccggattttgccgatgtgaaatctctggaaggtgtggctgataccaaacataaggctgttcctacctttgcattgcctactactgccggaactgctgctgaagtgactatcaattatgtgattatcgacgaagatgcacgcaagaaaatggtatgtgtagacccgaacgatatccctgctgtagctattgtagatccggaactgatgtattccatgccgaaaggactgactgccgctacaggtatggacgcgctgactcacgccatcgaaagttatataactccgggtgcatgggctatgagcgatatgttcgaactgaaagcgattgaaatgattgctcagaacttgaaagcagcggtagataacggtaaagacacagttgcccgcgaagcaatgtcgcaggctcaatatattgccggcatgggattctccaatgtaggtttgggaatcgtacattccatggctcacccgttgggcgctttctatgatactcctcacggcgttgccaatgcgctgttgttaccttatgtcatggagtacaatgctgagtctccggctgctccgaaatatatccatattgccaaggcgatgggcgtcaatacagacggtatgacagaaactgaaggtgtgaaggcggctatcgaggcagtgaaagcgctttctctgagtatcggtatcccacagaaattgcatgaaatcaatgtgaaggaagaggatattccggcattggcggtggctgcattcaatgacgtttgcacaggtggtaatccgcgtcctacgtcagtagcggagattgaagtattatatcggaaagcattctga

SEQ ID NO: 39624 - protein, 384 aa, Bacteroides thetaiotaomicron VPI-5482
MNRIILNETSYFGAGCRSVIAVEAARRGFKKAFFVTDKDLIKFGVAAEIIKVFDDNHIPYELYSDVKANPTIANVQNGVAAYKASGADFIVALGGGSSIDTAKGIGIVVNNPDFADVKSLEGVADTKHKAVPTFALPTTAGTAAEVTINYVIIDEDARKKMVCVDPNDIPAVAIVDPELMYSMPKGLTAATGMDALTHAIESYITPGAWAMSDMFELKAIEMIAQNLKAAVDNGKDTVAREAMSQAQYIAGMGFSNVGLGIVHSMAHPLGAFYDTPHGVANALLLPYVMEYNAESPAAPKYIHIAKAMGVNTDGMTETEGVKAAIEAVKALSLSIGIPQKLHEINVKEEDIPALAVAAFNDVCTGGNPRPTSVAEIEVLYRKAF

SEQ ID NO: 39625 - DNA, 1131 bp, Enterococcus faecalis V583
  CDS (1)..(1131): transl_table=11
atgaaaacaattcatttccctaccgaactatgggtaggagaaggcgcattagccaatttggaaacacttcatgatagacgtgttttcattgtcacagatccattcatggttgactctggatttgtgaatgaagtgacaaagcatttaacaaaaagtgaatggcaaatttttagtgatatcatccccgatccaccaattgataagattgctgcgggaattaagcatttagcgacatttcaaggagatacgatattagctttaggtgggggatccgctattgatgcggccaaagcaatgaaattttttggcaaacgtactttgcaaactcagattgctgagtttattgcggttcctacaactagtggaactggttcagaagttacgaatttttcagtgattacggttgctgaaactggcaccaaaatcccgcttgtaacggatgaaattcaaccagaaattgcgattttagatacaaatttagtgatgagtgtcccaccaaaaatcacagcggatacaggaatggacgtcttaacgcatgttattgaagcgtatgtttcaacagaagcaaatccgatttcagatgcgttgtgcgaaaaagtcgttcgcttagtattcgacaatttagaaatagcctttaatgagggtagcaaccaacaagcccgtgaaaatatgcatttagcttcatgtatggcagggatggcgtttaatgttacttcgttaggcttgaatcacggtattgctcatgcggccggtgcacgtttacatgtgccacatggacgaatgaatgcaatgctcttacctgaagtcattgcatataacagtggcttagcgaatggcaaagtcaccaacgaaccaacagctaaacgttatgcgcagttagcaaattgtctaaatgatacacagacaaccaatgcacggattggtgttcaacaatttattcgacaaatcaagcaactccgtcaaaaattaaacatgcctgccacttttagtgactatggtttaccaaaagaagaagtccaggctgcaatcccaaaaatagctgaaggcgcattgatggatggctgcaccaaaacaaatcctgtccaaccaacagcagcagaagtgacaaaaattttaaattctatcttataa

SEQ ID NO: 39626 - protein, 376 aa, Enterococcus faecalis V583
MKTIHFPTELWVGEGALANLETLHDRRVFIVTDPFMVDSGFVNEVTKHLTKSEWQIFSDIIPDPPIDKIAAGIKHLATFQGDTILALGGGSAIDAAKAMKFFGKRTLQTQIAEFIAVPTTSGTGSEVTNFSVITVAETGTKIPLVTDEIQPEIAILDTNLVMSVPPKITADTGMDVLTHVIEAYVSTEANPISDALCEKVVRLVFDNLEIAFNEGSNQQARENMHLASCMAGMAFNVTSLGLNHGIAHAAGARLHVPHGRMNAMLLPEVIAYNSGLANGKVTNEPTAKRYAQLANCLNDTQTTNARIGVQQFIRQIKQLRQKLNMPATFSDYGLPKEEVQAAIPKIAEGALMDGCTKTNPVQPTAAEVTKILNSIL

SEQ ID NO: 39627 - DNA, 1203 bp, Bacillus cereus ATCC 14579
  CDS (1)..(1203): transl_table=11
ttgcaagaggtttctgagtttcgtatgccaaagtcggtattatatggaaggaattcgcttgaaaaactgggagaacaatcaaaaaagttagggaaaagagcttttatagttactgatacaattatggagaaattaggatatgttgaaaagtgtatgcaacaactaaataagaaaggtattactgttagtacatataataaagtggatgctgagcctacaaatatacacgtattagaagcgttatctctttgtaaagaggaaaagtgcgattttattatcggtattggtggtggaagttgtattgatgctgcgaaagcggtagcggttttatatacaaatggtggagaagttgaggattatgtccaaaaggatattaaaatagaaaacaagccactaccacttattgcaattccaacaacttctggtactggatcggaagttacaagtgtagcagtaattacgaataaaaaaacagatgtaaaaatgatgatgaagcatcctagttttataccgaaagtagcaattatagatccagttttgacaagttcgttacccccacaaattacggcagcaacaggaatagatgcgttatgtcatgcgattgaagcttatatttctaaattttcacaaccacttacagatgtacttgctctttcagctattgaaagtattatgaaatatttacgtatagcatatgaagatggacgtaatatggaggcaagagaagcgatgatgattgcttctttacaagctggaattgcattttctaatgcatcagttacattagttcatggaatgtcaaggccagtgggagcattatttcatgtaccgcatggaatatcaaatgccatactattacctacagtgttagagtttacaaaaacaagtgcaatgaaaaggttagcaaaaattggacgtagtttaaataaggatttgtattcgaattctgatgaggaagtagcagactacacacttggtgaaataaaaaaactttgctttgatcttcgtattccaaatttaaaagaatacggaatcgatgaaattgaatttgaaaatgctatttctaaaatggcatcagatgcaattgaaagtggtagcccagctaataacccacgtgttccatcatatgatgaaatcaaagagctgtatcgagagtgttttaattataagtataaagaatttataaaaacatcagattgttaa

SEQ ID NO: 39628 - protein, 400 aa, Bacillus cereus ATCC 14579
MQEVSEFRMPKSVLYGRNSLEKLGEQSKKLGKRAFIVTDTIMEKLGYVEKCMQQLNKKGITVSTYNKVDAEPTNIHVLEALSLCKEEKCDFIIGIGGGSCIDAAKAVAVLYTNGGEVEDYVQKDIKIENKPLPLIAIPTTSGTGSEVTSVAVITNKKTDVKMMMKHPSFIPKVAIIDPVLTSSLPPQITAATGIDALCHAIEAYISKFSQPLTDVLALSAIESIMKYLRIAYEDGRNMEAREAMMIASLQAGIAFSNASVTLVHGMSRPVGALFHVPHGISNAILLPTVLEFTKTSAMKRLAKIGRSLNKDLYSNSDEEVADYTLGEIKKLCFDLRIPNLKEYGIDEIEFENAISKMASDAIESGSPANNPRVPSYDEIKELYRECFNYKYKEFIKTSDC

SEQ ID NO: 39629 - DNA, 2604 bp, Bacillus cereus ATCC 14579
  CDS (1)..(2604): transl_table=11
atggtagtcaaagagaaagttgtaaatgaaatgcaggaagtaaaaaagatgattgatacactagtaaataatggtcaacaagctttacaagcattagaaagttttacacaagaggaaattgacaacattgttcatgaaatggcattagcaggtgttgatcaacatatgccgctagcaaaattggcagttgaagaaactggccgtggtgtatatgaagacaaatgcattaaaaatatttttgccactgaatatatttggcatagtataaaacaagataaaacggtaggaattattcacgaagattctcatgaagaaataatagaaatcgcggaacctgtcggtgtagtagctggggtaacaccagtaacgaatccaacgtcgacaacaatgtttaaagcgttaattgcgataaaaacaagaaatccaattattttcgcgtttcatccttccgcacaaaaatgttctgtggcagcggcgaaaacagtatatgatgcagcgatgaaagctggtgcaccaaaacactgtattcaatggattgaaagaccgtctgttgaagcgacgaaacaattaatgaaccatgatggtgtagcactcgttctagcaactggaggcgctggtatggtgaaatcagcttactctactggaaaaccagcgttaggcgttgggcctggtaatgtaccgtgttatatagaaaaatcagcacatgtaaaacgagctgttaatgatttaattttatcgaaaacatttgataacggtatgatttgtgcatcggaacaagcaatcattgtcgataaagaaatctatgatgatgttaaaacagaaatgattgaaaacaattgttactttgtaacagaagaagaaagaaaaaaattagaaaagcttgttataaatgaaaatacatgtgcagtaaatagtgatattgtagggaaatcagcacagtatattgccgatttagttgggattactgttcctgaacatacaaaaatgcttgtagctgaaattcaaggtatcggagcagcatatccgttatctcgtgagaaactgagtccagtattagcttgtgtgaaggcgaattcattagaagaaggatttacatattgcgaagaaatgttgaacctaggtggtttaggacattcagcagttatccattctacaaataaagatgtgcaaaagcaatttgggttacgtatgaaagcttgccgtctcattgtaaatgcaccttcatcacaaggtggaataggggatatatataatggatttattccatcacttacacttggttgtggttcatacggaaagaattcagtttcccaaaatgtaacagccactcatttattaaatataaaaaggctggcaaatagaaaaaagaatatgcagtggttcaaattgccaccaaaaatttattttgaaaaacatgctacagcttatttagcaaatatgcctaacatttcacgtgcatttattgtaacggaccctggaatggttgaacatggctatgtcgatacagtcgcgcactatttaaacaagcatgcaaatgatgtgaaagttgaagttttctttgaggtcgaaccagatccatcagatgaaactgtttttaaaggtgcggaaatgatgagaagctttaagccagatgtaattatcgcacttggtggtggttcagctatggatgcagcaaaaggaatgtggttattctatgagcatccagaaacgacattctatggcattaaacagaagtttttagatataagaaaacgtacatgtaaatatccggaattaggaaataaggcgcagtttgttgcgattccaacgacatcaggaacgggatcagaagtgacaccatttgcggttattacagataagaaaaataatataaagtatccgcttgcagattatgaattaacaccagatgtagcaattgttgatccgcaatttgtaatgacagtaccaccacatgtaacagcagatactggtatggatgttttaacacatgcaattgaggcgtatgtgtctgttatggcaaatgactatacagatggattagcattaaaagctattgatctcgtattcaaatatttaccgagagcatataaagatggaaatgatgaagaagcaagagaaaaaatgcataacgcttctgcaattgcaggtatggcatttgcaaatgctttcctcggtattaatcacagcttagcacataaaattggaccagaattccatattccgcacggacgcgcaaatgccattctaatgccgcatgtagtccgctataatgctattaagccaagaaaacacgcattgttcccaaaatatgagcactttgtggcagatgaaagatatgcacatatagcgagaatgctcgggcttccagcaagctcggcagcagaaggggtggaatcactcgtcaaagcaattattgagcttggaaaaagcttaaatattaatatgagtattgcaggacaaggagtagataaagagcaatttgaagaggttgttggagtattagcagaaagagcttttgaagatcaatgtacaactgctaatccaaagttgccgcttatttcagaactgaaagaaatttatatgaaagcatataaaggtgaataa

SEQ ID NO: 39630 - protein, 867 aa, Bacillus cereus ATCC 14579
MVVKEKVVNEMQEVKKMIDTLVNNGQQALQALESFTQEEIDNIVHEMALAGVDQHMPLAKLAVEETGRGVYEDKCIKNIFATEYIWHSIKQDKTVGIIHEDSHEEIIEIAEPVGVVAGVTPVTNPTSTTMFKALIAIKTRNPIIFAFHPSAQKCSVAAAKTVYDAAMKAGAPKHCIQWIERPSVEATKQLMNHDGVALVLATGGAGMVKSAYSTGKPALGVGPGNVPCYIEKSAHVKRAVNDLILSKTFDNGMICASEQAIIVDKEIYDDVKTEMIENNCYFVTEEERKKLEKLVINENTCAVNSDIVGKSAQYIADLVGITVPEHTKMLVAEIQGIGAAYPLSREKLSPVLACVKANSLEEGFTYCEEMLNLGGLGHSAVIHSTNKDVQKQFGLRMKACRLIVNAPSSQGGIGDIYNGFIPSLTLGCGSYGKNSVSQNVTATHLLNIKRLANRKKNMQWFKLPPKIYFEKHATAYLANMPNISRAFIVTDPGMVEHGYVDTVAHYLNKHANDVKVEVFFEVEPDPSDETVFKGAEMMRSFKPDVIIALGGGSAMDAAKGMWLFYEHPETTFYGIKQKFLDIRKRTCKYPELGNKAQFVAIPTTSGTGSEVTPFAVITDKKNNIKYPLADYELTPDVAIVDPQFVMTVPPHVTADTGMDVLTHAIEAYVSVMANDYTDGLALKAIDLVFKYLPRAYKDGNDEEAREKMHNASAIAGMAFANAFLGINHSLAHKIGPEFHIPHGRANAILMPHVVRYNAIKPRKHALFPKYEHFVADERYAHIARMLGLPASSAAEGVESLVKAIIELGKSLNINMSIAGQGVDKEQFEEVVGVLAERAFEDQCTTANPKLPLISELKEIYMKAYKGE

SEQ ID NO: 39631 - DNA, 1155 bp, Bordetella pertussis Tohama I
  CDS (1)..(1155): transl_table=11
gtggcgatgtttgagttctgtacgcatgcgaggacgctggttggcgctggcgccagcgacgccctgggagagacgctggcggcccggtggggcgcgagccgcgtcctgctggtgacggacggcgcgctggtttcactgggcctggcgggccggctgcgcgacgcgctgaccagcgcgggccatacggtggccatgttcgatgaggtggtcgcggatccgccggagtcggtggtcgagcgcgccatcacggcggcgcgcgatgcccgggcccagatgatcgtgggctttggcggaggttcttcgatggatgtggccaagctggctgccgcattcgccgggacgacgcaggacttgcgccaagcctatggcataggcctggtcgcggggccgcgcttgccgctggtgcaggtgccgaccacggcgggcaccggctcggaggccacgccgatcgccgtcgtgacgaccggcgagggcgccaaggccggcgtcatctcgcccgtgctgtacgccgacctggccgtcctggacgcctccttgacgctgggcctgccgccggccatcaccgcggccaccggtatcgatgccatggtgcacgcgaccgaagcatataccagccgggtgctcaagaatcccatttccgacgccctggcgcgcgaagcgttgcggttgctgtttcgcgcgttgccggtcgcttgccgcgacggcggcgacctggcggcgcggcaggacatgctgctgggcgcgatgctggcgggccaggcgttcgccaatgcgccggtgggcgccgtgcatgcgctggcctatccgttgggcagcgcattccatgtgccgcacgggctgtccaattccctggtgctggggccggtgctgcggttcaattcgctgcgttgcgagacccagtacgcggagctggcggacgtgatcctgccggggcatgccggcggcgtggcggaaaaggccgccgcgttcgtgcaggcgatggccgaggtggcaggggcgctggaactgccgacgcggctggcgcaggtcggcgtcacggcggcggacatcccggcgctggccgggctggccctgcagcaacagcgcctgctggcgaacaatccgcgcgatgtcacgctggccgacgccacgcgactctacgaagaggcgttctga

SEQ ID NO: 39632 - protein, 384 aa, Bordetella pertussis Tohama I
MAMFEFCTHARTLVGAGASDALGETLAARWGASRVLLVTDGALVSLGLAGRLRDALTSAGHTVAMFDEVVADPPESVVERAITAARDARAQMIVGFGGGSSMDVAKLAAAFAGTTQDLRQAYGIGLVAGPRLPLVQVPTTAGTGSEATPIAVVTTGEGAKAGVISPVLYADLAVLDASLTLGLPPAITAATGIDAMVHATEAYTSRVLKNPISDALAREALRLLFRALPVACRDGGDLAARQDMLLGAMLAGQAFANAPVGAVHALAYPLGSAFHVPHGLSNSLVLGPVLRFNSLRCETQYAELADVILPGHAGGVAEKAAAFVQAMAEVAGALELPTRLAQVGVTAADIPALAGLALQQQRLLANNPRDVTLADATRLYEEAF

SEQ ID NO: 39633 - DNA, 1155 bp, Bordetella parapertussis 12822
  CDS (1)..(1155): transl_table=11
atgaacggattcgagtttcggacacatgcccgcacgctggcgggcgaggggacctcgcaacggttgggcgaggcggtcgcggcgcaatgggggccgtgccgcatcctggtcgtcacggacgagcagctggtgcggctgggtctggtcgcggccctggcgcaaagcctgcgcgacgccggtcacacggtccaggtctacgacggcgtgctggccgatccgcccgaagcggtggtgagccaggcgatcgcgcggggccgggaaacggacgtgcaatgcgtgatcggcttcggcggcggctcgtcgatggatatcgcgaaactggtggcggcgttcgccggctccgcggccgactttcgcgacagctacggcatcgaccgcgtcgccacggcgcgcctgccgctggtgcaggtgccgaccacggccggcaccggctcggaagccacgcccatcgccatcgtgacccgcgaggacgcctccaaggcgggcattgtctcccccgtcctgtactgcgacatcgccgtactggatgccgcgttgacccggggcctgccgccggccgtgaccgccgccaccggcatcgacgccatcgtgcacgccgtcgaggcctataccagccggctgcgcaagaacccgatctccgatggcctggcgcgccaggcgttgcgcctgctgtgccgttccatcggccccgcatgccgcgacggcgccgacatggcggcccgccatgacatgttgctgggcgcgatgctggcggggcaggcgttcgccaatgcgccggtggcggccgtgcatgcgctggcctatccgctgggcggcgttttccacgtgccgcacggcctgtccaatgcattgatgttcggcgcggtgctgcgtttcaacctgccgcaggccggcgccgcctatgcccagcttgcgcagatcgcttgtccgcaggtggacggcccgcagcaggcgcgcgccgaaggattcgtgcaggaaatggccagcctggggccgcgtctggggctgccgcggcgcctggccgaagtcggggtggccgaacgcgatctgcccatgctcgcgcaacaggccatgcagcaacagcgtttgctggtcaacaaccccagggagctcggctacgacgacgccttgcgcctttaccgggaggcgctgtga

SEQ ID NO: 39634 - protein, 384 aa, Bordetella parapertussis 12822
MNGFEFRTHARTLAGEGTSQRLGEAVAAQWGPCRILVVTDEQLVRLGLVAALAQSLRDAGHTVQVYDGVLADPPEAVVSQAIARGRETDVQCVIGFGGGSSMDIAKLVAAFAGSAADFRDSYGIDRVATARLPLVQVPTTAGTGSEATPIAIVTREDASKAGIVSPVLYCDIAVLDAALTRGLPPAVTAATGIDAIVHAVEAYTSRLRKNPISDGLARQALRLLCRSIGPACRDGADMAARHDMLLGAMLAGQAFANAPVAAVHALAYPLGGVFHVPHGLSNALMFGAVLRFNLPQAGAAYAQLAQIACPQVDGPQQARAEGFVQEMASLGPRLGLPRRLAEVGVAERDLPMLAQQAMQQQRLLVNNPRELGYDDALRLYREAL

SEQ ID NO: 39635 - DNA, 1149 bp, Bordetella parapertussis 12822
  CDS (1)..(1149): transl_table=11
atgtttgagttctgtacgcatgcgaggacgctggtcggcgctggcgccagcgacgccctgggagagacgctggcggcccgatggggcgccagccgcgtcctgctggtgacggatggcgcgctggtttcactgggcctggcgggccggctgcgcgacgcgctggccagcgcgggccatacggtggccatgttcgatgaggtggtcgcggatccgccggagtcggtggtcgagcgcgccatcattgcggcgcgcgatgcccgggcccaggtgatcgtgggctttggtggcggttcttcgatggatgtggccaagctggctgccgcattcgccgggacgacgcaggacttgcgccaagcctatggcataggcctggtcgcggggccgcgcttgccgctggtgcaggtgccgaccacggcgggcaccggctcggaggccacgccgatcgccgtcgtgacgaccggcgatggcgccaaggccggcgtcatctcgcctgtgctgtatgccgacctggccgtcctggacgccaccttgacgctgggcctgccgccggccatcaccgcggccaccggtatcgacgccatggtgcacgcgaccgaggcatataccagccgggtgctcaagaatcccatttccgacgccctggcgcgcgaagcgttgcggttgctgtttcgcgcgttgccgctcgcctgccgcgacggcggcgacctggcggcgcggcaggacatgctgctgggcgcgatgctggcgggccaggcgttcgccaatgcgccggtgggcgccgtgcatgcgctggcctatccgttgggcagcgcattccatgtgccgcacgggctgtccaactccctggtgctggggccggtgctgcggttcaattcgctgcgttgcgagacccagtacgcggagctggcggacgtgatcctgccggggtatgccgacggcgtggcggaaaaggccgccgcgttcgtgcaggcgatggccgaggtggcgggggcgctggaactgccgacgcggctggcgcaggtcggcgtcacggcggcggacatcccggcgctggccgggctggccctgcagcaacagcgcctgttggggaacaatccgcgcgatgtcacgctggccgacgccacgcgactctacgaagaggcgttctga

SEQ ID NO: 39636 - protein, 382 aa, Bordetella parapertussis 12822
MFEFCTHARTLVGAGASDALGETLAARWGASRVLLVTDGALVSLGLAGRLRDALASAGHTVAMFDEVVADPPESVVERAIIAARDARAQVIVGFGGGSSMDVAKLAAAFAGTTQDLRQAYGIGLVAGPRLPLVQVPTTAGTGSEATPIAVVTTGDGAKAGVISPVLYADLAVLDATLTLGLPPAITAATGIDAMVHATEAYTSRVLKNPISDALAREALRLLFRALPLACRDGGDLAARQDMLLGAMLAGQAFANAPVGAVHALAYPLGSAFHVPHGLSNSLVLGPVLRFNSLRCETQYAELADVILPGYADGVAEKAAAFVQAMAEVAGALELPTRLAQVGVTAADIPALAGLALQQQRLLGNNPRDVTLADATRLYEEAF

SEQ ID NO: 39637 - DNA, 1155 bp, Bordetella bronchiseptica RB50
  CDS (1)..(1155): transl_table=11
atgaacggattcgagtttcggacacatgcccgcacgctggcgggcgagggggcctcgcaacggttgggcgaggcggtcgcggcgcaatgggggccgtgccgcatcctggtcgtcacggacgagcagctggtgcggctgggcctggtcgcggccctggcgcaaagcctgcgcgacgccggccacacggtccaggtctacgacggcgtgctggccgatccgcccgaagcggtggtgagccaggcgatcgcgcggggccgggaaacggacgtgcaatgcgtgatcggcttcggcggcggctcgtcgatggatatcgcgaaactggtggcggcgttcgccggctccgcggccgactttcgcgacagctacggcatcgaccgcgtcgccacggcgcgcctgccgctggtgcaggtgccgaccacggccggcaccggctcggaagccacgcccatcgccatcgtgacccgcgaggacgcctccaaggcgggcattgtctcccccgtcctgtactgcgacatcgccgtactggatgccgcgttgacccggggcctgccgccggccgtgaccgccgccaccggcatcgacgccatcgtgcacgccgtcgaggcctataccagccggctgcgcaagaacccgatctccgatggcctggcgcgcgaggcgttgcgcctgctgtgccgttccatcggccccgcatgccgcgacggcgccgacatggcggcccgccatgacatgttgctgggcgcgatgctggcggggcaggcgttcgccaatgcgccggtggcggccgtgcatgcgctggcctatccgctgggcggcgttttccacgtgccgcacggcctgtccaatgcattgatgttcggcgcggtgctgcgtttcaacctgccgcaggccggcgccgcctatgcccagcttgcgcagatcgcctgtccgcaggtcgacggcccgcagcaggcgcgcgccgaaggattcgtgcaggaaatggccggcctggggccgcgtctggggctgccgcggcgcctggccgaagtcggggtggccgaacgcgatctgcccatgctcgcgcaacaggccatgcagcaacagcgtttgctggtcaacaaccccagggagctcggctacgacgacgccttgcgcctttaccgggaggcgttgtga

SEQ ID NO: 39638 - protein, 384 aa, Bordetella bronchiseptica RB50
MNGFEFRTHARTLAGEGASQRLGEAVAAQWGPCRILVVTDEQLVRLGLVAALAQSLRDAGHTVQVYDGVLADPPEAVVSQAIARGRETDVQCVIGFGGGSSMDIAKLVAAFAGSAADFRDSYGIDRVATARLPLVQVPTTAGTGSEATPIAIVTREDASKAGIVSPVLYCDIAVLDAALTRGLPPAVTAATGIDAIVHAVEAYTSRLRKNPISDGLAREALRLLCRSIGPACRDGADMAARHDMLLGAMLAGQAFANAPVAAVHALAYPLGGVFHVPHGLSNALMFGAVLRFNLPQAGAAYAQLAQIACPQVDGPQQARAEGFVQEMAGLGPRLGLPRRLAEVGVAERDLPMLAQQAMQQQRLLVNNPRELGYDDALRLYREAL

SEQ ID NO: 39639 - DNA, 1149 bp, Bordetella bronchiseptica RB50
  CDS (1)..(1149): transl_table=11
atgtttgagttctgtacgcatgcgaggacgctggtcggcgctggcgccagcgacgccctgggagagacgctggcggcccgatggggcgccagccgcgtcctgctggtgacggacggcgcgctggtttcactgggcctggcgggccggctgcgcgacgcgctggccagcgcgggccatacggtggccatgttcgatgaggtggtcgcggatccgccggagtcggtggtcgagcgcgccatcattgcggcgcgcgatgcccgggcccaggtgatcgtgggctttggcggcggttcttcgatggatgtggccaagctggctgccgcattcgccgggacgacgcaggacttgcgccaagcctatggcataggcctggtcgcggggccgcgcttgccgctggtgcaggtgccgaccacggcgggcaccggctcggaggccacgccgatcgccgtcgtgacgaccggcgatggcgccaaggccggcgtcatctcgcccgtgctgtatgccgacctggccgtcctggacgccaccttgacgctgggcctgccgccggccatcaccgcggccaccggtatcgacgccatggtgcacgcgaccgaggcatataccagtcgggtgctcaagaatcccatttccgacgccctggcgcgcgaagcgttgcggttgctgtttcgcgcgttgccgctcgcctgccgcgacggcggcgacctggcggcgcggcaggacatgctgctgggcgcgatgctggcgggccaggcgttcgccaatgcgccggtgggtgccgtgcatgcgctggcctatccgttgggcagcgcattccatgtgccgcacgggctgtccaactccctggtgctggggccggtgctgcggttcaattcgctgcgttgcgagacccagtacgcggagctggcggacgtgatcctgccggggtatgccggtggcgtggcggaaaaggccgccgcgttcgtgcaggcgatggccgaggtggcgggggcgctggaactgccgacgcggctggcgcaggtcggcgtcacggcggcggacatcccggcgctggccgggctggccctgcagcaacagcgcctgttggggaacaatccgcgcgatgtcacgctggccgacgccacgcgactctacgaagaggcgttctga

SEQ ID NO: 39640 - protein, 382 aa, Bordetella bronchiseptica RB50
MFEFCTHARTLVGAGASDALGETLAARWGASRVLLVTDGALVSLGLAGRLRDALASAGHTVAMFDEVVADPPESVVERAIIAARDARAQVIVGFGGGSSMDVAKLAAAFAGTTQDLRQAYGIGLVAGPRLPLVQVPTTAGTGSEATPIAVVTTGDGAKAGVISPVLYADLAVLDATLTLGLPPAITAATGIDAMVHATEAYTSRVLKNPISDALAREALRLLFRALPLACRDGGDLAARQDMLLGAMLAGQAFANAPVGAVHALAYPLGSAFHVPHGLSNSLVLGPVLRFNSLRCETQYAELADVILPGYAGGVAEKAAAFVQAMAEVAGALELPTRLAQVGVTAADIPALAGLALQQQRLLGNNPRDVTLADATRLYEEAF

SEQ ID NO: 39641 - DNA, 2664 bp, Chromobacterium violaceum ATCC 12472
  CDS (1)..(2664): transl_table=11
atggcagtcagcaatcaaatcgaactcgacgccctggtggcccgcgtcaagaaggcccagaccgcgttcgcgcagttcactcaggagcaggtcgaccacatcttccgctgcgcggcgctggccgccgccgacgcccgcatcccgctggcgcggatggccgtcgccgaaaccggcatgggcgtgatggaagacaaggtgatcaagaaccacttcgcctccgagtacatctacaacaagtacaaggacgagaagacctgcggcgtgctgtccgaggacgacaccttcggcaccatcaccatcgccgagccgatcggcgtgctgtgcggcatcgtgcccaccaccaacccgacctccaccgccatcttcaaggcgctgatctcgctgaagacccgcaacggcatcatcttctcgccgcacccgcgcgcgcgccgctccacctgcgaggccgcccgcctggtgctggaggccgccgtcgccgccggcgcgccgcaggacatcatcggctggatcgacgagccttcggtcgcgctgtccaaccagctgatgcaccaccccgacgtcaacctgatcctggccaccggcggcccgggcatggtgaaggccgcctactcctccggcaagcccgccatcggcgtcggcgccggcaacaccccggcggtgatagacgaaaccgccgacatcaagcgcgcggtcgcctccatcctgatgtccaagaccttcgacaacggcgtggtgtgcgcgtccgagcagtcggtgatcatcgtcgacgagatctacgacgcggtgcgcgagcgcttctccaagcacggcggctacatcctgaaggggagcgaagccgaggcggtgcgcaaggtgatcctgcaggacggcagcctgaacgccgccatcgtcggccagagcgccgccaagatcgccgccatggccggcatcgaagtgccgccgaccaccaaagtgctgatcggcgaagtgacggaagtgtcggagaaggaggccttcgcccacgaaaagctgtcgccgaccctggccatgtaccgcgccaaggacttcctcgacgcctgcgacaaggccgccgcgctggtgaccatgggcggcatcggccacacctcggcgctgtataccgaccaggacctgcaggaagaacgcgtgcgctacttcggcgacaagatgaagaccgcccgcatcctgatcaacaccccgtcctcgcaaggcggcatcggcgacctgtacaacttcagcctggcgccgtcgctgacgctgggctgcggttcctggggcggcaactccatctccgagaacgtcggtcccaagcacctgatcaacaagaaaaccgtcgccaagagggctgaaaacatgctgtggcacaagctgccgaagtccatttacttccgccgcggctgtctgccggtggcgctggaagacctggccggcaagaaacgctgcctgatcgtcaccggccagtacctgttcgagaacggcttcgtcgacgagccgatccgcctgctgaagaaaatgggcctggaggtggaaaccttcttcgaagtgcccgccgatccgacgctggccgtggtgcgcaagggcgcagaactggcccacgccttcaagcccgacgtgatcatggccatcggcggcggctcgccgatggacgcggccaagatcatgtgggtgatgtacgagcatccggaagtgcacttcgccgatctggcgctgcgcttcatggacatccgcaagcgcatctaccagttcccgaaactgggccagaaagccatgatggtggccgtgccgacgacctcgggcaccggctcggaagtgaccccgttcgcggtggtgaccgacgaggtgaccggcgtgaagtacccgatcgccgactacgagctgacgccgaacatggccatcgtcgacgccaacctggtgatgagcatgcccaagtcgctgaccgccttcggcggcatcgacgccgtcacccacgcgctggaagcgtatgtctcggtgatggccaacgagtactccgacccgcaggcgctgcaggccctgaaactcttgaaggaatacctgccgtcgtcctacctgaacggcgccaacgatcccaaggcgcgcgagcaggtgcacaacgccgccaccatcgccggcgtcgccttcgccaacgccttcctgggcgtctgccactcgatggcgcacaagatcggcgcggagttcggcctggcgcacggcctggccaacgcgctcttgatcagcaatgtgatccgctacaacgccgccgacgtgccgaccaagcagaccgcgttcagccagtacgaccgaccgaagagcgtggcgcgctacgccgagatcgcccgccacctgggcctggaagccagccgcgaccatcagcgcgtggaaaagctgatcgagtgggtggacgagttgaagaagaccctgggcatcccggcttccatccaggccgcgggcgtcgccgagtccgatttcctggccaaggtggatgaagtggccgaagccgctttcgacgaccagtgcaccggcgccaacccgcgctacccgctgatcagcgagctgaagcagctcttgctcgacagcttctatggccgcccgtacaaggaagcctgggagcgcgacgaggccgccgtggaagacaagccggccaagggcaagtccaaagccaaggcctga

SEQ ID NO: 39642 - protein, 887 aa, Chromobacterium violaceum ATCC 12472
MAVSNQIELDALVARVKKAQTAFAQFTQEQVDHIFRCAALAAADARIPLARMAVAETGMGVMEDKVIKNHFASEYIYNKYKDEKTCGVLSEDDTFGTITIAEPIGVLCGIVPTTNPTSTAIFKALISLKTRNGIIFSPHPRARRSTCEAARLVLEAAVAAGAPQDIIGWIDEPSVALSNQLMHHPDVNLILATGGPGMVKAAYSSGKPAIGVGAGNTPAVIDETADIKRAVASILMSKTFDNGVVCASEQSVIIVDEIYDAVRERFSKHGGYILKGSEAEAVRKVILQDGSLNAAIVGQSAAKIAAMAGIEVPPTTKVLIGEVTEVSEKEAFAHEKLSPTLAMYRAKDFLDACDKAAALVTMGGIGHTSALYTDQDLQEERVRYFGDKMKTARILINTPSSQGGIGDLYNFSLAPSLTLGCGSWGGNSISENVGPKHLINKKTVAKRAENMLWHKLPKSIYFRRGCLPVALEDLAGKKRCLIVTGQYLFENGFVDEPIRLLKKMGLEVETFFEVPADPTLAVVRKGAELAHAFKPDVIMAIGGGSPMDAAKIMWVMYEHPEVHFADLALRFMDIRKRIYQFPKLGQKAMMVAVPTTSGTGSEVTPFAVVTDEVTGVKYPIADYELTPNMAIVDANLVMSMPKSLTAFGGIDAVTHALEAYVSVMANEYSDPQALQALKLLKEYLPSSYLNGANDPKAREQVHNAATIAGVAFANAFLGVCHSMAHKIGAEFGLAHGLANALLISNVIRYNAADVPTKQTAFSQYDRPKSVARYAEIARHLGLEASRDHQRVEKLIEWVDELKKTLGIPASIQAAGVAESDFLAKVDEVAEAAFDDQCTGANPRYPLISELKQLLLDSFYGRPYKEAWERDEAAVEDKPAKGKSKAKA

SEQ ID NO: 39643 - DNA, 1134 bp, Chromobacterium violaceum ATCC 12472
  CDS (1)..(1134): transl_table=11
atgagcacaagcgctttcttcatcccctcgctgaacctgatgggcgcgggctgtctgcaacaggccgtcgacgcgatgcgcggccacggtttccgccgcgcgctgatcgtcaccgaccagggcctggtcaaggccggcctggccgccaaggtggccgacatgctgggcaaggccgacatcgaaccggtgatcttcgacggcgtccatcccaatcccagctgcgccaatgtcaacgccggtctggcgctgctcaaggaaaagcagtgcgacgtggtggtgtcgctgggcggcggctcgccgcacgactgcgccaaaggcatcgcgctggtggcggtgaacggcggcaagatccaggactacgagggcgtggacaagtcggccaagccgcagctgccgctggtggcgatcaacaccaccgcaggcaccgcgtccgaaatgacccgcttctgcatcatcaccgacgagtcgcgccatatcaagatggccatcgtcgacaagcacaccacgcccatcctgtcggtcaacgatccggaaaccatggccggcatgccggcctcgctgaccgccgccaccggcatggacgcgctgacccacgcggtggaagcctatgtgtccactatcgccacccccatcaccgacgcctgcgccttgaaggcggtggaactgatcgccggcttcctgcgccgcgcggtgaaggacggcaaggacatggaagcgcgcgagcaaatggcttacgcccagttcctggccggcatggccttcaacaacgcctcgctgggctatgtgcacgcgatggcgcaccagctgggcggcttctacgacctgccgcacggcgtgtgcaacgcggtgctgctgccgcatgtgcaggccttcaacgcagcctcggccggagagcggctgggcgacgtggccatcgcgctgggcgagaagacacgcagcgcccaggcggccatcgcggcgatcaagcgcctggcggcggatgtcggcattccggcaggcttgagggagctgggcgtcaaggaggcggatatcccgacgctggcggacaacgcgctgaaggatgcctgcggtttcaccaatccgcgcaagggcagccatgaggatgtctgcgcgatcttccgcgccgcgatgtag

SEQ ID NO: 39644 - protein, 377 aa, Chromobacterium violaceum ATCC 12472
MSTSAFFIPSLNLMGAGCLQQAVDAMRGHGFRRALIVTDQGLVKAGLAAKVADMLGKADIEPVIFDGVHPNPSCANVNAGLALLKEKQCDVVVSLGGGSPHDCAKGIALVAVNGGKIQDYEGVDKSAKPQLPLVAINTTAGTASEMTRFCIITDESRHIKMAIVDKHTTPILSVNDPETMAGMPASLTAATGMDALTHAVEAYVSTIATPITDACALKAVELIAGFLRRAVKDGKDMEAREQMAYAQFLAGMAFNNASLGYVHAMAHQLGGFYDLPHGVCNAVLLPHVQAFNAASAGERLGDVAIALGEKTRSAQAAIAAIKRLAADVGIPAGLRELGVKEADIPTLADNALKDACGFTNPRKGSHEDVCAIFRAAM

SEQ ID NO: 39645 - DNA, 1152 bp, Photorhabdus luminescens subsp. laumondii TTO1
  CDS (1)..(1152): transl_table=11
atgatgactacgactttttttatgacatcggtaaatatgtttggtgcgggttgtttggttgaagcggtaaatacgatgaaaggtgatggttataagcgagcattgattgtgaccgatcgtgttttaaatgaaattggggtggcagcaaaagttcaagctttattatctgatgttgatattgagagtacggtttatgatggtactaatccgaatccgacgacaattaacgttgaggaaggtttggatattctgcgtcagcataatagcgattgcgttatttctttagggggtggttcgccacatgattgtgcaaaagctattgtgttggtcgctgctaatggaggcgatatccgggattatgtcggtattggccgttcatctaaaccgcatttgccattaatctcagtcaatactaccgcgggtactgcgtcagaaatgtcacgtttctgtgttattaccgatactgaaagccatattaaaatggccattgctgacaagaaaataacacctgttttgtctgtgaacgatccggaattaatggtaggaatgccgaaagggttaaccgccgcaactggaatggatgcaatgactcatgcggttgaagcctatgtttctcctgcggctagcccaataacggatgcttgtgcattgaaagcaatctcaatgattagtcactctttacgccaagcagttgcagatgggagcaatatagaagcacgtgaaaacatggcctatgcacaattcttggcggggatggcgtttaatagtgcattactggggtatgtacacgccatgtctcaccaattgggcggtacttatgatttaccacacggcatatgcaatgctgttttattaccacacgttcaagagttcaacgctaaagcggttgcgggtcgtttgaaagatattgccgctgcgatgggggtagatgtaagcgctatgaatgatcagcaaggggctgcggcatgtattgctgaaattcgtaagttgtcaaaagatattggtattccgtcgggtctagcggaactgaatgtcaaattagaagatttaccagagttagcaactaatgccttgaaagatatatgttgtttgactaatcccactcaagctacccatgaagaaattgtttcgatctttaaagcggccatgtga

SEQ ID NO: 39646 - protein, 383 aa, Photorhabdus luminescens subsp. laumondii TTO1
MMTTTFFMTSVNMFGAGCLVEAVNTMKGDGYKRALIVTDRVLNEIGVAAKVQALLSDVDIESTVYDGTNPNPTTINVEEGLDILRQHNSDCVISLGGGSPHDCAKAIVLVAANGGDIRDYVGIGRSSKPHLPLISVNTTAGTASEMSRFCVITDTESHIKMAIADKKITPVLSVNDPELMVGMPKGLTAATGMDAMTHAVEAYVSPAASPITDACALKAISMISHSLRQAVADGSNIEARENMAYAQFLAGMAFNSALLGYVHAMSHQLGGTYDLPHGICNAVLLPHVQEFNAKAVAGRLKDIAAAMGVDVSAMNDQQGAAACIAEIRKLSKDIGIPSGLAELNVKLEDLPELATNALKDICCLTNPTQATHEEIVSIFKAAM

SEQ ID NO: 39647 - DNA, 2634 bp, Photorhabdus luminescens subsp. laumondii TTO1
  CDS (1)..(2634): transl_table=11
atgactgtaactcatgttactgaactgaacgaactcgttgctcgggtaaaaaaagcacaacgtgaatttgctaacttttctcaggagcaagttgacaaaatcttccgcgcagcagcccttgcagcggcagatgcacgtatccctttagcaaaattagccgtagcagaatccggtatgggcattgtcgaagacaaagtaatcaaaaaccactttgcttccgaatatatctataacgcttataaagatgagaaaacctgcggcattttgtctgaggataaaacattcggcaccatcactatcgccgaacctattggcttaatctgcggtatcgtgccaaccactaacccaacatctaccgctatttttaaggccctcatcagcctaaaaacccgtaacggcattattctctcaccccacccacgcgccaaaaaagcaacaaccaaagcagcagaattggttctatccgctgcggttgccgcgggtgcgccaaaagatattattggctggattgatgaaccctccgttgaactttccaatgcattgatgcaccaccaagacatcaatctcatcctggcaaccggaggcccaggtatggtaaaagcggcatacagctctggtaagcccgcaatcggcgtcggtgccggtaacaccccggttgtcattgatgaatcagctgatattaaacgcgctgttgcatctattctgatgtctaaaacctttgacaacggcgtcatctgcgcttcagaacaatccgttatcgtggtggatgaaatttatgatcaggtgcgtaaacgtttctttactcatggcggttatctgttacaaggcaaggaactgaaagctgttcaagatatcattctgaaaaacggtagtctaaatgcggaaatcgttggtcaatctgcaacaaaaattgccgaaatggcaggcattaatgttcctgaaaagaccaagatcttgattggagaagtgagcttaactgatgaagcagaaccctttgctcacgaaaaattgtctccactgctcgctatgtatcgtggtaatagctttgaagatgccgtagaaaaggcagaaaaattggttgaaatgggcggaattggtcacacttcttgcttgtataccgatcaggacaatcaagccgcacgaatcaagtattttggcgataaaatgaaaacagctcgtattctcgtgaatactcctgcttctcagggcggtatcggtgatctctataacttcaagcttgccccctctctgacactaggctgcggctcttggggaggaaattccatctctgaaaatgtagggcccaaacatctcatcaataccaaaaccgtggcgaaaagagcagaaaatatgctgtggcataaacttccgaaatccatttacttccgtcgcggctccctgcctgtggcattagaagaagttgcaaccgacggtgcaaaacgcgcttttatcgtaacagaccgtttcttatttaatcatggttatgctgatcaagtcactgatgtgctgaaatcccacgggatagaaacagaagttttctttgaagttgaagcagaccctaccctaagcactgttcgtaagggtgcggaacaaatgcactcattcaaaccggacatcattattgctctggggggagggtccccaatggatgcggccaaaattatgtgggtgatgtatgaacaccctgaaacgcatttcgaagagctagctctacggtttatggatatccgtaaacgcatctatagattccccaaaatgggggttaaagcgaaaatggtcgccattaccacaacttccggcacaggttctgaagtgacaccatttgcggttgtcactgatgatgcaaccggccagaaatatccactggctgattatgaattgacgcctaatatagctattgttgatgccaatctagtcatggatatgccgaaatcactctgtgcttttggtgggctggatgcaatcactcacgctttagaagcttatgtatcagtcttagcaaacgaatactctgacggacaagcactgcaagcgctaaaactactgaaagagttcctcccaaccagctatcatgaaggggccacgaacccagttgcccgtgaacgggttcataatgcagcaactattgcagggattgcatttgctaatgccttcttgggggtatgccactctatggcgcataaactgggttctgagttccatatcccgcatggcttggctaacgcattgctgatttgtaacgttatccgctataacgctaacgataacccaaccaaacagactgcattcagtcaatatgatcgcccacaggcccgccgtcgttacgctgaaattgccgatcatcttggtttatcggctacgggtgaccatactgtcacaaaaattgaaaaactgttagcctggctgaaagagctcaagtctgagctaggtatcccgacatctatccgtgaagcgggcgttcaagaagctgactttctggcaaaaattgataagttatctgaagatgccttcgacgaccaatgtaccggtgctaacccacgctacccgctgatttctgagctaaaacaattgctgttggattcatactatggacgagaattcacagaaaccgttgcaacagaaaaaagccaataa

SEQ ID NO: 39648 - protein, 877 aa, Photorhabdus luminescens subsp. laumondii TTO1
MTVTHVTELNELVARVKKAQREFANFSQEQVDKIFRAAALAAADARIPLAKLAVAESGMGIVEDKVIKNHFASEYIYNAYKDEKTCGILSEDKTFGTITIAEPIGLICGIVPTTNPTSTAIFKALISLKTRNGIILSPHPRAKKATTKAAELVLSAAVAAGAPKDIIGWIDEPSVELSNALMHHQDINLILATGGPGMVKAAYSSGKPAIGVGAGNTPVVIDESADIKRAVASILMSKTFDNGVICASEQSVIVVDEIYDQVRKRFFTHGGYLLQGKELKAVQDIILKNGSLNAEIVGQSATKIAEMAGINVPEKTKILIGEVSLTDEAEPFAHEKLSPLLAMYRGNSFEDAVEKAEKLVEMGGIGHTSCLYTDQDNQAARIKYFGDKMKTARILVNTPASQGGIGDLYNFKLAPSLTLGCGSWGGNSISENVGPKHLINTKTVAKRAENMLWHKLPKSIYFRRGSLPVALEEVATDGAKRAFIVTDRFLFNHGYADQVTDVLKSHGIETEVFFEVEADPTLSTVRKGAEQMHSFKPDIIIALGGGSPMDAAKIMWVMYEHPETHFEELALRFMDIRKRIYRFPKMGVKAKMVAITTTSGTGSEVTPFAVVTDDATGQKYPLADYELTPNIAIVDANLVMDMPKSLCAFGGLDAITHALEAYVSVLANEYSDGQALQALKLLKEFLPTSYHEGATNPVARERVHNAATIAGIAFANAFLGVCHSMAHKLGSEFHIPHGLANALLICNVIRYNANDNPTKQTAFSQYDRPQARRRYAEIADHLGLSATGDHTVTKIEKLLAWLKELKSELGIPTSIREAGVQEADFLAKIDKLSEDAFDDQCTGANPRYPLISELKQLLLDSYYGREFTETVATEKSQ

SEQ ID NO: 39649 - DNA, 2676 bp, Vibrio vulnificus YJ016
  CDS (1)..(2676): transl_table=11
atgcctgtaactaatatggctgaactagatgcgatgattgcacgcgttaagaaagcgcaagaagagttcgctacttactctcaagagcaagtagatgcaatcttccgtgcagcttctctagccgctaaccaagctcgtatcccgctagcacaaatggcggttgaagaatctggtatgggtattgttgaagataaagtaatcaagaaccactttgcatctgagtttatctacaacaaatacaaggacgaaaaaacgtgtggcatcctagaagaggatgacaacctaggtacgatgactatcgctgaaccagtaggtatcatctgcggtatcgttccaaccactaacccaacttcgactgcaatcttcaaatcactgatctctttgaagactcgtaacggtatcatcttctcgccacacccacgtgcgaaaaactcgactaacgacgcagcgaaactggttctagaagcagcagtagcagctggcgcgccaaaagacatcatcggttggatcgaccagccatctgtagagctttcgaacgcgcttatgaagcacgatgacatcgcacttatccttgcaactggtggtccaggcatggttaaagctgcttactcttctggtaagccagcaatcggtgtaggtgcaggtaacgttcctgttgttatcgatgaaactgcggacatcaaacgtgcagttgcatctatcctaatgtctaagacgttcgataacggcgtagtatgtgcttctgagcaagctgcaatcgttgttgacgcagtatacgacgaagtgaaagagcgttttgcttctcacaaagcatacgtacttagcaaagctgaagcagaaaaagtacgtaaagtactgctaatcgatggcgcactaaatgcgaaaatcgttggccagccagctgcagcaatcgctgaaatggcaggtgttaaagttcctgctgatactaaagttctcgttggtgaaggcctaggcaaagtgtcttacgatgacgcatttgctcacgagaagctatctccaactctaggtctattccgtgctgatgacttcgaagacgcagttgcacaagcagtaaccatggttgaaatcggcggtatcggtcacacatctggtctatacactaaccaagacgtaaacgcagatcgtatccgttacttcggtgacaaactgaagactgcacgtatccttgtaaacatcccaactactcacggtggtatcggtgacctttacaactttaacgttgcaccatctctaactcttggttgtggttcatggggtggtaactctatctctgagaacgtaggtcctaagcacctaatcaacaagaaaactgttgcgaagcgagctgaaaacatgttgtggcacaaactacctaagtcaatctacttccgtcgtggtagccttccaatcgcactaagcgacctagaaggtaagaaacgcgcattcctagtaactgaccgtttcctattcaacaacggttacgcagatgacgtagtacaacttcttaaagctcaaggcatggaagttcaaacattctttgatgttgaagctgacccaacgctatctgttgtagagaaaggcgcagcggcaatgcaaagcttccagccagatgtgattctagcgctaggtggtggttcaccaatggatgctgcgaagatcatgtgggtaatgtacgagcacccagaaactcacttcgaagaacttgcaatgcgctttatggatatccgtaaacgtatctacaagttccctaaaatgggtaagaaagctgagcttgtatgtatcactaccacttcaggtacaggttcagaagttacaccattcgcggttgtgactgacgacaagactggtgctaagtacccactagcggattacgaattgactcctcaaatggcaatcgtagatgcgaacctagtgatgaacatgcctaagtctctaaccgcattcggtggttacgatgcagtgactcacgctctagaagcttacgtatcagttcttgcgaacgagtactcagatggtcaggctctacaagcacttaagatgctaaaagagtacctaccttcaagctacgcgaacggtgcaaaagacccaatcgctcgtgagaaagtacacaacgcagcgaccatcgctggtatcgcattcgcgaacgcgttcctaggtgtatgtcactctatggcacacaagatcggtgcagagttccacctaccacacggtttggcgaacgctctacttatctctaacgtggtacgttacaacgcgaacgataacccaactaagcaaactgcgttctctcaatacgaccgtccacaagcacgtcgtcgttacgctgaagttgctgaccacctaggcctaagccaagctggtgaccgcactgctcagaagattgaacgtctactagcatggttggatgagctaaaaggtaacctagacatcccaatgtctatccaagcggcaggtgttgctgaagctgacttcctagcgaaagttgatgaactagcagtagaagcgttcgatgaccagtgtactggtgcgaacccacgctacccactaatcgctgagctaaaagaagttctactggcttcttactacggtaaagctttcgttgaaggtgaaactttcgaaggtacgactgtaatcaagaagaaagcagaccaagtagcgccaaaagcgaaaaaataa

SEQ ID NO: 39650 - protein, 891 aa, Vibrio vulnificus YJ016
MPVTNMAELDAMIARVKKAQEEFATYSQEQVDAIFRAASLAANQARIPLAQMAVEESGMGIVEDKVIKNHFASEFIYNKYKDEKTCGILEEDDNLGTMTIAEPVGIICGIVPTTNPTSTAIFKSLISLKTRNGIIFSPHPRAKNSTNDAAKLVLEAAVAAGAPKDIIGWIDQPSVELSNALMKHDDIALILATGGPGMVKAAYSSGKPAIGVGAGNVPVVIDETADIKRAVASILMSKTFDNGVVCASEQAAIVVDAVYDEVKERFASHKAYVLSKAEAEKVRKVLLIDGALNAKIVGQPAAAIAEMAGVKVPADTKVLVGEGLGKVSYDDAFAHEKLSPTLGLFRADDFEDAVAQAVTMVEIGGIGHTSGLYTNQDVNADRIRYFGDKLKTARILVNIPTTHGGIGDLYNFNVAPSLTLGCGSWGGNSISENVGPKHLINKKTVAKRAENMLWHKLPKSIYFRRGSLPIALSDLEGKKRAFLVTDRFLFNNGYADDVVQLLKAQGMEVQTFFDVEADPTLSVVEKGAAAMQSFQPDVILALGGGSPMDAAKIMWVMYEHPETHFEELAMRFMDIRKRIYKFPKMGKKAELVCITTTSGTGSEVTPFAVVTDDKTGAKYPLADYELTPQMAIVDANLVMNMPKSLTAFGGYDAVTHALEAYVSVLANEYSDGQALQALKMLKEYLPSSYANGAKDPIAREKVHNAATIAGIAFANAFLGVCHSMAHKIGAEFHLPHGLANALLISNVVRYNANDNPTKQTAFSQYDRPQARRRYAEVADHLGLSQAGDRTAQKIERLLAWLDELKGNLDIPMSIQAAGVAEADFLAKVDELAVEAFDDQCTGANPRYPLIAELKEVLLASYYGKAFVEGETFEGTTVIKKKADQVAPKAKK

SEQ ID NO: 39651 - DNA, 1149 bp, Vibrio vulnificus YJ016
  CDS (1)..(1149): transl_table=11
atggcatttgcactaaatcttcctaaattgagttactcaggtgtcggagcggtcgatgatgcgatcgcaacgctaagccaacagccaatcaaacgcgcgttagtggtaacggaccataatctggtcgaactgggcatcttggatcatttgtttgagttgcttgatgagttctctattgactacgagttgtttgacaaagtgacgccaaatccaactgcaacgttagtgcgagaaggattagcggtttacaacgatactggctgcgattgtttcatcgcagtcgggggcggtagcccagtcgattgtgccaaagcgatccgtattgtggcgtctaacccaggtgatatcgttgattttgatggggttggcaaagtgaagagtgctggtgatttcttcattgccatcaataccaccgcagggaccgcggccgagatgacctcgaactcggtgatcactgatgagtcgcgccaagtaaaaatggtcattattgacgccaaacagatccctgatgtcgcggttaatgacccgacgttgatggtcaatttgccaccgcacgtaaccgccgcgacggggatggatgcgctcactcacgcggtggaagcctatgtcacaccaggcgcacataccttaactaaaccgactgcgcttgaggcaatcaaactgattgcccagtggttacctatcgcggttgaagatggtaaaaatcttgaagcgcgcgagcaattggctaacgctcagttcttagcgggcatggcgtttaacagtgcgggtttggggttagtgcacgccatggctcatcaacctggcgcgactcataatttacctcatggggtgtgcaatgcgattttgctgccgcaagtgtgtgaatttaacgccgagaaatatcctcaacgttttcgcgatatcgcttcggtgatgggtgggaaaacggaggggctgagcgatagagaagctgccgatttagccgttaatctgatgcggaatttgtcaaaacgagtcaacattcctagcggtttttctttgcttggaataagtcgagcagattgcgagctgtggatagagaaagccctggctgacccgtgtctggggggaaaccctcgccagccaacagccagtgaagtagagtcactctaccttgcgtgtatgtaa

SEQ ID NO: 39652 - protein, 382 aa, Vibrio vulnificus YJ016
MAFALNLPKLSYSGVGAVDDAIATLSQQPIKRALVVTDHNLVELGILDHLFELLDEFSIDYELFDKVTPNPTATLVREGLAVYNDTGCDCFIAVGGGSPVDCAKAIRIVASNPGDIVDFDGVGKVKSAGDFFIAINTTAGTAAEMTSNSVITDESRQVKMVIIDAKQIPDVAVNDPTLMVNLPPHVTAATGMDALTHAVEAYVTPGAHTLTKPTALEAIKLIAQWLPIAVEDGKNLEAREQLANAQFLAGMAFNSAGLGLVHAMAHQPGATHNLPHGVCNAILLPQVCEFNAEKYPQRFRDIASVMGGKTEGLSDREAADLAVNLMRNLSKRVNIPSGFSLLGISRADCELWIEKALADPCLGGNPRQPTASEVESLYLACM

SEQ ID NO: 39653 - DNA, 1149 bp, Vibrio vulnificus YJ016
  CDS (1)..(1149): transl_table=11
atggcaagtgcattttttatcccaactgtgaacctaatgggcgcaggctgtcttaaagacgcagcagacagcattaaagctcaaggctttaccaaagggcttattgttaccgacaaaattcttaatcaaatcggcgttgtaaaacaagttcaagacctactaagcgagcgtcatgtagaagcggttgtcttcgatggtactcagcccaacccaaccatcggcaacgtcaatgcaggtttggcactactgaagcaaaatgagtgtgattttgtgatttcactaggtggtggttctccgcacgactgtgcaaaaggcattgcgcttgtcgcagcaaacggcggcgagattgcggattacgaaggcgtggacaaatcagcgaaaccaatgctaccgctgattgcgattaacactaccgcaggcaccgcatctgaaatgacccgtttctgcatcattaccgatgaagaacgtcatattaaaatggcgattgtcgataaacacaccacgccactaatctctgtgaacgatcctgaactgatgctggcaaaacctgcatcactcactgcggcaacaggaatggacgccttgactcacgcggtagaagcgtacgtttctattgctgcgacaccaattactgacgcagtcgcaatcaaagcgattgagcttatccaagcccatcttcgtactgcggttgcacacggtgacgatattgaagcgcgtgagcaaatggcgtacgcacagttcatggcaggtatggcgttcaacaatgcctcactaggttacgtacacgcaatggcgcaccaattgggtggcttctacgatctaccacacggtgtttgtaacgcgatcttgttgccacacgtacaacgctacaatgcgcaggtttgtccagagcgtctacgtgatgtggcaaaagcaatgggtgtcaatgtcgaaggcatgagtgcagagcaaggcgcagaagccgccattgatgcgattgtggcactggcgaaagacgtgggtattccagcaggtattcgcgagcttggtgcaaaatctgaagatatcccaaccttggctgacaatgcactcaaagacgcttgtggtttcactaacccgaaacaagccacgcacgaagaaatctctgcgattttcgaagcggcaatgtaa

SEQ ID NO: 39654 - protein, 382 aa, Vibrio vulnificus YJ016
MASAFFIPTVNLMGAGCLKDAADSIKAQGFTKGLIVTDKILNQIGVVKQVQDLLSERHVEAVVFDGTQPNPTIGNVNAGLALLKQNECDFVISLGGGSPHDCAKGIALVAANGGEIADYEGVDKSAKPMLPLIAINTTAGTASEMTRFCIITDEERHIKMAIVDKHTTPLISVNDPELMLAKPASLTAATGMDALTHAVEAYVSIAATPITDAVAIKAIELIQAHLRTAVAHGDDIEAREQMAYAQFMAGMAFNNASLGYVHAMAHQLGGFYDLPHGVCNAILLPHVQRYNAQVCPERLRDVAKAMGVNVEGMSAEQGAEAAIDAIVALAKDVGIPAGIRELGAKSEDIPTLADNALKDACGFTNPKQATHEEISAIFEAAM

SEQ ID NO: 39655 - DNA, 1152 bp, Rhodopseudomonas palustris CGA009
  CDS (1)..(1152): transl_table=11
atgaccgcaacgaccttcttcattccctctctcaatctgttcggcgccggctgcgtatcgagcgcagcggaccacgccaaggcacgcggcttcaagcgcgcgctgatcgtcaccgacagcgggctgcacaagctcggcgtcgccgatcagatcgcctcgatgctgatcgagcgcaacgtgaccagcgtcgtcttccccggcgcgaagccaaacccgacgatcaagaacgtcgaagacgggcttgcactgctgaagcaggagaactgcgactgcgtgatctcgctcggcggcggttcagcgcacgattgcgcgaagggcatcgcgctgaccgccaccaatggcggcagcatcaaggactatgaaggcgtcgatcggtcggcgcacgctcagcttccgctgatcgccatcaacaccacggcgggcacggcgagtgagatgacgcggttctgcatcatcaccgacgaggaacgccaggtgaagatggcgatcgtcgaccgccacaccacgccgctgctgtcggtcaacgatccggtactgatgctcggcaagccgccggccctgaccgccgcgaccggcatggacgcgctgacgcacgcgatcgaagcctatgtgtcgatcgccgcaacgccgatcaccgacgcctgcgcgctaaaggcgatgtcgatcatctccaacagtctgcgcaccgtggtcgccgagggccagaacctcgtcgcccgcgaggcgatgtcgtatgcgggcttcctcgccggcatggcgttcaacaacgcctcgctcggctatgtacatgcgatggcgcaccagctcggcggcttctacgacctgccgcacggcgtctgcaacgcggtgctgctgccgcacgtgcaggcctacaacgcgcaagtcgcggcgggacggctgaaggacgtcgcccacgcgctcggcgtcgacaccaccggcatgaccgatgcccaaggcgccgatgccgccattcatgccatccaacggctatcggccgatgtcggcattccgcccggtctcggcggtctcggcatgaaggaaaccgacgtgccgatcctcgccgccaacgcgctgaaggatgcgtgcggcttcaccaatccgaagcaggcgacgcagaccgagatcgaaaccatcttccgggcggccgcctga

SEQ ID NO: 39656 - protein, 383 aa, Rhodopseudomonas palustris CGA009
MTATTFFIPSLNLFGAGCVSSAADHAKARGFKRALIVTDSGLHKLGVADQIASMLIERNVTSVVFPGAKPNPTIKNVEDGLALLKQENCDCVISLGGGSAHDCAKGIALTATNGGSIKDYEGVDRSAHAQLPLIAINTTAGTASEMTRFCIITDEERQVKMAIVDRHTTPLLSVNDPVLMLGKPPALTAATGMDALTHAIEAYVSIAATPITDACALKAMSIISNSLRTVVAEGQNLVAREAMSYAGFLAGMAFNNASLGYVHAMAHQLGGFYDLPHGVCNAVLLPHVQAYNAQVAAGRLKDVAHALGVDTTGMTDAQGADAAIHAIQRLSADVGIPPGLGGLGMKETDVPILAANALKDACGFTNPKQATQTEIETIFRAAA

SEQ ID NO: 39657 - DNA, 1149 bp, Bacillus methanolicus
  CDS (1)..(1149): transl_table=11
atgacaacaaactttttcattccaccagccagcgtaattggacgcggtgcagtaaaggaagtaggaacaagacttaagcaaattggagctaagaaagcgcttatcgttacagatgcattccttcacagcacaggtttatctgaagaagttgctaaaaacattcgtgaagctggcgttgatgttgcgattttcccaaaagctcaaccagatccagcagatacacaagttcatgaaggtgtagatgtattcaaacaagaaaactgtgattcacttgtttctatcggtggaggtagctctcacgatacagctaaagcaatcggtttagttgcagcaaacggcggaagaatcaatgactatcaaggtgtaaacagcgtagaaaaaccagtcgttccagtagttgcaatcactacaacagctggtactggtagtgaaacaacatctcttgcggttattacagactctgcacgtaaagtaaaaatgcctgttattgatgagaaaattactccaactgtagcaattgttgacccagaattaatggtgaaaaaaccagctggattaacaatcgcaactggtatggatgcattgtcccatgcaattgaagcatatgttgcaaaaggtgctacaccagttactgatgcatttgctattcaagcaatgaaacttatcaatgaatacttaccaaaagcggttgcgaacggagaagacatcgaagcacgtgaaaaaatggcttatgcacaatacatggcaggagtggcatttaacaacggtggtttaggactagttcactctatttctcaccaagtaggtggagtttacaaattacaacacggaatctgtaactcagttaatatgccacacgtttgcgcattcaacctaattgctaaaactgagcgcttcgcacacattgctgagcttttaggtgagaatgttgctggcttaagcactgcagcagctgctgagagagcaattgtagctcttgaaagaatcaacaaatccttcggtatcccatctggctatgcagaaatgggcgtgaaagaagaggatatcgaattattagcgaaaaacgcatacgaagacgtatgtactcaaagcaacccacgcgttcctactgttcaagacattgcacaaatcatcaaaaacgctatgtaa

SEQ ID NO: 39658 - protein, 382 aa, Bacillus methanolicus
MTTNFFIPPASVIGRGAVKEVGTRLKQIGAKKALIVTDAFLHSTGLSEEVAKNIREAGVDVAIFPKAQPDPADTQVHEGVDVFKQENCDSLVSIGGGSSHDTAKAIGLVAANGGRINDYQGVNSVEKPVVPVVAITTTAGTGSETTSLAVITDSARKVKMPVIDEKITPTVAIVDPELMVKKPAGLTIATGMDALSHAIEAYVAKGATPVTDAFAIQAMKLINEYLPKAVANGEDIEAREKMAYAQYMAGVAFNNGGLGLVHSISHQVGGVYKLQHGICNSVNMPHVCAFNLIAKTERFAHIAELLGENVAGLSTAAAAERAIVALERINKSFGIPSGYAEMGVKEEDIELLAKNAYEDVCTQSNPRVPTVQDIAQIIKNAM

SEQ ID NO: 39659 - DNA, 1203 bp, Bacillus cereus ATCC 10987
  CDS (1)..(1203): transl_table=11
ttgcaagaagttgctgaatttcgtatgccgaagtctgtattatatggaagaaattcgcttgaaaaactgggggaacaatccaagaagtttggaaaaagagcttttatagtaactgatacaattatggagaatttaggatatgttgagagttgtatacaacaattaaatacaaaaggtattaccgttattacatataataaagtaaatgctgagcctacaaatatacatgtgttagaggcgttaactatttgtaaagaggaaaagtgtgattttattatcggtcttggtggtggaagttgtattgatgcagcaaaagcagttgcggtgttatatacaaatggcggagaagtagaagattatgtccaaaaggatatggaaatagacaatgatccgctaccgctcattgcaattccaacaacttcgggtactgggtcagaagtaacaagtgtagcagtaattacgaataaacgaacagatgtaaaaatgatgatgaaacatccgagttttaccccgcaagtagcgattattgatccgattttaacacgttctgtaccacctcatattacagcagcaacagggatagatgcattatgtcatgcagtcgaagcatatatttctaaagtttcacaatcacttacagatgtactcgctctttccgctattgaaagtattatgaaatatttacgtattgcatatgaagatggagagaatatggaggcaagagaagcgatgatgattgcttccttacaagctgtaattgcattttcaaacgcatctgttacattagttcatggaatgtcaagaccagtaggagcgttatttcatgtaccacatggtatatcaaatgcaatactattacctacagttttagagtatacaaaagtgagtgcagtaaaaagactagcagaaattggacgctgtttaaataaagatatgtattcctattgtgatgaagaagtagccgattacacgctcggggaaataaaaaaactttgctttgatcttcgtattccaaatttaaaagaatacggaattggtgaggttgaatttgaaaaagctatttctaaaatggcatcagatgcaattgaaagtggaagtccagcaaataatccacgagtaccatcctatgatgaaattaaacagttgtatcgagaatgttttcattatcgatatgaagattctataaaaacattagagttttaa

SEQ ID NO: 39660 - protein, 400 aa, Bacillus cereus ATCC 10987
MQEVAEFRMPKSVLYGRNSLEKLGEQSKKFGKRAFIVTDTIMENLGYVESCIQQLNTKGITVITYNKVNAEPTNIHVLEALTICKEEKCDFIIGLGGGSCIDAAKAVAVLYTNGGEVEDYVQKDMEIDNDPLPLIAIPTTSGTGSEVTSVAVITNKRTDVKMMMKHPSFTPQVAIIDPILTRSVPPHITAATGIDALCHAVEAYISKVSQSLTDVLALSAIESIMKYLRIAYEDGENMEAREAMMIASLQAVIAFSNASVTLVHGMSRPVGALFHVPHGISNAILLPTVLEYTKVSAVKRLAEIGRCLNKDMYSYCDEEVADYTLGEIKKLCFDLRIPNLKEYGIGEVEFEKAISKMASDAIESGSPANNPRVPSYDEIKQLYRECFHYRYEDSIKTLEF

SEQ ID NO: 39661 - DNA, 2604 bp, Bacillus cereus ATCC 10987
  CDS (1)..(2604): transl_table=11
atggtagtcaaagagaaaattgtaaatgaaatgcaggaagtaaaagagatgattgatacgttagtgaataacggtcgaaaggctttacaagcattagaaagttttacacaagagcaaattgacaacattgttcatgaaatggcattagcaggtgttgatcaacatatgccacttgcgaagttggctgttgaagaaacaggtcgtggtgtatacgaagataaatgtattaaaaatatttttgctactgaatatatttggcatagcataaagaaagataaaacagtagggattattcacgaagatcctcatgaagaaataatagaaattgcggagcccgtcggtgtagtagctggggtaacaccagtaacgaatccaacatcgacaacaatgtttaaagcattaatcgcgataaaaacgagaaatccaattattttcgcatttcatccttccgcacaaaactgttctattgcagctgcgaaaacagtatacgatgcagcggtgaaggcgggggcaccaaaatattgtattcagtggattgaaaagccttctgtcgaagcaacgaaacaattaatgaaccatgaaggtgttgcgcttgttttggcaactggaggggctggtatggtgaaatcagcttattctactggaaaaccagcgctaggtgtaggtcctggtaatgtaccatgttatatagagaaatcagcgcatataaaacgagcggttaatgatttgattttatctaaaacatttgataatggtatgatttgtgcatcagaacaagcaattattgtagacaaggaaatttatgatgatgtgaaaacagaaatgattgcaaatgattgttattttgtaaccgaggaagagagaagtaaattagaaaagcttgttattaatgaaaatacatgtgcagtaaatagtgatattgtagggaaatccgcacagtatattgccaaattagttggaattactgtacctaaaaatacaaaaatgcttgtagctgaaatacaaggcatcggagccgcatatccactatctcgtgagaagttaagtccagtattagcttgtgtaaaagcaaattcattagaagaaggatttacatattgtgaagaaatgttaaacctcggtggtttaggacattcagcagttatccattctgtaaataaagaagtgcaaaagcaatttggattacgtatgaaagcttgccgccttattgtaaatgccccttcatcacaaggtggaatcggtgacatatataatggatttattccatcacttacgcttggctgcggttcctacgggaaaaactcgatttctcaaaacgtaacagcgacgcatttattaaatataaaaaggttggcaaatagaaaaaagaatatgcaatggttcaaattaccaccaaaaatttattttgaaaaacatgcgacagcatatttagcaaatatgcctaacatttcacgtgcatttattgtaacggatccaggaatggttgagcacggatatgtagatacggtcacgcattatttacgtaaacatgtaaatgatgtgaaagttgaagttttctttgaggttgagccggatccatcagatgaaactgtgtttaaaggtgcagaaatgatgagaagttttcagccagatgtaattatcgcacttggtggtggttcagcgatggatgccgcgaaagggatgtggcttttctatgagcatccagaaacaacattctatggaattaaacagaagtttttagatataagaaaacgaacatgtaaatatccggaattaggaagtaaggcgcagtttattgccattccaacaacatctggaacaggatcagaagtgacaccatttgcggttattacagataagaaaaataatataaagtatccactcgcggattatgaattaacgccagatgtagcaattgttgatccacaatttgtaatgacagtaccaccacatgtaacagcagacaccggcatggacgtattaacgcatgcaatcgaggcgtatgtgtctgttttagcgaatgactatacagatggattagcattaaaggccattgatctcgtatttaaatatttaccaagagcatttaaagatggaaatgatgaagaagcacgagaaaaaatgcacaatgcttctgcaatcgcaggaatggcatttgcaaatgcttttctaggtattaatcacagcttagcacataaaattggaccagaatttcatattccacatgggcgtgcgaatgcaattcttatgccgcacgtagttcgctataatgctattaagccaagaaaacacgcattgttcccaaaatatgagcactttgtagccgatgaacgctatgcacatattgcgagaatgctcgggcttccagcaagttcgactgcagaaggtgtggaatcacttgtcaaagcaattattgagctcggaaaaagtttaaatataaatatgagtattgcaggacaaggagttgctaaagaccaatttgaagaggttgttggattattagcagaaagagcttttgaagatcaatgtacaacagctaatccaaaattacctctcatttcagagctgaaagaaatttatatgaaagcatataaaggtgagtaa

SEQ ID NO: 39662 - protein, 867 aa, Bacillus cereus ATCC 10987
MVVKEKIVNEMQEVKEMIDTLVNNGRKALQALESFTQEQIDNIVHEMALAGVDQHMPLAKLAVEETGRGVYEDKCIKNIFATEYIWHSIKKDKTVGIIHEDPHEEIIEIAEPVGVVAGVTPVTNPTSTTMFKALIAIKTRNPIIFAFHPSAQNCSIAAAKTVYDAAVKAGAPKYCIQWIEKPSVEATKQLMNHEGVALVLATGGAGMVKSAYSTGKPALGVGPGNVPCYIEKSAHIKRAVNDLILSKTFDNGMICASEQAIIVDKEIYDDVKTEMIANDCYFVTEEERSKLEKLVINENTCAVNSDIVGKSAQYIAKLVGITVPKNTKMLVAEIQGIGAAYPLSREKLSPVLACVKANSLEEGFTYCEEMLNLGGLGHSAVIHSVNKEVQKQFGLRMKACRLIVNAPSSQGGIGDIYNGFIPSLTLGCGSYGKNSISQNVTATHLLNIKRLANRKKNMQWFKLPPKIYFEKHATAYLANMPNISRAFIVTDPGMVEHGYVDTVTHYLRKHVNDVKVEVFFEVEPDPSDETVFKGAEMMRSFQPDVIIALGGGSAMDAAKGMWLFYEHPETTFYGIKQKFLDIRKRTCKYPELGSKAQFIAIPTTSGTGSEVTPFAVITDKKNNIKYPLADYELTPDVAIVDPQFVMTVPPHVTADTGMDVLTHAIEAYVSVLANDYTDGLALKAIDLVFKYLPRAFKDGNDEEAREKMHNASAIAGMAFANAFLGINHSLAHKIGPEFHIPHGRANAILMPHVVRYNAIKPRKHALFPKYEHFVADERYAHIARMLGLPASSTAEGVESLVKAIIELGKSLNINMSIAGQGVAKDQFEEVVGLLAERAFEDQCTTANPKLPLISELKEIYMKAYKGE

SEQ ID NO: 39663 - DNA, 1143 bp, Desulfovibrio vulgaris subsp. vulgaris str. Hildenborough
  CDS (1)..(1143): transl_table=11
atgcgtatcaccaagttcgccattcccgagatcatcttcggtaatggaagcctcaaccatcttgcgccctgcgcacgcagactcggggctgcgcgggtgctcctcgtcagcgacaaggggctggaggccagcggctgggtggagcgtgtcgtggacatcctcgaagccgacggtctcgaatgggtgtatttcaacgactgcaactccaatccgcgtgaccatcaggtgcatcacggggcgcgggtctatcaggaagagcgtgccgacgtcgtcatcgcgctgggcggcggaagccccatggacaccgccaagggcatcggcaccatcgtcggcaacggtgggcgcatcaacgactacgagggggccaaccgcatcatgcggcccctgccgcccatgatctttctgcccaccacggcgggcagcggttcggacatctcgcaattctgcatcatcactgatgtggagcgtcggctgaagatgtccatcatcagccggtcactggtgcccaacgtatcgatcatcgacccgcaggtgctcatgaccatgagcgaggaactcgtcatcgcctccgccatcgacgccttcgcccatgccgtcgaatcgtacctttcgcgccttgcctcgccgttcaccgaccatcaggcgttgcgtgccatggaactgatcatggacaacctcatgcctgccgtcgaacggcgcgaccctgccgcgctggagagactcagcatcgccagcaccgaggcgggcatgtcgttcagcaatgcgggactcggcatcgggcactccctcgcccattcgcttggcggcatgttcgacgtgatgcacggtctggtgcatccggtgttgctgccgcatgtcatgcggttcaatcttccggtcagcgtggaaaagctggcggccatcgggcgcatcgtcgtcgggccgcgtgtcgccagtgccgagtgcatcgcgcgggcgggcatcgaacggttgcacgagttcttctccgcactgggggttccggtgcgtctcgggcaactgctgcccgacaggggcgtgctcgagaccatcgcccggacggcgctcaatgatgcctgcactgtgaccaacccgcgcgaggccacctgcgagaacctgctcgccctgtgcgaagaggcgtggtga

SEQ ID NO: 39664 - protein, 380 aa, Desulfovibrio vulgaris subsp. vulgaris str. Hildenborough
MRITKFAIPEIIFGNGSLNHLAPCARRLGAARVLLVSDKGLEASGWVERVVDILEADGLEWVYFNDCNSNPRDHQVHHGARVYQEERADVVIALGGGSPMDTAKGIGTIVGNGGRINDYEGANRIMRPLPPMIFLPTTAGSGSDISQFCIITDVERRLKMSIISRSLVPNVSIIDPQVLMTMSEELVIASAIDAFAHAVESYLSRLASPFTDHQALRAMELIMDNLMPAVERRDPAALERLSIASTEAGMSFSNAGLGIGHSLAHSLGGMFDVMHGLVHPVLLPHVMRFNLPVSVEKLAAIGRIVVGPRVASAECIARAGIERLHEFFSALGVPVRLGQLLPDRGVLETIARTALNDACTVTNPREATCENLLALCEEAW

SEQ ID NO: 39665 - DNA, 1182 bp, Desulfovibrio vulgaris subsp. vulgaris str. Hildenborough
  CDS (1)..(1182): transl_table=11
atggcagtacaggaacaggtctacggtttcttcattccccgggtgaccctcatcggcatcggtgcctccaaggccattcctgaaaagatcaaggcgcttggcgggtcgaagccgctcatcgtcaccgacatgggcatcgtcaaggctggcatcctgaagcagataaccgaccttctcgacgccgcgaagatggcctacagcgtgtatgacgagaccatccccaaccccacggacgacaacgtccacaagggtgtcgacgtctacaagaagaacaagtgcgacagcctcatcaccctcggtggcggcagctcgcacgactgtggcaagggcatcggcctcgtcgtcgccaacggcggcaagattcacgacttcgaaggcgtggacaagtcgacccagcgcatgcccccctaccttgcggtcaacaccacggcaggcaccgcttcggagatgacccgcttctgcatcatcaccgacaccagccgcaaggtgaagatggccatcgtcgactggcgcgtgaccccgaacatcgccctcgacgaccccctgctgatgctcggaatgccccccgcactcaccgcggccaccggcatggacgccctgacccacgccgtggaagcctacgtctccaccatcgccacccccatgaccgacgcctgcgcagaacaggccatcacgctcatcgccaccttcctgcgccgtgccgttgccaacggtcaggacctcgaggcccgcgaacgcatgtgcttcgcgcagtaccttgccggcatggccttcaacaatgccagcctcggccatgtccatgccatggcgcaccagcttggcggtttctacgacctgccgcacggcgagtgcaacgccatcctgctgccccacgtctccaagttcaacctcatcgccaagcttgaccgctacgcccgcatcgcacagctgatgggcgagaacatcgccggtctgtccacgcgtgaagccgccgaaagggccatcagcgccatcaagtgcctgtccaccgatgtgggcatccccgccggtctggtggcgcttggcaagcgttacggcaaggacgtcaaggccgccgacatcgccatcatgaccaagaacgcgcagaaggacgcctgcggcctgaccaatccgcgttgtccgacggatgctgacgtcgcagccatttacgaagcggccctgtaa

SEQ ID NO: 39666 - protein, 393 aa, Desulfovibrio vulgaris subsp. vulgaris str. Hildenborough
MAVQEQVYGFFIPRVTLIGIGASKAIPEKIKALGGSKPLIVTDMGIVKAGILKQITDLLDAAKMAYSVYDETIPNPTDDNVHKGVDVYKKNKCDSLITLGGGSSHDCGKGIGLVVANGGKIHDFEGVDKSTQRMPPYLAVNTTAGTASEMTRFCIITDTSRKVKMAIVDWRVTPNIALDDPLLMLGMPPALTAATGMDALTHAVEAYVSTIATPMTDACAEQAITLIATFLRRAVANGQDLEARERMCFAQYLAGMAFNNASLGHVHAMAHQLGGFYDLPHGECNAILLPHVSKFNLIAKLDRYARIAQLMGENIAGLSTREAAERAISAIKCLSTDVGIPAGLVALGKRYGKDVKAADIAIMTKNAQKDACGLTNPRCPTDADVAAIYEAAL

SEQ ID NO: 39667 - DNA, 1161 bp, Desulfovibrio vulgaris subsp. vulgaris str. Hildenborough
  CDS (1)..(1161): transl_table=11
atggaatccgcaagggagcttcgcaagttcgtcgcgccggagttcgtcttcggcaacggcgcggcccggctggcaggtcgatatgtgcataatctcgggggtacccgctgcctcgtggtcaccgaccccggggtcatgcgaaatggacatgccgacaccgtcattggcagcctcaccgcctatggcatagcccatgcggtcttccaggacatttcgcccaacccgcgtgatgtggaagtccagcgcggggtcgaggcctaccaccgcgaagggtgcgacgccatcgtcgccgtggggggcggcagccccatagactgcgccaagggcatcggcatcgtggcaagcaatggtggcagcatcagcctctacgaaggggtcgacgccatccccaagccgatgccacccctcgtatgcgtccccaccaccgctggcagcgcagccgacgtctcgcaattcgccatcatcaccgacacgacccgcatggtgaaaatcgccatcgtcagcaaggcggctgtggcggatgtatcgctcatcgacccctcgaccacgaaatccatgagccgcgacctcacggcagccacgggcatagacaccctcacccacgccatcgaagccttcgcctccaacgccagcggccccataaccgacatgttcgcgctggaagccatcagtctcgtgaacacgcatctgccgcaggtgcttgcagacggtgatgacgacaccgcccgcgaaggcatggcactcgcctgcctcaacgccggactggccttctccaacgccattctgggtgctgtccacgccatggcgcacagcctcggcgggctgcttgacctgccccatggcgaatgcaacgccattctgctgccctttgtggtgcggcgcaacttcgacgcagcccccgtgcggtacgcccgagtggcgaacgccctcggcatcgacgttggaggcacccccgccaccgccatccgcgacgcgctcttcgacaggttgatgacgctgcgcacggccgccgggttcacgcgcgggctttccgccttcggagtcacccgtgagcagataggacgccttgcccgccttgccgtggaagacccctgccttgccaccaaccccgaagcactcgacatcgcagacatcgagagcctgtatgcagaagccctctag

SEQ ID NO: 39668 - protein, 386 aa, Desulfovibrio vulgaris subsp. vulgaris str. Hildenborough
MESARELRKFVAPEFVFGNGAARLAGRYVHNLGGTRCLVVTDPGVMRNGHADTVIGSLTAYGIAHAVFQDISPNPRDVEVQRGVEAYHREGCDAIVAVGGGSPIDCAKGIGIVASNGGSISLYEGVDAIPKPMPPLVCVPTTAGSAADVSQFAIITDTTRMVKIAIVSKAAVADVSLIDPSTTKSMSRDLTAATGIDTLTHAIEAFASNASGPITDMFALEAISLVNTHLPQVLADGDDDTAREGMALACLNAGLAFSNAILGAVHAMAHSLGGLLDLPHGECNAILLPFVVRRNFDAAPVRYARVANALGIDVGGTPATAIRDALFDRLMTLRTAAGFTRGLSAFGVTREQIGRLARLAVEDPCLATNPEALDIADIESLYAEAL

SEQ ID NO: 39669 - DNA, 1119 bp, Listeria monocytogenes str. 4b F2365
  CDS (1)..(1119): transl_table=11
atgaacagctttcaaattaaaacaaaagtagcttttggtacgaatagtttacaagttttaaaagaaattaaaaataaaaatgtctggattatctgtgaccgttttttggctgatggggaagggcttcaaggtttaattggacaattagatacatccaataatgtgcatatttttaccgatgtcgtacctgatccacctatttccaaagtagctggaggggttagtgaggcaggcaaaatccaaccgcaagtcatgattgcttttggtggtggttcagcgattgatacggctaaaggaatctactatttcgccaaacgtttggaaaaaatcaatatcagtacttttattgcaattccaaccaccagcggtacgggttcagaagttacagccgcaaccgttatcactgatccaacaacgaaaattaaatatccgcttttcttagatgaactaattccggatatggctattttggatgcgcaactggttgttacggtacctccagctattacagcgaacacagggatggacgtcttaacacacgcaattgaagcttatgtctctaaagatgcaagcgattataccgatgctcttggtgaaaaaagtgtgcaattaacgttacgtttcttaacgagctgttatgatgatggtcgtaatttagcgaatcgagaaaaaatgcataatgcttctactatggctggaatggcatttaactgcgccaatttaggcttgaatcacagtattgcgcatcaacttggtgcacagtttcacgtaccacacgggctagccaatgcgatcttactagatgcagtgattcgttttaacgcctttaaaaatcgtgaaacagaacaaaaatatgcagaaatggcacgcatttgtggcattgcttccagatcagactcgaacgaaacagctgtccgcttacttcgcgaaagaattgtagcgatgatggaacatatgcaaatgccgcgcacattgacagacgccggtgtagcaaaagaaaaagtctatgcaaaaatggacgaaattgcaacgaatgcactgaaagacgcttgcttaccaactagtcctacgacaccctcacatcaagaactaaaagaaattttagaacaaataatttag

SEQ ID NO: 39670 - protein, 372 aa, Listeria monocytogenes str. 4b F2365
MNSFQIKTKVAFGTNSLQVLKEIKNKNVWIICDRFLADGEGLQGLIGQLDTSNNVHIFTDVVPDPPISKVAGGVSEAGKIQPQVMIAFGGGSAIDTAKGIYYFAKRLEKINISTFIAIPTTSGTGSEVTAATVITDPTTKIKYPLFLDELIPDMAILDAQLVVTVPPAITANTGMDVLTHAIEAYVSKDASDYTDALGEKSVQLTLRFLTSCYDDGRNLANREKMHNASTMAGMAFNCANLGLNHSIAHQLGAQFHVPHGLANAILLDAVIRFNAFKNRETEQKYAEMARICGIASRSDSNETAVRLLRERIVAMMEHMQMPRTLTDAGVAKEKVYAKMDEIATNALKDACLPTSPTTPSHQELKEILEQII

SEQ ID NO: 39671 - DNA, 1140 bp, Listeria monocytogenes str. 4b F2365
  CDS (1)..(1140): transl_table=11
atgcaaaaagttagttttaaaacagatctttatattggccaaggagcaacagatcgtttactcgattttaaagacaaacaaatctttatcgtaacagatccatttatggttagttccggaatgattaatgcgattacagaaaaaattgatccatcgaatacatatacgatttttagcgaaatcattccagacccaccgattgaaaacgtggtagcaggaattgaagttttgaatgaatgtgatgctaacttgatgattgcaattggtggcggatcagcgattgatgcggcgaaagcgatgaaattcttcggccaaaaacttggtacggtgcgcgcaatgcctttcattgtcattccaacaactagtggaacgggctccgaagtaactagtttctctgttattactaacaaagaaaaagccattaaatacccactaattacagatgctattttgccagatgaagcaattttagatgcagacttagtaaaatctgttccaccagcaattacagcagatactggtatggatgtgttaacgcatgcgcttgaagcctatgtatctacaaaagcgaatgattactcggatgcaatggcggaaaaagttatccaattagttttcacttatttagaacgtgcttacaaagacggtaatgatttagaagctcgcgaaaaaatgcataatgcgtcttgtcttgcaggaatggcatttaacattacttctcttggcttaaatcacggtattgcgcatacagccggtgcgaaatttaaaattccacatggtcgtatgaatacattacttttaccgcacgtaattagttataatgctggaattacaagtgattttggtaacaatccggataaccgagcagcggaacgttatacagcgattgcaaaattactaaaaatgccagcatcgaatacacgtcttggtgttcgtagcttaattaatgccattaaacaacttcaaaagaaactcaatatgccaactacattaacagaatgtggtattagccgcacagatttaaatgaaaatattgctcaaatcgcggaaggcgcgctaaatgacggatgtactgcaaccaatcctagaataccgacagaaacagatgttagtgcgattcttgaaaaaatgttggcataa

SEQ ID NO: 39672 - protein, 379 aa, Listeria monocytogenes str. 4b F2365
MQKVSFKTDLYIGQGATDRLLDFKDKQIFIVTDPFMVSSGMINAITEKIDPSNTYTIFSEIIPDPPIENVVAGIEVLNECDANLMIAIGGGSAIDAAKAMKFFGQKLGTVRAMPFIVIPTTSGTGSEVTSFSVITNKEKAIKYPLITDAILPDEAILDADLVKSVPPAITADTGMDVLTHALEAYVSTKANDYSDAMAEKVIQLVFTYLERAYKDGNDLEAREKMHNASCLAGMAFNITSLGLNHGIAHTAGAKFKIPHGRMNTLLLPHVISYNAGITSDFGNNPDNRAAERYTAIAKLLKMPASNTRLGVRSLINAIKQLQKKLNMPTTLTECGISRTDLNENIAQIAEGALNDGCTATNPRIPTETDVSAILEKMLA

SEQ ID NO: 39673 - DNA, 2601 bp, Listeria monocytogenes str. 4b F2365
  CDS (1)..(2601): transl_table=11
atggcaattaaagaaaatgcggcccaagaagtattagaagttcaaaaagtgattgacagattagcagacaatggacaaaaagcattgaaagcatttgaaagttacaatcaagaacaagtagacaatatcgttcacgcaatggcacttgccggacttgaccaacatatgccccttgcaaaattagcagtagaagaaactggacgtggattatacgaagataaatgtattaaaaacatcttcgcgacagaatatatttggaacaacattaaaaacaacaaaacagtaggcgttattaatgaagatgtacaaactggtgtgattgaaattgctgaaccagttggagttgttgccggggttacacctgtaactaacccaacatccactactcttttcaaagcaattatcgctatcaaaacacgtaacccaatcatctttgctttccatccaagtgcacagcgttgttcatctgcagcagcgaaagttgtatacgatgcagcaattgcagctggagcaccagaacattgtattcaatgggtagaaaaaccttccctagaagcaacgaaacaattaatgaatcacgataaagtagcacttgtacttgcaactggtggtgctggaatggttaaatcagcatactctactggtaaacctgcactaggtgttggaccaggtaacgtaccagcttacattgacaaaacagccaaaattaaacgttctgttaatgacattattctttctaaatcttttgaccaaggtatgatttgtgcttctgaacaagcagtcatcgtggacaaagaagtagctaaagaagtaaaagcagaaatggaagcaaacaaatgctacttcgttaaaggcgctgaattcaaaaaattagaaagctatgtaatcaatcctgaaaaaggaacacttaacccagatgtagttggtaaatcccctgcatggattgcaaaccaagctggcttcaaagttccagaagatacaaaaattcttgtagctgaaattaaaggtgttggcgacaaatacccactatctcacgaaaaattaagcccagttcttgcattcatcgaagctgctaaccaagcagaagcattcgatcgttgtgaagaaatgttagtatacggaggacttggacactccgcagttattcactctacggataaagaagttcaaaaagcatttggtattcgtatgaaagcttgccgtatcatcgtaaatgcaccaagcgcacaaggcggtatcggtgacatttataacggcttcatcccttccctaacactaggttgtggatcttacggtaaaaactctgtatcacaaaatgtaagtgcgactaacttgctgaacgttaaacgtatcgcggatcggagaaataatatgcaatggttcaaacttccaccaaaaattttctttgaaaaatattccactcaataccttcaaaaaatggaaggcgttgaacgcgtatttatcgtaactgacccaggaatggttcaattcaaatacgtggatgtcgtaatcgaacacctgaaaaaacgtggcaacgatgtagcttaccaagtatttgctgacgttgaaccagatccatctgacgtaacagtttacaaaggtgcagaactaatgaaagacttcaaacctgatacaattatcgctcttggtggtggttctgcaatggatgctgccaaaggtatgtggttattctatgaacacccagaagcttcattcttcggcttgaaacaaaaattcttagatatccgtaaacgtacattcaaatatcctaaacttggtggaaaagcgaaattcgttgcaattccaacaacaagtggtacaggttctgaagtaactccatttgcggttattacagacaaagaaaacaacattaaataccctcttgcagactacgaattaactccagatgttgcgattgtcgatgcacaatatgtaactactgttccagcacacattactgctgacactggtatggacgttctaactcacgcaattgaatcttatgtatccgtaatggcaagcgattatactcgtggattatctatccgcgcaatcgaacttgtatttgaaaacttacgtgaatctgttcttactggtgatccagatgcgcgtgaaaaaatgcataatgcttctgccctagctggtatggcgtttgcaaatgcgttcctaggaattaaccacagcttggcacacaaaattggacctgaattccacattcctcacggtcgtgcgaatgcaatccttatgccacatgttattcgttataacgcacttaaacctaaaaaacatgcgttattccctagatatgaaagcttccgtgctgatgaagattatgctcgtatctctcgtattatcggcttccctgcagcaactacagaagaaggcgttaaatcacttgtagatgaaatcatcaaacttggtaaagacgttggtatcgacatgagtcttaaaggacaaaatgttgctaaaaaagatttggatgcagttgtagatacacttgcagatcgcgcattcatggaccaatgtactactgccaaccctaaacaaccacttgtaagtgaactaaaagaaatctacctagaagcttacaaaggtgtttga

SEQ ID NO: 39674 - protein, 866 aa, Listeria monocytogenes str. 4b F2365
MAIKENAAQEVLEVQKVIDRLADNGQKALKAFESYNQEQVDNIVHAMALAGLDQHMPLAKLAVEETGRGLYEDKCIKNIFATEYIWNNIKNNKTVGVINEDVQTGVIEIAEPVGVVAGVTPVTNPTSTTLFKAIIAIKTRNPIIFAFHPSAQRCSSAAAKVVYDAAIAAGAPEHCIQWVEKPSLEATKQLMNHDKVALVLATGGAGMVKSAYSTGKPALGVGPGNVPAYIDKTAKIKRSVNDIILSKSFDQGMICASEQAVIVDKEVAKEVKAEMEANKCYFVKGAEFKKLESYVINPEKGTLNPDVVGKSPAWIANQAGFKVPEDTKILVAEIKGVGDKYPLSHEKLSPVLAFIEAANQAEAFDRCEEMLVYGGLGHSAVIHSTDKEVQKAFGIRMKACRIIVNAPSAQGGIGDIYNGFIPSLTLGCGSYGKNSVSQNVSATNLLNVKRIADRRNNMQWFKLPPKIFFEKYSTQYLQKMEGVERVFIVTDPGMVQFKYVDVVIEHLKKRGNDVAYQVFADVEPDPSDVTVYKGAELMKDFKPDTIIALGGGSAMDAAKGMWLFYEHPEASFFGLKQKFLDIRKRTFKYPKLGGKAKFVAIPTTSGTGSEVTPFAVITDKENNIKYPLADYELTPDVAIVDAQYVTTVPAHITADTGMDVLTHAIESYVSVMASDYTRGLSIRAIELVFENLRESVLTGDPDAREKMHNASALAGMAFANAFLGINHSLAHKIGPEFHIPHGRANAILMPHVIRYNALKPKKHALFPRYESFRADEDYARISRIIGFPAATTEEGVKSLVDEIIKLGKDVGIDMSLKGQNVAKKDLDAVVDTLADRAFMDQCTTANPKQPLVSELKEIYLEAYKGV

SEQ ID NO: 39675 - DNA, 1179 bp, Bacillus anthracis str. 'Ames Ancestor'
  CDS (1)..(1179): transl_table=11
atgccgaagtctgtattatatggaagaaattctcttgaaaagctgtgggaacaatctaagaaattcgggaaaagagcgtttatagttacggatacaattatggaggatttaggatatgttgagaggtgtatacaacaattaaatacgaaaggtataactgttattacatataataaagtaaatgctgagcctacaaatatacacgtgttagaggcgttaactatttgtaaagaaggaaagtgtgattttataatcggtcttggtggtggaagttgtattgatgcagcaaaagcagttgcggtgttatatacaaatggcggagaagtggaagattatgtccaaaaggatagggaaatagacaatgatccgctaccacttattgcaatcccaacaacctctggaactggatcggaagtaacaagtgtagcagtaattacgaataaacgaacagatgtaaaaatgatgatgaagcatccgagttttaccccgcaagtagcaattattgacccaattttaacacgttcggtaccacctcacattacagcagcaacagggatagatgctttatgtcatgcagtcgaagcatatatttctaaagtttcacaatcacttacagatgtattagctctttccgctattgaaagtattatgaaatatttacgtattgcatatgaagatggagagaatatggaggcaagagaagcgatgatgatagcgtccttacaagctggaattgcattttctaatgcatctgttacattagttcatggcatgtcgagaccagtaggagcattatttcatgtaccacatggtatatcgaatgcaatactattacctacagttttagagtatacaaaaggtagtgcggtaaaaagactagcggaaattggccgctgtttaaataaagatttgtattcctattgtgatgaagaagtagccgactacacgctgggggaaataaaaaaactttgttttgatcttcatattccaaatttaaaagaatacggaattggtgagcttgagtttgaaaaagctatttctaaaatggcgtcagatgcaattgaaagtggaagtccagcgaataacccacgtgtgccatcatatgatgaaattaaacagttgtatcgagaatgttttcattataaatatgaagattcaataaaaacattaggggattaa

SEQ ID NO: 39676 - protein, 392 aa, Bacillus anthracis str. 'Ames Ancestor'
MPKSVLYGRNSLEKLWEQSKKFGKRAFIVTDTIMEDLGYVERCIQQLNTKGITVITYNKVNAEPTNIHVLEALTICKEGKCDFIIGLGGGSCIDAAKAVAVLYTNGGEVEDYVQKDREIDNDPLPLIAIPTTSGTGSEVTSVAVITNKRTDVKMMMKHPSFTPQVAIIDPILTRSVPPHITAATGIDALCHAVEAYISKVSQSLTDVLALSAIESIMKYLRIAYEDGENMEAREAMMIASLQAGIAFSNASVTLVHGMSRPVGALFHVPHGISNAILLPTVLEYTKGSAVKRLAEIGRCLNKDLYSYCDEEVADYTLGEIKKLCFDLHIPNLKEYGIGELEFEKAISKMASDAIESGSPANNPRVPSYDEIKQLYRECFHYKYEDSIKTLGD

SEQ ID NO: 39677 - DNA, 1203 bp, Bacillus anthracis str. Sterne
  CDS (1)..(1203): transl_table=11
ttgcaagaagttgctgagtttcgtatgccgaagtctgtattatatggaagaaattctcttgaaaagctgtgggaacaatctaagaaattcgggaaaagagcgtttatagttacggatacaattatggaggatttaggatatgttgagaggtgtatacaacaattaaatacgaaaggtataactgttattacatataataaagtaaatgctgagcctacaaatatacacgtgttagaggcgttaactatttgtaaagaaggaaagtgtgattttataatcggtcttggtggtggaagttgtattgatgcagcaaaagcagttgcggtgttatatacaaatggcggagaagtggaagattatgtccaaaaggatagggaaatagacaatgatccgctaccacttattgcaatcccaacaacctctggaactggatcggaagtaacaagtgtagcagtaattacgaataaacgaacagatgtaaaaatgatgatgaagcatccgagttttaccccgcaagtagcaattattgacccaattttaacacgttcggtaccacctcacattacagcagcaacagggatagatgctttatgtcatgcagtcgaagcatatatttctaaagtttcacaatcacttacagatgtattagctctttccgctattgaaagtattatgaaatatttacgtattgcatatgaagatggagagaatatggaggcaagagaagcgatgatgatagcgtccttacaagctggaattgcattttctaatgcatctgttacattagttcatggcatgtcgagaccagtaggagcattatttcatgtaccacatggtatatcgaatgcaatactattacctacagttttagagtatacaaaaggtagtgcggtaaaaagactagcggaaattggccgctgtttaaataaagatttgtattcctattgtgatgaagaagtagccgactacacgctgggggaaataaaaaaactttgttttgatcttcatattccaaatttaaaagaatacggaattggtgagcttgagtttgaaaaagctatttctaaaatggcgtcagatgcaattgaaagtggaagtccagcgaataacccacgtgtgccatcatatgatgaaattaaacagttgtatcgagaatgttttcattataaatatgaagattcaataaaaacattaggggattaa

SEQ ID NO: 39678 - protein, 400 aa, Bacillus anthracis str. Sterne
MQEVAEFRMPKSVLYGRNSLEKLWEQSKKFGKRAFIVTDTIMEDLGYVERCIQQLNTKGITVITYNKVNAEPTNIHVLEALTICKEGKCDFIIGLGGGSCIDAAKAVAVLYTNGGEVEDYVQKDREIDNDPLPLIAIPTTSGTGSEVTSVAVITNKRTDVKMMMKHPSFTPQVAIIDPILTRSVPPHITAATGIDALCHAVEAYISKVSQSLTDVLALSAIESIMKYLRIAYEDGENMEAREAMMIASLQAGIAFSNASVTLVHGMSRPVGALFHVPHGISNAILLPTVLEYTKGSAVKRLAEIGRCLNKDLYSYCDEEVADYTLGEIKKLCFDLHIPNLKEYGIGELEFEKAISKMASDAIESGSPANNPRVPSYDEIKQLYRECFHYKYEDSIKTLGD

SEQ ID NO: 39679 - DNA, 2604 bp, Bacillus anthracis str. Sterne
  CDS (1)..(2604): transl_table=11
atggtagtcaaagagaaagttgtaaatgaaatgcaggaagtaaaagagatgattgatacgttagtgaataacggtcggaaggctttacaagcattagaaagttttacacaagagcaaattgacaacattgttcatgaaatggcattagcaggtgttgatcaacatatgcctcttgcgaagttggctgttgaagaaacaggtcgtggtgtatacgaagataaatgcattaaaaatatttttgctactgaatatatttggcatagcataaagaaagataaaacagtagggattattcacgaagaccctcatgaagaaataatagaaattgcggagcccgtcggtgtagtagctggggtaacaccagtaacgaatccaacatcgacaacaatgtttaaagcattaatagcgataaaaacgagaaatccaattattttcgcatttcatccttcagcacaaaactgttctgttgcagccgcgaaaacagtatacgatgcagcggtgaaggcgggggcaccaaaacattgtattcagtggattgaaaagccttctgtcgaagcaacgaaacaattaatgaaccatgaaggtgttgcgcttgttttagcaactggaggggctggtatggtgaaatcagcttattctactggaaaaccagcgctaggtgtaggtcctggtaatgtaccatgttatatagagaaatcagcgcatataaaacgagcggttaatgatttgattttatcaaaaacgtttgataacgggatgatttgtgcatcagaacaagcaatcattgtagacaaggaaatttatgatgatgtgaaaacagaaatgattacaaatgattgttactttgtaacagaggaagagagaagaaaattagaaaagcttgttattaatgaaaatacatgtgcagtaaatagtgatattgtagggaaatctgcacagtatattgccgaattagttggaattactgtacctaaaaatacaaaaatgcttgtagctgaaatacaaggcatcggagccgcatatccactatctcgtgagaagttaagtccagtattagcttgtgtaaaagcaaattcattagaagaaggatttacatattgtgaagaaatgttaaacctcggtggcttagggcattcagcagttatccattctgtaaataaagaagtgcaaaagcaatttggattacgtatgaaagcttgccgccttattgtaaatgctccttcatcacaaggtggaatcggtgacatatataatggatttattccatcacttacgcttggctgcggttcctacgggaaaaactcggtttctcaaaacgtaacagcgacgcacttattaaatataaaaaggttggcaaatagaaaaaagaatatgcagtggttcaaattaccaccaaaaatttattttgaaaaacatgcgacagcatatttagcaaatatgcctaacatttcacgtgcgtttattgtaacggatccaggaatggttgagcatggatatgtagatacggtcgcgcattatttacgtaaacatgcaaatgatgtgaaagtagaagttttctttgaggttgagccagatccatcagatgaaactgtttttaaaggtgcggaaatgatgagaagttttcagcctgatgtcatcatcgcacttggtggtggttcagcgatggatgcagcgaaagggatgtggcttttctatgagtacccagaaacaacattctatggaattaaacagaagtttttagatataagaaaacgtacatgtaaatatccggaattaggaagtaaggcgcagtttgttgccattccaacaacatctggaacaggatcagaagtgacaccatttgcggttattacagataagaaaaataatataaagtatccacttgccgattatgaattaacgccagatgtagcaattgttgatccgcaatttgtaatgacagtaccaccacatgtaacagcagatactgggatggacgtattaacgcatgcaatcgaggcatatgtgtctgttttagcaaatgattatacagatggattagcattaaaggccattgatctcgtatttaaatatttaccaagagcatttaaagatggacatgatgaagaagcacgagaaaaaatgcataatgcttctgcaattgcagggatggcatttgcaaatgcattcctaggtattaatcacagtttagcgcataaaattggaccagaattccatattccgcatggacgtgcgaatgcaattcttatgccgcacgtaattcgttataatgctattaagccaagaaaacatgcattgttcccaaaatatgagcactttgtggctgatgaacgctatgcacatattgcgagaatgctcgggctaccagcaagttcggtggcagaaggtgtagaatcactcgacaaagcaattattgatctcggaaaaagtttaaatataaatatgagtattgcgggacaaggagttgctaaagaccaatttgaagaggttgttggattattagcagaaagagcttttgaagatcaatgtacaacagctaatccgaaattacctctcatttcagagctgaaagaaatttatatgaaagcatataaaggtgagtaa

SEQ ID NO: 39680 - protein, 867 aa, Bacillus anthracis str. Sterne
MVVKEKVVNEMQEVKEMIDTLVNNGRKALQALESFTQEQIDNIVHEMALAGVDQHMPLAKLAVEETGRGVYEDKCIKNIFATEYIWHSIKKDKTVGIIHEDPHEEIIEIAEPVGVVAGVTPVTNPTSTTMFKALIAIKTRNPIIFAFHPSAQNCSVAAAKTVYDAAVKAGAPKHCIQWIEKPSVEATKQLMNHEGVALVLATGGAGMVKSAYSTGKPALGVGPGNVPCYIEKSAHIKRAVNDLILSKTFDNGMICASEQAIIVDKEIYDDVKTEMITNDCYFVTEEERRKLEKLVINENTCAVNSDIVGKSAQYIAELVGITVPKNTKMLVAEIQGIGAAYPLSREKLSPVLACVKANSLEEGFTYCEEMLNLGGLGHSAVIHSVNKEVQKQFGLRMKACRLIVNAPSSQGGIGDIYNGFIPSLTLGCGSYGKNSVSQNVTATHLLNIKRLANRKKNMQWFKLPPKIYFEKHATAYLANMPNISRAFIVTDPGMVEHGYVDTVAHYLRKHANDVKVEVFFEVEPDPSDETVFKGAEMMRSFQPDVIIALGGGSAMDAAKGMWLFYEYPETTFYGIKQKFLDIRKRTCKYPELGSKAQFVAIPTTSGTGSEVTPFAVITDKKNNIKYPLADYELTPDVAIVDPQFVMTVPPHVTADTGMDVLTHAIEAYVSVLANDYTDGLALKAIDLVFKYLPRAFKDGHDEEAREKMHNASAIAGMAFANAFLGINHSLAHKIGPEFHIPHGRANAILMPHVIRYNAIKPRKHALFPKYEHFVADERYAHIARMLGLPASSVAEGVESLDKAIIDLGKSLNINMSIAGQGVAKDQFEEVVGLLAERAFEDQCTTANPKLPLISELKEIYMKAYKGE

SEQ ID NO: 39681 - DNA, 1203 bp, Bacillus thuringiensis serovar konkukian str. 97-27
  CDS (1)..(1203): transl_table=11
ttgcaagaagttgctgagtttcgtatgccgaagtctgtattatatggaagaaattctcttgaaaagctgtgggaacaatctaagaaattcgggaaaagagcgtttatagttacggatacaattatggaggatttaggatatgttgagaggtgtatacaacaattaaatacgaaaggtataactgttattacatataataaagtaaatgctgagcctacaaatatacacgtgttagaggcgttaactatttgtaaagaaggaaagtgtgattttataatcggtcttggtggtggaagttgtattgatgcagcaaaagcagttgcggtgttatatacaaatggcggagaagtggaagattatgtccaaaaggatagggaaatagacaatgatccgctaccacttattgcaatcccaacaacttctggaactggatcggaagtaacaagtgtagcagtaattacgaataaacgaacagatgtaaaaatgatgatgaagcatccgagctttaccccgcaagtagcgattattgacccaattttaacacgttcggtaccacctcacattacagcagcaacagggatagatgctttatgtcatgcagtcgaagcatatatttctaaagtttcacaatcacttacagatgtattagctctttccgctattgaaagtattatgaaatatttacgtattgcatatgaagatggagagaatatggaggcaagagaagcgatgatgatagcgtccttacaagctggaattgcattttctaatgcatctgttacattagttcatggcatgtcgagaccagtaggagcattatttcatgtaccacatggtatatcgaatgcaatactattacctacagttttagagtatacaaaaggtagtgcggtaaaaagactagcggaaattggccgctgtttaaataaagatttgtattcctattgtgatgaagaagtagccgactacacgctgggggaaataaaaaaactttgttttgatcttcatattccaaatttaaaagaatacggaattggtgagcttgagtttgaaaaagctatttctaaaatggcgtcagatgcaattgaaagtggaagtccagcgaataacccacgtgtgccatcatatgatgaaattaaacagttgtatcgagaatgttttcattataaatatgaagattcaataaaaacattagggaattaa

SEQ ID NO: 39682 - protein, 400 aa, Bacillus thuringiensis serovar konkukian str. 97-27
MQEVAEFRMPKSVLYGRNSLEKLWEQSKKFGKRAFIVTDTIMEDLGYVERCIQQLNTKGITVITYNKVNAEPTNIHVLEALTICKEGKCDFIIGLGGGSCIDAAKAVAVLYTNGGEVEDYVQKDREIDNDPLPLIAIPTTSGTGSEVTSVAVITNKRTDVKMMMKHPSFTPQVAIIDPILTRSVPPHITAATGIDALCHAVEAYISKVSQSLTDVLALSAIESIMKYLRIAYEDGENMEAREAMMIASLQAGIAFSNASVTLVHGMSRPVGALFHVPHGISNAILLPTVLEYTKGSAVKRLAEIGRCLNKDLYSYCDEEVADYTLGEIKKLCFDLHIPNLKEYGIGELEFEKAISKMASDAIESGSPANNPRVPSYDEIKQLYRECFHYKYEDSIKTLGN

SEQ ID NO: 39683 - DNA, 2604 bp, Bacillus thuringiensis serovar konkukian str. 97-27
  CDS (1)..(2604): transl_table=11
atggtagtcaaagagaaagttgtaaatgaaatgcaggaagtaaaagagatgattgatacgttagtgaataacggtcggaaggctttacaagcattagaaagttttacacaagagcaaattgacaacattgttcatgaaatggcattagcaggtgttgatcaacatatgccacttgcgaaattggctgttgaagaaacaggtcgtggtgtatacgaagataaatgcattaaaaatatttttgctactgaatatatttggcatagcataaagaaagataaaacagtagggattattcacgaagatcctcatgaagaaataatagaaattgcggagcccgtcggtgtagtagctggggtaacaccagtaacaaatccaacatcgacaacaatgtttaaagcattaatcgcgataaaaacgagaaatccaattattttcgcatttcatccttcagcacaaaactgttctattgcagccgcgaaaacagtatacgatgcagcggtgaaggcgggggcaccaaaacattgtgtgcagtggattgaaaagccttctgtcgaagcaacgaaacaattaatgaaccatgaaggtgttgcgcttgttttggcaactggaggggctggtatggtgaaatcagcttattctactggaaaaccagcgctaggtgtaggtcctggtaatgtaccatgttatatagagaaatcagcgcatataaaacgagcggttaatgatttgattttatcaaaaacatttgataacgggatgatttgtgcatcagaacaagcaattattgtagataaggaaatttatgatgatgtgaaaacagaaatgattgcaaatgattgttactttgtaacagaggaagagagaagaaaattagaaaagcttgttattaatgaaaatacatgtgcagtaaatagtgatattgtagggaaatccgcacagtatattgccgaattagttggaattactgtacctaaaaatacaaaaatgcttgtagctgaaatacaaggcatcggagccgcatatccactatcacgtgagaagttaagtccagtattagcttgtgtaaaagcaaattcattagaagaaggatttacatattgtgaagaaatgttaaacctcggtggtttagggcattcagcagttatccattctgtaaataaagaagtgcaaaagcaatttggattacgtatgaaagcttgtcgccttattgtaaatgctccttcatcacaaggtggaatcggtgacatatataatggatttattccatcacttacgcttggctgcggttcctacgggaaaaactcggtttctcaaaacgtaacagcgacgcatttattaaatataaaaaggttggcaaatagaaaaaagaatatgcagtggttcaaattaccaccaaaaatttattttgaaaaacatgcgacagcatatttagcaaatatgcctaacatttcacgtgcgtttattgtaacggatccaggaatggttgagcacggatatgtagatacggtcgctcattatttacgtaaacatgcaaatgatgtgaaagtagaagttttctttgaggttgagccagatccatcagatgaaactgtgtttaaaggtgcggaaatgatgagaagttttcagcctgacgtcattatcgcacttggtggtggttcagcgatggatgcagcgaaagggatgtggcttttctatgagcatccagaaacaacattctatggaattaaacagaagtttttagatataagaaaacgcacatgtaaatatccggaattaggaagtaaggcgcagtttgttgccattccaacaacatctggaacaggatcagaagtgacaccatttgcggttattacagataagaaaaataatataaagtacccactcgcggattatgaattaacgccagatgtagcaattgtagatccgcaatttgtaataacagtaccgccacatgtaacagcagacactgggatggacgtattaacgcatgcaatcgaggcgtatgtgtctgttttagcaaatgactatacagatggactagcattaaaggctattgatctcgtatttaaatatttaccaagagcatttaaagatggacatgatgaagaagcacgagaaaaaatgcataatgcttctgcaattgcagggatggcatttgcaaatgcattcctaggtattaatcacagtttagcgcataaaattggaccagaattccatattccgcatggacgtgcgaatgccattcttatgccgcacgtaattcgttataatgctattaagccaagaaaacatgcattgttcccaaaatatgagcactttgtggctgatgaacgctatgcacatattgcgagaatgctcgggcttccagcaagttcggcggcagaaggtgtggaatcactcgtcaaagcaattattgatctcggaaaaagtttaaatataaatatgagtattgcgggacaaggagttgctaaagaccaatttgaagaggttgttggattattagcagaaagagcttttgaagatcaatgtacaacagctaatccgaaattacctctcatttcagagctgaaagaaatttatatgaaagcatataaaggtgagtaa

SEQ ID NO: 39684 - protein, 867 aa, Bacillus thuringiensis serovar konkukian str. 97-27
MVVKEKVVNEMQEVKEMIDTLVNNGRKALQALESFTQEQIDNIVHEMALAGVDQHMPLAKLAVEETGRGVYEDKCIKNIFATEYIWHSIKKDKTVGIIHEDPHEEIIEIAEPVGVVAGVTPVTNPTSTTMFKALIAIKTRNPIIFAFHPSAQNCSIAAAKTVYDAAVKAGAPKHCVQWIEKPSVEATKQLMNHEGVALVLATGGAGMVKSAYSTGKPALGVGPGNVPCYIEKSAHIKRAVNDLILSKTFDNGMICASEQAIIVDKEIYDDVKTEMIANDCYFVTEEERRKLEKLVINENTCAVNSDIVGKSAQYIAELVGITVPKNTKMLVAEIQGIGAAYPLSREKLSPVLACVKANSLEEGFTYCEEMLNLGGLGHSAVIHSVNKEVQKQFGLRMKACRLIVNAPSSQGGIGDIYNGFIPSLTLGCGSYGKNSVSQNVTATHLLNIKRLANRKKNMQWFKLPPKIYFEKHATAYLANMPNISRAFIVTDPGMVEHGYVDTVAHYLRKHANDVKVEVFFEVEPDPSDETVFKGAEMMRSFQPDVIIALGGGSAMDAAKGMWLFYEHPETTFYGIKQKFLDIRKRTCKYPELGSKAQFVAIPTTSGTGSEVTPFAVITDKKNNIKYPLADYELTPDVAIVDPQFVITVPPHVTADTGMDVLTHAIEAYVSVLANDYTDGLALKAIDLVFKYLPRAFKDGHDEEAREKMHNASAIAGMAFANAFLGINHSLAHKIGPEFHIPHGRANAILMPHVIRYNAIKPRKHALFPKYEHFVADERYAHIARMLGLPASSAAEGVESLVKAIIDLGKSLNINMSIAGQGVAKDQFEEVVGLLAERAFEDQCTTANPKLPLISELKEIYMKAYKGE

SEQ ID NO: 39685 - DNA, 2610 bp, Staphylococcus aureus subsp. aureus MRSA252
  CDS (1)..(2610): transl_table=11
atgttaactatacctgaaaaagaaaatcgtggatcgaaagaacaagaagtggcaattatgattgatgctctagctgacaaagggaaaaaggcattagaagcattatctaaaaagtcacaagaagaaattaatcatattgttcatcaaatgagcttagcagctgttgatcaacatatggtgctagcaaaattagcacatgaagaaactggaagaggtatatacgaagataaagcgattaaaaatttatacgcttctgaatatatatggaattcaataaaagacaataagacagtagggattattggtgaagataaagaaaaaggattaacgtatgtagcggaaccaattggtgttatttgtggtgttacgccaacaacaaatcctacgtcgacaactatttttaaagcgatgattgcaattaagacaggaaatccaatcatttttgcattccatccaagtgcgcaagaatcgtcgaagcgtgcagcagaagttgtattagaagcggcaatgaaggcaggtgcacctaaagatattattcaatggattgaagtgccctctatcgaagcaacaaaacaattaatgaatcacaaaggtattgcattagttctagcaacaggtggttcgggcatggttaagtctgcatattcaactggcaaaccggcattaggtgtgggaccaggtaacgtgccgtcttacattgaaaaaacagcacacattaagcgtgcagtaaatgatatcattggttcaaaaacatttgataatggtatgatttgtgcttctgaacaagttgtagtcattgataaagaaatttataaagatgttactaatgaatttaaagcacatcaagcatactttgttaaaaaagatgaattacaacgcttagaaaatgcaattatgaatgaacaaaaaacaagtattaaacctgatattgtcggtaaatctgcagttgaaatagctgaattagcaggtatacctgtccccgaaaatacaaaacttatcatagccgaaattagcggtgtaggttcagactatccgttatctcgtgaaaaattatctccagtattagccttagtaaaagcccaatctacaaaacaagcatttcaaatttgtgaagacacactacattttggtggattaggacacacagccgttatccatacagaagatgaaacattacaaaaagattttggactaagaatgaaagcttgtcgtgtacttgtaaatacaccatcagcggttggaggtattggtgatatgtataacgaattgattccgtctttaacattaggttgtggttcgtacggtagaaactcaatttcacataatgttagtgcgacagatttattaaacattaaaacaattgctaaacgacgtaataatactcaaattttcaaggtgcctgctcaaatttattttgaagaaaatgcaatcatgagtctaacaacaatggacaagattgaaaaagtgatgattgtctgtgaccctggtatggtcgaattcggttatacaaaaacagttgagaatgtattaagacaaagaacggaacagcctcaaattaaaatatttagcgaagtcgaaccgaacccatcaacgaatacagtatataaaggtctggaaatgatggttgatttccaaccggatacaatcattgcacttggtggtggttcagcgatggatgctgcaaaagcaatgtggatgttctttgaacaccctgagacatcattcttcggtgctaaacaaaagttcctagacatcggtaaacgtacttataaaataggcatgcctgaaaatgcgacgttcatttgtatccctacgacatcaggtacaggttcagaagtaacaccatttgcagttatcacagatagtgaaacaaatgtaaaatatccgttggctgattttgctttaacacctgatgttgcaattattgaccctcaatttgtgatgagtgtgccaaaaagcgttacagcagatacaggaatggatgtactaacgcatgcaatggaatcatatgtatctgtaatggcttcagattacacaagaggtttgagtctacaagcgattaaattgacgttcgaatatttaaaatcatctgttgaaaaaggtgataaagtttcaagagagaaaatgcataacgcatcaactttggctggtatggcatttgcaaatgcattcttaggcattgcacactcaattgcgcataaaattggtggggaatatggtattccgcatggtagagcgaatgcgatattactaccgcatattatccgttataatgccaaagacccgcaaaaacatgcattattccctaaatatgagttcttcagagcagatacagattatgcagatattgccaaattcttaggattaaaaggtaatacgacagaagcactcgtagaatcattagctaaagctgtctacgaattaggtcaatcagtcggaattgaaatgaatttgaaatcacaaggtgtgtctgaagaagaattaaatgagtcaattgatagaatggcagagctcgcatttgaagatcagtgtacaactgctaatcctaaagaagcgctaatcagtgaaatcaaagatatcattcaaacatcatatgattataagcaataa

SEQ ID NO: 39686 - protein, 869 aa, Staphylococcus aureus subsp. aureus MRSA252
MLTIPEKENRGSKEQEVAIMIDALADKGKKALEALSKKSQEEINHIVHQMSLAAVDQHMVLAKLAHEETGRGIYEDKAIKNLYASEYIWNSIKDNKTVGIIGEDKEKGLTYVAEPIGVICGVTPTTNPTSTTIFKAMIAIKTGNPIIFAFHPSAQESSKRAAEVVLEAAMKAGAPKDIIQWIEVPSIEATKQLMNHKGIALVLATGGSGMVKSAYSTGKPALGVGPGNVPSYIEKTAHIKRAVNDIIGSKTFDNGMICASEQVVVIDKEIYKDVTNEFKAHQAYFVKKDELQRLENAIMNEQKTSIKPDIVGKSAVEIAELAGIPVPENTKLIIAEISGVGSDYPLSREKLSPVLALVKAQSTKQAFQICEDTLHFGGLGHTAVIHTEDETLQKDFGLRMKACRVLVNTPSAVGGIGDMYNELIPSLTLGCGSYGRNSISHNVSATDLLNIKTIAKRRNNTQIFKVPAQIYFEENAIMSLTTMDKIEKVMIVCDPGMVEFGYTKTVENVLRQRTEQPQIKIFSEVEPNPSTNTVYKGLEMMVDFQPDTIIALGGGSAMDAAKAMWMFFEHPETSFFGAKQKFLDIGKRTYKIGMPENATFICIPTTSGTGSEVTPFAVITDSETNVKYPLADFALTPDVAIIDPQFVMSVPKSVTADTGMDVLTHAMESYVSVMASDYTRGLSLQAIKLTFEYLKSSVEKGDKVSREKMHNASTLAGMAFANAFLGIAHSIAHKIGGEYGIPHGRANAILLPHIIRYNAKDPQKHALFPKYEFFRADTDYADIAKFLGLKGNTTEALVESLAKAVYELGQSVGIEMNLKSQGVSEEELNESIDRMAELAFEDQCTTANPKEALISEIKDIIQTSYDYKQ

SEQ ID NO: 39687 - DNA, 2610 bp, Staphylococcus aureus subsp. aureus MSSA476
  CDS (1)..(2610): transl_table=11
atgttaactatacctgaaaaagaaaatcgtggatcgaaagaacaagaagtggcaattatgattgatgctctagctgacaaagggaaaaaagcattagaagcattatctaaaaagtcacaagaagaaattgatcatattgttcatcaaatgagcttagcagctgttgatcaacatatggtgctagcaaaattagcacatgaagaaactggaagaggtatatacgaagataaagcgattaaaaatttatacgcttctgaatatatatggaattcaataaaagacaataagacagtagggattattggtgaagataaagaaaaaggattaacgtatgtagcggaaccaattggtgttatttgtggtgttacgccaacaacaaatcctacgtcgacaactatttttaaagcgatgattgcaattaagacaggaaatccaatcatttttgcattccatccaagtgcacaagaatcgtcgaagcgtgcagcagaagttgtattagaagcggcaatgaaggcaggtgcacctaaagatattattcagtggattgaagtgccttctatcgaagcaacaaaacaattaatgaatcacaaaggtattgcattagttctagcaacaggtggttcgggcatggttaagtctgcatattcaactggcaaaccggcattaggtgtgggaccaggtaacgtgccgtcttacattgaaaaaacagcacacattaaacgtgcagtaaatgatatcattggttcaaaaacatttgataatggtatgatttgtgcttctgaacaagttgtagtcattgataaagaaatttataaagatgttactaatgaatttaaagcacatcaagcatactttgttaaaaaagatgaattacaacgcttagaaaatgcaattatgaatgaacaaaaaacaggtattaagcctgatattgtcggtaaatctgcagttgaaatagctgaattagcaggtatacctgtccccgaaaatacaaaacttatcatagccgaaattagcggtgtaggttcagactatccgttatctcgtgaaaaattatctccagtattagccttagtaaaagcccaatctacaaaacaagcatttcaaatttgtgaagacacactacattttggtggattaggacacacagccgttatccatacagaagatgaaacattacaaaaagattttggactaagaatgaaagcttgtcgtgtacttgtaaatacaccatcagcggttggaggtattggtgatatgtataacgaattgattccgtctttaacattaggttgtggttcgtacggtagaaactcaatttcacataatgttagtgcgacagatttattaaacattaaaacgattgctaaacgacgtaataatactcaaattttcaaggtgcctgctcaaatttattttgaagaaaatgcaatcatgagtctaacaacaatggacaagattgaaaaagtgatgattgtctgtgaccctggtatggtagaattcggttatacaaaaacagttgagaatgtattaagacaaagaacggaacagcctcaaattaaaatatttagcgaagtcgaaccgaacccatcaactaatacagtatataaaggtctggaaatgatggttgatttccaaccggatacaatcattgcacttggtggtggttcagcgatggatgctgcaaaagcaatgtggatgttctttgaacaccctgagacatcattcttcggtgctaaacaaaagttcctagacatcggtaaacgtacttataaaataggcatgcctgaaaatgcgacgttcatttgtatccctacgacatcaggtacaggttcagaagtaacaccatttgcagttatcacagatagtgaaacaaatgtaaaatatccgttggctgattttgctttaacacctgacgttgcaattattgaccctcaatttgtgatgagtgtgccaaaaagcgttacagcagatacaggaatggatgtactaacgcatgcaatggaatcatatgtatctgtaatggcttcagactacacaagaggtttgagtctacaagcgattaaattgacgttcgaatatttaaaatcatctgttgaaaagggtgataaagtttcaagagagaaaatgcataacgcatcaactttggctggtatggcatttgcaaatgcattcttaggcattgcacactcaattgcgcataaaattggtggcgaatatggtattccgcatggtagagcgaatgcgatattactaccgcatattatccgttataatgccaaagacccgcaaaaacatgcgttattccctaaatatgagttcttcagagcagatacagattatgcagatattgccaaattcttaggattaaaaggtaatacgacagaagcacttgtagaatcattagctaaagctgtctacgaattaggtcaatcagtcggaattgaaatgaatttgaaatcacaaggtgtgtctgaagaagaattaaatgagtcaattgatagaatggcagagctcgcatttgaagatcaatgtacaactgctaatcctaaagaagcactaatcagtgaaatcaaagatatcattcaaacatcatatgattataagcaataa

SEQ ID NO: 39688 - protein, 869 aa, Staphylococcus aureus subsp. aureus MSSA476
MLTIPEKENRGSKEQEVAIMIDALADKGKKALEALSKKSQEEIDHIVHQMSLAAVDQHMVLAKLAHEETGRGIYEDKAIKNLYASEYIWNSIKDNKTVGIIGEDKEKGLTYVAEPIGVICGVTPTTNPTSTTIFKAMIAIKTGNPIIFAFHPSAQESSKRAAEVVLEAAMKAGAPKDIIQWIEVPSIEATKQLMNHKGIALVLATGGSGMVKSAYSTGKPALGVGPGNVPSYIEKTAHIKRAVNDIIGSKTFDNGMICASEQVVVIDKEIYKDVTNEFKAHQAYFVKKDELQRLENAIMNEQKTGIKPDIVGKSAVEIAELAGIPVPENTKLIIAEISGVGSDYPLSREKLSPVLALVKAQSTKQAFQICEDTLHFGGLGHTAVIHTEDETLQKDFGLRMKACRVLVNTPSAVGGIGDMYNELIPSLTLGCGSYGRNSISHNVSATDLLNIKTIAKRRNNTQIFKVPAQIYFEENAIMSLTTMDKIEKVMIVCDPGMVEFGYTKTVENVLRQRTEQPQIKIFSEVEPNPSTNTVYKGLEMMVDFQPDTIIALGGGSAMDAAKAMWMFFEHPETSFFGAKQKFLDIGKRTYKIGMPENATFICIPTTSGTGSEVTPFAVITDSETNVKYPLADFALTPDVAIIDPQFVMSVPKSVTADTGMDVLTHAMESYVSVMASDYTRGLSLQAIKLTFEYLKSSVEKGDKVSREKMHNASTLAGMAFANAFLGIAHSIAHKIGGEYGIPHGRANAILLPHIIRYNAKDPQKHALFPKYEFFRADTDYADIAKFLGLKGNTTEALVESLAKAVYELGQSVGIEMNLKSQGVSEEELNESIDRMAELAFEDQCTTANPKEALISEIKDIIQTSYDYKQ

SEQ ID NO: 39689 - DNA, 1173 bp, Acinetobacter sp. ADP1
  CDS (1)..(1173): transl_table=11
atggcttttaaaaatattgctgaccaaacaaacggtttttatatcccttgtgtctccctttttggccctggttgtgccaaagaaattggtaccaaagcacaaaatttaggtgcaaaaaaagcactcatcgtgactgatgctggtttatttaaatttggtgtagctgacactatcgcagcataccttaaagaagctggcgtagacagtcatattttcccaggcgctgaacccaatccgacagataaaaacgtacataatggcgttgatgcatataataccaatggatgtgactttattgtatcgctcggtggtggatcatctcacgactgtgcaaaaggtattggattagttaccgcaggcggtggtcacattcgtgattacgaaggaattgataaaagtactgttccaatgacgccgttaattgcagtcaataccactgcaggcacagcatctgaaatgacacgtttctgtattattaccaatacagatacacatgtaaaaatggcgattgtagattggcgttgtaccccactgattgccattgatgaccctaagctcatgattgctaagcctgcaagcctgactgctgcgactggtatggatgcgctgacacatgctgtcgaagcttatgtatctactgctgcgaacccaatcacagacgcctgtgccgaaaaagcaatcagcatgatcagtgaatggctcagcccagctgttgccaatggtgaaaaccttgaagcacgtgatgcaatgagctatgcccaatatcttgcaggtatggcatttaacaatgcgtcattaggttatgttcatgccatggcgcaccaacttggcggtttctacaatctgccacacggcgtatgtaatgcggtattgttgccacacgtttgtgagttcaacctgattgcttgcccagagcgttatgcacgtatcgcagaattaatgggcgtaaatacacacggccttacggtgactgaagctgcatatgctgcaatcgatgcaattcgtacattatcaaaatcaattggtatcccatctggcttgaccgagcttggtgtaaaaactgaagatcttgcagtaatggccgaaaatgcacaaaaagacgcgtgtatgttgactaatccacgcaaagcaaatcacgctcaagttgtagatattttcacagcagcattgtaa

SEQ ID NO: 39690 - protein, 390 aa, Acinetobacter sp. ADP1
MAFKNIADQTNGFYIPCVSLFGPGCAKEIGTKAQNLGAKKALIVTDAGLFKFGVADTIAAYLKEAGVDSHIFPGAEPNPTDKNVHNGVDAYNTNGCDFIVSLGGGSSHDCAKGIGLVTAGGGHIRDYEGIDKSTVPMTPLIAVNTTAGTASEMTRFCIITNTDTHVKMAIVDWRCTPLIAIDDPKLMIAKPASLTAATGMDALTHAVEAYVSTAANPITDACAEKAISMISEWLSPAVANGENLEARDAMSYAQYLAGMAFNNASLGYVHAMAHQLGGFYNLPHGVCNAVLLPHVCEFNLIACPERYARIAELMGVNTHGLTVTEAAYAAIDAIRTLSKSIGIPSGLTELGVKTEDLAVMAENAQKDACMLTNPRKANHAQVVDIFTAAL

SEQ ID NO: 39691 - DNA, 1185 bp, Acinetobacter sp. ADP1
  CDS (1)..(1185): transl_table=11
atggcaaagccttattacgaatttttttgtccagtaaaagtgattgcaggcaatgctgctttagaacatattccatttgaacttgcgaccttaggttcaaaacgtccaatgatcatcaccgataaaggtgtaagagccaatcacctgcttgaacccattgaagccgctttcagctctactgatgccgaaattggttatatctttgatgatgtgccacctgattcaagtttacaaacggtaagaaaagcagctcagctttatcgcgatcatcattgtgatgcgattattgcaattggcggcggttcagtcattgatacttcaaaagctaccaatattttagtctctgaaggcggagatgacctgctaaaatattctggcgctcacaatttacccaaaccccttaagccattttttgtgattcccactacgtctggtacaggctctgaagccaccatggtggctgtggtatccgacacagaaaaaaatgtcaaaatggcttttgcatcgtattacttgatgccacacgcggccattcttgacccacgtatgacactgaccttgcctgctcatttaaccgccatgacaggtatggatgccttaacgcattgtgttgaagcatatacctgtttagcatctaatccgctcagtgatgcttacgccagcgcaggtatcaagaaaatcagtgaacacctttttaacgttattgaaaacccaagcgattcacaagggcgtctggagcttgcacaagcatcaaccatggcgggcattgccttctcaaattcgatggtaggtttggtacattcgctgggacatgcacttggtgcagtagcacatctgccccatggcttatgcatgaatttatttttaccctatgtactggagtacaataaggaagtaaacggcgataaaattggtgagttgttattgccacttgcaggcgcagatatttatgcgcaaacacctgcaaatttacgcgcagataaagccatttcaaccattctggcaatgcgtgatcgcctgtttagcttaacaaagttaccgcgtacattacgtgaaacaggtaaaattaccgaagcccaactggatgaagtggctgaaaaggcgctcaatgatggttcgattatttacaacccgaaagaagcgaatattcaggatttaaaagcaatattacacaaagcctggtaa

SEQ ID NO: 39692 - protein, 394 aa, Acinetobacter sp. ADP1
MAKPYYEFFCPVKVIAGNAALEHIPFELATLGSKRPMIITDKGVRANHLLEPIEAAFSSTDAEIGYIFDDVPPDSSLQTVRKAAQLYRDHHCDAIIAIGGGSVIDTSKATNILVSEGGDDLLKYSGAHNLPKPLKPFFVIPTTSGTGSEATMVAVVSDTEKNVKMAFASYYLMPHAAILDPRMTLTLPAHLTAMTGMDALTHCVEAYTCLASNPLSDAYASAGIKKISEHLFNVIENPSDSQGRLELAQASTMAGIAFSNSMVGLVHSLGHALGAVAHLPHGLCMNLFLPYVLEYNKEVNGDKIGELLLPLAGADIYAQTPANLRADKAISTILAMRDRLFSLTKLPRTLRETGKITEAQLDEVAEKALNDGSIIYNPKEANIQDLKAILHKAW

SEQ ID NO: 39693 - DNA, 1155 bp, Erwinia carotovora subsp. atroseptica SCRI1043
  CDS (1)..(1155): transl_table=11
atgatggttaacagaatgatccttaacgaaacatcctattttggcacaggcgctatcgctcagattgccgatgaagtaaaacggcgcgggttcaagaaagccctgctggtgacggacaaagatttggttaaattcggtgtcgccgccaaggttacggcgaagctggatgcggcagggttgccctacgatatctacgatgaggtgattcccaaccctaccatcggcgtggtggaaagaggcatcgagcacttcaaggcatcgcaggccgattacctgatcgcgattggcggcggctcaccgcaggatacctgcaaagccatcggaattattatcaataatcctgagttcgccgatgtccgcagcctcgaaggcgttgcgcccacccgacgcccctcggtgccgattatcgctatcccgaccacttcaggcacagccgcagaggttacgatcaattacgtgatcaccgacgaagaaaaacgccgcaaattcgtgtgcgtcgatccacatgacattccaattgtcgccatcgtcgatcctgacatgatgatgagcatgcctgcctcgctgaaagcggcaacggggattgacgctctgacgcacgccattgagggtttcaccaccaaagccgcctgggaactgactgatacgctgcacctgaaggccattgaaattatcagccgttcactgcgtgattccgttgccgggaagccgaaaggcgtggaagagatggcgctgggacaatacatcgccggtatggggttctcgaacgttgggcttgggctggtacacggcatggcgcacccactcggcgcgttctacaacaccccgcacggcgtcgctaatgcgatcctactgccgcatatcatggcctacaacgcagattacaccggtgaaaaattccgggatatcgccgttgcgatgggggtaaacggcgcgacagatatgtcgattgctcaggcgagggaagcagctattcatgcggtgcgacagctttctcacgatgtagatatcccaccgagattgcgcgatgtcggcgtgagagaagaggatattccagcgctggcgcaggccgcctttgacgatgtctgcaccggcggtaacccgcgcgataccaacatcgacgacataaaagcgctgtatcaatctatttattaa

SEQ ID NO: 39694 - protein, 384 aa, Erwinia carotovora subsp. atroseptica SCRI1043
MMVNRMILNETSYFGTGAIAQIADEVKRRGFKKALLVTDKDLVKFGVAAKVTAKLDAAGLPYDIYDEVIPNPTIGVVERGIEHFKASQADYLIAIGGGSPQDTCKAIGIIINNPEFADVRSLEGVAPTRRPSVPIIAIPTTSGTAAEVTINYVITDEEKRRKFVCVDPHDIPIVAIVDPDMMMSMPASLKAATGIDALTHAIEGFTTKAAWELTDTLHLKAIEIISRSLRDSVAGKPKGVEEMALGQYIAGMGFSNVGLGLVHGMAHPLGAFYNTPHGVANAILLPHIMAYNADYTGEKFRDIAVAMGVNGATDMSIAQAREAAIHAVRQLSHDVDIPPRLRDVGVREEDIPALAQAAFDDVCTGGNPRDTNIDDIKALYQSIY

SEQ ID NO: 39695 - DNA, 2676 bp, Erwinia carotovora subsp. atroseptica SCRI1043
  CDS (1)..(2676): transl_table=11
atggccgtaaccaacgttgctgaacttaacgcactggtcgaaagagttaaaaaggcacagcaggaatttgccacttacactcaggaacaagtggacaagatcttccgcgctgccgcactcgctgcatcggatgcccgtatcccgctggcaaaaatggcggttgctgaatccggtatggggatcgtggaagataaagtcatcaaaaaccacttcgcatccgaatacatttataacgcctatcaggatgaaaaaacctgtggcgtcctctctactgatgacactttcggtactattaccattgcagagcctattggcctgatttgcggtattgttcccaccaccaaccccacttctaccgcgatttttaaagcgctgatcagcctgaagactcgtaacgggattatcttctctccccatccacgtgcaaaaaatgcgaccaataaagccgcagacattgtactgcaagctgcgattgccgctggcgccccgaaagatatcatcggctggattgatcaaccgtccgtcgatttatccaaccaactgatgcaccacccagatatcaacctgattctggctaccggcgggccgggtatggtgaaagcggcatacagctcaggtaaaccggcgatcggcgtaggtgcaggtaacacccccgttgttattgacgaaacggcggatattaagcgtgccgttgcctctatcctgatgtcgaaaaccttcgataacggcgtcatttgtgcgtcagaacagtcagtcatcgtggtagacagcgcctatgatgccgtacgtgagcgtttcgccacccacggcggctacatgctgaaaggcaaagaacttcatgccgtacaaggcattctgctgaaaaacggctcactgaatgccgacattgtgggccagccagcaccaaagatcgctgaaatggcgggtatcaccgtccctgcgaacaccaaagtgctgatcggtgaagtgacggccgttgatgaatccgaaccgtttgcccatgaaaaactgtctccgacgctggcgatgtaccgggcgaaagacttcaatgacgccgtcattaaagcggaaaaactggtggcaatgggtggcatcggtcacacatcctgcctgtataccgatcaggacaatcagccagagcgtgtaaatcatttcgggaatatgatgaaaacggcacgtatcctgattaacacgccggcttctcagggtggtatcggcgatctctacaacttcaaactcgctccgtctctgacactgggctgtggctcatggggcggaaactccatctccgaaaacgtcggtccgaagcacttgatcaacaaaaaaacggtagccaagcgagcagagaatatgttgtggcataaacttcctaaatccatttacttccgtcgtggctcactgcctatcgcacttgaagaagtcgcatccgatggtgcaaaacgcgcatttatcgtgactgaccgcttcctgttcaataatggctacgttgatcaggtaacttccgtactgaaacaacacggactggaaaccgaagttttctttgaagttgaagctgacccgacactgagcatcgtgcgcaaaggcgcggaacaaatgcactccttcaagcccgatgtgattattgcactgggtggcggttctccgatggatgctgcgaagatcatgtgggtgatgtatgagcaccctactacacacttcgaagagctggcgctgcgctttatggatatccgtaaacgtatctataagttcccgaaaatgggtgtcaaagccaagatggtggcgattaccactacatccggtactggttccgaagtcacgccatttgccgtggtgaccgacgatgcaactggacagaaatatccgttggcggactatgcgctgaccccagatatggccattgttgatgccaatctggtgatgaacatgccgaaatcgctgtgtgcctttggtgggctcgatgccgtaacccactcgctggaagcctatgtttccgtgctggcaaatgaatattcagacggacaggcgttacaagcgctgaaactgctgaaggaaaatctgccggacagctaccgtgacggtgcgaaaaacccggttgcccgtgagcgcgtgcacaacgccgcgacgattgcgggtatcgcgtttgccaacgccttcctcggcgtctgtcactcaatggcgcataaactgggctcggagttccatattccgcacggtctggctaatgccatgctgatctcgaacgtgattcgctataacgcgaacgataacccgaccaaacaaacaacgttcagccaatatgaccgtccgcaagctcgtcgtcgttacgctgaaatagccgaccacctacgtttgactgcgcctagcgaccgtactgcacagaaaatcgagaaattactgaactggctggaagaaataaagaccgaactggggatcccagcgtccattcgtgaagcgggcgtacaggaggccgatttcctggctaaggtcgataaactgtcagaagatgcgttcgacgatcagtgtactggtgctaacccacgctacccgctgatttctgaattgaaacagattctgctggacacttactatggtcgtaagttctctgaagaggtaaaaacggaaaccgttgaacctgtagcaaaagccgccaaaaccggcaagaaagccgcacattaa

SEQ ID NO: 39696 - protein, 891 aa, Erwinia carotovora subsp. atroseptica SCRI1043
MAVTNVAELNALVERVKKAQQEFATYTQEQVDKIFRAAALAASDARIPLAKMAVAESGMGIVEDKVIKNHFASEYIYNAYQDEKTCGVLSTDDTFGTITIAEPIGLICGIVPTTNPTSTAIFKALISLKTRNGIIFSPHPRAKNATNKAADIVLQAAIAAGAPKDIIGWIDQPSVDLSNQLMHHPDINLILATGGPGMVKAAYSSGKPAIGVGAGNTPVVIDETADIKRAVASILMSKTFDNGVICASEQSVIVVDSAYDAVRERFATHGGYMLKGKELHAVQGILLKNGSLNADIVGQPAPKIAEMAGITVPANTKVLIGEVTAVDESEPFAHEKLSPTLAMYRAKDFNDAVIKAEKLVAMGGIGHTSCLYTDQDNQPERVNHFGNMMKTARILINTPASQGGIGDLYNFKLAPSLTLGCGSWGGNSISENVGPKHLINKKTVAKRAENMLWHKLPKSIYFRRGSLPIALEEVASDGAKRAFIVTDRFLFNNGYVDQVTSVLKQHGLETEVFFEVEADPTLSIVRKGAEQMHSFKPDVIIALGGGSPMDAAKIMWVMYEHPTTHFEELALRFMDIRKRIYKFPKMGVKAKMVAITTTSGTGSEVTPFAVVTDDATGQKYPLADYALTPDMAIVDANLVMNMPKSLCAFGGLDAVTHSLEAYVSVLANEYSDGQALQALKLLKENLPDSYRDGAKNPVARERVHNAATIAGIAFANAFLGVCHSMAHKLGSEFHIPHGLANAMLISNVIRYNANDNPTKQTTFSQYDRPQARRRYAEIADHLRLTAPSDRTAQKIEKLLNWLEEIKTELGIPASIREAGVQEADFLAKVDKLSEDAFDDQCTGANPRYPLISELKQILLDTYYGRKFSEEVKTETVEPVAKAAKTGKKAAH

SEQ ID NO: 39697 - DNA, 2643 bp, Streptococcus pyogenes MGAS10394
  CDS (1)..(2643): transl_table=11
atgactgaaggacataatactgttgaaacaacctctgtttctgtgacaattgatgctcttgttcaaaaaggtttagctgctcttgaagagatgcgtaagcttgaccaagaacaagttgactatatcgtagcaaaagcttctgttgctgccttggatgcacacggagaacttgctaaacatgcttacgaagaaacaggtcgtggtgtctttgaagataaagcaacaaaaaatctatttgcttgtgagcatgtggttaataacatgcgccatcaaaaaacagtaggaattattgaagaggatgacgtgacaggtttgacgttgattgctgagccggttggtgttatctgtgggattacaccaacaactaacccaacttcaacagctatctttaaatctttgatctcgttaaaaacacgtaatccaattatttttgcctttcacccatcagcacaagaatcatcagcacatgccgctcgtattgttcgtgatgctgctattgccgctggtgctcctgaaaattgtgtgcagtgggttgaaacaccatcacttgaagcaacaaatgctttgatgaatcatgacggcattgccactatccttgcgacaggtggaaatgcgatggttaaagcagcttactcatgtggaaaacctgctcttggggtaggtgcaggtaatgttccagcctatgtggaaaaatctgctaatatccgtcaagccgctcatgatattgtgatgtctaaatcatttgataatggtatggtctgtgcctctgaacaagctgttatcatcgataaagaaatctatgacgattttgtagcagaattcaaatcttaccacacttattttgttaataaaaaagaaaaagctcttcttgaagaattctgttttggtgcaaaagcaaatagcaaaaactgtgctggtgcaaaattaaatccaaatattgtaggaaaaccagctacttggattgcagcacaagctggatttactgttccagaaggaacgaatattcttgctgcagaatgtaaagaagtttcagaaaatgagcctttaacacgtgaaaaattatctccagtcattgctgttttgaaatctgaatcacgtgaagacggtgttgaaaaagctcgtcaaatggttgaatttaatggacttggtcactcagctgccattcatacagcagatgcagagttggcaaaagaatttggaactagaatccgtgctatccgcgtcatctggaattcaccttctacatttggtggtatcggggatgtttacaatgctttcttaccatcattgactcttggttgtggttcgtatggacgtaacgcagttggtgataacgttagtgctataaatctcttgaacatcaaaaaagtaggaagacgtagaaataatatgcaatggtttaaagttccttcaaaaacatacttcgaacgtgattcaattcaatatttgcaaaaatgtcgtgatgttgaacgtgtcatgattgttacagatcacgctatggttgagcttggtttcttggatcgtatcattgaacaacttgatcttcgtcgcaataaagttgtttatcagatctttgctgaagtagaaccagatccagacattacaactgttatgaaaggtactgaattaatgcgtaccttcaaaccagacaccattattgcccttggcgggggatctcctatggatgcagccaaagttatgtggctcttttatgaacaaccagaagttgatttccatgacctcgttcaaaaattcatggatatccgcaaacgtgcgttcaaattcccagaacttggtaagaaaacaaaatttgttgctatcccaacaacttctggaacaggttcagaggtgacaccatttgccgttatctctgacaaagcaaataatcgtaaatatccaatcgctgattactcattaacaccaactgtagccattgttgacccagctttggtattgactgttccaggctttattgctgctgatactggtatggacgttttgacacacgcaaccgaagcttacgtgtcacaaatggccaatgactttacggatggtttagctcttcaagccattaaaattgtttttgataatcttgaaaaatcagttaaaacagccgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacggcgacatggcctaagtataattactaccgtgcggatgaaaaataccaagacattgcgaaattgttagggcttccagcttctacaccagaagaagcagtggaatcttatgcgaaagctgtttatgatctgggttgccgagttggtattcaaatgaacttcaaagctcaaggtatcgacgaaaatgaatggaaagaacattctcgtgaattggcttaccttgcttatgaagaccaatgttcacctgctaacccacgtcttccaatggttgatcacatgcaagaaattattgaagatgcttactatggttatgctgaacgtccaggacgacgtaagtga

SEQ ID NO: 39698 - protein, 880 aa, Streptococcus pyogenes MGAS10394
MTEGHNTVETTSVSVTIDALVQKGLAALEEMRKLDQEQVDYIVAKASVAALDAHGELAKHAYEETGRGVFEDKATKNLFACEHVVNNMRHQKTVGIIEEDDVTGLTLIAEPVGVICGITPTTNPTSTAIFKSLISLKTRNPIIFAFHPSAQESSAHAARIVRDAAIAAGAPENCVQWVETPSLEATNALMNHDGIATILATGGNAMVKAAYSCGKPALGVGAGNVPAYVEKSANIRQAAHDIVMSKSFDNGMVCASEQAVIIDKEIYDDFVAEFKSYHTYFVNKKEKALLEEFCFGAKANSKNCAGAKLNPNIVGKPATWIAAQAGFTVPEGTNILAAECKEVSENEPLTREKLSPVIAVLKSESREDGVEKARQMVEFNGLGHSAAIHTADAELAKEFGTRIRAIRVIWNSPSTFGGIGDVYNAFLPSLTLGCGSYGRNAVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTELMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVLTVPGFIAADTGMDVLTHATEAYVSQMANDFTDGLALQAIKIVFDNLEKSVKTADFEAREKMHNASTMAGMAFANAFLGISHSMAHKIGAQFHTVHGRTNAILLPYVIRYNGTRPAKTATWPKYNYYRADEKYQDIAKLLGLPASTPEEAVESYAKAVYDLGCRVGIQMNFKAQGIDENEWKEHSRELAYLAYEDQCSPANPRLPMVDHMQEIIEDAYYGYAERPGRRK

SEQ ID NO: 39699 - DNA, 1164 bp, Desulfotalea psychrophila LSv54
  CDS (1)..(1164): transl_table=11
gtgactaacatgctccatacattcaaatccgtaagtaagattgttcacggtgcaggctctattgctgacgcaggtaaagaggtaaaacgtcttggtggcaagcgcgccatcatcgtgactgatccaggtcttgcttcactgggtttgcacattgcagtagaggaagctcttgcccatgcaggtattgaatttgttctttatgcaaaagcagagcttgaaccaaacgcaacctctattcagcattgtgctgatgttgctaaggaattcaaggcagacgttatcatcggttttggtggtggtagtgctcttgataccgccaaggctgcatccgttcttgccgttcacgaaggtccaatctctaaatatttcggtgttgatgttgttcctggaccatgtatgccacttattgcagtgccaaccaccgctggtaccggtagcgagatgacctctatctctgtactcaccaacaacgagaccggcgcaaagcttggtatcgttagtgactatatctacgcatctgctgttatccttgacccagcattgactacaggtcttccaccacatataaccgcaatgaccggtgttgatgcctttgttcacgccatggaatcctttgtaggccttatgtctactccattcacggatgcccttaatcttcaggcaatgaagattattgctaagaatatccgcaaggcatatgccaacggtaataatcttgaggctcgtgaggcaatgctttacggttctgcccttgctggaatgggttttggtaatacccagaacggtgttatccacgctgttggtacctctgttcctgcaaagtataagttgccacacggtttgcttatggcagcagtagctccaatcggtatcgattacaactacatgtctaacccagagaagtatgcagttgttgctgatatcttgagccacgttgtggagagcgacgagccagtagaagatcgcgcagcttactgtgcagatgcatttgtgcaaatgcttgaagatcttgatattgctccaggccttgctccttatggtgtgaccgcagaagatctgccaggaattgctacccgcgctgcagcagctaagcgtttgatggataataatccacgtcagggtaatgagaagcaactcttgaccatgttggaaaaacatttctag

SEQ ID NO: 39700 - protein, 387 aa, Desulfotalea psychrophila LSv54
MTNMLHTFKSVSKIVHGAGSIADAGKEVKRLGGKRAIIVTDPGLASLGLHIAVEEALAHAGIEFVLYAKAELEPNATSIQHCADVAKEFKADVIIGFGGGSALDTAKAASVLAVHEGPISKYFGVDVVPGPCMPLIAVPTTAGTGSEMTSISVLTNNETGAKLGIVSDYIYASAVILDPALTTGLPPHITAMTGVDAFVHAMESFVGLMSTPFTDALNLQAMKIIAKNIRKAYANGNNLEAREAMLYGSALAGMGFGNTQNGVIHAVGTSVPAKYKLPHGLLMAAVAPIGIDYNYMSNPEKYAVVADILSHVVESDEPVEDRAAYCADAFVQMLEDLDIAPGLAPYGVTAEDLPGIATRAAAAKRLMDNNPRQGNEKQLLTMLEKHF

SEQ ID NO: 39701 - DNA, 1164 bp, Desulfotalea psychrophila LSv54
  CDS (1)..(1164): transl_table=11
gtgattaatatgcttcatacatttaaatctgtaagtaagatcgttcacggtgcaggatctattgctgacacaggtaaagaggtgaaacgtcttggtggcgagcgtgccattatcgtaactgatccaggtcttgcttcacttggtttgcatgtagctgtggaagaggcattggctcttgctggtattgagtttgttctttacgccaaggcagagcttgaaccaaatgcaacctctattcaagactgtgctgatgctgctaaggcttttaacgcagacgttatcatcggttttggtggtggtagtgctcttgataccgccaaggctgcatccgttcttgccgttcacgaaggtccaatctctaaatacttcggtgttgatgttgttcctggaccatgtatgccacttattgcagtgccaaccaccgctggtaccggtagcgagatgacctctatctctgtactcaccaacaacgagaccggcgcaaaacttggtatcgttagtgactatatctacgcagctgctgttattcttgacccagcattgactacaggtcttccaccacatataactgcaatgaccggtgttgatgcctttgttcacgccatggaatcctttgtaggccttatgtctactccattcacagatgcccttaatcttcaggcgatgaagattattgctaagaatatccgtaaggcatatgccaacggtaataatcttgaggctcgtgaggcgatgctttacggttctgctcttgctggtatgggttttggtaatacccagaacggtgttatccacgctgttggtacctctgttcctgcaaagtataagttgccacacggtttgcttatggcagcagtagctccaattggtatcgattacaactatatggctaacccagagaagtatgcagttgttgctgatatccttacccacgttgtggctggtgaagagtcggtagaagatcgtgccgcttattgtgcagatgcatttgtgcaaatgcttgaagatcttgatattgctccaggcctttctccctacggtgtaaccgaggaagatctgccaggaatcgctacccgcgccgccgcagccaagcgtttgatggataataatccacgccaaggtaacgagaaacaactcttgaccatgttgcaaaagcacttctag

SEQ ID NO: 39702 - protein, 387 aa, Desulfotalea psychrophila LSv54
MINMLHTFKSVSKIVHGAGSIADTGKEVKRLGGERAIIVTDPGLASLGLHVAVEEALALAGIEFVLYAKAELEPNATSIQDCADAAKAFNADVIIGFGGGSALDTAKAASVLAVHEGPISKYFGVDVVPGPCMPLIAVPTTAGTGSEMTSISVLTNNETGAKLGIVSDYIYAAAVILDPALTTGLPPHITAMTGVDAFVHAMESFVGLMSTPFTDALNLQAMKIIAKNIRKAYANGNNLEAREAMLYGSALAGMGFGNTQNGVIHAVGTSVPAKYKLPHGLLMAAVAPIGIDYNYMANPEKYAVVADILTHVVAGEESVEDRAAYCADAFVQMLEDLDIAPGLSPYGVTEEDLPGIATRAAAAKRLMDNNPRQGNEKQLLTMLQKHF

SEQ ID NO: 39703 - DNA, 1182 bp, Desulfotalea psychrophila LSv54
  CDS (1)..(1182): transl_table=11
atggctattcaagagcaagtatacggttttttcattccaagtgtgactcttatcggcattggtgctgcccgggaaatccctgcacgcatacagtcacttggtggcagaaagcccctcatcgtcaccgataagggcatcacaggcgctggcatcaccaaacagatcactgatctctgtgacggagcaggaatggaatatgcgatatatgataagactgttcccaatccaacagacattaatgtccatgaaggcatagatgtatacaagagaaatggttgtgatagtcttatcacccttgggggtggttcatcccacgattgtggtaagggaattggccttgttgttgccaacggcggtagaattaatgattatgagggagtggataaagccaccaagccaatgccaccctatattgccgtaaacaccacggcaggcacagcatctgagatgactagatttgctgttatcaccgatacccgccgtagggtaaagatggccatcgccgattggcgagtaaccccgggtatcgcccttgatgatccaatgctgatgatgggaatgccaccagcacttaccgcagccaccggcatggatgcccttactcactcagttgaagcctatgtatcaactgcggcaaccccactgaccgactccgctgcagagaaatctatccaactcatttctcaacacctccgcccagccgtcgccaatggcagcgacatcaatgcgcgggagggtatgtgctacgcccaataccttggcggcatggccttcaacaatgcaagccttggccacgtacacgccatggcccatcagcttggcggtttctacgatctaccccatggtgaatgtaacgccatcctcctcccccatgtaagtcgctttaacctgattgccaaggtcgcgcgttatgcaaaaattgcagaactgctgggcgaagatatcaaaggactctctcagcgtgatgcggcagaacttgccattgagtccatagaacagctctctcaggatgttggcataccagcagggcttgttgagctgggcagacgttatggtaaagatgttgaggaaaaagacatcgatatcatgacggtaaatgcccagaaagatatctgtggcctgaccaatccacgctgtctcagagacagcgacgtaaaagaaatttacagggccgctctctag

SEQ ID NO: 39704 - protein, 393 aa, Desulfotalea psychrophila LSv54
MAIQEQVYGFFIPSVTLIGIGAAREIPARIQSLGGRKPLIVTDKGITGAGITKQITDLCDGAGMEYAIYDKTVPNPTDINVHEGIDVYKRNGCDSLITLGGGSSHDCGKGIGLVVANGGRINDYEGVDKATKPMPPYIAVNTTAGTASEMTRFAVITDTRRRVKMAIADWRVTPGIALDDPMLMMGMPPALTAATGMDALTHSVEAYVSTAATPLTDSAAEKSIQLISQHLRPAVANGSDINAREGMCYAQYLGGMAFNNASLGHVHAMAHQLGGFYDLPHGECNAILLPHVSRFNLIAKVARYAKIAELLGEDIKGLSQRDAAELAIESIEQLSQDVGIPAGLVELGRRYGKDVEEKDIDIMTVNAQKDICGLTNPRCLRDSDVKEIYRAAL

SEQ ID NO: 39705 - DNA, 1182 bp, Desulfotalea psychrophila LSv54
  CDS (1)..(1182): transl_table=11
atggctattcgtgaacaagtaaacggtttttttatcccaagcgtaactcttatcggtattggcgctgctaaagaaatccctgcacgcctccagtcacttggtggaaaaaagcctctcattgttactgataaaggaattactggcgctggaatcaccaagcagatcaccgatctctgtgatgcggcaggaatgacatacgtaatatatgacaagactatccccaatccaaccgatctcaatgttgctgaaggtgaacaggcatataaagatggtgagtgtgatagtcttatcacccttggcggtggttcatcccacgattgcggcaaaggcattggccttgttattgccaacggtggcaccattcatgattacgaaggagtagatcagtctacccaggcaatgcctccttatattgcagtaaacaccacagcaggtacagcctctgagatgactcgtttctgtatcatcaccgataccagccgtaaggtaaaaatggccatcgttgattggcgagtaactccaggtatcgccctcgatgatccaatgttaatgatgggaatgccacctgcacttaccgcagccactggtatggacgcactcactcactcaattgaagcctatgtttctactgcagctaccccacttaccgactctgctgcagaaaaatctattcaactcatctcccaacatcttcgtcctgccgttgctaatggcagtgacattgatgcacgagagggcatgtgctacgcccagtaccttggcggcatggcattcaacaatgcaagtcttggtcacgttcatgctatggctcatcagcttggcggtttctacgacctgccccatggcgagtgtaatgccatcctccttccccatgtgagtcgctttaaccttattgccaaggttggacgttatgcaaaaattgcagaattactgggtgaagatgtcgctggactttcagaacgtgatgcggcagagcttgccattcaatccatagagcaactttctaaagatgttggtattccatctggccttaaagagctaggcagacgttatggcaaagatgtagaagcagaagacatcgacaccatgacagctaatgcccaaaaagatgcctgtggccttaccaatccacgtatccttagagatatcgatgtaaaaaatatatataaagctgctctctag

SEQ ID NO: 39706 - protein, 393 aa, Desulfotalea psychrophila LSv54
MAIREQVNGFFIPSVTLIGIGAAKEIPARLQSLGGKKPLIVTDKGITGAGITKQITDLCDAAGMTYVIYDKTIPNPTDLNVAEGEQAYKDGECDSLITLGGGSSHDCGKGIGLVIANGGTIHDYEGVDQSTQAMPPYIAVNTTAGTASEMTRFCIITDTSRKVKMAIVDWRVTPGIALDDPMLMMGMPPALTAATGMDALTHSIEAYVSTAATPLTDSAAEKSIQLISQHLRPAVANGSDIDAREGMCYAQYLGGMAFNNASLGHVHAMAHQLGGFYDLPHGECNAILLPHVSRFNLIAKVGRYAKIAELLGEDVAGLSERDAAELAIQSIEQLSKDVGIPSGLKELGRRYGKDVEAEDIDTMTANAQKDACGLTNPRILRDIDVKNIYKAAL

SEQ ID NO: 39707 - DNA, 1218 bp, Desulfotalea psychrophila LSv54
  CDS (1)..(1218): transl_table=11
atgcacagacaacccatacaaatgaggaaaaaattcatggctattcgagagcaagtatacggttatttcattcccagtgtaactcttatcggcattggcgctgctaaagaaatccctgcccgcctccaatcacttggtggcaaaaagcctctgattgtaacagacaaaggcattacaggcgctggaatcaccaaacagatcaccgatctctgtgatgcggcaaaaatggaatatgctgtatacgatgagactattccaaatccaaccgatattaatgttgctcacggtgtagaggcctatagcaaaaatggttgtgatagtcttattaccctcggtggcggttcatcccatgattgtggtaaaggcgtcggccttgttattgccaacggtggcaagattcatgactacgagggggtagatcaatccaccaagccaatgcctccatatattgccgtaaacaccactgcaggcacagcctctgaaatgacccgtttctgtatcatcaccgataccagccgtaaggtaaaaatggccatcgttgactggcgagtaaccccgggtatcgccctcgatgatccaatgttaatgatgggaatgccaccagcacttaccgcagccacaggtatggacgctcttactcactcaattgaagcctatgtttcaactgcggccaccccacttaccgactccgctgcagaaaaatcaattcagctcattgcccaacatcttcgccctgccgttgccaatggcagtgacatcaacgcccgagagggtatgtgctacgcccagtaccttggcggtatggcattcaacaatgcaagtcttggtcacgtccatgctatggctcatcagcttggcggtttctacgacctgccccatggcgaatgtaatgcaatcctccttccccacgtaagtcgctttaaccttattgccaaggttggacgttatgcaaaaattgcagaactgttgggcgaagatatcaccggactttcacagcgtgatgcggcagagcttgccatccaatccatagaacagctcgcccaggatgttggtattccagcaggccttaaggaattaggcagacgttatggcaaggatgtagaagagaaagacatcgatatcatgacagcgaatgcccaaaaagatgcctgtggccttaccaatccacgtggcctcagagatgctgatgtaaaagcaatttacaaggctgctctctag

SEQ ID NO: 39708 - protein, 405 aa, Desulfotalea psychrophila LSv54
MHRQPIQMRKKFMAIREQVYGYFIPSVTLIGIGAAKEIPARLQSLGGKKPLIVTDKGITGAGITKQITDLCDAAKMEYAVYDETIPNPTDINVAHGVEAYSKNGCDSLITLGGGSSHDCGKGVGLVIANGGKIHDYEGVDQSTKPMPPYIAVNTTAGTASEMTRFCIITDTSRKVKMAIVDWRVTPGIALDDPMLMMGMPPALTAATGMDALTHSIEAYVSTAATPLTDSAAEKSIQLIAQHLRPAVANGSDINAREGMCYAQYLGGMAFNNASLGHVHAMAHQLGGFYDLPHGECNAILLPHVSRFNLIAKVGRYAKIAELLGEDITGLSQRDAAELAIQSIEQLAQDVGIPAGLKELGRRYGKDVEEKDIDIMTANAQKDACGLTNPRGLRDADVKAIYKAAL

SEQ ID NO: 39709 - DNA, 1230 bp, Desulfotalea psychrophila LSv54
  CDS (1)..(1230): transl_table=11
atgctatatctttcctgttactttttggttcagggaacaaaaaggttattgctcttttttgcacacagaggagaaagtttgatgtacattaccaagtttgcaattccagagattatttttggccggggaagcctaaaacatacgggcaaatgtgccctacgcctcggggcaaaaaaggtctttcttgtcagcgactccggcattgaaaaggccggctgggtggccaaactgatcagcatactcgaagcagaaggcgttgattcggtgtattactcacatgtttcacccaacccaagagatttcgaagtagaagagggggcaaagatttaccaggaagaaggtgccgatgtgattattgctctcggaggagggagcgccatcgacacggccaaaggaatcgccatcatcgccagtaatggtggcagaatacgagattatgaaggtgctaaccgggtcaaccttcccctgccgccaatgattctgatcaccaccacggcaggaagtggctctgaaatttctcaattctgcatcatcaccgatatggccagaaaggtgaaaatgtcaatcatcacccgtaccatagtggccaacctcgctattatagatccctccctgctgacaaccaagagcacccaactcattattcactcagcagttgatgcctttgcccatgcagttgaagcctatctctctaaaattgcatccccttttactgaaactcattcactccaggccatcgctctcatttacgaatacctacccaaagccatcattaccggctcactcgatgatctggaacaactcagtatcgcttcggtttctgcatctatggcctttagcaatgcaagccttggcgcggaacatgcccttgcccatactctgggcggctatttcgatattgcccatggggcaatacaccccatacttcttcccgctgtcatgcgctttcacctcaaatgtagcacaaagaaattggccaaaattgcccgtactatttcagtgagacaggcggcaacagaatacgacactgcccttgccggcatcatggagctcgaacattttttttcaaaaatgcccgttgccacaaaactctcagaaataattacctatacagaagaagatcgtctgaaaaaaatctgtaaggttgcaatagaagatgcctgcattcttaccaacccacgcccagtctcttgggaagatctcttctcaatatgccaggaggtatggtaa

SEQ ID NO: 39710 - protein, 409 aa, Desulfotalea psychrophila LSv54
MLYLSCYFLVQGTKRLLLFFAHRGESLMYITKFAIPEIIFGRGSLKHTGKCALRLGAKKVFLVSDSGIEKAGWVAKLISILEAEGVDSVYYSHVSPNPRDFEVEEGAKIYQEEGADVIIALGGGSAIDTAKGIAIIASNGGRIRDYEGANRVNLPLPPMILITTTAGSGSEISQFCIITDMARKVKMSIITRTIVANLAIIDPSLLTTKSTQLIIHSAVDAFAHAVEAYLSKIASPFTETHSLQAIALIYEYLPKAIITGSLDDLEQLSIASVSASMAFSNASLGAEHALAHTLGGYFDIAHGAIHPILLPAVMRFHLKCSTKKLAKIARTISVRQAATEYDTALAGIMELEHFFSKMPVATKLSEIITYTEEDRLKKICKVAIEDACILTNPRPVSWEDLFSICQEVW

SEQ ID NO: 39711 - DNA, 1185 bp, Desulfotalea psychrophila LSv54
  CDS (1)..(1185): transl_table=11
atgtgtaatcagacgacaaagcctgttgagtttattatgccaccgataacggttataggttcaggagcaatcagagagttaccggaacgacttgttgcaattcagggaacaaagcccctggttgttactgataaggggatgactgctcttggcgttactgcaaccatcgtaggtatattagaaaaggctggcatggcctgtgctgtttatgatgagactgtgcccaacccaaccgataaaaatgttgaagctggtcttgccgcatatgtggcccatggttgtgactctattattacccttggtggtggtagtgcccatgattgtggtaagggtattggcctggtggcaaccaacggtggcagaattcatgactatgaaggtgtcaataaatctcatgctcgtatgccgagttttattgcgattaacaccacagcaggaactgcctcggagatgactcgtttctgtatcatcaccgacagtgtgcgtaaggtgaagatgacaattgtcgatcgtcgtgtaactcctcgccttgccatggatgatcctgatctgatgttgggccttcctcccggtcttaccgctgcaaccggtcttgacgccctgactcacgctattgaagcatttgtctccaccgatgctacccatatgaccgatgccaatgctgaaaaggcaattaagttgattgccaagtatctgcgtcgtgccgtggggaatggtcgcaatgttgaggctcgtgaggcgatgtgttatgcccagtatcaggcggggatggcctttaataacgcagggcttggctatgtgcatgccatggcccatcagcttggcggttatctcaatttaccccatggtgagtgtaacgcaatccttctgccctatgtctgtgagttcaatatgattgcctgtatggatcgttttgccgagatggcagacctccttggggtcaaagagggggcccgcactcagagggagatggctcttaatgtaattaaggcgatcagggatctgatggatgatgtggctattccaccaagccttaccgctctggcagctaagtatggtaagacagtcaatccggaagattttgttatgatggccgaaaatgccatgaaggatgcctgtgctgccaccaatccgcggcggatgagcatggaaaatattattgccatctaccaggccgttctctag

SEQ ID NO: 39712 - protein, 394 aa, Desulfotalea psychrophila LSv54
MCNQTTKPVEFIMPPITVIGSGAIRELPERLVAIQGTKPLVVTDKGMTALGVTATIVGILEKAGMACAVYDETVPNPTDKNVEAGLAAYVAHGCDSIITLGGGSAHDCGKGIGLVATNGGRIHDYEGVNKSHARMPSFIAINTTAGTASEMTRFCIITDSVRKVKMTIVDRRVTPRLAMDDPDLMLGLPPGLTAATGLDALTHAIEAFVSTDATHMTDANAEKAIKLIAKYLRRAVGNGRNVEAREAMCYAQYQAGMAFNNAGLGYVHAMAHQLGGYLNLPHGECNAILLPYVCEFNMIACMDRFAEMADLLGVKEGARTQREMALNVIKAIRDLMDDVAIPPSLTALAAKYGKTVNPEDFVMMAENAMKDACAATNPRRMSMENIIAIYQAVL

SEQ ID NO: 39713 - DNA, 1152 bp, Desulfotalea psychrophila LSv54
  CDS (1)..(1152): transl_table=11
atggcgaaatttattgttccaaaagaaatattccacggcttaggcactcttgagaatcttaaagggttgaaaggcagcaaagcagttattgtcattggtggtagctcagttcagaaaaacggagctctggaaagaactcagaactgcctctctgaagcaaacattgaatctgttgttttctccggtgtagaagctgatccatctattgagacagttcttaaaggagcagagttcttcaccgaggaacagcccgatgttattgtcggattgggcggatgttcagccatcgatgctgctaaagcaatgtgggttttttacgagtatcctgagtcaaagcttgaagaattgtcagctccatttgctgttaaggccctgcgtaataaggcttatttcgttgcaattccctcaacaagcggtacaggtacagaaatcaccggtctttccgtaattacagacagagagaaaggtacaaaataccctatcgtttctcacgagctgactcctgacgtggctattattgatggcgagctttgcgctagcatgcctaagcatgtaactgcaaataccggacttgatgccctgagccatggcgtggaagcttatgcctcaaacattgccgaccgttatagcgattctctggccaaaggttctattgacctggtattcaagaatctcctcattgttgtagaagagcccaaaaacctggaagcccgccaggcaatgcacgatgcttcctgcatggcaggtatggcatttaccaatgtatggctgggaattgttcactccatgtcacatcagattggtggaactttcggtatacctcatggttgtggtaatgctattcttatgcctaacgtcatccgtttcaattccaaggtaacagataagtatgccgatcttgcagctctgtccggcaaatcaactgctgaagagttcgcccaggaagtatcaaacctccgagcatctgcaggtgttgtagggtcactcaaagagtatggtattggtgagaaagagtgggaagcaaagttggatactctgactgagaatgcactgaacgatccctgtacccttttcaacctcagaaaacctacgtttgaagagatcaaggcaatctaccaggcatgctacgacggaacagcgattaatttctaa

SEQ ID NO: 39714 - protein, 383 aa, Desulfotalea psychrophila LSv54
MAKFIVPKEIFHGLGTLENLKGLKGSKAVIVIGGSSVQKNGALERTQNCLSEANIESVVFSGVEADPSIETVLKGAEFFTEEQPDVIVGLGGCSAIDAAKAMWVFYEYPESKLEELSAPFAVKALRNKAYFVAIPSTSGTGTEITGLSVITDREKGTKYPIVSHELTPDVAIIDGELCASMPKHVTANTGLDALSHGVEAYASNIADRYSDSLAKGSIDLVFKNLLIVVEEPKNLEARQAMHDASCMAGMAFTNVWLGIVHSMSHQIGGTFGIPHGCGNAILMPNVIRFNSKVTDKYADLAALSGKSTAEEFAQEVSNLRASAGVVGSLKEYGIGEKEWEAKLDTLTENALNDPCTLFNLRKPTFEEIKAIYQACYDGTAINF

SEQ ID NO: 39715 - DNA, 1149 bp, Yersinia pseudotuberculosis IP 32953
  CDS (1)..(1149): transl_table=11
atgagtttcatgttggcactaccgaaaatcagcttgcacggcacgggtgcaatcggcgatatggttaaattactcagtgacaaacagtgggggaaagcactgattgttactgacgggcaactggttgaactcggcttattggacagtttattcgcggcgctggcgcagtatcagttaccttacgggctgtttggggaggtattccctaatccaacagaagagttggtccaggccggttttgccgcctttacccagcatcaatgtgactatttgattgccttcggtggtggcagccccattgataccgccaaagccatcaaaatactgactgccaatccggggccatccaccgcttattccggtgtaggtaaagtcaaacaaacgggtgttccgttgatagccatcaataccacggcaggaacggcggcggaattgaccagtaatgcggtgattattgatagccagcggcaagtgaaggaggtgattatcgataccaatctcatccctgatattgcggttgacgatccctcagtaatgctcaatattcccgccagtgtcacggcggcgacggggatggatgcccttacccacgctatcgaagcgtatgtctcgttaggtgcacatacgttaacggaccattcagcgctcgaatcaatccgtcttatcagccaatggttgccattagcggtcgctgacggcaaaaacctacaagcgcgcgaaatgatggcatgtgggcaatatttggcgggtatggcgtttaacagtgctgggctaggtttggttcacgcactggcccaccaaccgggtgccacacataatcttcctcatggcgtctgcaatgctatcttgctgccggtaattgaagaatataatcgcccgcaggctacccgccgttttgcccgaattgcacaggcaatgggggtagacactcaggacatgagtgatgagcaagcaagtcatcaggcgatagcggccattcgtcagttatcgctgcaagttggtattcctgccgggttctccgccttaggtattgaggaaagtgatattgaaggttggttagataaagcgctggctgacccttgtgctccttgtaacccacgttctgcagatcgggaacaaattcgcacactgtacttacaggcactttaa

SEQ ID NO: 39716 - protein, 382 aa, Yersinia pseudotuberculosis IP 32953
MSFMLALPKISLHGTGAIGDMVKLLSDKQWGKALIVTDGQLVELGLLDSLFAALAQYQLPYGLFGEVFPNPTEELVQAGFAAFTQHQCDYLIAFGGGSPIDTAKAIKILTANPGPSTAYSGVGKVKQTGVPLIAINTTAGTAAELTSNAVIIDSQRQVKEVIIDTNLIPDIAVDDPSVMLNIPASVTAATGMDALTHAIEAYVSLGAHTLTDHSALESIRLISQWLPLAVADGKNLQAREMMACGQYLAGMAFNSAGLGLVHALAHQPGATHNLPHGVCNAILLPVIEEYNRPQATRRFARIAQAMGVDTQDMSDEQASHQAIAAIRQLSLQVGIPAGFSALGIEESDIEGWLDKALADPCAPCNPRSADREQIRTLYLQAL

SEQ ID NO: 39717 - DNA, 2676 bp, Yersinia pseudotuberculosis IP 32953
  CDS (1)..(2676): transl_table=11
atggctgtaacgaatgtcgctgaacttaacgagctagtagcacgcgtcaagaaagcccagcgcgagtatgccaacttttcgcaagagcaagttgataaaatcttccgtgctgcagcattagccgctgcggatgcccgtattccactagccaaactggctgtaacagagtctggcatgggtattgttgaagacaaagtgatcaaaaaccactttgcttctgaatatatttacaatgcttataaagatgaaaaaacctgtggtattttgtgtgaagataagaccttcgggacgatcactatcgcagaacctattggtctaatctgcggtatcgtaccaaccactaaccctacgtctaccgctatttttaaagcactgattagcttgaagacacgtaacggtattatcttctccccacatccacgcgctaaagacgcaaccaataaagctgcggatatcgtgcttcaagccgctatcgcagcaggtgcgccagcggatattattggttggattgatgctccaacagttgaattatctaatcaactgatgcatcacccagacattaatcttattctggcaaccggtgggccaggtatggttaaagcggcctatagctctggtaaaccagccatcggcgtaggtgcgggtaatacgccagtcgtcgttgacgaaactgcagatattaaacgtgttgtcgcatctattctgatgtctaaaacctttgataacggtgttatctgcgcgtcagagcagtccatcatcgttgttgactcggtttacgatgcggttcgcgagcgttttgcttctcatggtggctacctgttacaaggtaaagaattgaaagccgttcaggatattatcctgaaaaatggcggtctaaacgcagccatcgtgggccagccagcaactaagatcgctgagatggctggcattaaagtgccaagtaataccaagatacttatcggtgaagtcaaagttgtcgatgaatcagagccatttgctcatgaaaaactgtcgcctacactggcaatgtatcgtgctaaaaactttgaagaagcggttgaaaaagcagagaaactggtggagatgggcggtatcggtcatacctcttgtctgtacaccgaccaagataaccagactgcacgcgttaaatatttcggcgataaaatgaagaccgcccgaattctaatcaacacccctgcctctcaaggtggtatcggtgacttgtataacttcaagctggcaccgtctctgacgctgggttgtggttcttggggtggtaactccatctctgaaaacgtcggtccgaaacacttgatcaacaagaaaactgtggctaagcgagcagaaaacatgttgtggcataaactaccgaaatctatttacttccgtcgcggctctctgcctatagcgttggaagaagtggcaactgacggtgcaaaacgtgccttcatcgtgactgaccgctacttgttcaacaacggttatgcagaccaagtcaccagcgtactgaaatctcacggtattgaaactgaagttttcttcgaagtagaagctgaccctaccctgagtatcgtgcgtaaaggtgcagagcagatgaactccttcaagccagacgttattattgctctgggtggtggttcaccgatggatgcggcaaaaatcatgtgggtaatgtacgaacatcctgaaacgcatttcgaagaactggcattgcgttttatggatatccgtaaacgtatttataagttcccgaaaatgggtgtaaaagcgaaattggtcgctattacaaccacatcaggtaccggttcagaagtcaccccgtttgccgtggttactgatgacgcaacaggccagaaatatccattggcagactatgcattgacaccagatatggccattgttgatgccaaccttgttatgaatatgcctaagtctctgtgtgccttcggtggtctggatgcagtaacgcacgcactggaagcctatgtgtctgtactggctaatgaatactctgacggccaggcgctgcaagcactgaagctgttgaaagaattcttgccagccagctacaacgaaggggctaaaaacccagttgctcgcgaacgtgtacataatgcagcaacaattgccggtatcgcctttgctaacgccttcttgggtgtctgtcactctatggcccacaaactgggttctgagttccatatcccacacggcttggcaaatgctatgttgatttctaacgttattcgttacaacgcgaatgacaacccaacaaaacagactgccttcagccaatatgaccgcccacaagcgcgtcgccgttatgcagaaattgcagatcatttggggctgagcgcaccgggcgaccgtactgcacaaaaaatccagaaactgctggcttggttagatgaaatcaaagctgaactgggtatcccagcatcgattcgcgaagcgggtgttcaggaagctgacttcttagctaaagtagacaaattgtctgaagatgcatttgatgaccagtgcacaggtgctaacccacgctacccactgatctcagagctgaaacagatccttatggatacttattacggtcgcgaatatgttgaagagtttgaccgcgaagaagaagtcgcggcagctactgcgcctaaagctgagaaaaagaccaaaaagtaa

SEQ ID NO: 39718 - protein, 891 aa, Yersinia pseudotuberculosis IP 32953
MAVTNVAELNELVARVKKAQREYANFSQEQVDKIFRAAALAAADARIPLAKLAVTESGMGIVEDKVIKNHFASEYIYNAYKDEKTCGILCEDKTFGTITIAEPIGLICGIVPTTNPTSTAIFKALISLKTRNGIIFSPHPRAKDATNKAADIVLQAAIAAGAPADIIGWIDAPTVELSNQLMHHPDINLILATGGPGMVKAAYSSGKPAIGVGAGNTPVVVDETADIKRVVASILMSKTFDNGVICASEQSIIVVDSVYDAVRERFASHGGYLLQGKELKAVQDIILKNGGLNAAIVGQPATKIAEMAGIKVPSNTKILIGEVKVVDESEPFAHEKLSPTLAMYRAKNFEEAVEKAEKLVEMGGIGHTSCLYTDQDNQTARVKYFGDKMKTARILINTPASQGGIGDLYNFKLAPSLTLGCGSWGGNSISENVGPKHLINKKTVAKRAENMLWHKLPKSIYFRRGSLPIALEEVATDGAKRAFIVTDRYLFNNGYADQVTSVLKSHGIETEVFFEVEADPTLSIVRKGAEQMNSFKPDVIIALGGGSPMDAAKIMWVMYEHPETHFEELALRFMDIRKRIYKFPKMGVKAKLVAITTTSGTGSEVTPFAVVTDDATGQKYPLADYALTPDMAIVDANLVMNMPKSLCAFGGLDAVTHALEAYVSVLANEYSDGQALQALKLLKEFLPASYNEGAKNPVARERVHNAATIAGIAFANAFLGVCHSMAHKLGSEFHIPHGLANAMLISNVIRYNANDNPTKQTAFSQYDRPQARRRYAEIADHLGLSAPGDRTAQKIQKLLAWLDEIKAELGIPASIREAGVQEADFLAKVDKLSEDAFDDQCTGANPRYPLISELKQILMDTYYGREYVEEFDREEEVAAATAPKAEKKTKK

SEQ ID NO: 39719 - DNA, 1185 bp, Symbiobacterium thermophilum IAM 14863
  CDS (1)..(1185): transl_table=11
gtgcttccgcggtattatgagttctacaatccggtcaaggtgctctcgggcgaacacgccctcgagaacctgccctatgagatggctcatctccatgcgaagcgccccatcctcctcaccaatcagcagctggtggaagtggggctcacacgcatcctgcaggacgcgctgcggggttcggacctgaccatcgccgcacagtacacggagatcccccaggactcgtcgatccacgtggtcaacgccgccggccgggtcttccgggaagccggctgcgactcgatcatcgccctgggcggcggctcggtcatcgacaccgccaaggggctgcgggtgctgatcggccaggagaccgacgacatcatgcagtacatgggcgcggacatcctgcagccgaagcggcgcgtgcccctggccgtggtgcccaccaccgccggcacgggctcggaggccaccctggtggcggtcatcgcccacccggagcggcaggtgaagatggagttcgtctcccaccacctgctgccggacctggccgtgctcgacccacgcatgacccgctcgctgccgccccgcatcacggcttccacgggcatggacgcgctggtgcacgcgatcgagggctacacctcgatccagcggaacccgctcagcgacgcctatgcctgggcggccatcgagctgatccgggagtacctgccccgggcggtggcgaacggccaggacaccgaggcccgcctcgccatggccaacgcggccctcatggccggcgccgccttctccaacgccatggtggggctggtccatgccatcggccatgcggtgggcggcgtggcccgggtcgcgcacggcgacgccatggcgattctgctgccccacgtcatggagtataacctcgacatgctgagcgaccggtacggccgcctgctcctggccctggccggacccgaggtctatgcggcgactccggacaacgtgcgcggctcccaggccatcgcggtggtgcgggccttcgccgagcggctccaccaggcgtgcggcctccccctccgcctccgggacgtgggcgtcaccgaggcccagctgcccgccatcgcccgcacgaccatgaacgacggcgccctgctgatgaacgccaaggaggcgggtccggacgacgtgatgcagatcctccggaaggccttctga

SEQ ID NO: 39720 - protein, 394 aa, Symbiobacterium thermophilum IAM 14863
MLPRYYEFYNPVKVLSGEHALENLPYEMAHLHAKRPILLTNQQLVEVGLTRILQDALRGSDLTIAAQYTEIPQDSSIHVVNAAGRVFREAGCDSIIALGGGSVIDTAKGLRVLIGQETDDIMQYMGADILQPKRRVPLAVVPTTAGTGSEATLVAVIAHPERQVKMEFVSHHLLPDLAVLDPRMTRSLPPRITASTGMDALVHAIEGYTSIQRNPLSDAYAWAAIELIREYLPRAVANGQDTEARLAMANAALMAGAAFSNAMVGLVHAIGHAVGGVARVAHGDAMAILLPHVMEYNLDMLSDRYGRLLLALAGPEVYAATPDNVRGSQAIAVVRAFAERLHQACGLPLRLRDVGVTEAQLPAIARTTMNDGALLMNAKEAGPDDVMQILRKAF

SEQ ID NO: 39721 - DNA, 969 bp, Symbiobacterium thermophilum IAM 14863
  CDS (1)..(969): transl_table=11
gtgcgccgtctacgccgacgtgatggccgagcccagcgcggagtggctggacccggtcagcaggtgaaggcccaccaggccgaccttgtggtggccgtgggcggcggcagcgcgatcgacgtggccaaggccacagccgtcctggccgccaacggcggcacggcctacgactacttcggcgtcgaccgggtgccccggccggggctgcccgtgatcgccatgcccaccacggccggcaccggcgccgaggccacgcccaacgccatcttcaccaacacccggacgcaggtgaaggaggggatcgtctccccgtacatgatgcccgcggtggccatcgtggaccccgagctgaccctgacagcgccgcccggggtgaccgccgccaccgggatggacgccctgacccacgcggtggaatccttcacctcagtcaaggccgcgcccaccacggacctgttcgccgccgaagccatccgccggatcggccggtcgatccgcaccgcggtcttccgcggcggggacctcgcggcccggaccgatatggccctcggcagcctgtacgccggcatcgccatctgcaacgccggcaccggcgcggtccacgccatggcctacccgctgggcggccagttccgggtgccccacggcatcgccaacgcgtcgctgctgccgcacgtgctcccgtggaacctgcagggcagcgtggagaagttcgcgcaggtcgcccggctgctgggtgagcccgtggacgggctcagcgccctggcggcggcggagcgtgcggtggcggccatccagcggctctgcgccgacctcggcatcccctcccggctgtcggcgttcggcgtccgggaggagcacatccccgccatggcggcggccgcgcacgcgacgcgacggctcatggacaacaacccccgcaacctgacggttgaagaggtagaggcaatctatcgctcggccctgtga

SEQ ID NO: 39722 - protein, 322 aa, Symbiobacterium thermophilum IAM 14863
MRRLRRRDGRAQRGVAGPGQQVKAHQADLVVAVGGGSAIDVAKATAVLAANGGTAYDYFGVDRVPRPGLPVIAMPTTAGTGAEATPNAIFTNTRTQVKEGIVSPYMMPAVAIVDPELTLTAPPGVTAATGMDALTHAVESFTSVKAAPTTDLFAAEAIRRIGRSIRTAVFRGGDLAARTDMALGSLYAGIAICNAGTGAVHAMAYPLGGQFRVPHGIANASLLPHVLPWNLQGSVEKFAQVARLLGEPVDGLSALAAAERAVAAIQRLCADLGIPSRLSAFGVREEHIPAMAAAAHATRRLMDNNPRNLTVEEVEAIYRSAL

SEQ ID NO: 39723 - DNA, 1209 bp, Bacillus licheniformis ATCC 14580
  CDS (1)..(1209): transl_table=11
atgactttaaatatgaaagtagaagcgatgaacaaattccacacgtttgaaatccctaccgtcattaagcacggaatcggagccgttaaacatgtgggggaagaagtgaaaaagcttggcgtttcaaaagcgctgcttgtcacagaccctggcatctacaaagccggtgtaacaaacccggtcgttgtatcccttcaggaagcaggcgtagaagttgccgtctttaataaagtcgagccgaatccgcctgtccgtcttgtcgctgaaggttccaaactgtatgctgaagaaaactgcgacggccttgtcgcggtcggcggcggaagctcaatggatacggcgaaagcgatcggagttgaagccactcatgaaggctcagtccttgactatgaagcggcagaaggaaaaaagccgcttgaaaaccggattcctccgcttacaacgatcccgacgactgccggaaccggctcagaagttacacaatgggcggttatcacagatgaagagcgcgaatttaaattcaatacgggcggcccgctgattgctgctcatttgacaattatcgatcctgaattgcatgtatcaatgcctccgcacgtaacagcgatgaccggcgttgacgctttggctcatgccatcgagtgctatacgatgaaatttgcccagccgattactgacgcggtggcccttcttgcgatcgaatacggcgcacattacatccgcagagcgtttgccgatggagaagatcttgaagcgagatacggcatggcgcaggcggccatgcttgcaggcctttcttacggaagcgaatccgcaggcgctgctcacgcgatgagccagacgctcggagggatcatccctgtcgcgcacggccaatgtgtggcggcgatgatgggccctgtaatggaatacaactggaaaggctaccctgaaaaatttgcccgcattgcaaaagcgttcggaattgacacaagcggcatgtctgcagttgaagcggctaaagctgcggtgaactggatgtatcagcttgtggaagacttagagattcctagtcttgaagagcaaggcgtatcacctgacatgatcgaccgcctttcaaaagaagcgatgaaagatccgcaaacggtcggtaaccctagagacctgaacgaaaaagcgtacaattggatttacaaacgctgcttcaatttaaccccgaaaactgtctga

SEQ ID NO: 39724 - protein, 402 aa, Bacillus licheniformis ATCC 14580
MTLNMKVEAMNKFHTFEIPTVIKHGIGAVKHVGEEVKKLGVSKALLVTDPGIYKAGVTNPVVVSLQEAGVEVAVFNKVEPNPPVRLVAEGSKLYAEENCDGLVAVGGGSSMDTAKAIGVEATHEGSVLDYEAAEGKKPLENRIPPLTTIPTTAGTGSEVTQWAVITDEEREFKFNTGGPLIAAHLTIIDPELHVSMPPHVTAMTGVDALAHAIECYTMKFAQPITDAVALLAIEYGAHYIRRAFADGEDLEARYGMAQAAMLAGLSYGSESAGAAHAMSQTLGGIIPVAHGQCVAAMMGPVMEYNWKGYPEKFARIAKAFGIDTSGMSAVEAAKAAVNWMYQLVEDLEIPSLEEQGVSPDMIDRLSKEAMKDPQTVGNPRDLNEKAYNWIYKRCFNLTPKTV

SEQ ID NO: 39725 - DNA, 1167 bp, Bacillus licheniformis ATCC 14580
  CDS (1)..(1167): transl_table=11
atgccagcgaattatcaatttcggacagccggtcatatcgttgcaggtgaacattccatccgccggctgaaagatcatgtgcgaacgattgtaccgaaggcggacagggcgctgattattacccagccgtcgatcgtcaagctcggcgcgatcggagaggtacaggctcagcttacagagatcggcattcagtcagatgtttgcacagccatattgccggaaccgaccgtacaaaatattgaagacgtatttagaggcatccgtgagaaacgatacgacattctcatcggaatcggcggaggcagcgttttggacggaacgaaaatattgtccgtgctgcaaacgaattcaaaaaaggtcgaggagctgctcgggacagatttggtcgaaaagccgggaatcccgaccgtgctgattccgagtacttcggggacgggcgcagaggtgacgccgaacgcgatcgttacgcttccagaagaggaattgaaagtcggcatcgtcagtccgcttcttttgccgaaacttgtcattcttgacccggtcatcacccttggattgccaaaaccgattacggcggctaccggaatggatgcattcactcattcgcttgaatcgttcatttcgacgaaagcaaacccgatcagcgatatgttcgctttagaatccatcagattgatttcggcaagtattgtggaagcatatgaaaacggttcatcgatacaagcgagagaaaacatgctgctcggttcgacgtatggcggaatggcgctgacggctgccggtactgctgccgttcacgccctcgcctatccgcttggggggaaataccgaatttcccacggtgtcgccaattcgatgctccttccgcatgtgatggagtttaatatggatgccattacagaacggctgtctcttgcggcagaaacaatgggaatcgttgcatctgatttgaccgccgaacaagcggctgaggccgttgtgcagaaaataagagagtggacggagcggctgaatattcctcaggatttaaaagcgttcggcgtaaccgcaagcgacgtggacgatttagccgactcagcttcaaaagtgacgcgcctgcttcataacaatccgaaaccgctcagtctggaaaatataaaagacatctatcgaaaactaatcaactaa

SEQ ID NO: 39726 - protein, 388 aa, Bacillus licheniformis ATCC 14580
MPANYQFRTAGHIVAGEHSIRRLKDHVRTIVPKADRALIITQPSIVKLGAIGEVQAQLTEIGIQSDVCTAILPEPTVQNIEDVFRGIREKRYDILIGIGGGSVLDGTKILSVLQTNSKKVEELLGTDLVEKPGIPTVLIPSTSGTGAEVTPNAIVTLPEEELKVGIVSPLLLPKLVILDPVITLGLPKPITAATGMDAFTHSLESFISTKANPISDMFALESIRLISASIVEAYENGSSIQARENMLLGSTYGGMALTAAGTAAVHALAYPLGGKYRISHGVANSMLLPHVMEFNMDAITERLSLAAETMGIVASDLTAEQAAEAVVQKIREWTERLNIPQDLKAFGVTASDVDDLADSASKVTRLLHNNPKPLSLENIKDIYRKLIN

SEQ ID NO: 39727 - DNA, 2604 bp, Bacillus licheniformis ATCC 14580
  CDS (1)..(2604): transl_table=11
atggcaatcgaagaaaagaacatgaaacaaaagcaaaatgcctcaaacatgattgatcagctagtcgaaaaaggcctaaaggcattggaagaattccgcagctttgatcaggagcagattgatgagatcgtcaaacagatggcgcttgccggccttgatcagcacatgcctctcgccaaacttgccgtcgaagaaacgaagcgcggcgtttatgaagataaaatcattaaaaacatgtttgccacagagtatgtctaccatcatatcaaatacgataaaacagtgggcatcatcaatgaaaacgaacacgacggagtcattgaaatcgcggagcctgtcggtgtcatcgccggcgtgacgccggtgaccaaccctacttccaccaccatgttcaagtccctgatatcaattaaaacaagaaatccaatcgtgtttgctttccatccatccgcccaaaaatgcagccgcgaagcggcgagaatccttcgggacgcagccgtcaaagcaggagcacccgacaactgcatccaatggatcgagacgccttctctggatgcaacgcaagccctaatgacccacccgaacgtttccctgatcctcgcaacaggaggcgcaggcatggtgaaatccgcttacagctccggaaaaccggcccttggcgtcggacctggaaacgttccgtgctacatcgagaagtctgccaacctgaagcaagccgtcaatgatctgatcttatccaaaacatttgacaacggcatgatttgcgcatcagagcaggccgtcatcatagacaaaggcatctactcagacgtcaaagccgaaatgacaagaaacaactgctatttcttaaataaaaccgaaaaatcaaaggtcgaaaaattggtcatcaatgaaaatacttgcgcggtaaacgctgatatcgtcggcatgccggcattcaaaattgctgaaatggccggtatcaaagtgccgcaagatacaaaaatcctcatcgccgaattagaaggtgtaggtccggatgacccgctgtccagagaaaaactgagccctgttttagcgtgctacaaagtcagcgggcttgaagaaggattaaaacgcgccgaagagatgctggcgttcgggggaaccggccactcggcggtgattcatacgaacgatcaagaagccgttaaagaattcggcttaaggatgaaggccggccggatcattgtcaatgcaccgtcgtcacaaggagcgatcggcgacatttacaacgcctatatgccttctttaacgctcggctgcggcacatatggcgggaactccgtctcgtcaaacgtaggggccgttcatttaatcaacacgaaaaaagtggcgaaaaggaatgtcaatatgcagtggtttaaagtgcctccaaaaatctattttgaaaaacacgcaacccaatatttagcgaaaatgcctgacatctcaaaagcgtttattgtgactgatccgggaatggtgaaactcggatatgtagaccgcgcccttcactacttaagaaggcgcccggattacgttcattgcgaaattttttctgatgtcgagcctgatccttcaatcgaaacggtgatgaacggcgtcgacatgatggccaaattccagccggatgtcatcatcgccctcggcggaggttcggcaatggatgccgcaaaaggaatgtggatgttctacgagcaccctgatgctgaattctttggcttaaagcaaaaatttctggacatccgcaagcgcatcgtcaaatacccgaaactgggaggaaaagcaaaattcgtcgcaatcccgacgacatcaggcacaggttctgaagtcacttcattctctgtcattacagacaaagaaacgaatacaaagtacccgctggccgattatgaattaacaccggatgtcgcgatcattgacccgcaatttgtcatgaccgtgccgaaacatatcacggccgacacaggaatggacgtattgacacacgcaattgaatcatacgtatcgtgcatggccaacgactatactgacggcttggccatgaaggccatccagctgatcttcgaatatctgccaagagcatacaaaaacggcagcgacgagctggcccgcgaaaaagtgcataatgcatcaacgattgccggaatggcattttccaatgccttcctcggcatcaaccacagcttagcccataagcttggcgccgagtttcagatcgctcatggacgggcaaacgccatccttctgccgcacgtgatccgctataatgcagcgaagccgaaaaagttcacggcatttcctaaatacagccacttcatagccgaccagcgctacgcggagattgccagaacgctcggcctgcctgcaaaaacaactgcagaaggtgttgaaagcctcatccaggagatcatctcgcttgccaaagagcttaaaattccgatgagcattaaacaaaacggcgtggatgccgccgcattcgaaagcaaagtagatctcatggccgagcgcgcctttgaagatcagtgcacgacagccaatcctaagctgccgctcgtttcagagctggctgagatttaccgttccgcgtataaaggagtttag

SEQ ID NO: 39728 - protein, 867 aa, Bacillus licheniformis ATCC 14580
MAIEEKNMKQKQNASNMIDQLVEKGLKALEEFRSFDQEQIDEIVKQMALAGLDQHMPLAKLAVEETKRGVYEDKIIKNMFATEYVYHHIKYDKTVGIINENEHDGVIEIAEPVGVIAGVTPVTNPTSTTMFKSLISIKTRNPIVFAFHPSAQKCSREAARILRDAAVKAGAPDNCIQWIETPSLDATQALMTHPNVSLILATGGAGMVKSAYSSGKPALGVGPGNVPCYIEKSANLKQAVNDLILSKTFDNGMICASEQAVIIDKGIYSDVKAEMTRNNCYFLNKTEKSKVEKLVINENTCAVNADIVGMPAFKIAEMAGIKVPQDTKILIAELEGVGPDDPLSREKLSPVLACYKVSGLEEGLKRAEEMLAFGGTGHSAVIHTNDQEAVKEFGLRMKAGRIIVNAPSSQGAIGDIYNAYMPSLTLGCGTYGGNSVSSNVGAVHLINTKKVAKRNVNMQWFKVPPKIYFEKHATQYLAKMPDISKAFIVTDPGMVKLGYVDRALHYLRRRPDYVHCEIFSDVEPDPSIETVMNGVDMMAKFQPDVIIALGGGSAMDAAKGMWMFYEHPDAEFFGLKQKFLDIRKRIVKYPKLGGKAKFVAIPTTSGTGSEVTSFSVITDKETNTKYPLADYELTPDVAIIDPQFVMTVPKHITADTGMDVLTHAIESYVSCMANDYTDGLAMKAIQLIFEYLPRAYKNGSDELAREKVHNASTIAGMAFSNAFLGINHSLAHKLGAEFQIAHGRANAILLPHVIRYNAAKPKKFTAFPKYSHFIADQRYAEIARTLGLPAKTTAEGVESLIQEIISLAKELKIPMSIKQNGVDAAAFESKVDLMAERAFEDQCTTANPKLPLVSELAEIYRSAYKGV

SEQ ID NO: 39729 - DNA, 1203 bp, Bacillus cereus E33L
  CDS (1)..(1203): transl_table=11
ttgcaagaagttgctgagtttcgtatgccgaagtctgtattatatggaagaaattctcttgaaaagctgggggaacaatctaagaaattcgggaaaagagcgtttatagttacggatacaattatggaggatttaggatatgttgagaggtgtatacaacaattaaatacgaaaggtataactgttattacatataataaagtaaatgctgagcctacaaatatacacgtgttagaggcgttaactatttgtaaagaaggaaagtgtgattttataatcggtcttggtggtggaagttgtattgatgcagcaaaagcagttactgtgttatatacaaatggcggagaagtggaagattatgtccaaaaggatagtgaaatagacaatgatccgctaccacttattgcaatcccaacaacttctggaactggatcggaagtaacaagtgtagcagtaattacgaataaacgaacagatgtaaaaatgatgatgaagcatccgagttttaccccgcaagtagcgattattgacccgattttaacacgttcggtaccacctcacattacagcagcaacagggatcgatgcattatgtcatgcagtcgaagcatatatttctaaagtttcacaatcacttacagatgtactcgctctttcagcaattgaaagtattatgaaatatttacgtattgcttatgaagatggagagaatatggaggcaagagaagcgatgatgattgcttccttacaagctggaattgcattttccaatgcatctgttacattagttcatggcatgtcgagaccagtaggagcattatttcatgtaccacatggtatatcgaatgcaatactattacctacagttttagaatatacaaaaggtagtgcggtaaaaagactagcggaaattggccgctgtttaaataaagatttgtattcctattgtgatgaagaagtagccgactacacgctgggggaaataaaaaaactttgttttgatcttcgtattccaaatttaaaagaatacggaattggtgaagttgagtttgaaaaagctatttctaaaatggcgtcagatgcaattgaaagtggaagtccagcgaataacccacgtgtgccatcatatgatgaaattaaacagttgtatcgagaatgttttcattataaatatgaagattcagtaaaaacattaggggattaa

SEQ ID NO: 39730 - protein, 400 aa, Bacillus cereus E33L
MQEVAEFRMPKSVLYGRNSLEKLGEQSKKFGKRAFIVTDTIMEDLGYVERCIQQLNTKGITVITYNKVNAEPTNIHVLEALTICKEGKCDFIIGLGGGSCIDAAKAVTVLYTNGGEVEDYVQKDSEIDNDPLPLIAIPTTSGTGSEVTSVAVITNKRTDVKMMMKHPSFTPQVAIIDPILTRSVPPHITAATGIDALCHAVEAYISKVSQSLTDVLALSAIESIMKYLRIAYEDGENMEAREAMMIASLQAGIAFSNASVTLVHGMSRPVGALFHVPHGISNAILLPTVLEYTKGSAVKRLAEIGRCLNKDLYSYCDEEVADYTLGEIKKLCFDLRIPNLKEYGIGEVEFEKAISKMASDAIESGSPANNPRVPSYDEIKQLYRECFHYKYEDSVKTLGD

SEQ ID NO: 39731 - DNA, 2604 bp, Bacillus cereus E33L
  CDS (1)..(2604): transl_table=11
atggtagtcaaagagaaagttgtaaatgaaatgcaggaagtaaaagagatgattgatacgttagtgaataacggtcggaaggctttacaagcattagaaagttttacacaagagcaaattgacaacattgttcatgaaatggcattagcaggtgttgatcaacatatgccacttgcgaaattggctgttgaagaaacaggtcgtggggtatacgaagataaatgcattaaaaatatttttgctactgaatatatttggcatagcataaagaaagataaaacagtagggattattcacgaagatcctcatgaagaaataatagaaattgcggagcccgtcggtgtagtagctggggtaacaccagtaacgaatccaacatcgacaacaatgtttaaagcattaatcgcgataaaaacgagaaatccaattattttcgcatttcatccttcagcacaaaactgttctgttgcagccgcgaaaacagtatatgatgcagcggtgaaggcgggggcatcaaaacattgtattcagtggattgaaaagccttctgtcgaagcaacgaaacaattaatgaaccatgaaggtgttgcgcttgttttggcaactggaggggctggtatggtgaaatcagcttattctactggaaaaccagcgctaggtgtaggtcctggtaatgtaccatgttatatagagaaatcagcgcacataaaacgagcggttaatgatttgattttatcaaaaacatttgataacgggatgatttgtgcatcagaacaagcaatcattgtagacaaggaaatttatgatgatgtgaaaacagaaatgattacaaatgattgttactttgtaacagaggaagagagaagaaaattagaaaagcttgttattaatgaaaatacatgtgcagtaaatagtgatattgtagggaaatctgcacagtatattgccgaattagttggaattactgtacctaaaaatacaaaaatacttgtagctgaaatacaaggcatcggagccgcatatccactatctcgtgagaagttaagtccagtattagcttgtgtaaaagcaaattcattagaagaaggatttacatattgtgaagaaatgttaaacctcggtggtttagggcattcagcagttatccattctgtaaataaagaagtgcaaaagcaatttggattacgtatgaaagcttgtcgccttattgtaaatgctccttcatcacaaggtgggatcggtgacatatataatggatttattccatcacttacgcttggctgcggttcctatgggaaaaactcggtttctcaaaacgtaacagcgacgcatttattaaatataaaaaggttggcaaatagaaaaaagaatatgcagtggttcaaattaccaccaaaaatttattttgaaaaacatgcgacagcatatttagcaaatatgcctaacatttcacgtgcgtttattgtaacggatccaggaatggttgagcacggatatgtagatacggttacgcattatttacgtaaacatgcaaatgatgtgaaagttgaagttttctttgaggtcgagccagatccgtcagatgaaactgtgtttaaaggtgcggaaatgatgagaagttttcagcctgatgtcattatcgcacttggtggtggttcagcgatggatgcagcgaaagggatgtggcttttctatgagcacccagaaacaacattctatggaattaaacagaagtttttagatataagaaaacgtacatgtaaatatccggaattaggaagtaaggcgcagtttgttgctattccaacaacatctggaacaggatcagaagtgacaccatttgcggttattacagataagaaaaataatataaagtatccacttgcagattatgaattaacgccagatgtagcaattgttgatccacaatttgtaatgacagtaccaccacatgtaacagcagacactgggatggacgtattaacgcatgcaatcgaggcgtatgtgtctgttttagcaaatgactatacagatggattagcactaaaggctattgatctcgtatttaaatatttaccaagagcatttaaagatggacatgatgaagaagcacgagaaaaaatgcataatgcttctgcaattgcagggatggcatttgcaaatgctttcctaggtattaatcacagtttagcacataaaattggaccagaatttcatattccgcatgggcgtgcgaatgcaattcttatgccgcacgtagttcgctataatgctattaagccaagaaaacacgcattgttcccaaaatatgagcattttgtagctgatgaacgctatgcacatattgcgagaatgctcgggctaccagcaagttcggtggcagaaggtgtagaatcactcgtcaaagcaattattgatctcggaaaaagtttaaatataaatatgagtattgcgggacaaggagttgctaaagaccaatttgaacaggttgttggattattagcagaaagagcttttgaagatcaatgtacaacagctaatccgaaattacctctcatttcagagctgaaagaaatttatatgaaagcatataaaggtgagtaa

SEQ ID NO: 39732 - protein, 867 aa, Bacillus cereus E33L
MVVKEKVVNEMQEVKEMIDTLVNNGRKALQALESFTQEQIDNIVHEMALAGVDQHMPLAKLAVEETGRGVYEDKCIKNIFATEYIWHSIKKDKTVGIIHEDPHEEIIEIAEPVGVVAGVTPVTNPTSTTMFKALIAIKTRNPIIFAFHPSAQNCSVAAAKTVYDAAVKAGASKHCIQWIEKPSVEATKQLMNHEGVALVLATGGAGMVKSAYSTGKPALGVGPGNVPCYIEKSAHIKRAVNDLILSKTFDNGMICASEQAIIVDKEIYDDVKTEMITNDCYFVTEEERRKLEKLVINENTCAVNSDIVGKSAQYIAELVGITVPKNTKILVAEIQGIGAAYPLSREKLSPVLACVKANSLEEGFTYCEEMLNLGGLGHSAVIHSVNKEVQKQFGLRMKACRLIVNAPSSQGGIGDIYNGFIPSLTLGCGSYGKNSVSQNVTATHLLNIKRLANRKKNMQWFKLPPKIYFEKHATAYLANMPNISRAFIVTDPGMVEHGYVDTVTHYLRKHANDVKVEVFFEVEPDPSDETVFKGAEMMRSFQPDVIIALGGGSAMDAAKGMWLFYEHPETTFYGIKQKFLDIRKRTCKYPELGSKAQFVAIPTTSGTGSEVTPFAVITDKKNNIKYPLADYELTPDVAIVDPQFVMTVPPHVTADTGMDVLTHAIEAYVSVLANDYTDGLALKAIDLVFKYLPRAFKDGHDEEAREKMHNASAIAGMAFANAFLGINHSLAHKIGPEFHIPHGRANAILMPHVVRYNAIKPRKHALFPKYEHFVADERYAHIARMLGLPASSVAEGVESLVKAIIDLGKSLNINMSIAGQGVAKDQFEQVVGLLAERAFEDQCTTANPKLPLISELKEIYMKAYKGE

SEQ ID NO: 39733 - DNA, 1155 bp, Mannheimia succiniciproducens MBEL55E
  CDS (1)..(1155): transl_table=11
atgacatattctttacttcatacaaacaaagttattgcaggagctggttgtgttgctcaaataacagatgttgtgaatagttttgatgcgactaatgtggtgatcattacggatcaaggagtttttaatgcagggcttatcaatgaacctaaaatgttgttggaacaagctggagtcaatgttcatgtaattagtgatacacctccggaaccacctgtagataaagtgaatgatatttataaggttgctatgcaattcaatgtcgaaatggtaatcggtatcgggggaggtagtgcgatggataccgctaaactggtggcgattttattaaataatcatgtagcattacgagatgtagttgatggtaaagtaaaatttaagaatcgcggtattcctacattaatgattccgactacatccggcaccggttcagaagcgacacaaaattctattgtattagtacctgaaagagaacttaaagtcggtattgtagatgaaaaaatgttgccaaactgcgttattttagatcctaaaatgacaacggggttaccaaaacatatcactgcaaatacgggtattgatgctttatgtcatgccattgaatgttatatttctaaaaagtgtagcccgtttaccgagatgtttgctttaaaatcaattgagcttatagctaaaagtattcgtattgcttatgaagacggtcataatctgcaggctcgtgaaaatatgctattaggctcttatttaggtggtgtaagtattgctacgtcaagtacggtagctgttcatgctttatcttacccattaggagggaaatatcatattcctcatggcttatctaatgcaattttattgccagatgtgatgaaatttaatctggatgcctgtgttgagaaatttgctcgaatagctaaggcaatggacttaaatattgcgggcttaacggaacaagaggcggccgaagcaatgattgaagaactttatgcattaattagggatttgaatattaaatgtgatcttaaaacagtgggtatcacagaagatatattagatgaactggttgacgccggatattctgtaagacgattgttagataacaatccaaaagaaatgacaaaacaagatattagaggtatttataaaaaaatactctga

SEQ ID NO: 39734 - protein, 384 aa, Mannheimia succiniciproducens MBEL55E
MTYSLLHTNKVIAGAGCVAQITDVVNSFDATNVVIITDQGVFNAGLINEPKMLLEQAGVNVHVISDTPPEPPVDKVNDIYKVAMQFNVEMVIGIGGGSAMDTAKLVAILLNNHVALRDVVDGKVKFKNRGIPTLMIPTTSGTGSEATQNSIVLVPERELKVGIVDEKMLPNCVILDPKMTTGLPKHITANTGIDALCHAIECYISKKCSPFTEMFALKSIELIAKSIRIAYEDGHNLQARENMLLGSYLGGVSIATSSTVAVHALSYPLGGKYHIPHGLSNAILLPDVMKFNLDACVEKFARIAKAMDLNIAGLTEQEAAEAMIEELYALIRDLNIKCDLKTVGITEDILDELVDAGYSVRRLLDNNPKEMTKQDIRGIYKKIL

SEQ ID NO: 39735 - DNA, 1173 bp, Mannheimia succiniciproducens MBEL55E
  CDS (1)..(1173): transl_table=11
atgggggtagtgcttatgtcaacatattactttttaccaaccagaaacgtattcggagagaacgctgttgaagaagtcggcgagttaatgagaagcttgggcggcaaccgaccgctcatcgtgaccgacggctttcttgctcaaagcggcatggcggaacaactcgccaccatcctaagaggtgccggcttagagcctattatcttcggcggtgcggaacctaacccgacggataaaaacgtggaaagcggtatcgccttctatcacgaccataactgcgattgtattatttctttaggcggcggctcatctcacgactgcgcgaaaggtatcggtttaattgccagtaacggcggtcgcattcaggattatgaaggcgtggatcgttcaaccaacccgatggtgccgttaatggcggtaaacaccactgccggtaccgcttccgaaatcacccgcttttgtatcatcacagatacggcccgcaaagtaaaaatggcgattgtggactggcgcgttactccgcaaattgcggtaaacgatccgctgctgatgaaaggcatgccggcgggtttaacagccgcaaccggtatggatgctctcactcatgccattgaagcctatgtttctaccgcagccaatccgcttacggatgccgcagccttaatggcgatttccatgatccagcaatatttgccgaaagccgtggcaaacggggattacatgaaagcccgcgataaaatggcctacgcccaatacttagcgggtatcgcattcaacaacgcttccttaggttacgtacacgcaatggcgcaccagttaggcggtttctataacctgccgcacggtgtttgtaacgcaattttactgccttatgtggaagaatttaatctaatcggcaacctcaaccgcttccgcgatattgccaacgcaatgggcgaaaacatccagggcttgagtaccgatgacgcagcgctcaaagccatcgccgcgatccgtcgactaagcaaacaggtaggcattcctgccaacttaaaagaactcggcgttaaaccggaagactttgacgtcatggctgaaaatgcaatgaaagacgtttgcatgctcaccaacccgcgcaaagctaccaaacaacaggttatcgaaatcttccaacgcgcctatgacggcaattaa

SEQ ID NO: 39736 - protein, 390 aa, Mannheimia succiniciproducens MBEL55E
MGVVLMSTYYFLPTRNVFGENAVEEVGELMRSLGGNRPLIVTDGFLAQSGMAEQLATILRGAGLEPIIFGGAEPNPTDKNVESGIAFYHDHNCDCIISLGGGSSHDCAKGIGLIASNGGRIQDYEGVDRSTNPMVPLMAVNTTAGTASEITRFCIITDTARKVKMAIVDWRVTPQIAVNDPLLMKGMPAGLTAATGMDALTHAIEAYVSTAANPLTDAAALMAISMIQQYLPKAVANGDYMKARDKMAYAQYLAGIAFNNASLGYVHAMAHQLGGFYNLPHGVCNAILLPYVEEFNLIGNLNRFRDIANAMGENIQGLSTDDAALKAIAAIRRLSKQVGIPANLKELGVKPEDFDVMAENAMKDVCMLTNPRKATKQQVIEIFQRAYDGN

SEQ ID NO: 39737 - DNA, 2631 bp, Mannheimia succiniciproducens MBEL55E
  CDS (1)..(2631): transl_table=11
atgattatgagtaacgctgttgaaaacacagtaagccccgctcaagcggaggtgaactcactggttgagaaaggtttagtggcactggagcaattccgccaactaaatcaggaacaggtggactacattgtagcgaaagcttctgttgccgctttagaccaacatggagcattggcgctacatgcgttagaggaaaccgggcgcggcgtgttcgaggacaaagccactaaaaacctgtttgcctgcgaacatgtagtgaacaaaatgcgacactggaaaaccgccgggattatcagtgacgacgatgtcacaggtatcaccgaaattgccgatccggtgggcgtagtttgcggcattacacctaccactaatcctacttccacggctatcttcaaatcactgatcgctttaaaaacccgcaatcctattgttttcgctttccacccttccgcccaacagtcttccgctcatgccgcacaaatcgtgcgtgatgccgcagtagccgccggtgcgccggaaaactgtattcaatggattgcacaaccttctatggaaggtactaatgcgttaatgaatcacccgggcattgccaccattctggctaccggcggtaatgctatggtgcaggccgcttattcatgcggcaagccggcattgggagtcggtgccggaaatgtgcccgcttatgtggaaaaatccgccgatattaaacaggcaactcacgatatcgtgatgtcgaaatcctttgataacggtatggtatgcgcttcagagcaagccgctattgccgatgcggaaatttatgaggaattcgtcaacgaattaaaatcctacggtgtgtatttcgtcaataaaaaagaaaaaactttattggaagaatttatgttcggtgtaaaagctaacggtgcaaattgcgccggtgcgaaactaaacgccgacgtggtaggtaaatccgcatactggattgctcaacaagcgggctttgaagtgccgaaaaaaaccaatattcttgccgcagaatgtaaagaagtcagcccgaaagaacctttaacccgggaaaaattatcaccggtacttgccgttttaaaatcccgttctaccgaagagggattaacgcttgccgaagccatggtggaatttaacggtttaggacactccgcggcaattcacaccaaagatgcggcgcttgccaaacgcttcggcgagcgcgttaaagccattcgcgttatctggaattcgccttctaccttcggcggtatcggcgacgtttataacgctttcctgccttcattaaccttgggttgcggttcttacggcaaaaattccgtcagcaacaatgtcagcgccatgaacttagtaaatatcaaacgtgtgggaagacggagaaataatatgcaatggtttaaagtaccttcaaaaatctattttgaacgggattcaattcaatatttacaatccgtaccggatatgcgacgagtagttatcgtaaccgaccgcactatggtggatcttgggtttgtacaaaaaatcgcccatcagttggaatcccgtcgcgatccggtttcttaccagttatttgccgatgtagaaccggatccgagcattcaaaccgtgcgccgcggtgtggatttaatccgtaatttcaaaccggacactattatcgcgcttggcggcggttccgccatggatgcggcaaaagtgatgtggttattctatgaacaaccggaaattgacttccgtgatttggttcaaaaattcatggatattcgtaaacgtgcctttaaatttccatcattgggaaaaaaagcccgctatatcggcattccgaccacatccggtacgggttcggaagtgaccccgtttgcggtgattaccgaaggtaacaaaaaatatccgattgcggactattcgctaacgccgactatcgctttagtggatccggcattagttatgacggtacccgcccatgtagcggcggatacgggattagacgtattaacccatgccaccgaagcttatgtttccgtactggccaacgattataccgacggtcttgctttacaggcgattaaactggtattccggtatttggaaaaatccgtaaaagaaaatgatccggaggcaagagaaaagatgcataatgcgtccaccattgcgggtatggcgtttgccaatgcattcttaggtatgaatcattcccttgcacataaacttggcggccatttccatacgcctcacgggcgcactaatgcgatcttaatgccgcacgtgatccgttataacggtactaaaccgacgaaaaccgccacatggccgaaatacaactattacaaagcggacgaaaaatatcaggatatcgcccgtttgttgggcttaccggcggcgaccccggaagagggcgtgaaatcttatgccaaagcggtttacgatttagcggtacgttgcggtattaaaatgtccttcaaagaacagggattggaagaacaagcctggatggatgcccgccatgaaattgcattgcttgcctatgaagaccaatgttcgccggcaaatccgcgattaccgattgtggcggacatggaagaaattctcactaacgcctactatggttatgatgaaagcaaatactaa

SEQ ID NO: 39738 - protein, 876 aa, Mannheimia succiniciproducens MBEL55E
MIMSNAVENTVSPAQAEVNSLVEKGLVALEQFRQLNQEQVDYIVAKASVAALDQHGALALHALEETGRGVFEDKATKNLFACEHVVNKMRHWKTAGIISDDDVTGITEIADPVGVVCGITPTTNPTSTAIFKSLIALKTRNPIVFAFHPSAQQSSAHAAQIVRDAAVAAGAPENCIQWIAQPSMEGTNALMNHPGIATILATGGNAMVQAAYSCGKPALGVGAGNVPAYVEKSADIKQATHDIVMSKSFDNGMVCASEQAAIADAEIYEEFVNELKSYGVYFVNKKEKTLLEEFMFGVKANGANCAGAKLNADVVGKSAYWIAQQAGFEVPKKTNILAAECKEVSPKEPLTREKLSPVLAVLKSRSTEEGLTLAEAMVEFNGLGHSAAIHTKDAALAKRFGERVKAIRVIWNSPSTFGGIGDVYNAFLPSLTLGCGSYGKNSVSNNVSAMNLVNIKRVGRRRNNMQWFKVPSKIYFERDSIQYLQSVPDMRRVVIVTDRTMVDLGFVQKIAHQLESRRDPVSYQLFADVEPDPSIQTVRRGVDLIRNFKPDTIIALGGGSAMDAAKVMWLFYEQPEIDFRDLVQKFMDIRKRAFKFPSLGKKARYIGIPTTSGTGSEVTPFAVITEGNKKYPIADYSLTPTIALVDPALVMTVPAHVAADTGLDVLTHATEAYVSVLANDYTDGLALQAIKLVFRYLEKSVKENDPEAREKMHNASTIAGMAFANAFLGMNHSLAHKLGGHFHTPHGRTNAILMPHVIRYNGTKPTKTATWPKYNYYKADEKYQDIARLLGLPAATPEEGVKSYAKAVYDLAVRCGIKMSFKEQGLEEQAWMDARHEIALLAYEDQCSPANPRLPIVADMEEILTNAYYGYDESKY

SEQ ID NO: 39739 - DNA, 1152 bp, Mannheimia succiniciproducens MBEL55E
  CDS (1)..(1152): transl_table=11
atgtcaaacagatttattttaaacgaaaccgcttatttcggcgccgggtcaattcaacatattgtcaccgaagtacaaaaacgcggttttacgaaagggttaattgttaccgataaatcattgattcaatttaaagtggtggaaaaagtgaccgcacttttagagggtgccaatctggcttatgagatttttgacgaagtattgccgaatccgaccatgaatgtggtaaaagcgggacttgctaaatttaaagcgagcggtgcggattatatgattgcgatcggcggaggttcgccgcaggataccgcgaaagctatcggcattatcgtcaataatccggagtttgcggatattcgcagtctggaagggactgcgccgacgaaaaaaccggcggtacctaccattgcggtgccgactacggcgggaacggccgcggaagttaccattaattatgtgattaccgatgaagagaacaaacgtaaattcgtttgtgtggatcctcattccattccggtcgtggctgtgattgacagcgagatgatggccagtatgccgccgaccttaaaagcggcaaccggggtggatgcactgactcacgctattgaaggtttcatcaccttgggcgcctgggaactttccgatatgttccatctgaaggctattgaaattattgcccgcgctttgcgttcctcggttaaaggcgagcaacagggcgtggaagatatggcattagggcaatacgtcgcgggtatgggcttctcaaatgtgggcttaggattagtacatggtatggcacatccgttaggcgcgttttacagcacaccgcacggtgtcgctaatgccgtattgctgcctcatattatggcgtataacgcagatttcaccggagacaagttccgttcgattgctaaagccatgggggtacggaatacggaaatcctctctattgaacaagcaagagttgcagccgttgaagcggtaaaaaccttaaataaagatgtgggtattccggctacattacgtgaagtgggtatgaaagaagaggatattcccgaactcgccaaagcggcctttgccgatgtttgtaccggaggaaatccgagaccaacttcggtaaatgagattgaacggttatatcgggctatttattaa

SEQ ID NO: 39740 - protein, 383 aa, Mannheimia succiniciproducens MBEL55E
MSNRFILNETAYFGAGSIQHIVTEVQKRGFTKGLIVTDKSLIQFKVVEKVTALLEGANLAYEIFDEVLPNPTMNVVKAGLAKFKASGADYMIAIGGGSPQDTAKAIGIIVNNPEFADIRSLEGTAPTKKPAVPTIAVPTTAGTAAEVTINYVITDEENKRKFVCVDPHSIPVVAVIDSEMMASMPPTLKAATGVDALTHAIEGFITLGAWELSDMFHLKAIEIIARALRSSVKGEQQGVEDMALGQYVAGMGFSNVGLGLVHGMAHPLGAFYSTPHGVANAVLLPHIMAYNADFTGDKFRSIAKAMGVRNTEILSIEQARVAAVEAVKTLNKDVGIPATLREVGMKEEDIPELAKAAFADVCTGGNPRPTSVNEIERLYRAIY

SEQ ID NO: 39741 - DNA, 996 bp, Bacillus licheniformis ATCC 14580
  CDS (1)..(996): transl_table=11
atgaaaacgctttatcattttcgaacggccgcccgaattgaggctggtccacattcactcaatttgctcggcgattacttagatcaaattggattgaatcagattcgttcggtgtttattttaactcagccgtcgatcgtctctctcggctatgcagaccaaattaaagaagggcttgcaaagaaaggcatctcaagtgaagtcaacacggatatacagcctgagccgacggagcaaaatatcgaacaggtttttcagcttttttctgaaggaggccatgacgcgattttgggaattggcggaggcagtgtgcttgatgcggctaaaatcctctctgttctgaaaacaaatgaaaaaccgatttctgctttgattggcacgaatctcgttgaaaagcccggcgttccgcttgtgctgattccgacaacatccggaacagggtcagaagtgacgccgaatgcgattgtaacgttccctgagaaagaattaaagattggtatagtcagtccctatctgctgccgtcgcttgtgattttagatccagttttgacgaccggacttccaaaggcaatcacagctgcaaccggaatggatgcatttacacacgcactcgaatcctatatttccaacaaagcaaatccattcagcgacatgtttgcgcttgaatctatgagactgatttcctccagcattcagcaggcctaccatcatggagataacctggaggcgagagaaaaaatgctcattggcgccatgtatggcggaatggccttgacaagcgcaggaacagcggcggttcatgcgatggcttaccctctagggggaaaatacaagatttcgcacggtgtggccaattcaatgctgcttccgcatgtaacggccttcaacgcggatcatgtaactgaccgcctttcggacgtggccggcgtaattggaatcgagccaaaaggttcgaagtccagccaagcagagcgggttatacgaaaaattgaatag

SEQ ID NO: 39742 - protein, 331 aa, Bacillus licheniformis ATCC 14580
MKTLYHFRTAARIEAGPHSLNLLGDYLDQIGLNQIRSVFILTQPSIVSLGYADQIKEGLAKKGISSEVNTDIQPEPTEQNIEQVFQLFSEGGHDAILGIGGGSVLDAAKILSVLKTNEKPISALIGTNLVEKPGVPLVLIPTTSGTGSEVTPNAIVTFPEKELKIGIVSPYLLPSLVILDPVLTTGLPKAITAATGMDAFTHALESYISNKANPFSDMFALESMRLISSSIQQAYHHGDNLEAREKMLIGAMYGGMALTSAGTAAVHAMAYPLGGKYKISHGVANSMLLPHVTAFNADHVTDRLSDVAGVIGIEPKGSKSSQAERVIRKIE

SEQ ID NO: 39743 - DNA, 1161 bp, Legionella pneumophila subsp. pneumophila str. Philadelphia 1
  CDS (1)..(1161): transl_table=11
atgaaaaaccaatcattaattgtcaattggaattacccgacacgaatcctggttggggctgggcgaatcaatgaactagcgaaagtatgtcgtgagttaggcatgaatgctcctctgttagtcacagacccgggattggcttcgtcgttaatggtgagtaaagtcatacaacaggctcaggcatccggtttgcgaacggggttattttgccaaattaaaacaaatcctaccggtgacaatgtgatgaatggagtctatgcttttaaagctggccagcatgatggcgtgattgctttcggaggtggctcggctttggatgccggcaaagccatcgctttaatggttggccaggatcgacctttatgggattttgaggacgtgggtgataactggactcgggtgaatgtttcagccatggccccagttcttgccattccaacaacagcaggaactggttcagaggtcgggcgagcttctgtaattaccgatgctgaaaagcaggttaaaaaaatcatttttcatcctaaaatgttgcctgctatggttattctggatccagtgttaacagtcggtcttcccaaatcacttactgcagctacaggtatggatgctctttcccattgtcttgaagcttattgttccaattattatcatcctatggcagaaggtattgcgttggaaggaataagattaatcaaggagaacttaattcaagcttacaaggatggtagtgacctggaggcaagaacccatatgctggttgcttcagcaatgggggctaccgcctttcagcgtggtcttggagcgatgcatgccttggctcatccattaggtgcaatttatgatgtccatcacgggcggcttaatgcggttttgatgccctatgttttattggctaatcgtagtgaaattgaaaacaagatagagcacctggcaaattatttgtcaatagcaaatggatttgatggttttttggattggatagagcagatgagattagagttaggaatcgaaaatacattaagtcagttaggtattgatcattcgcagatagacagactggcaaaaatggccaccgaggatgcggcagcagcttccaatcctgttctttttacattagagcaatacaaagaactattgagcaaagccattggtgagtaa

SEQ ID NO: 39744 - protein, 386 aa, Legionella pneumophila subsp. pneumophila str. Philadelphia 1
MKNQSLIVNWNYPTRILVGAGRINELAKVCRELGMNAPLLVTDPGLASSLMVSKVIQQAQASGLRTGLFCQIKTNPTGDNVMNGVYAFKAGQHDGVIAFGGGSALDAGKAIALMVGQDRPLWDFEDVGDNWTRVNVSAMAPVLAIPTTAGTGSEVGRASVITDAEKQVKKIIFHPKMLPAMVILDPVLTVGLPKSLTAATGMDALSHCLEAYCSNYYHPMAEGIALEGIRLIKENLIQAYKDGSDLEARTHMLVASAMGATAFQRGLGAMHALAHPLGAIYDVHHGRLNAVLMPYVLLANRSEIENKIEHLANYLSIANGFDGFLDWIEQMRLELGIENTLSQLGIDHSQIDRLAKMATEDAAAASNPVLFTLEQYKELLSKAIGE

SEQ ID NO: 39745 - DNA, 1155 bp, Bacteroides fragilis YCH46
  CDS (1)..(1155): transl_table=11
atgattaatcgatttatattaaacgaagtttcttacttcggtccgggagcacgtgaagtgctccccaaagagatttcacgtttggggctgcacaaagcatttgtcgcaacagacaaagatttgataaagtttggagtagctgacaaagtacttaaggtgctggaagctgccaagattccttatgaaatattcagtgagattaagcccaatcctacagtgtcgaatgtgaaagccggtgtcgaggcatttgcatcttccggtgcagactttattttggctataggtggcggatcttctatggatacggcaaaggcgattggtattatttccaataacccggaattcagtgatgtcgtttcattggagggagtggcagataccaagaagaaatctgttcccatcatcgcattacctactactgcaggaactgcggcagaggtgactatcaactatgtgataacggatgaacagaaccagaagaagatggtttgtgtagatcctaatgatattccgtctattgcgatagtggatgctgagttgatgtacacacttcctaaaagtctgactgcagctacgggactcgacgcactgactcatgctattgaaggtttaataaccaaaggggcatgggagatgagtgatatgttcgaaattaaagctattgaaatgatcaatcgttatcttgtgactgccgttgaagaaccatcgaatgcagaggcacgtaacggtatggcagtggctcaatatattgcaggtatggctttttcgaatgtaggtctgggagttgtgcatggtatggcacatccgttgggagctattttcgatattcctcatggtgtggccaatgctctattattgcccattattatggagttcaatgctcctgcagctcttgacaaatatgttgagatagctaaagcgatgaatgtgtattctactgacatgactaaagaaaaggcggcagaagcagcagtcgaagctgtaaaaacattatctttgagggtcaatattccgcaacacttgtcggacttgggtattcaggaaagtgatcttgaccgtctggccacagcagcgtttgctgatgtatgtacgccgggcaatccacgggaagtaacaaaagaaattattcttgatttatataagaaagcattatga

SEQ ID NO: 39746 - protein, 384 aa, Bacteroides fragilis YCH46
MINRFILNEVSYFGPGAREVLPKEISRLGLHKAFVATDKDLIKFGVADKVLKVLEAAKIPYEIFSEIKPNPTVSNVKAGVEAFASSGADFILAIGGGSSMDTAKAIGIISNNPEFSDVVSLEGVADTKKKSVPIIALPTTAGTAAEVTINYVITDEQNQKKMVCVDPNDIPSIAIVDAELMYTLPKSLTAATGLDALTHAIEGLITKGAWEMSDMFEIKAIEMINRYLVTAVEEPSNAEARNGMAVAQYIAGMAFSNVGLGVVHGMAHPLGAIFDIPHGVANALLLPIIMEFNAPAALDKYVEIAKAMNVYSTDMTKEKAAEAAVEAVKTLSLRVNIPQHLSDLGIQESDLDRLATAAFADVCTPGNPREVTKEIILDLYKKAL

SEQ ID NO: 39747 - DNA, 1293 bp, Nocardia farcinica IFM 10152
  CDS (1)..(1293): transl_table=11
atgcaggtagacgagctgctcaagccattccccatcaaggagttccaccccttcccgcgggcgctgctgggccccggctcgcacgagatcatcgggccggaggcgctgaagctcggcttcaagaaggtactggtgatgaccagcggcctgcgcggcaccgacatcgtgcccaagatcgtcggctcgctcgagtaccacgggctcgaggtcgtgctctacgacaaggtcgagtcgaaccccaaggactacaacgtgatggacgcggtcgcgctgtaccagcagcacggctgcgacagcttcgtgtcgatcggcggcggctcctcgcacgacgcctgtaagggcgcgcgcatctcgatcgcccacgacgggcgcaacatcaacgagttcgagggcttcaacaagtcggagaacccgaagaacccgccgcacatcgcggtctcgaccaccgcgggcaccggctcggagacctcctgggcctacgtcatcaccgacaccaccaccgatcccgacaacccgcacaagtacgtcgccttcgacgacgcctcggtcgccaccctggccatcgacgacccggtgctgtacttcgactgcccgaccgactacaccgcgcagtgcggtttcgacgtgctcgcgcacggttcggagccgttcgtctcgcggctgaacttcaccccgtcgatcggcaacgcgctctacgcgatcaagctggtcgcggagaacctgcgcaccgccacctggaacccgaccgagctgtccggccgcgagggcatgatgtacgcccagtacatcgcggcgcaggcgttcaactccggcggcctcggcatcatccactccatctcgcacgcggtgtcggcgttctacgacacccaccacggcctgaacaacgcgatcgcgctgccgcgcgtgtgggcgttcaacatgccggtggcgtacaagaagttcgccgagatcgcgggcgcgatgggcgtggacacctacggcatgaccgacgtgcaggccgccgacgcggcactgggcgcggccgtgcggctgctgcgcgacgtgggcatcccggagaagttcaccgacatcaccaaggacacctactcgaagaaccggctgggccagggcccgaccaagtactacgagaacgcctcggtgatcaagggcaacgacgaggacatcgaccggatcacccggcacgtcctcggtgacgcctgcaccccgggcaacccgaaggaatgcaccttcgagaccgtgcgcccggtcgtcgagcactgcatgcacggcagcctggacgacctgctcagctga

SEQ ID NO: 39748 - protein, 430 aa, Nocardia farcinica IFM 10152
MQVDELLKPFPIKEFHPFPRALLGPGSHEIIGPEALKLGFKKVLVMTSGLRGTDIVPKIVGSLEYHGLEVVLYDKVESNPKDYNVMDAVALYQQHGCDSFVSIGGGSSHDACKGARISIAHDGRNINEFEGFNKSENPKNPPHIAVSTTAGTGSETSWAYVITDTTTDPDNPHKYVAFDDASVATLAIDDPVLYFDCPTDYTAQCGFDVLAHGSEPFVSRLNFTPSIGNALYAIKLVAENLRTATWNPTELSGREGMMYAQYIAAQAFNSGGLGIIHSISHAVSAFYDTHHGLNNAIALPRVWAFNMPVAYKKFAEIAGAMGVDTYGMTDVQAADAALGAAVRLLRDVGIPEKFTDITKDTYSKNRLGQGPTKYYENASVIKGNDEDIDRITRHVLGDACTPGNPKECTFETVRPVVEHCMHGSLDDLLS

SEQ ID NO: 39749 - DNA, 1302 bp, Nocardia farcinica IFM 10152
  CDS (1)..(1302): transl_table=11
gtggcccagctgacgcgacccgtaccgggtgttccgaccgatccggtattgcgcacccggacccgcaccgacctccccgccgccgatccggcggcctccgaggtggaactgagcgggccgtgggagccggacacggtgagcgccaccgccgccccgcagctggcgaaattccacacccccgaggtcgtgttcgggccgggcgcaatgggtgaactggggcattgcgcgcggcgggtgggcgcgcggcggccgttcctggtcaccgatcccggcatcatcgagtccgggtgggtcgccgaggcgaccgggcacctgcagcaggtcggcctgcatccggtggtgtggtcgacgatcacgccgaacccgaaggaccacgagatcaccgccgcctacgagcactacctggcgaccggcagcgacgtcgtgatcgcggtcggcggcggttccagcatcgacgcggccaagggggtggcgatcctggccggcaacggcggcgcgatcctcgactacgagggcgtggaccgggtgacccagccgatcccgccgctggtcatggtgccctcgacctccggcaccggcgcggacgtgtcgcagttcgccatcgtcaccgacaccactcagcgcaccaagatcaccatcatcagccggacactcgtgcccgacgtgtcgatcgtcgacccgcggctgctgatcaccatgcccgacgacctcaacgccgccaccggactggacgcgctcacgcacgcgatcgagtcctacgtctcgcgcgcgcacaaccagctcaccgaccatcacgccctgcacgccgcgcacctgatcaccagcaacctgcgccgcaccatgacgcacccgcgcctggccgaaccgcgcatcgcgatggcgcacggcgcgttgcaggcgggcatggccttcaccaacgccatcctcgggatcacccacgccatgagtcaccaggtgggcgggctgctcgacgccccgcacggcgtgctcaacggcatcctgctgccgcactgcatccgcttcaacgccgccgccgacccgaccccgtacgtgccgttggccgccgccgtcgggatcgacgtggcacgcaagcccgccgccgaggtggccgagctgctggccgagcggatccgcgcgctggccgacgagatcggggtgccgcgcgggctggccgcgttgggtgtgaccgaagccgacatcccgacgatggcccgcaccaccctcaacgacgcctgcctggcgaccaacccgcgcgtgcccgacgccgagagcatcgcggagctgttccgcgaggcgttgtga

SEQ ID NO: 39750 - protein, 433 aa, Nocardia farcinica IFM 10152
MAQLTRPVPGVPTDPVLRTRTRTDLPAADPAASEVELSGPWEPDTVSATAAPQLAKFHTPEVVFGPGAMGELGHCARRVGARRPFLVTDPGIIESGWVAEATGHLQQVGLHPVVWSTITPNPKDHEITAAYEHYLATGSDVVIAVGGGSSIDAAKGVAILAGNGGAILDYEGVDRVTQPIPPLVMVPSTSGTGADVSQFAIVTDTTQRTKITIISRTLVPDVSIVDPRLLITMPDDLNAATGLDALTHAIESYVSRAHNQLTDHHALHAAHLITSNLRRTMTHPRLAEPRIAMAHGALQAGMAFTNAILGITHAMSHQVGGLLDAPHGVLNGILLPHCIRFNAAADPTPYVPLAAAVGIDVARKPAAEVAELLAERIRALADEIGVPRGLAALGVTEADIPTMARTTLNDACLATNPRVPDAESIAELFREAL

SEQ ID NO: 39751 - DNA, 1161 bp, Legionella pneumophila str. Paris
  CDS (1)..(1161): transl_table=11
atgaaaaaccaatcattaattgtcaattggaattacccgacacgaatcctggttggggctgggcgaatcaatgaactagcgaaagcatgtcgtgagttaggcatgaatgctcctctgttagtcacagacccgggattggcttcgtcgttaatggtgagtaaagtcatacaacaggctcaggcatccggtttgcgaacggggttattttgccaaattaaaacaaatcctaccggcgacaatgtgatgaatggagtctgtgcttttaaagctggccagcatgatggcgtgattgctttcggaggtggctcggctttggatgccggcaaagccatcgctttaatggttggccaggatcgacctttatgggatttcgaggatgtgggtgataactggactcgagtgaatgtttcagccatggccccagttcttgccattccaacaacagcaggaactggttcagaggtcgggcgagcttctgtaattaccgatgctgaaaagcaggttaaaaaaattatttttcatcctaaaatgttgcctgccatggttattctggatccagagttaacagtcgggcttcccaaattactcactgcagccacaggtatggatgctctttcccattgtcttgaagcttattgttccaattattatcatcctatggcagaaggtattgcgttagaaggaataagattaatcaaggagaatttaattcaagcttacaaggatggtagtgacctggaggcaagaacccatatgctagttgcttcagcaatgggagctactgcctttcagcgtggtcttggagcgatgcatgccttggctcatccattaggtgcaatttatgatatccatcacgggcggcttaatgcggttttgatgccctatgttttattggctaatcgtagtgaaattgaaaacaagatagagcgtctggcaaattatttgtcaatagcaaatggatttgatggttttttggattggatagagcagatgagattagagttaggaatcgaaaatacactaagtcagttaggtattgatcattcgcagatagacagactggcaaaaatggccactgaggatgcggcagcagcttccaatactgttctttttacattcgagcaatacaaagaactattgagcaaagctattggtgagtaa

SEQ ID NO: 39752 - protein, 386 aa, Legionella pneumophila str. Paris
MKNQSLIVNWNYPTRILVGAGRINELAKACRELGMNAPLLVTDPGLASSLMVSKVIQQAQASGLRTGLFCQIKTNPTGDNVMNGVCAFKAGQHDGVIAFGGGSALDAGKAIALMVGQDRPLWDFEDVGDNWTRVNVSAMAPVLAIPTTAGTGSEVGRASVITDAEKQVKKIIFHPKMLPAMVILDPELTVGLPKLLTAATGMDALSHCLEAYCSNYYHPMAEGIALEGIRLIKENLIQAYKDGSDLEARTHMLVASAMGATAFQRGLGAMHALAHPLGAIYDIHHGRLNAVLMPYVLLANRSEIENKIERLANYLSIANGFDGFLDWIEQMRLELGIENTLSQLGIDHSQIDRLAKMATEDAAAASNTVLFTFEQYKELLSKAIGE

SEQ ID NO: 39753 - DNA, 1161 bp, Legionella pneumophila str. Lens
  CDS (1)..(1161): transl_table=11
atgaaaaaccaatcattaattgtcaattggaattacccgacacgaatcctggttggggctgggcgaatcaatgaactagcgaaagtatgtcgtgacttaggtatgaatgctcctctgttagtcacagacccgggattggcttcgtcgttaatggtgagtaaagttatacaacaggctcaggcatccggtttgcgaacggggttattttgccaaattaaaacaaatcctaccggtgacaatgtgatgaatggagtctatgcttttaaagctgggcagcatgatggtgtgattgctttcggaggtggctcggctttggatgccggcaaagccatcgctttaatggttggccaggatcgacctttatgggatttcgaggacgtgggtgataactggactcgagtgaatatttcagccatggccccagttcttgccattccaacaacagcaggaactggttcagaggtcgggcgagcttctgtaattaccgatgctgaaaagcaggttaaaaaaatcatttttcatcctaaaatgttgcctgctatggttattctcgatccagagttaactgtcgggcttcccaaatcacttactgcagctacaggtatggatgctctttcccattgtcttgaagcttattgttccaattattatcatcctatggcagaaggtattgcgttggaaggaataagattaatcaaggggaatttaattcaagcttacaaggatggtagtgacctggaggcaagaacccatatgctggttgcttcagcaatgggggctaccgcctttcagcgtggtcttggagcgatgcacgccttggctcatccattaggtgcaatttatgatgtccatcacgggcggcttaatgcggttttgatgccttatgttttattggctaatcgtagtgaaattgaaaacaagatagagcgtctggcaaattgtttatcaatagcaaatggatttgatggttttttggagtggatagagcagatgagattagagttaggaatcgaaaatacattaagtcagttaggtattgatcattcgcagatagacagactggcaaaaatggccactgaggatgcggcagcagcttccaatcctgttctttttacattagagcaatacaaagaactattgagcaaagccattggtgagtga

SEQ ID NO: 39754 - protein, 386 aa, Legionella pneumophila str. Lens
MKNQSLIVNWNYPTRILVGAGRINELAKVCRDLGMNAPLLVTDPGLASSLMVSKVIQQAQASGLRTGLFCQIKTNPTGDNVMNGVYAFKAGQHDGVIAFGGGSALDAGKAIALMVGQDRPLWDFEDVGDNWTRVNISAMAPVLAIPTTAGTGSEVGRASVITDAEKQVKKIIFHPKMLPAMVILDPELTVGLPKSLTAATGMDALSHCLEAYCSNYYHPMAEGIALEGIRLIKGNLIQAYKDGSDLEARTHMLVASAMGATAFQRGLGAMHALAHPLGAIYDVHHGRLNAVLMPYVLLANRSEIENKIERLANCLSIANGFDGFLEWIEQMRLELGIENTLSQLGIDHSQIDRLAKMATEDAAAASNPVLFTLEQYKELLSKAIGE

SEQ ID NO: 39755 - DNA, 2706 bp, Photobacterium profundum SS9
  CDS (1)..(2706): transl_table=11
atgcctgttacaaatatggctgaactagatgcaatggttgcccgcgtaaaagctgctcaacaagagtttgcaactttctctcaagagcaagttgataaaatctttcgtgctgcttctctagctgcgaacaacgcacgtattcctctagctcaacaagctgtagctgagtctggtatgggtattgttgaagataaggttatcaaaaaccacttcgcttcagaatttatctacaacaaatacaaagacgaaaaaacgtgcggtattttggaagagaacgaagagttcggcaccatgactatcgcagaaccagtaggtatcatttgcggtatcgtacccactacgaacccaacatctactgcaatcttcaaatctcttatctctcttaaaacacgtaacgcaattatcttctcgccacatccacgtgctaaaaactcaacgaacgctgctgctaaattagtgcttgacgctgctgttgctgctggcgcaccaaaaaacatcattggttggattgaccaaccttcagttgagctttcaaatgcattgatgaagcataacgacattaaccttattcttgcgactggtggtccaggtatggttaaagcggcttactcttcaggtaaaccagctatcggtgttggtgcgggtaacgtacctgtagttattgatgaaacggctgatattaagcgtgctgtagcatctgtgcttatgtctaagacattcgataacggtgttgtatgtgcttctgagcaagcagttatcgttatggacgaagtctacgatgaagtgaaagcacgctttgcttctcacaacggttatgtactgtctaaagctgaagcagataaagtacgtaaaatcttgcttatcaacggtaacctaaacgcagatatcgtaggccagccagcaactaaaattgctgaaatggcaggtattactgttcctgctgatactaagattcttatcggtgaaggcgatgaagttaagtacgaagacgaattcgcacacgaaaaactatctccaacgttaggtatgttccgcgcatcttcttttgaaaatgcagtagagcaagcttgtactatggttgatatcggcggtatcggtcacacatctggtctatacactaaccaagatgtaaataaagatcgtatcaagtacttcggcgacaagatgaagactgcacgtattcttgtaaacattccgactactcacggtggtatcggtgacctttacaactttaacgttgcaccttctctaactcttggttgtggttcatggggtggtaactctatctctgagaacgtaggtcctaagcaccttatcaacaagaagactgtagcgaagcgagctgagaatatgttgtggcataaactaccaaaatcaatctacttccgtcgtggtagccttccaatcgcattgagcgatctagaaggcaagaaacgtgcattcctagttactgaccgtttcctattcaacaacggttatgctgatgatgtggttaaactacttaaagctcaaggtattgaagttcaaactttcttcgacgtagaagcggatccaacactgtctattgttgagaaaggtgcagaagcgatgaagagcttccagcctgacgtaatcatcgcgcttggtggtggttctccgatggatgctgcgaagatcatgtgggttatgtacgagcacccagaaactcactttgaagaactagcaatgcgctttatggatattcgtaagcgtatttacaagttccctaaaatgggtaaaaaagctgagctagtatgtatcacgactacatcaggtacgggttctgaagtaacacctttcgctgttgttacagacgataagacaggtgctaagtacccactcgctgattacgaattaacacctcatatggctatcgttgatgcaaacttagtaatgaacatgcctaggtcgctaacagcatttggtggttacgatgcagtaactcacgcactagaagcttacgtttctgttcttgctaacgaatactctgatggccaggctcttcaagcacttaagatgctgaaagaatacctaccttcaagctacgcaaatggtgcaaacgacccaatcgctcgtgagaaagtacacaatgcggcaactatcgctggtattgcgtttgcgaatgctttcctaggtgtgtgtcactcaatggctcacaaagtgggtgcagagttccacgtaccacacggcttagctaatgcattgttgatttctaacacaattcgttacaacgcgaacgataacccaacaaaacaaacagcgttctctcagtacgcaagcccacaagctcgccgtcgttatgctgaagttgctgatcacttgagtttatctcaagctggtgaccgtactgctcagaagattgaacgtctactaacatggttagaagagctgaaaattgcactggatatcccgctatcaattcaagctgcaggcattccagaagctgacttcctagcgaaactagaccaactatcaattgaagcgttcgatgatcagtgtactggtgctaacccacgttaccctcttatcagcgagctgaaagaagtactaacgtctgcttactacggtactccgtatatcgaaggtgaaactttcgaaggtacgactgtcattaagaagtctgagccagtagtagttgctgtaaaagtagaaaaagtgaaagcaaagaaagaagcagctaaagcttaa

SEQ ID NO: 39756 - protein, 901 aa, Photobacterium profundum SS9
MPVTNMAELDAMVARVKAAQQEFATFSQEQVDKIFRAASLAANNARIPLAQQAVAESGMGIVEDKVIKNHFASEFIYNKYKDEKTCGILEENEEFGTMTIAEPVGIICGIVPTTNPTSTAIFKSLISLKTRNAIIFSPHPRAKNSTNAAAKLVLDAAVAAGAPKNIIGWIDQPSVELSNALMKHNDINLILATGGPGMVKAAYSSGKPAIGVGAGNVPVVIDETADIKRAVASVLMSKTFDNGVVCASEQAVIVMDEVYDEVKARFASHNGYVLSKAEADKVRKILLINGNLNADIVGQPATKIAEMAGITVPADTKILIGEGDEVKYEDEFAHEKLSPTLGMFRASSFENAVEQACTMVDIGGIGHTSGLYTNQDVNKDRIKYFGDKMKTARILVNIPTTHGGIGDLYNFNVAPSLTLGCGSWGGNSISENVGPKHLINKKTVAKRAENMLWHKLPKSIYFRRGSLPIALSDLEGKKRAFLVTDRFLFNNGYADDVVKLLKAQGIEVQTFFDVEADPTLSIVEKGAEAMKSFQPDVIIALGGGSPMDAAKIMWVMYEHPETHFEELAMRFMDIRKRIYKFPKMGKKAELVCITTTSGTGSEVTPFAVVTDDKTGAKYPLADYELTPHMAIVDANLVMNMPRSLTAFGGYDAVTHALEAYVSVLANEYSDGQALQALKMLKEYLPSSYANGANDPIAREKVHNAATIAGIAFANAFLGVCHSMAHKVGAEFHVPHGLANALLISNTIRYNANDNPTKQTAFSQYASPQARRRYAEVADHLSLSQAGDRTAQKIERLLTWLEELKIALDIPLSIQAAGIPEADFLAKLDQLSIEAFDDQCTGANPRYPLISELKEVLTSAYYGTPYIEGETFEGTTVIKKSEPVVVAVKVEKVKAKKEAAKA

SEQ ID NO: 39757 - DNA, 1149 bp, Photobacterium profundum SS9
  CDS (1)..(1149): transl_table=11
atgagcagtgcattttttatcccttcggtaaacttaatgggcgctggttgtttaactgaggcggcagatgcggttaaagcacatggcttcaaaaaagcattaatcgtgacagataaagtattgaaccaaattggcgtggttaagcaagtggttgatctgctggctgaacgtaacgtagaagcggttgtttttgatggcacacaacctaacccaacaatgggcaatgttgaagcgggcttagcgctattaaaagccaatgagtgtgactttgttatttcattaggtggtggctcgccgcacgattgtgcgaaaggtgttgcgcttgttgcttcaaatggcggttcaatctctgattatgaaggggttgatgtgagtgctaaacctcagttaccacttgttgcgattaatacgacagctggtacagcatcagagatgacacgcttctgtattattacggatgaagctcgtcacattaagatggccattgttgataaaaatacaacgccattaatgtcagtaaatgatcctgaattgatgttagcaaagcctgcatcattaaccgcagcaaccggtatggatgcgctaacacacgctattgaagcatacgtttcaactgcagcaacaccgattacagatgctgtagcaattaaagctatggagcttattcaggcacacttacgtaccgctgtaaatgatggtcaaaaccttgaagcgcgtgagcaaatggcctacgcacaattcatggctggcatggcatttaacaatgcctctttaggttacgtacacgcaatggcgcaccagttaggtggtttttacgacctgccacatggtgtgtgtaatgcggttcttttacctcacgttcagcgctataacgctaaagtatgtcctgagcgtttacgtgatgtagcaaaagccatgggtgtgaatgttgaatctatgactgctgaacaaggtgcagatgctgcattagaagccattcaagttctatcgaaagatgtaggtattccagctggtcttaaagatcttggcgcaaagaatgaagatatctcaattcttgctgataatgcattgaaagatgcatgtggttttactaatccaaagcaagcaactcatgaagaaatttctgagatttttgctgctgcaatgtaa

SEQ ID NO: 39758 - protein, 382 aa, Photobacterium profundum SS9
MSSAFFIPSVNLMGAGCLTEAADAVKAHGFKKALIVTDKVLNQIGVVKQVVDLLAERNVEAVVFDGTQPNPTMGNVEAGLALLKANECDFVISLGGGSPHDCAKGVALVASNGGSISDYEGVDVSAKPQLPLVAINTTAGTASEMTRFCIITDEARHIKMAIVDKNTTPLMSVNDPELMLAKPASLTAATGMDALTHAIEAYVSTAATPITDAVAIKAMELIQAHLRTAVNDGQNLEAREQMAYAQFMAGMAFNNASLGYVHAMAHQLGGFYDLPHGVCNAVLLPHVQRYNAKVCPERLRDVAKAMGVNVESMTAEQGADAALEAIQVLSKDVGIPAGLKDLGAKNEDISILADNALKDACGFTNPKQATHEEISEIFAAAM

SEQ ID NO: 39759 - DNA, 1176 bp, Geobacillus kaustophilus HTA426
  CDS (1)..(1176): transl_table=11
atggtcggacattatatccaaaaggaagttgaatttgagttctctttccatcttcctacatcaatccagtttggatacggtaaagcatctcaactcggaaatcagctggtagacatggggataaaaagtgcttttttagttactgacagaggagtggaagcaactggcttactggcaggaatcattcaatctctagagtcgtctaatatacagtactgtgtttatgccgatgtagaacctgatccaagcttggagactattgatcaaggggcagctgcttttaaggaacagccttttgactgcattgtcgccataggtggtggaagtccgatcgatacggccaaaggaatacgtgtcgtcgcaacaaacgggggatccattggtgattacgctggtgttaatcgcatcaagaaaaagtctgaaatccctttaatagccttgcctacaacatctggtacaggtagtgaggttacaatctttggtgtctactctgattggaagaataatgttaaggttacggttacaagcccatatatggcgcctgagattgctttggtagaccctaagcttactatgagtttacccaaaaaaataacggctgcatcaggtattgatgcgctagcccatggaatcgaaactttcttctccttgcgttctcagcctatatcggatgttctagcgatcgaagcaatgacaacggtaaatcgctatctgcgtcgtgcagttgaagatggtactaataaagaggcaaggatcggtatgtcctacgggagcttattggcgggaatggcttttaataacggatttctaggtttagcccatgcgattggaagtgctttatcaggtcactgtcatgtatctcatggtgtcgcaatcgggttgctacttccaaaggttgtggaatttaactccgttgttcagcctgaaaaagcggccaagatagccgaattgttagggaggaaaggaaaccagaatacccttgtgcaacaagcggctttggcggtcgcttcgttagttaaagagattgggcttccgacacgtttgcgcgacgtcgacgttcccaaagaaaaactccccgatatcgcaaaagattcattcaaaagcggaatgatgcgatttaacccacgtcaaccgagtgaagcagaggttatgacactcttacaacagatttattga

SEQ ID NO: 39760 - protein, 391 aa, Geobacillus kaustophilus HTA426
MVGHYIQKEVEFEFSFHLPTSIQFGYGKASQLGNQLVDMGIKSAFLVTDRGVEATGLLAGIIQSLESSNIQYCVYADVEPDPSLETIDQGAAAFKEQPFDCIVAIGGGSPIDTAKGIRVVATNGGSIGDYAGVNRIKKKSEIPLIALPTTSGTGSEVTIFGVYSDWKNNVKVTVTSPYMAPEIALVDPKLTMSLPKKITAASGIDALAHGIETFFSLRSQPISDVLAIEAMTTVNRYLRRAVEDGTNKEARIGMSYGSLLAGMAFNNGFLGLAHAIGSALSGHCHVSHGVAIGLLLPKVVEFNSVVQPEKAAKIAELLGRKGNQNTLVQQAALAVASLVKEIGLPTRLRDVDVPKEKLPDIAKDSFKSGMMRFNPRQPSEAEVMTLLQQIY

SEQ ID NO: 39761 - DNA, 1149 bp, Geobacillus kaustophilus HTA426
  CDS (1)..(1149): transl_table=11
atgaacattcataagttcgtgatgcccgaagtgatttttggtaacggttccattcatcaagtaggggaaagttgtctaaggcttggtgcgacaaatgtgttgattgtcagcgatccaggtgttacggaagctggttggctcgatgttgtcattaagagttgcaggcaagtaggattaaaatacacgacattttgtgatgtaacaataaatccaaaggacgaagaagtaaaaaaaggctgtgaagcatatcttgagaatgaatgcgatgctatcattggaatcggtggaggcagttctattgatgccgcaaaggctgtcgccattcttgctacaaacgggggacaaattcatgaatatgagggagtggataaaattcaattgccccttcctcctcaagtgatggttccaacaacagcagggtcaggatcagaagtatcccaattttctgttattgttaatacaaaagagaaaaaaaagatgacgatcatttcccgatctcttattcctgatattgcaattattgatccagaaacattgtcgacaaaaagcgctcatttaactgcctcaacaggattagatgttttaacgcatggcattgaggcgtatgtaagtctagcagctacaccgcttacagacgttcaagctcaaaacgctatttctttagtaggaaaatatttgcgcccttctgtcgcctctaaaatcaaccaagaggcaaaaaccaatatggcaatggcgagtttgcaggcaggattggctttttctaacgcgattttaggcgctgttcatgcaatgtcccatgctgtcgggggaaggtatcctcttcttcatggggatataaactctatattgcttccgcatgtgatggagttcaatctgttggcgaatccgaaaaaatttgctgatattgcttgttttctcggaatggatactcgtggcatgtcttatatggaagcgggaagaaaaacaattgaatatgtaaaacaattggcagaggatattggggtgccacagcgattatctgatataggagtgaaacaagaagaaatacggaaaatgagtttggttgcctttcatgacgcatgtatgatcaccaaccctcgtgatatcactgtagaagaaattgaaggaatattcagaaaggcgtggtaa

SEQ ID NO: 39762 - protein, 382 aa, Geobacillus kaustophilus HTA426
MNIHKFVMPEVIFGNGSIHQVGESCLRLGATNVLIVSDPGVTEAGWLDVVIKSCRQVGLKYTTFCDVTINPKDEEVKKGCEAYLENECDAIIGIGGGSSIDAAKAVAILATNGGQIHEYEGVDKIQLPLPPQVMVPTTAGSGSEVSQFSVIVNTKEKKKMTIISRSLIPDIAIIDPETLSTKSAHLTASTGLDVLTHGIEAYVSLAATPLTDVQAQNAISLVGKYLRPSVASKINQEAKTNMAMASLQAGLAFSNAILGAVHAMSHAVGGRYPLLHGDINSILLPHVMEFNLLANPKKFADIACFLGMDTRGMSYMEAGRKTIEYVKQLAEDIGVPQRLSDIGVKQEEIRKMSLVAFHDACMITNPRDITVEEIEGIFRKAW

SEQ ID NO: 39763 - DNA, 1188 bp, Geobacillus kaustophilus HTA426
  CDS (1)..(1188): transl_table=11
atgaccgcatcccgcatcgtctttccgccgctcagctatgtcggctggggggcgcttggccagttagttccagaagtaaaaaggcttggggcaaaacacgtgttggtgatcaccgatccagcgcttgaaaaactcggtctcgtcgagcaagtggcatctccgctccggcaagcagggtgcagcgtgcatgtatatacggatgttgtgccggagccgccgcttgaaacaggggagaaggcggtggcgtttgtccgcgacggagagtttgatctcgtcatcggggtcggcggcggcagcgcgatggatttggcgaaactggccgctgttttggccgtgcatgaaggttcggtcgccgattatttaaacttgacgggaacgagaacacttgagaaaaaaggattgccgaaaatattgattccgacgacatcaggcaccgggtcggaggtgacgaacatctccgtgttgtccttagaaacgacgaaagacgtcgtgacgcatgattatttgttggcggatgtggcgatcgtcgatccgcagcttacggtttccgtcccgccgcgggtgacggcggcgacgggcattgatgcgcttacccatgcggttgaagcgtacgtgtcggtcaatgcgagcccgacatcggacggcttggcgcttcaggcgatgcgtctcatttcccgctcattgcgcaaggcggtggaacatggagcggacaaacaggcgcgcatcgatatggcgaacggcagctatttggccggtttggcgtttttcaacgccggggtggccggcgtgcatgcgctcgcgtatccgcttggcggacagtttcatatcgcccatggcgaatcaaatgccgtgctcttgccatatgtgatgggctacattcgccaaagctgcacgaaacgaatggctgatatcttaaacgccctcggcggcaactcgagctttttatcagaggaggaggcgtcgcaccgctgcgtcgaggagctcgagcgcctcgtcgccgatgtcggcatcccgaagacgctcggcggttttggcattccggaaagtgcgttagaaagcttgacaaaagacgccattcagcaaaaacggctgctcgcccgcagcccgatgccgctttcggaagacgacatccgcacgatttatcaagcggcgtttacagggacgatcgtcgaaccgaacaacgaatga

SEQ ID NO: 39764 - protein, 395 aa, Geobacillus kaustophilus HTA426
MTASRIVFPPLSYVGWGALGQLVPEVKRLGAKHVLVITDPALEKLGLVEQVASPLRQAGCSVHVYTDVVPEPPLETGEKAVAFVRDGEFDLVIGVGGGSAMDLAKLAAVLAVHEGSVADYLNLTGTRTLEKKGLPKILIPTTSGTGSEVTNISVLSLETTKDVVTHDYLLADVAIVDPQLTVSVPPRVTAATGIDALTHAVEAYVSVNASPTSDGLALQAMRLISRSLRKAVEHGADKQARIDMANGSYLAGLAFFNAGVAGVHALAYPLGGQFHIAHGESNAVLLPYVMGYIRQSCTKRMADILNALGGNSSFLSEEEASHRCVEELERLVADVGIPKTLGGFGIPESALESLTKDAIQQKRLLARSPMPLSEDDIRTIYQAAFTGTIVEPNNE

SEQ ID NO: 39765 - DNA, 1188 bp, Geobacillus kaustophilus HTA426
  CDS (1)..(1188): transl_table=11
atgtacgaattgttggtgcccagccgggttgtgtatgggcgcgatacgttcgccgaagtcggcccacaagcaaaagcgctcgggacgaaagcgctgatcgtcagcgacccggtgatggagaaaatcggccttgtcgcccgttgcgagcaatacttgcaacaggtggggatgacgtttgccaagtacacaggggttgacacggagccgacggatgtccatgtgaaggaagcgcttgacgtctgccggagcgagcagtgcgatgtcattatcgctcttggcggcggcagcagcatcgacgccgccaaagcggtgtccgtgatgatgacgaatgaaggaacgatcagcgactatgtcggcaatcaaaaaaggtttaccgaaaaaccgctgccgctcatcgccattccgacaacggccggaacgggttcggaagtgacgaaagtaacggtcattatcgatacgaagatggacgtcaaaatgatgatttcccaaccggcgctgcttccagccgtggcgattgtcgacccgttgctcacggtttcatgcccgccgtccgttacagcggcgaccggggttgatgcgctgtgccatgcgatcgaggcgtatatttcccgacgcgcccacccggtgaccgatgcgctggcgctctctgccattgaagcgatcgtcggtcatttgcgccgggcgtatgaaaacggccaagacatcgaagcgcgggagaagatggcgatcgcggccatgaaagccggcatggccttttccaacgcctcggtgacgctcgtgcacggcatgtcgcggccgatcggcgcgcttttccacgtgccgcacggcgtatcgaacgcgatgttgttgcctggggtgcttgagtttacaaaagacagcgccatcgaacgattggcggtgatcgtccgaatcatcaagccgccgctcaaagacgtttccgatacggaagcggctgaggcgctcgttgaggaagtgaaacagctttgccgcgatttgcacatcccgaatatgaaaacgtggggcattgacaaaacagcgtttgacaaggtggtggacaaaatggcggctgacgcgcttgcgagcggcagccccgccaacaacccgaaagtgccgacgcatgaggaaattgtggcattgtaccattattgttacgactatcagtacgacaccaaaaccgtaagttcgtaa

SEQ ID NO: 39766 - protein, 395 aa, Geobacillus kaustophilus HTA426
MYELLVPSRVVYGRDTFAEVGPQAKALGTKALIVSDPVMEKIGLVARCEQYLQQVGMTFAKYTGVDTEPTDVHVKEALDVCRSEQCDVIIALGGGSSIDAAKAVSVMMTNEGTISDYVGNQKRFTEKPLPLIAIPTTAGTGSEVTKVTVIIDTKMDVKMMISQPALLPAVAIVDPLLTVSCPPSVTAATGVDALCHAIEAYISRRAHPVTDALALSAIEAIVGHLRRAYENGQDIEAREKMAIAAMKAGMAFSNASVTLVHGMSRPIGALFHVPHGVSNAMLLPGVLEFTKDSAIERLAVIVRIIKPPLKDVSDTEAAEALVEEVKQLCRDLHIPNMKTWGIDKTAFDKVVDKMAADALASGSPANNPKVPTHEEIVALYHYCYDYQYDTKTVSS

SEQ ID NO: 39767 - DNA, 1188 bp, Salmonella enterica subsp. enterica serovar Paratyphi A str. ATCC
  CDS (1)..(1188): transl_table=11
atgcaagctgaactacagacggcgctgtttcaggcattcgacaccctgaatctgcaacgggtgaaaacgttcagcgtaccgccggtcacgctgtgcggacttggggcgctcggcgcctgcggccaggaagcgcaagcgcgaggcgtaagtcatctgtttgtgatggtcgacagcttcctgcatcaggcgggaatgaccgcgccgctggcacgcagcctggcgatgaaaggcgtggcgatgacagtctggccgtgtccgccaggcgagccgtgcatcaccgatgtttgcgcggcggtggcgcaactgcgtgaggcggcgtgcgacggcgtagtggcctttggcggcggttcggtgctggacgcggcgaaagcggtcgccctgctggtgactaaccctgaccagacgctgagcgccatgaccgagcgcagtacattacgcccgcgtctgccgctgattgcggtgccgaccaccgccggaaccggttctgaaaccaccaacgtgacggtgattatcgacgcggtcagcgggcgcaagcaggtgctggcacacgcgtcactaatgccggacgtggcgattcttgatgctgccgtgaccgaaggcgttccgccaaacgtgacggcgatgactggtatcgatgcgttgacgcatgcgattgaggcctacagcgcgctcaacgccacgccgtttaccgacagcctggcgattggcgcgatagcgatgattggcaaatcgctgccgaaagccgtgggttacggccacgatctggcggcgcgtgaaaatatgttgttggcctcctgtatggcgggaatggccttttccagcgccggtctggggctgtgtcatgcgatggcgcaccagccaggggcggcgctgcatattccgcacggccaggccaacgccatgctgctgccgacagtcatgggatttaaccggatggtatgccgcgaacgcttcagtcaaatcggtcgggcgttaaccaataagaagtcggacgatcgcgatgcgattgcggcggtgagcgagctgattgccgaagtggggcagagcaaacggctggctgacgctggcaccaaacccgaacactacagcgcgtgggcgcaagccgcgctggaggatatttgtctgcgcagtaacccacgcaccgccacacaggcacagattatcgacctgtacgcggctgccgggtaa

SEQ ID NO: 39768 - protein, 395 aa, Salmonella enterica subsp. enterica serovar Paratyphi A str. ATCC
MQAELQTALFQAFDTLNLQRVKTFSVPPVTLCGLGALGACGQEAQARGVSHLFVMVDSFLHQAGMTAPLARSLAMKGVAMTVWPCPPGEPCITDVCAAVAQLREAACDGVVAFGGGSVLDAAKAVALLVTNPDQTLSAMTERSTLRPRLPLIAVPTTAGTGSETTNVTVIIDAVSGRKQVLAHASLMPDVAILDAAVTEGVPPNVTAMTGIDALTHAIEAYSALNATPFTDSLAIGAIAMIGKSLPKAVGYGHDLAARENMLLASCMAGMAFSSAGLGLCHAMAHQPGAALHIPHGQANAMLLPTVMGFNRMVCRERFSQIGRALTNKKSDDRDAIAAVSELIAEVGQSKRLADAGTKPEHYSAWAQAALEDICLRSNPRTATQAQIIDLYAAAG

SEQ ID NO: 39769 - DNA, 2679 bp, Salmonella enterica subsp. enterica serovar Paratyphi A str. ATCC
  CDS (1)..(2679): transl_table=11
atggctgttactaatgtcgctgaacttaacgcactcgtagagcgtgtaaaaaaagcccagcgtgaatatgccagtttcactcaagaacaggtcgacaaaatcttccgcgccgccgctctggcagccgctgatgcccgcattccgctggccaaaatggccgtcgccgaatcaggtatgggtatcgtggaagacaaagtgattaaaaaccacttcgcttctgaatatatttacaatgcctataaagatgaaaaaacctgcggcgtgctgtcagaagacgacaccttcgggaccatcaccattgctgaacctatcggcattatttgcggtatcgttccaaccactaacccgacctctactgcgatcttcaaatcgctgattagcctgaagacccgtaacgccatcatcttttctccgcatccgcgcgctaaagaagcaactaacaaagcggcagacatcgttctgcaagcggctatcgctgccggcgcaccgaaagatctgattggctggatcgatcaaccttccgtagaactgtctaatgcgctgatgcaccacccggatattaacctgatcctcgccactggcggtccaggcatggttaaagctgcatacagctccggtaaaccggcaatcggcgtaggcgcaggtaacaccccggttgtcattgatgaaaccgctgatatcaaacgcgctgtggcgtctgttctgatgtctaaaaccttcgataacggcgtaatctgtgcttctgaacagtctgttgtcgttgttgattccgtctatgatgccgttcgcgaacgtttcgccagccacggcggctacatgctgcagggccaggagctgaaagcggttcaaaacgttattctgaaaaatggcgctctgaacgccgctatcgtcggtcagccagcctacaaaatcgctgaactggcaggcttctccgtaccagaaaccaccaagattctgatcggtgaagttacggtcgttgacgaaagcgaaccgttcgcacacgaaaaactgtctccgactctggcgatgtaccgtgcgaaagatttcgaagaagcggtagaaaaagcagaaaaactggtcgctatgggcggtatcggtcacacctcctgcctgtacactgaccaggataaccagccagaacgcgttgcttacttcggtcagatgatgaaaaccgcgcgtatcctgatcaacaccccggcctctcagggtggtatcggtgacctgtacaacttcaaactcgcaccttccctgacgttgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctctctgcccatcgcgctggatgaagtgattactgatggccacaaacgtgcgctcatcgtgactgaccgcttcctgttcaacaacggctatgcagaccagatcacctctgtgctgaaagcggctggcgttgaaaccgaagtcttcttcgaagttgaagcagacccgacgctttccgttgttcgcaaaggcgctgagctggctaactccttcaaaccggacgtgatcatcgcgctgggcggcggttccccgatggacgccgcgaaaatcatgtgggtcatgtacgaacatccggaaactcacttcgaagaactggcgctgcgctttatggacatccgtaaacgtatctacaagttcccgaaaatgggcgtgaaagcgaaaatgatcgccgtcaccaccacttccggtaccggttctgaagtcacaccgtttgcggttgtgaccgacgatgcaaccggtcagaaatatccgctggctgactatgccctgaccccggatatggcgattgtcgatgccaacctggtgatggatatgccgaagtccctgtgtgcgttcggtggtctggatgcggtaactcacgccctggaagcttacgtttccgtactggcttctgagttctctgacggtcaggctctgcaggctctgaaactgctgaaagaaaacctgccggcgtcttaccacgaagggtctaaaaacccggttgcgcgtgaacgtgttcacagtgcagcgactatcgccggtatcgcgtttgccaacgccttcctcggtgtatgtcactccatggcgcacaaactgggctctcagttccacattccgcacggtctggcgaacgccctgctgatttgtaacgttatccgctacaacgcgaatgacaacccgaccaagcagaccgctttcagccagtacgatcgtccgcaggcacgccgtcgttacgctgaaattgctgaccacctgggcctgagcgcgccgggcgaccgtaccgccgctaagattgaaaaactgctggcatggctggaaagcattaaagctgagctgggcattcctaagtctatccgtgaagcaggcgtgcaggaagctgacttcctggcacacgttgacaaactgtctgaagatgccttcgatgaccagtgcaccggcgctaacccgcgttatccgctgatctccgaactgaaacagattctgctggatacctactacggtcgtgatttcaccgaaggtgaagttgcagcgaagaaagacgtcgttgccgcaccgaaagcagagaaaaaagcgaaaaaatccgcttaa

SEQ ID NO: 39770 - protein, 892 aa, Salmonella enterica subsp. enterica serovar Paratyphi A str. ATCC
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKEATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFASHGGYMLQGQELKAVQNVILKNGALNAAIVGQPAYKIAELAGFSVPETTKILIGEVTVVDESEPFAHEKLSPTLAMYRAKDFEEAVEKAEKLVAMGGIGHTSCLYTDQDNQPERVAYFGQMMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSVVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHALEAYVSVLASEFSDGQALQALKLLKENLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLESIKAELGIPKSIREAGVQEADFLAHVDKLSEDAFDDQCTGANPRYPLISELKQILLDTYYGRDFTEGEVAAKKDVVAAPKAEKKAKKSA

SEQ ID NO: 39771 - DNA, 1149 bp, Salmonella enterica subsp. enterica serovar Paratyphi A str. ATCC
  CDS (1)..(1149): transl_table=11
atggcgaacagaatgattctgaatgaaacggcatggtttggccggggagcggtggacgcattaaccgatgaggtaacgcgccgcggttatcataaggcgctgattgttaccgataaaacgctggtgcaatgcggtgtggtcgataaagtgacaagcagaatggatgctgcagggctggcgtgggagatctatgctggcgtgatccctaatcctacgatttccgttgtccaggaagggcttaaggtttttacccaaagcggcgcggactatctcatcgccattggcggcggttctccgcaggatacctgtaaagcgatcggtattatcagtaacaatccggaatttgccgatgtgcgcagtctggaagggctatcgccgacccgtaaacccagcgtgccgattatggcgatcccgacaacggcgggaaccgcggcggaagtcactatcaattatgtgattaccgatgaagagaaacggcgcaaattcgtttgtgtcgatccgcatgatattccgcaggcggcatttatcgatgctgatatgatggacggtatgccgcccgcgctgaaagcggcaacgggcgtggatgcgctaacccatgctattgaaggctatattacccgggccgcatgggcgctgacggatgccttacatatcaaagccattgagattattgcgggtgcgctgcgcggtgccgtggcaggagaaaaagaggctggtgaggcgatggcgctggggcaatacgttgccgggatggggttttccaatgtggggctggggctggtgcatgggatggcgcatccgctgggcgcgttttacaacacgccgcacggcgtcgcgaatgctattttgcttccgcatgtgatgcgtttcaatgccgggtctaccaacgagaaattccgtgatatcgcccgggcgatgggggtgaaggtagaaggattgagtcttgaagaggcacgtaatgccgcagtggaagccgtatttgcgctaaatcgcgatgtgggaattccgctgcatttgcgtgatgtcggcgttcgaaaagaggatatcccggcgctggcgcaggcggcgttcgatgatgtctgtacgggcggcaatccgcgtgaagcgagtctggcggacattgtcgaactgtatcatatcgcctggtaa

SEQ ID NO: 39772 - protein, 382 aa, Salmonella enterica subsp. enterica serovar Paratyphi A str. ATCC
MANRMILNETAWFGRGAVDALTDEVTRRGYHKALIVTDKTLVQCGVVDKVTSRMDAAGLAWEIYAGVIPNPTISVVQEGLKVFTQSGADYLIAIGGGSPQDTCKAIGIISNNPEFADVRSLEGLSPTRKPSVPIMAIPTTAGTAAEVTINYVITDEEKRRKFVCVDPHDIPQAAFIDADMMDGMPPALKAATGVDALTHAIEGYITRAAWALTDALHIKAIEIIAGALRGAVAGEKEAGEAMALGQYVAGMGFSNVGLGLVHGMAHPLGAFYNTPHGVANAILLPHVMRFNAGSTNEKFRDIARAMGVKVEGLSLEEARNAAVEAVFALNRDVGIPLHLRDVGVRKEDIPALAQAAFDDVCTGGNPREASLADIVELYHIAW

SEQ ID NO: 39773 - DNA, 1149 bp, Salmonella enterica subsp. enterica serovar Paratyphi A str. ATCC
  CDS (1)..(1149): transl_table=11
atgagctttatgttggcactgccaaaaattagcctgcatggcgctggagcgattgccgatatggtgaacctcgtggcgaataagcaatggggcaaagcgctgatcgttaccgatggtcaactggtaaagctgggcctgctggatagcctgtttagcgcactggatgaacatcaaatgtcttaccacctgtttgatgaggtgttcccaaacccgacagaagagctggtgcagaaaggttttgcggcgtatcagagcgcagaatgtgactacattatcgccttcggcggcggcagcccgatcgataccgcaaaagcggtgaaaattctgaccgccaacccaggtccttctaccgcctactccggcgtcggcaaagtgaaaaacgccggcgtaccgctggtagcgattaatactacggcaggtaccgcggcagagatgaccagcaacgcggtgattatcgactctgcccgtaaggtcaaagaggtgatcatcgacccgaatatcatcccggatattgccgtggatgacgccagcgtcatgctggaaatccccgcttctgtgaccgccgcaaccggcatggatgccctgacccatgcggtggaagcctatgtctccgttggcgcgcatccgcttaccgacgctaacgcgctggaagcgattcgcttaatcaatttgtggctaccgaaagcggttgacgatggccataacctcgaagcccgtgagcaaatggcattcggccagtacctggcgggtatggcgttcaacagcgccggtttggggctggttcacgcgctggcgcaccagccgggcgcaactcacaacctgccgcacggagtctgcaacgctatcctgctgccaattgtcgagaactttaaccgtccgaacgccgtcgcgcgttttgcccgtatcgcacaggcgatgggcgtagagacgcgcggtatgtctgacgaagccgcaagtcaggaagcgattaacgctatccgtacgctgagcaaacgcgtcggcattccagaaggtttcagcaagctgggcgtcacaaaagaagatatcgaaggctggctggataaagccctcgccgacccgtgcgcgccgtgtaacccgcgcaccgccagccgcgatgaagttcgcgggctgtacctggaggcgttatga

SEQ ID NO: 39774 - protein, 382 aa, Salmonella enterica subsp. enterica serovar Paratyphi A str. ATCC
MSFMLALPKISLHGAGAIADMVNLVANKQWGKALIVTDGQLVKLGLLDSLFSALDEHQMSYHLFDEVFPNPTEELVQKGFAAYQSAECDYIIAFGGGSPIDTAKAVKILTANPGPSTAYSGVGKVKNAGVPLVAINTTAGTAAEMTSNAVIIDSARKVKEVIIDPNIIPDIAVDDASVMLEIPASVTAATGMDALTHAVEAYVSVGAHPLTDANALEAIRLINLWLPKAVDDGHNLEAREQMAFGQYLAGMAFNSAGLGLVHALAHQPGATHNLPHGVCNAILLPIVENFNRPNAVARFARIAQAMGVETRGMSDEAASQEAINAIRTLSKRVGIPEGFSKLGVTKEDIEGWLDKALADPCAPCNPRTASRDEVRGLYLEAL

SEQ ID NO: 39775 - DNA, 1149 bp, Idiomarina loihiensis L2TR
  CDS (1)..(1149): transl_table=11
atgagcagtactttttatattccagcggtcaatattattggcgagaacgcccttaaagatgcggccacgcaaatggacaactatggctttaaacaagccttgatagtcaccgaccccggcatgaccaaactgggcgttactgccgaaatcgaagccctgctcaaagagcatggaatagacagcctaatttacgatggcgtacaacccaacccgacagtaacgaacgtgaaagccgggttagatgttctgcagaaacatcaatgcgattgtgttatttcactaggtggaggttcagctcacgactgcgccaaaggtatagccctggttgccactaatggcgggcatattagtgactatgaaggcgttgatgtctcgaaaaagccacaactgccactcattagtattaataccaccgcaggcacagcgtccgaaatgacccgcttttgcatcattaccgatccggaacgccatattaaaatggcaattgtcgaccaaaatgtgacaccaattctgtcggttaacgacccaaggttaatggtcggtatgcctgccagcttgactgcagcaacaggcatggatgcgctgacccatgccgttgaagcctatgtatctaccgacgctacgccgattaccgatgcctgtgccataaaagccatagagattatccgggacaatctgcacgaagcggttcataacggagcgaatatggaagctcgtgagcaaatggcttacgcacagtttctggcgggtatggcgtttaacaatgcgtccctgggttatgtacatgccatggcgcaccaactcggcggattctacgacttgccgcacggcgtctgcaacgcggttttattgcctcatgtgcaacgctacaacagtcaggttgtcgcaccgcgcctgaaagacattggtaaagcactgggcgcagaagtacagggattaacagaaaaagaaggggctgacgctgctattgccgccattgtaaaactatctcaaagcgtcaatattccggctggtttggaagaattaggggcaaaagaagaggactttaatacattggcagacaatgccatgaaagacgcttgtggcctgactaatccaattcaacccagtcacgaagacattgttactatttttaaagcggctttttaa

SEQ ID NO: 39776 - protein, 382 aa, Idiomarina loihiensis L2TR
MSSTFYIPAVNIIGENALKDAATQMDNYGFKQALIVTDPGMTKLGVTAEIEALLKEHGIDSLIYDGVQPNPTVTNVKAGLDVLQKHQCDCVISLGGGSAHDCAKGIALVATNGGHISDYEGVDVSKKPQLPLISINTTAGTASEMTRFCIITDPERHIKMAIVDQNVTPILSVNDPRLMVGMPASLTAATGMDALTHAVEAYVSTDATPITDACAIKAIEIIRDNLHEAVHNGANMEAREQMAYAQFLAGMAFNNASLGYVHAMAHQLGGFYDLPHGVCNAVLLPHVQRYNSQVVAPRLKDIGKALGAEVQGLTEKEGADAAIAAIVKLSQSVNIPAGLEELGAKEEDFNTLADNAMKDACGLTNPIQPSHEDIVTIFKAAF

SEQ ID NO: 39777 - DNA, 1047 bp, Idiomarina loihiensis L2TR
  CDS (1)..(1047): transl_table=11
gtgacggataaaggcgtacttgatgccgggctaatccaacctattgttgccgaacttaaaagtcagggcattacgggtattgttatttactctgagatatcagcggagccagaaacccatgtcgttgaatcgtgccgtgacgttttcattaatgaaagctgtgatgggattattggaattggtggcggcagtgcaatggataccgcaaaagccgttgcggtatatcaaagtgagaagagagctttgaacgaactgtttggcgagaacaattgtgcgcggcgaaccgtgcctttaatttgtttaccgaccaccgcaggaacaggctccgaagtcactaatatatccatcctgtcagacgtagaggcacaactgaaaaaggggattgtcagcgatgaactgctgccggatgtggcgattgttgcaccggaattgacgcagagttgcccgccatctgtaacggcagcaagtggcattgatgcattggtgcacgccgtagaaagttatatttctaattttgcttcagatatcacccgggcgttatcagtaggcgccataaaaatgatcgtcaacgccttgcccgatgcttatcgacgtcctgacgatctcgacgcaagagagcgtatggctaccggtagcttaatggctgggttggcattcggaaatgcaggagttggtgcagtacatgccttggcttatcccctgggcgggcgttatcacttgtcgcatggggttagtaatgcactgatgttcactcacgtcatgcgctggaatctatcatcctgcccaaatgattttctcaatatcgcgctggcgatgggggccgaggcaacgattagcgaagccgacgcaggagacttcgttattgagaaacttgaatccctctgccgggctgtcgaaattccgggcggattaagagagtttggtattgaacgcagtgatctgcgttcaatagctgaagcggcgagtggtgtgactcgtttattgagaaataatcctcgtgaacttagcgtcgatgatatcgaagcaatttatcaggccgcttactaa

SEQ ID NO: 39778 - protein, 348 aa, Idiomarina loihiensis L2TR
MTDKGVLDAGLIQPIVAELKSQGITGIVIYSEISAEPETHVVESCRDVFINESCDGIIGIGGGSAMDTAKAVAVYQSEKRALNELFGENNCARRTVPLICLPTTAGTGSEVTNISILSDVEAQLKKGIVSDELLPDVAIVAPELTQSCPPSVTAASGIDALVHAVESYISNFASDITRALSVGAIKMIVNALPDAYRRPDDLDARERMATGSLMAGLAFGNAGVGAVHALAYPLGGRYHLSHGVSNALMFTHVMRWNLSSCPNDFLNIALAMGAEATISEADAGDFVIEKLESLCRAVEIPGGLREFGIERSDLRSIAEAASGVTRLLRNNPRELSVDDIEAIYQAAY

SEQ ID NO: 39779 - DNA, 1152 bp, Azoarcus sp. EbN1
  CDS (1)..(1152): transl_table=11
atgagcacgacgactttcttcatccccccggtcaacctgatgggcgccggctgcctcgccgacgcgatggccgcgatccgcagttacggctttcgccacgcgctgatcgtcaccgacgccggcctcgcccgtgccggggtcgccgacaaggtcgcggccctcctcgccgagcaggacatccaggcgacggtgttcgacggcgcgaagccgaatccgaccgtcggcaacgtcgaggccggcctcgcgctgctgcgcgacaagcagtgcgactgcgtgatctcgctcggcggcggctcgccgcacgactgcgcgaaaggcatcgcgctcgtcgccaccaacggcgggcggatcggcgactacgaaggggtcgaccgctcggccaagccgcagctgccgctcgtcgcgatcaacacgaccgccggcaccgcgagcgagatgacgcgcttttgcatcatcaccgacgaagcgcgccacatcaaaatggcgatcgtcgaccgcaacgtcacgccgatcctgtcggtcaacgacccgacgctgatggtcgcgaagcccgccgcgctgactgccgcgaccggtatggacgcgctgacgcacgcggtcgaagcctacgtgtcgaccgcggcgacgccaatcaccgacgcgtgcgcactgaaggcggtaacgctgatcgcggcgaacctgcgccgcgcggtcgccgacggcaacgacctcgacgcgcgcgagcagatggcctatgcgcagttcctcgccggcatggcgttcaacaacgcatcgctcggctatgtgcacgcgatggcacatcagctcggcgggttctatgacctgccgcacggcgtgtgcaacgcggtgctgctgccgcacgtcgaggcgttcaacgcgagcttttcggccacgcgccttgcagacgtcgcgcgcgcgatgggcgccgacgtcgatgcgctcgacgacgccgcggcggcagaaggttgtcttgccgcgatccgccgactcgctgccgatgtcggcatcccggccgggctgacgcagctcggcgtcaaagcggaagacatcccgacgctcgccgcaaacgcgctgaatgatgcctgcggcctgacgaacccgcgcccggccacgcaggccgacatcgaggcgatcttccgcggcgcgctgtaa

SEQ ID NO: 39780 - protein, 383 aa, Azoarcus sp. EbN1
MSTTTFFIPPVNLMGAGCLADAMAAIRSYGFRHALIVTDAGLARAGVADKVAALLAEQDIQATVFDGAKPNPTVGNVEAGLALLRDKQCDCVISLGGGSPHDCAKGIALVATNGGRIGDYEGVDRSAKPQLPLVAINTTAGTASEMTRFCIITDEARHIKMAIVDRNVTPILSVNDPTLMVAKPAALTAATGMDALTHAVEAYVSTAATPITDACALKAVTLIAANLRRAVADGNDLDAREQMAYAQFLAGMAFNNASLGYVHAMAHQLGGFYDLPHGVCNAVLLPHVEAFNASFSATRLADVARAMGADVDALDDAAAAEGCLAAIRRLAADVGIPAGLTQLGVKAEDIPTLAANALNDACGLTNPRPATQADIEAIFRGAL

SEQ ID NO: 39781 - DNA, 1146 bp, Silicibacter pomeroyi DSS-3
  CDS (1)..(1146): transl_table=11
atgaaacttgttggcaactggtcctatcccaccgccatccgctttggcgcggggcggatcgccgaaatcgccgaggcctgcaaggccgccggtatctccaaaccgctgctggtcaccgacaaggggctggccgcgatggaaatcaccacccgcacgctcgacctgatggaggccgcgggcctgggccgggcgatgttttccgaggttgatcccaacccgaccgagcgcaatgtcgaggccgggttgaaggtctatcgcgagggcggctatgacggggtgatcgcctttggcggcggctcggggctcgatctgggcaagacgctggccttcatggcaggccagacccgcccgctctgggatttcgaggatatcggcgactggtggacccgcgccgacccggcaggcattcacccgatcgtcgccgtgcccaccaccgccgggaccggatcggaagtgggccgcgcgggcgtgatcaccaattccgacagccatgagaaaaagatcatcttccacccgctgatgctgcccaaggtggtgatctgcgacccggaactgaccgtgggcatgccgaaattcatcaccgccggtaccgggcttgatgcctttgcccattgcgtcgaggcctattgctcgccccattaccacccgatgagccagggcatcgcgctggaaggcatgcgactggtcaaggaatacctgccccgcgcctatgccgatgggtccgaccttgaggcgcgcgcgcatatgatgtcggccgccgccatgggcgccaccgcgttccagaaagggctgggcgccatccatgcgctgtcgcaccccatcggcgcacatcaccacacccaccacggcaccaccaacgcggtctgcatgcccgccgtgctgcaattcaaccgccccgctgtcgagggcgtgctggcacaggccgccgcctatctgggcatcgcgggcgggttcgacgggttcgcggcctatgtcgacgagttgaatacctcgctcggcatcccgaaaaccctgacagacctgggcgtcaaggatcccaacctcgacgtgctggtgcgcgacgcgctgaacgatccctcgaccggcggcaacccggtaacgatgacggcagagaacacccgcccgctgctggaatcgctgttctga

SEQ ID NO: 39782 - protein, 381 aa, Silicibacter pomeroyi DSS-3
MKLVGNWSYPTAIRFGAGRIAEIAEACKAAGISKPLLVTDKGLAAMEITTRTLDLMEAAGLGRAMFSEVDPNPTERNVEAGLKVYREGGYDGVIAFGGGSGLDLGKTLAFMAGQTRPLWDFEDIGDWWTRADPAGIHPIVAVPTTAGTGSEVGRAGVITNSDSHEKKIIFHPLMLPKVVICDPELTVGMPKFITAGTGLDAFAHCVEAYCSPHYHPMSQGIALEGMRLVKEYLPRAYADGSDLEARAHMMSAAAMGATAFQKGLGAIHALSHPIGAHHHTHHGTTNAVCMPAVLQFNRPAVEGVLAQAAAYLGIAGGFDGFAAYVDELNTSLGIPKTLTDLGVKDPNLDVLVRDALNDPSTGGNPVTMTAENTRPLLESLF

SEQ ID NO: 39783 - DNA, 1233 bp, Bacillus clausii KSM-K16
  CDS (1)..(1233): transl_table=11
ttgaaaaataacaagcaggaatttaagaacggcatctataaatttataagaatcaacttccataagaacttccataaggagattgggatgaatatcaataaattcgtaacaccagagattatttttgggagtgacgcgataaggcaagcgggggatgcttgcgtgcggcttggggcgagaaaagtattaattgttagtgataatggtgtagctaatgccggctggctagaaaaagtaatggatctttgcaaagagtctcatttgccctttgccacgtttatcgacgtgacgatagacccgaaagatcgcgaagttgagcaagggtgccgagtgtttgttcaacatgagtgtgacgcgattattgggattggtggaggaagtgtgttagatgtagcgaaagcgattgccatactcgcaacgaacggaggggcgattagtgattatgaagggattgataaaattaaaaaaccccttcccccgatgattatgattatgacaacggcaggatctggctctgaggtgtcgcagttttccatcattgtggattcgactcgaaaaaagaaaatgacgatcatatcgaaaacattggtgcctgatatcgccattattgacccttttacactcgtcacgaaagacagcagcctcactgctacaacggggatggatgtattgacgcatgcggttgaagcctatgtcagtgtggccgctactccgcttacagatgtccaagcgaaaaatgccctcaccttgtgtgctcaatatttgcgcccctctgttgcctcgaaaacaaataaagaagcgaaggaagcgatggcaatggctagtttacaggcagggcttgctttctcaaatgcaatcctaggggcagcacatgcgatctcacatgcaataggagggaagtttcctttgccgcatggagagatcaatgcgattcttttgccctatgtgatggattttaattttatcgcagcacctaaacgattttcagacatagcgacatgcttagggatcgatacaagaggattgaccgatcgtgaagcaggcaatgctgcgatccaatccgttaaagaactatcctctgatattgggattccaaccaagtttaaacaagtcggattaacagaaatgattgatcatataagccaagtggcgttagaagatgcgtgtatgattacgaatccccgtgacatggatattgagcaagtgaaacaagtattaaatcatgttttatag

SEQ ID NO: 39784 - protein, 410 aa, Bacillus clausii KSM-K16
MKNNKQEFKNGIYKFIRINFHKNFHKEIGMNINKFVTPEIIFGSDAIRQAGDACVRLGARKVLIVSDNGVANAGWLEKVMDLCKESHLPFATFIDVTIDPKDREVEQGCRVFVQHECDAIIGIGGGSVLDVAKAIAILATNGGAISDYEGIDKIKKPLPPMIMIMTTAGSGSEVSQFSIIVDSTRKKKMTIISKTLVPDIAIIDPFTLVTKDSSLTATTGMDVLTHAVEAYVSVAATPLTDVQAKNALTLCAQYLRPSVASKTNKEAKEAMAMASLQAGLAFSNAILGAAHAISHAIGGKFPLPHGEINAILLPYVMDFNFIAAPKRFSDIATCLGIDTRGLTDREAGNAAIQSVKELSSDIGIPTKFKQVGLTEMIDHISQVALEDACMITNPRDMDIEQVKQVLNHVL

SEQ ID NO: 39785 - DNA, 1170 bp, Bacillus clausii KSM-K16
  CDS (1)..(1170): transl_table=11
atgaatacacattaccaatttcaaacagcagataaactcattgctggtattggggtgtttaccgaattagtcagtcacttgcaaaaggcagtcccatctgtcgagcgagtccttattgtaacgcaaccttttgtaaagaagctggatttttatcaagtgatgacctcttcccttgaaaaggccggtctttcatacgaggttgttaccgacgtagaacctgaaccgacagaagccaatattgaaaacattaaagagcgtgttcgcgattcgtcatacgacgtgttgattggcttaggaggcggaagtgttcttgactcgaccaaattactgtctgtattgttgtcaaacacatgtacgatccaagacatcttgggaacggatcttgtaaaagagccaggcattccgactgtgctcatcccaaccacgtctggcactgggtcagaagtgacgccaaatgcgattgtgacctttccagacaaagagctgaagattggcatcgtcagtcgccatttgttgcctgtgctcgttgtacttgacccactattaacggtgtcccttcctaaaccaattacagccgccactgggatggacgcattcacccactcgttggagtcgtttatttccaataaagccaatcgatttagcgacatgtttgcgcttgaatcaatcaggctcatcgccgatgggattcagacagcctatcacgatggcagcaatgtggaagcacgtgaaaaaatgctgattggctcgacgtacggcggaatggcattgactgccgctggtacggcagctgtgcatgccatggcttatccccttggaggaaagtttaaggtgacacatggcgtcgccaattcaatgctgctcccacatgtcatggcgtacaacatggacgcgattgtcgaccgcctcgcccaagtagctgacccaatgggcattcaactgaatcagggagcgactagccaacaaaaagcaaaagcagttgttcaaaagataaaagaatggacagccgaattttcgatcccacaagatttaaccgaatttggcgtgagagaagatgatttggaggatctggccatagccgctgtacaggtgaaacgcctgatggacaataatccaaaagaaatgactgtcaacgatgcgattcaaatttacaaaaagctacttgcttaa

SEQ ID NO: 39786 - protein, 389 aa, Bacillus clausii KSM-K16
MNTHYQFQTADKLIAGIGVFTELVSHLQKAVPSVERVLIVTQPFVKKLDFYQVMTSSLEKAGLSYEVVTDVEPEPTEANIENIKERVRDSSYDVLIGLGGGSVLDSTKLLSVLLSNTCTIQDILGTDLVKEPGIPTVLIPTTSGTGSEVTPNAIVTFPDKELKIGIVSRHLLPVLVVLDPLLTVSLPKPITAATGMDAFTHSLESFISNKANRFSDMFALESIRLIADGIQTAYHDGSNVEAREKMLIGSTYGGMALTAAGTAAVHAMAYPLGGKFKVTHGVANSMLLPHVMAYNMDAIVDRLAQVADPMGIQLNQGATSQQKAKAVVQKIKEWTAEFSIPQDLTEFGVREDDLEDLAIAAVQVKRLMDNNPKEMTVNDAIQIYKKLLA

SEQ ID NO: 39787 - DNA, 1185 bp, Bacillus clausii KSM-K16
  CDS (1)..(1185): transl_table=11
atgcaagcaacaacctgtcatttgccagccacgattatttatggggaaaacagttttttgcaagttggagttgaagctgcgaagcttggaagcaaggcgctgatcattagcgatgcagtaatggaaaggctcggaaatgttgaacgggctcaagcattgcttaagaaaagcggaatcccatcgtattcctatttaggtgtagcaactgagccgacagatacgtacgtgtatgaagcgttggagttgtttcgtacaaaaggttgcaatgtcattgtttccattggaggaggaagctgtatagatacagctaaagctgtcgcggtgctagcagccaatggcggatcaatcgatgaatacatgaacgggcgtacgattgcgcgaaaaggggcggttcctttaattgctttgccgacaacagggggcactggttctgaagcaacagacgcgacagtgattacgaacacagacaccaatgtcaaaatgatgattaaacagcaagcctttatgccacggacggctattgttgatccagtgctgacaaaatcgacgcctaaacacattactgcggctactggaattgatgcgcttacccatgcgttggaggcttatattagcaaaaaagcacatccgtttaccgatggattggcgctatcggcaatggagcggattttccactatctattgaccgcctataaagacggcaacgatatgaaggcaaggcatgaaatgttgtatggctcgctgcttgcaggcatggctttctccaattcatccgtttgtcttgtccatgggatgtcaaggccaattggcgctctcttccatgtaccacacggtgtttccaacgctatgcttttaccggttgtgcttgaatatacaaaggaaagttgcaaggagcgccttgcttcaatcggccgtgtcctctttccaggaaaaagcggcgaagggactgaaacattagctaatgccgttgtcgaagaaatcgtagcgctgtgcgcgaaagtcgatattcctacattgccagactggggcgttcaagaagaggcatttatgccaatgctttctaaaatggctgacgatgcgcttgaaagcggaagtccgcaaaacaacccgcgtgtcccgtcaaaacgagagttgattgagctgtatgaggccctctttcaacaaaaaccggccgttttccattaa

SEQ ID NO: 39788 - protein, 394 aa, Bacillus clausii KSM-K16
MQATTCHLPATIIYGENSFLQVGVEAAKLGSKALIISDAVMERLGNVERAQALLKKSGIPSYSYLGVATEPTDTYVYEALELFRTKGCNVIVSIGGGSCIDTAKAVAVLAANGGSIDEYMNGRTIARKGAVPLIALPTTGGTGSEATDATVITNTDTNVKMMIKQQAFMPRTAIVDPVLTKSTPKHITAATGIDALTHALEAYISKKAHPFTDGLALSAMERIFHYLLTAYKDGNDMKARHEMLYGSLLAGMAFSNSSVCLVHGMSRPIGALFHVPHGVSNAMLLPVVLEYTKESCKERLASIGRVLFPGKSGEGTETLANAVVEEIVALCAKVDIPTLPDWGVQEEAFMPMLSKMADDALESGSPQNNPRVPSKRELIELYEALFQQKPAVFH

SEQ ID NO: 39789 - DNA, 1161 bp, Bacillus clausii KSM-K16
  CDS (1)..(1161): transl_table=11
atggtgcacatttttaaaagcgcttacaaaattatgacaggcgtaggagcgatttcccatttaggtagtgaaatagcaaggttaaaaatgaaccacccccttgtcgtaactgataaaatgattaagaaggccgggctgcttgaggaagtaacagtggcacttgctgggcgtagctatggcatatttttagaagtggagccagaaccagcattttcagttgtggaagcgtgcaaacaaacatttgtcgctgggggccatgatggcgtgattgccataggaggcggcagtgcccttgatacagcgaaagcgacggcggcttacgttcgttataacggtgcacttgctgatttgattggcactgatttagttcctacaaaaggggtcccactcattgccattccgaccacagcgggaacaggctccgaggtaacgaatattgcaattctgtccgacaatgacgctaagctaaaaaaagggatggttagtgaccatttgcttcctgatgtggcaatcgtttctccagaattatcgaggacaacccctcctgctgttacagctgcgagcggcatagacgcccttgtccatggaattgaagcgtacttatctgtaaatgcatcgccccttacagatgctttcgctcttcaggcaattgaaaaaattgcccggaatttaccggaagcatacgcaaagccaacaaacctcgcagcacgggaagaaatggccgttgccagcttaatggctggcatggcattcggcaacgccggagttggcgctgtccatgccctcgcttatcctcttgggggaaggtttaacatggcccatggtgtcagtaacgccgtgctgttgccctatgtaatgagggagaacaaagttgcctgcgtcgaccggcttgctgttatcgcagaagtgttaggcgtaaaggagatagggatgggagcgagtgaaggggctgaccaggcgataagcgccatggagcgtctttgtgatcaagtccatattccaagcaaccttagagagtttggcataagacgtgcagaccttacggctatggcagaagatgcaagcaaaatcgatcggctcttaaagaacaacccccgtccgcttgagcgtgataccattttgtcgatttatgaacgagcatgggcagggcggtcagtgtag

SEQ ID NO: 39790 - protein, 386 aa, Bacillus clausii KSM-K16
MVHIFKSAYKIMTGVGAISHLGSEIARLKMNHPLVVTDKMIKKAGLLEEVTVALAGRSYGIFLEVEPEPAFSVVEACKQTFVAGGHDGVIAIGGGSALDTAKATAAYVRYNGALADLIGTDLVPTKGVPLIAIPTTAGTGSEVTNIAILSDNDAKLKKGMVSDHLLPDVAIVSPELSRTTPPAVTAASGIDALVHGIEAYLSVNASPLTDAFALQAIEKIARNLPEAYAKPTNLAAREEMAVASLMAGMAFGNAGVGAVHALAYPLGGRFNMAHGVSNAVLLPYVMRENKVACVDRLAVIAEVLGVKEIGMGASEGADQAISAMERLCDQVHIPSNLREFGIRRADLTAMAEDASKIDRLLKNNPRPLERDTILSIYERAWAGRSV

SEQ ID NO: 39791 - DNA, 1209 bp, Bacillus clausii KSM-K16
  CDS (1)..(1209): transl_table=11
atgagcatgcatatgaaaattgaatcgatgttaaactaccatacttttgaagtgccgaccgctattaagcatggcattggcgctatctcccaccttggcgaagaagtccgcgcccttggttccaaaaaaatattgcttgtgacggaccctggcatttacaacgcaggcattacaagaccagtcgaacaaagcctcgagaaagcgggcattgacgtcgtccttttcaacgaagttgagcccaatccaccaacacgattaatcgccaaaggttccagcgtttatgcggaacatcgctgcgacggcttagtggctgtcggcggcggctcttctatggatacagctaaagcaattggcgtggaagtgacacacgaaggcacagtccttgattacgaagcagcagagggcaagaagccgcttaaacggcgaattccaccattggcaactgttccaaccactgccggaacaggttcggaagtgacgcaatgggcagtcattacggatgaacaacggaaatacaaattcaatacaggcggccctcttattgctgcacacgtaaccattattgatccacaattgcatacttcaatgcctcctcatgtcacagcgatgacaggcattgatgccatagcccatgccattgagtgctacacgatgaaatatgcacaaccggttacagatgctgtcgccttgttggcaattgaatatgcagccacctacatacgccgcgcttttgcagacggggatgacctagaagcacgctatgggatggcgcaagctgcaatgttggcggggctttcctatggaagcgaatcggctggggccgcccacgcaatgagccagtcccttggcggcatcgtccctgtagctcatggacaatgtgtggcagcgatgatgggaccggtcatggaattcaactggaaaggagcgcctgaacgttttgcccgcattgcccaagcattcggcctaaacacaacggctatgacaaccaatgaggcggccaaggcagcagtccgctatatgtatgagttagttgaagagctggaaatcccatcgcttgaagaccaaggtgttgacaaaacacaaattagccgttgggccgaagaagcgttgaaagatccacaaaccatcggaaatcctcgtgacttgacgcttgctgattatgaatggatttacaaacgctgctttaacctcgtaccaagcaccctttaa

SEQ ID NO: 39792 - protein, 402 aa, Bacillus clausii KSM-K16
MSMHMKIESMLNYHTFEVPTAIKHGIGAISHLGEEVRALGSKKILLVTDPGIYNAGITRPVEQSLEKAGIDVVLFNEVEPNPPTRLIAKGSSVYAEHRCDGLVAVGGGSSMDTAKAIGVEVTHEGTVLDYEAAEGKKPLKRRIPPLATVPTTAGTGSEVTQWAVITDEQRKYKFNTGGPLIAAHVTIIDPQLHTSMPPHVTAMTGIDAIAHAIECYTMKYAQPVTDAVALLAIEYAATYIRRAFADGDDLEARYGMAQAAMLAGLSYGSESAGAAHAMSQSLGGIVPVAHGQCVAAMMGPVMEFNWKGAPERFARIAQAFGLNTTAMTTNEAAKAAVRYMYELVEELEIPSLEDQGVDKTQISRWAEEALKDPQTIGNPRDLTLADYEWIYKRCFNLVPSTL

SEQ ID NO: 39793 - DNA, 1137 bp, Thermococcus kodakarensis KOD1
  CDS (1)..(1137): transl_table=11
gtgttctggctcaagacgaggataagtgagggggaggactcactagagagcctcaaggacgaggccaaggatcacgaacgggttctcatactggcatctggttctatgaagaggcacggctttctaagcgaggccgaggactacgttagggaagccggagcagaggttatgagtatatcaggacttccggcggagccgagcgttgaggtcattgaggagttcctgccgaaggttagggagtttgggcccgatctcctcatagccatgggcggcggcagcgttatcgacacgaccaaagccctcaaggtcttctacgatgcccccgagctcgtctttgaggagatagccttcatcaaccgtttctcaaggccgaagcccgttccaaaactaaaaactcccctcatcgcgattccctcaacgagcggagctggaagcgaggtttccgcggccagtgtcctgaagaagaacgggataaagtacaacatcgtaacgccggagatagcacctgaggtagctattctcgacccgaggctcccgaggactatgccaagggaagttgcgaggaattctggcctggatgtcctcgtccacggtatagaggcttacacaactaaggtcgctgggcccttcagcgatgcgatggcgataagggcgataaagaccgtcttcgagtggcttccgaagtcggttgaaggtgaccccgaggcgagggcaagaatgcactacgcggcaacgatggcagggatagcctttctcaatgccaggcttggtttggcccacgcgatgagccacaaggcggcatgggtaggtccccatggcttactcaacgcgatattcataccctacgtgatggagttcaacgccgagaggagtgagtatgcgaggaagcgctatgctgagatagcgcgcgaacttgggttgaagagtgctgaagagctgataaaagccgtcagagagctcaacgagcgccttggagttccaaagctaagcgagcttgttgatgaagagacttttgttgaaagggttgaggagatggctgaaaaggcctaccgcgacgggctgatagcgttcaaccccgttgaaccaaagccagaggagataagagagctttatctgaaggctttgaacgcgttatag

SEQ ID NO: 39794 - protein, 378 aa, Thermococcus kodakarensis KOD1
MFWLKTRISEGEDSLESLKDEAKDHERVLILASGSMKRHGFLSEAEDYVREAGAEVMSISGLPAEPSVEVIEEFLPKVREFGPDLLIAMGGGSVIDTTKALKVFYDAPELVFEEIAFINRFSRPKPVPKLKTPLIAIPSTSGAGSEVSAASVLKKNGIKYNIVTPEIAPEVAILDPRLPRTMPREVARNSGLDVLVHGIEAYTTKVAGPFSDAMAIRAIKTVFEWLPKSVEGDPEARARMHYAATMAGIAFLNARLGLAHAMSHKAAWVGPHGLLNAIFIPYVMEFNAERSEYARKRYAEIARELGLKSAEELIKAVRELNERLGVPKLSELVDEETFVERVEEMAEKAYRDGLIAFNPVEPKPEEIRELYLKALNAL

SEQ ID NO: 39795 - DNA, 2610 bp, Staphylococcus aureus subsp. aureus COL
  CDS (1)..(2610): transl_table=11
atgttaactatacctgaaaaagaaaatcgtggatcgaaagaacaagaagtggcaattatgattgatgctctagctgacaaagggaaaaaagcattagaagcattatctaaaaagtcacaagaagaaattgatcatattgttcatcaaatgagcttagcagctgttgatcaacatatggtgctagcaaaattagcacatgaagaaactggaagaggtatatacgaagataaagcgattaaaaatttatacgcttctgaatatatatggaattcaataaaagacaataagacagtagggattattggtgaagataaagaaaaaggattaacgtatgtagcggaaccaattggtgttatttgtggtgttacgccaacaacaaatcctacgtcgacaactatttttaaagcgatgattgcaattaagacaggaaatccaatcatttttgcattccatccaagtgcacaagaatcgtcgaagcgtgcagcagaagttgtattagaagcggcaatgaaggcaggtgcacctaaagatattattcagtggattgaagtgccttctatcgaagcaacaaaacaattaatgaatcacaaaggtattgcattagttctagcaacaggtggttcgggcatggttaagtctgcatattcaactggcaaaccggcattaggtgtgggaccaggtaacgtgccgtcttacattgaaaaaacagcacacattaaacgtgcagtaaatgatatcattggttcaaaaacatttgataatggtatgatttgtgcttctgaacaagttgtagtcattgataaagaaatttataaagatgttactaatgaatttaaagcacatcaagcatactttgttaaaaaagatgaattacaacgcttagaaaatgcaattatgaatgaacaaaaaacaggtattaagcctgatattgtcggtaaatctgcagttgaaatagctgaattagcaggtatacctgtccccgaaaatacaaaacttatcatagccgaaattagcggtgtaggttcagactatccgttatctcgtgaaaaattatctccagtattagccttagtaaaagcccaatctacaaaacaagcatttcaaatttgtgaagacacactacattttggtggattaggacacacagccgttatccatacagaagatgaaacattacaaaaagattttggactaagaatgaaagcttgtcgtgtacttgtaaatacaccatcagcggttggaggtattggtgatatgtataacgaattgattccgtctttaacattaggttgtggttcctacggtagaaactcaatttcacataatgttagtgcgacagatttattaaacattaaaacgattgctaaacgacgtaataatactcaaattttcaaggtgcctgctcaaatttattttgaagaaaatgcaatcatgagtctaacaacaatggacaagattgaaaaagtgatgattgtctgtgaccctggtatggtagaattcggttatacaaaaacagttgagaatgtattaagacaaaaaacggaacagcctcaaattaaaatatttagcgaagtcgaaccgaacccatcaactaatacagtatataaaggtctggaaatgatggttgatttccaaccggatacaatcattgcacttggtggtggttcagcgatggatgctgcaaaagcaatgtggatgttctttgaacaccctgagacatcattcttcggtgctaaacaaaagttcctagacatcggtaaacgtacttataaaataggcatgcctgaaaatgcgacgttcatttgtatccctacgacatcaggtacaggttcagaagtaacaccatttgcagttatcacagatagtgaaacaaatgtaaaatatccgttggctgattttgctttaacacctgacgttgcaattattgaccctcaatttgtgatgagtgtgccaaaaagcgttacagcagatacaggaatggatgtactaacgcatgcaatggaatcatatgtatctgtaatggcttcagactacacaagaggtttgagtctacaagcgattaaattgacgttcgaatatttaaaatcatctgttgaaaagggtgataaagtttcaagagagaaaatgcataacgcatcaactttggctggtatggcatttgcaaatgcattcttaggcattgcacactcaattgcgcataaaattggtggcgaatatggtattccgcatggtagagcgaatgcgatattactaccgcatattatccgttataatgccaaagacccgcaaaaacatgcattattccctaaatatgagttcttcagagcagatacagattatgcagatattgccaaattcttaggattaaaaggtaatacgacagaagcactcgtagaatcattagctaaagctgtctacgaattaggtcaatcagtcggaattgaaatgaatttgaaatcacaaggtgtgtctgaagaagaattaaatgagtcaattgatagaatggcagagctcgcatttgaagatcaatgtacaactgctaatcctaaagaagcactaatcagtgaaatcaaagatatcattcaaacatcatatgattataagcaataa

SEQ ID NO: 39796 - protein, 869 aa, Staphylococcus aureus subsp. aureus COL
MLTIPEKENRGSKEQEVAIMIDALADKGKKALEALSKKSQEEIDHIVHQMSLAAVDQHMVLAKLAHEETGRGIYEDKAIKNLYASEYIWNSIKDNKTVGIIGEDKEKGLTYVAEPIGVICGVTPTTNPTSTTIFKAMIAIKTGNPIIFAFHPSAQESSKRAAEVVLEAAMKAGAPKDIIQWIEVPSIEATKQLMNHKGIALVLATGGSGMVKSAYSTGKPALGVGPGNVPSYIEKTAHIKRAVNDIIGSKTFDNGMICASEQVVVIDKEIYKDVTNEFKAHQAYFVKKDELQRLENAIMNEQKTGIKPDIVGKSAVEIAELAGIPVPENTKLIIAEISGVGSDYPLSREKLSPVLALVKAQSTKQAFQICEDTLHFGGLGHTAVIHTEDETLQKDFGLRMKACRVLVNTPSAVGGIGDMYNELIPSLTLGCGSYGRNSISHNVSATDLLNIKTIAKRRNNTQIFKVPAQIYFEENAIMSLTTMDKIEKVMIVCDPGMVEFGYTKTVENVLRQKTEQPQIKIFSEVEPNPSTNTVYKGLEMMVDFQPDTIIALGGGSAMDAAKAMWMFFEHPETSFFGAKQKFLDIGKRTYKIGMPENATFICIPTTSGTGSEVTPFAVITDSETNVKYPLADFALTPDVAIIDPQFVMSVPKSVTADTGMDVLTHAMESYVSVMASDYTRGLSLQAIKLTFEYLKSSVEKGDKVSREKMHNASTLAGMAFANAFLGIAHSIAHKIGGEYGIPHGRANAILLPHIIRYNAKDPQKHALFPKYEFFRADTDYADIAKFLGLKGNTTEALVESLAKAVYELGQSVGIEMNLKSQGVSEEELNESIDRMAELAFEDQCTTANPKEALISEIKDIIQTSYDYKQ

SEQ ID NO: 39797 - DNA, 2610 bp, Staphylococcus epidermidis RP62A
  CDS (1)..(2610): transl_table=11
atgttatctgtaactaaaaaaaatacatatgaatcaaacaaagatgaagtcacacaaatgattgattcattagcagaaaaaggacaagaagctctaaaagaactatctaaaaaatcacaacatgagattaatgacattgtacatcagatgagcatggctgctgttgatcagcatatgcatttagctaaactagcttacgacgaaacaggtagaggtatttatgaagacaaagctatcaaaaatttatatgcctcagagtacatatggaattcaatcaaagacaataaaacagtaggtatcataggtgaagataaacaaaaaggattaacgtatgtagctgaacctataggcgtgatttgtggagtgacaccaacgaccaaccctacatctacaactattttcaaagcaatgattgctattaaaacaggtaatccaattattttcgcatttcatccaagtgcacaacaatcatcaaaatatgctgctaaagtcattttagaagctgcaacaaaagcaggtgctcctaaagattgtattcaatggatagaagtgccatcaattgaggcaactaaacaattaatgaatcataaagatattgctttagttctagcgactggaggctctggaatggtaaagtccgcatattcgacaggtaaacctgcattaggagtcggtccaggtaatgttcctacttatattgaaaaaactgctcatatcaaacgtgctgttaatgatatcattggttctaaaacttttgataatggtatgatttgtgcttctgaacaagtcatggttgttgataaagaagtatacactgacgtcgttaaagaattcaaattacaccaaacatattttgttaataaaaatgaactacaacaattagaagatgccatcatgaatgaagataaaactgcagttaaacctgatatagttggtaaatctgctgtagatatagcgaaattgtcaggaattagtgttccagaaaaaacaaaattattagtcgcagaaattgatggaattggaaaagattatcctttatcacgtgaaaaattatcacctgtactcgcaatggtaactgcaaaatcaacaggacatgcactacaaatttgtgaagacatattaaaatttggtggtttaggtcacactgctgtaattcacaccgaggatagtcaattacaacaaaaattcggtctaaaaatgaaagcttgccgtgtattggtaaatacaccttctgctgtcggaggaattggaaatatgtataatgaactcattccttcactcacgttaggttgtggttcatatggtagaaattctatttctcataatgtaagcgcagtagacttattaaatattaaaacaatagcaaaacgtcgtaataatatgcaatggtttaaactcccacctaaagtttattttgaagaaaattcagttatgtatttgacagagatggataatgttgaacgtgtaatgatagtttgtgatccaggaatggttaatattggttatactgatatagttgaacaagtgctgagacgccgagaaaaccaaccacaaatcaaagtgtttaacgaagttgaacctaatccatcaactcatacagtctataaggggttagaaatgtttataaatttccaacctaatactattattgcactcggtggcggttcggcaatggatgcagccaaagcaatatggatgttctttgagcatccagaaacttcattttttggggcaaaacaaaagttcttagatattcgtaaacgtacttataaaattaccaaacctaaaaacgcaaaatttatatgtataccaacgacatcaggaactggttctgaagtgacaccttttgcagtaattactgatagcgagacacacgttaagtatccactagcagattatgcgttaactcccgatattgctatcgtcgatccacaattcgtattaagtgtacctaaagatgttgccgcagatacaggaatggatgttttgacacatgccattgaatcttacgtctctgtcatggcttcagattatacaagaggcttaagcttacaagcaataaagttaacttttgattatctaaaatcatcagttcaagaaaatgacaaacactcacgagaaaaaatgcataatgcttcaacaatggccggtatggcatttgccaatgcttttttaggaatttctcattctatcgcacataaaattggtggtgaatatggtattccccacggcagaacaaatgctattttattaccacatgtcattcgctataatgccaaagatccacaaaaacatgcactgtttcctaaatatgatttctttagagcagatactgactatgctgacattgcaaaatttttaggactcaaaggtaatacaactgaagaattagtggatgctctagctaatgcggtgtatgatttaggatgttcagttggtattgatatgaatttaaaatcacaaggcgtaactgaagagcttcttcactctactatagacagaatggctgaattagcatttgaagatcaatgtacaactgctaatccaaaagaaccgctaattagtgaacttaaaggcattatcgaaacagcatatgattatgaaagataa

SEQ ID NO: 39798 - protein, 869 aa, Staphylococcus epidermidis RP62A
MLSVTKKNTYESNKDEVTQMIDSLAEKGQEALKELSKKSQHEINDIVHQMSMAAVDQHMHLAKLAYDETGRGIYEDKAIKNLYASEYIWNSIKDNKTVGIIGEDKQKGLTYVAEPIGVICGVTPTTNPTSTTIFKAMIAIKTGNPIIFAFHPSAQQSSKYAAKVILEAATKAGAPKDCIQWIEVPSIEATKQLMNHKDIALVLATGGSGMVKSAYSTGKPALGVGPGNVPTYIEKTAHIKRAVNDIIGSKTFDNGMICASEQVMVVDKEVYTDVVKEFKLHQTYFVNKNELQQLEDAIMNEDKTAVKPDIVGKSAVDIAKLSGISVPEKTKLLVAEIDGIGKDYPLSREKLSPVLAMVTAKSTGHALQICEDILKFGGLGHTAVIHTEDSQLQQKFGLKMKACRVLVNTPSAVGGIGNMYNELIPSLTLGCGSYGRNSISHNVSAVDLLNIKTIAKRRNNMQWFKLPPKVYFEENSVMYLTEMDNVERVMIVCDPGMVNIGYTDIVEQVLRRRENQPQIKVFNEVEPNPSTHTVYKGLEMFINFQPNTIIALGGGSAMDAAKAIWMFFEHPETSFFGAKQKFLDIRKRTYKITKPKNAKFICIPTTSGTGSEVTPFAVITDSETHVKYPLADYALTPDIAIVDPQFVLSVPKDVAADTGMDVLTHAIESYVSVMASDYTRGLSLQAIKLTFDYLKSSVQENDKHSREKMHNASTMAGMAFANAFLGISHSIAHKIGGEYGIPHGRTNAILLPHVIRYNAKDPQKHALFPKYDFFRADTDYADIAKFLGLKGNTTEELVDALANAVYDLGCSVGIDMNLKSQGVTEELLHSTIDRMAELAFEDQCTTANPKEPLISELKGIIETAYDYER

SEQ ID NO: 39799 - DNA, 2631 bp, Lactobacillus acidophilus NCFM
  CDS (1)..(2631): transl_table=11
atggctaaggcacaacaaaaagaaactcctactgaggaagaaaagaaaaagcaaatctacgacatggtagataatttagtaaaaagatcacatgttgcattagatgaaatggctaacttcacacaagaacaagttgataagatctgtgaagcagttgctactgcaggtgaacaaaacgcttacccactagctaaaatggctgttgaagaaactaagcgtggtgtagtagaagataagactactaaaaacatgtacgctagtgaaaatatttggaacagtttacgccacgaaaaaactgttggtgtaattgaagaagataaggaactaggattaactaagattgctgaacctaagggtgttattgccggtgttactccagtaactaacccaacttcaactgttattttcaaagcaatgcttgctctaaagacgagaaatactattatttttggtttccacccacaagctcaaaaatgttgtgtagaaactggtaaaattatccaagcggctgctgttgctgcaggtgcacctaaagatgcaattttatggattgaagagccaagtttggatgcaaccactgatttaatgaataatccaggtgttcaaactattttggccactggtggtccaggtatggttaaggctgcatattcatcaggtaaaccagctatcggtgttggtcctggtaatggtccttcatacattgaaaaatcagctaatatcggtcgtgctgtttatgatattgttttatcaaagaacttcgataacggtatggtttgtgcttctgaaaactcagtcgttgtagatgacgcaatttatgacaaggctgtagaagaatttaagaagtggggttgttacttcttaaataaagaagaaattaagaaatttgaagaacactttattgatccaagacgtggtactgttgcaggtcctgtagctggtaaatcagcttatgaaattgctaaactttgtggtgttgatgtaccaaagactactaaagtaattgttgctgaatacaaaggtgttggtagaaagttcccactttcagctgaaaaactttctcctgtctttactttatatcgcgctaagaatcatgacgatgcatttaagatttgttctgaacttcttgattatggtggtcgtggtcataccgcgggaattcactcaagcgatcaaaatataattgatgaatttgcaatgaagatggatgcttgtcgtattctagttaattcaccagctgcacttggtggtattggtgatctttacaacaatatgttgccttcacttacattaggtacaggttcatacggtgctaacacattttcacacaatattggtgccagagatttacttaatattaaaacggttgcgaaacgtcgcgacaatatgcaatgggtaaaagttccatcaaagacttactttgaacataatgctgctaattatttgcgtcacatgccaaatgttaaccgtttcttcattgttactgatgaaggcgtagctgaccaaggctttgctgacgaaatcactgatattatttctaagcgtcgtggtcaaaaagaatatgaagtatttaaggctgtaacgcttgatcctgatactgatgtaattaaagacggtgttcacagaatgaacatctttaagcctgacgtaattattgctattggtggtggctcagtaatggatgctgctaaagtaatgcgcttattctacgaaaatccagaaatgagctttgaagaagcttaccaaaagtttttggatatcagaaaaagagtagtccgcttccctaagattaatggtgttcaacttgtatgtattccaacaacttctggtactggttcagaagtttccccaattgcagttattagcgatactaaaacaggtatgaaacacactctttgtgattatgctttaactccagatgtttcaattgttgatgatcaatttgttcaaaatatgcctaaacgcttaattgcttggtcaggttttgaagcattaggtcatgctattgaaagctatgtttcaactatggccactgatttcactcgtggttggtcacttgaagctattaaagcgatctttgcaaacttgaagaagtcatacgatggtgatcttgatgcaagaaagcaaatgcatgatgctgcaactattgcaggtatggcatattcaaatgcattccttggtcttgaacactcaattgctcatactgttggctcaacctttgatattccaagcggagtaagtgatgcgattgctttaccgcaagttattcgctttaatgccaaacgtcctgaaaagctcgctatgtggcctcactactcagtatatcgtgctgaaagtgactatgctgatattgcaagagctatcggtttgactggttcaagtgatgctgaattagttgaaaaactggttcaaaagattattgaattggctcattctgttggtattaagatggcttataaggattatggcgttgacaagactgaatttgataagaaagttgatcaaatggcagttgaagcttatggtgatcaaaatactgtaactaatccatcagcaccacttattacacaaattgttgtcttaatgaaagattgctacgaaggcaaaggtatttcagacaatgataaataa

SEQ ID NO: 39800 - protein, 876 aa, Lactobacillus acidophilus NCFM
MAKAQQKETPTEEEKKKQIYDMVDNLVKRSHVALDEMANFTQEQVDKICEAVATAGEQNAYPLAKMAVEETKRGVVEDKTTKNMYASENIWNSLRHEKTVGVIEEDKELGLTKIAEPKGVIAGVTPVTNPTSTVIFKAMLALKTRNTIIFGFHPQAQKCCVETGKIIQAAAVAAGAPKDAILWIEEPSLDATTDLMNNPGVQTILATGGPGMVKAAYSSGKPAIGVGPGNGPSYIEKSANIGRAVYDIVLSKNFDNGMVCASENSVVVDDAIYDKAVEEFKKWGCYFLNKEEIKKFEEHFIDPRRGTVAGPVAGKSAYEIAKLCGVDVPKTTKVIVAEYKGVGRKFPLSAEKLSPVFTLYRAKNHDDAFKICSELLDYGGRGHTAGIHSSDQNIIDEFAMKMDACRILVNSPAALGGIGDLYNNMLPSLTLGTGSYGANTFSHNIGARDLLNIKTVAKRRDNMQWVKVPSKTYFEHNAANYLRHMPNVNRFFIVTDEGVADQGFADEITDIISKRRGQKEYEVFKAVTLDPDTDVIKDGVHRMNIFKPDVIIAIGGGSVMDAAKVMRLFYENPEMSFEEAYQKFLDIRKRVVRFPKINGVQLVCIPTTSGTGSEVSPIAVISDTKTGMKHTLCDYALTPDVSIVDDQFVQNMPKRLIAWSGFEALGHAIESYVSTMATDFTRGWSLEAIKAIFANLKKSYDGDLDARKQMHDAATIAGMAYSNAFLGLEHSIAHTVGSTFDIPSGVSDAIALPQVIRFNAKRPEKLAMWPHYSVYRAESDYADIARAIGLTGSSDAELVEKLVQKIIELAHSVGIKMAYKDYGVDKTEFDKKVDQMAVEAYGDQNTVTNPSAPLITQIVVLMKDCYEGKGISDNDK

SEQ ID NO: 39801 - DNA, 2502 bp, Vibrio fischeri ES114
  CDS (1)..(2502): transl_table=11
atgggtatcgttgaagataaggttatcaaaaaccacttcgcatcagagttcatctacaacaaatataaagatgaaaaaacatgtggcattcttgaagaagacgataacctaggaacaatgactatcgcagaacctgtaggtattatctgtggtatcgttccaacaactaacccaacatctactgcaatcttcaaatctctaatctctctaaaaactcgtaacggtatcattttctcgccacacccacgtgcgaaaaactctactaatgatgcagcgaaacttgttttagacgcagcagttgcagctggtgctccaaaagacatcatcggttggattgatcaaccatctgtagaactttctaatgcactaatgaagcacgacggtatcgctcttatccttgctactggtggtccaggcatggttaaagcagcatactcttcaggtaaacctgcaatcggtgttggtgctggtaacgttcctgttgttatcgatgacacagctgatgttaaacgtgcagtcgcttctgttcttatgtctaaaacattcgataacggcgtagtttgtgcttctgagcaagctgtaatcgtaatggatgaagtatacgacgaagttaaagagcgttttgcttctcacaaaggttacgtactatctaaagctgaagcagataaagttcgtaaagttctacttatcgacggtaacctaaacgcaaacatcgtaggtcaacctgcaacagctatcgctgaaatggctggcgttaaagttccagctgatactaagatccttgttggtgaaggtatcggtgaagtatcttacgatgacgaattcgctcatgagaaactatctccaacactaggtatgttccgtgcgtcttctttcgagaacgcggtagaccaagctgttaaaatggtagaaattggcggtatcggccacacatctggtctgtacactaaccaagatgttaacgctgaccgtatccgttactttggtgacaaactaaaaacagcacgtattcttgtaaacatcccaactactcacggtggtatcggtgacctttacaactttaacgttgcaccttctctaactcttggttgtggttcatggggtggtaactctatctctgagaacgtgggtcctaagcaccttatcaacaagaaaactgtagcgaagcgagctgaaaatatgttatggcacaaactacctaagtctatctacttccgtcgtggcagccttccaatcgcaatgagcgacctagaaggtaagaaacgtgcattccttgtaactgaccgtttcctattcaacaacggttacgctgatgacgtagttcaactacttaaagctcaaggtatcgaagttcaaacattctttgatgtagaagcggatccaacactatctgttgttgagaaaggcgctgaagcaatgaagagcttccaacctgacgtaatccttgctctaggtggtggttcaccaatggatgctgctaagattatgtgggtaatgtacgagcacccagaaactcatttcgcagaactagcaatgcgctttatggatatccgtaaacgtatctacaagttccctaaaatgggtaaaaaagctgagcttgtatgtatcactacaacttcaggtactggttcagaagttactccattcgctgttgttacagacgacaagactggtgctaaatacccactagctgattacgaaattacgccaaacatggcaatcgttgatgctaacctagtaatgaacatgcctaagtctctaaccgcatttggtggttacgatgcagtaactcacgcattagaagcttacgtatctgttcttgctaatgaatactctgacggtcaagcgcttcaagctcttaagatgcttaaagaatacttaccatcaagctacaaaaatggtgcgaacgacccaatcgctcgtgagaaagtacacaatgctgcaactatcgctggtatcgcgtttgctaacgcattcctaggtgtgtgtcactcaatggctcacaaaatcggtgctgagttccacttaccacacggtttagctaacgcattacttatctctaacgttgtacgttacaatgcgaacgataacccaactaaacaaacagcattctctcagtacgaccgtccacaagcacgtcgtcgttacgcagaagttgctgaccacctaggcctaagccaagctggtgaccgtactgctcagaagattgagcgtctactaacttggttagaagagcttaagaaagatttagatattccactatctatcaaagatgcaggtgttaacgaagcagacttcatcgctaaactagatgaactatctgttgaagcgttcgatgaccaatgtactggtgcgaacccacgttaccctctaatcacagagctaaaagaagtactaacaacttcttactacggtaaaccttttgttgaaggtgaaacgtttgaaggcacaacagtaattaaaaaaactgaagagccaaaagcgaaaaaagcaaagaaataa

SEQ ID NO: 39802 - protein, 833 aa, Vibrio fischeri ES114
MGIVEDKVIKNHFASEFIYNKYKDEKTCGILEEDDNLGTMTIAEPVGIICGIVPTTNPTSTAIFKSLISLKTRNGIIFSPHPRAKNSTNDAAKLVLDAAVAAGAPKDIIGWIDQPSVELSNALMKHDGIALILATGGPGMVKAAYSSGKPAIGVGAGNVPVVIDDTADVKRAVASVLMSKTFDNGVVCASEQAVIVMDEVYDEVKERFASHKGYVLSKAEADKVRKVLLIDGNLNANIVGQPATAIAEMAGVKVPADTKILVGEGIGEVSYDDEFAHEKLSPTLGMFRASSFENAVDQAVKMVEIGGIGHTSGLYTNQDVNADRIRYFGDKLKTARILVNIPTTHGGIGDLYNFNVAPSLTLGCGSWGGNSISENVGPKHLINKKTVAKRAENMLWHKLPKSIYFRRGSLPIAMSDLEGKKRAFLVTDRFLFNNGYADDVVQLLKAQGIEVQTFFDVEADPTLSVVEKGAEAMKSFQPDVILALGGGSPMDAAKIMWVMYEHPETHFAELAMRFMDIRKRIYKFPKMGKKAELVCITTTSGTGSEVTPFAVVTDDKTGAKYPLADYEITPNMAIVDANLVMNMPKSLTAFGGYDAVTHALEAYVSVLANEYSDGQALQALKMLKEYLPSSYKNGANDPIAREKVHNAATIAGIAFANAFLGVCHSMAHKIGAEFHLPHGLANALLISNVVRYNANDNPTKQTAFSQYDRPQARRRYAEVADHLGLSQAGDRTAQKIERLLTWLEELKKDLDIPLSIKDAGVNEADFIAKLDELSVEAFDDQCTGANPRYPLITELKEVLTTSYYGKPFVEGETFEGTTVIKKTEEPKAKKAKK

SEQ ID NO: 39803 - DNA, 1146 bp, Vibrio fischeri ES114
  CDS (1)..(1146): transl_table=11
atgagtgcattttttatccctacagtaaacttaatgggtgcaggttgtcttacagaagcgatggacagcattaaatcacaaggttacaaaaagggtcttatcgttactgataacgtactagttgcaattggtatggttaaacaagtatcagatttattagcagagcgcggtgttgaagttgctgtgtttgatggtacgcaaccaaacccaacaatcggtaacgtaaatgcaggtttaaaaattcttaaagataatgagtgtgacttcgttatctctttaggtggtggttctcctcacgattgtgctaaaggtattgctttagttgctgcaaatggtggtgagattgctgattatgaaggtgttgatcagtcagctaagccacaattgcctctaattgcaattaatacaacggctggtacggcatctgaaatgacgcgtttctgtatcattactgatgaagctcgtcacattaagatggcgattgtagataagcacacgacaccattgatgtctgtaaatgatcctgaattaatgcttgctaaacctgcatcattaacagcagcaacaggtatggatgcgttaacgcacgctattgaagcatacgtatcaattgcagcaacaccagtaactgatgctgtagcaattaaagcaatggaacttatccaagcgcatttacgtacagcggttaacgacggtcaaaacctagaagctcgtgagcaaatggcttatgcacaattcatggcgggcatggcatttaacaatgcgtctttaggttatgttcacgcaatggcacaccaactaggtggtttctacgaccttccacacggcgtatgtaatgcgattcttcttcctcacgtacaaagctacaatgctaaagtatgtccagaacgtctaaaagacgttgcaaaagcaatgggcgtaaacgttgaaggcatgacaaatgaagaaggcgctcaagctgcattagaagcgattaaacaattatcacaagatgttggtattccttctggtctaacagagcttaacgctaaagaagaagattttgatacgcttgctgaaaatgcattaaaagatgcatgtggttttactaaccctaaacaagcgacgcacgaagaaatcgtaagtatcttcaaagcagcaatgtaa

SEQ ID NO: 39804 - protein, 381 aa, Vibrio fischeri ES114
MSAFFIPTVNLMGAGCLTEAMDSIKSQGYKKGLIVTDNVLVAIGMVKQVSDLLAERGVEVAVFDGTQPNPTIGNVNAGLKILKDNECDFVISLGGGSPHDCAKGIALVAANGGEIADYEGVDQSAKPQLPLIAINTTAGTASEMTRFCIITDEARHIKMAIVDKHTTPLMSVNDPELMLAKPASLTAATGMDALTHAIEAYVSIAATPVTDAVAIKAMELIQAHLRTAVNDGQNLEAREQMAYAQFMAGMAFNNASLGYVHAMAHQLGGFYDLPHGVCNAILLPHVQSYNAKVCPERLKDVAKAMGVNVEGMTNEEGAQAALEAIKQLSQDVGIPSGLTELNAKEEDFDTLAENALKDACGFTNPKQATHEEIVSIFKAAM

SEQ ID NO: 39805 - DNA, 2679 bp, Salmonella enterica subsp. enterica serovar Choleraesuis str
  CDS (1)..(2679): transl_table=11
atggctgttactaatgtcgctgaacttaacgcactcgtagagcgtgtaaaaaaagcccagcgtgaatatgccagtttcactcaagaacaggtcgacaaaatcttccgcgccgccgctctggcagccgctgacgcccgcattccgctggccaaaatggccgtcgccgaatctggtatgggtatcgtggaagacaaagtgattaaaaaccacttcgcttctgaatatatttacaatgcctataaagatgaaaaaacctgcggcgtgctgtctgaagacgacaccttcgggaccatcaccattgctgaacctatcggcattatttgcggtatcgttccaactactaacccgacctctaccgcgatcttcaaatcgctgattagcctgaagacccgtaacgccatcatcttttctccgcatccgcgcgctaaagaagcaaccaacaaagcggcagacatcgttctgcaagcggctatcgctgccggcgcgccgaaagatctgattggctggatcgatcaaccttccgtagaactgtctaatgcgctgatgcgccacccggatattaacctgatcctcgccactggcggtccaggcatggttaaagctgcatacagctccggtaaaccggctatcggcgtaggcgcaggcaacaccccggttgtcattgatgaaaccgctgatatcaaacgcgctgtggcgtctgttctgatgtctaaaaccttcgataacggcgtaatctgtgcttctgaacagtctgttgtcgttgttgattccgtctatgatgccgttcgcgaacgtttcgccagccacggcggctacatgctgcagggccaggagctgaaagcggttcaaaacgttatcctgaaaaatggcgctctgaacgccgctatcgtcggccagccagcctacaaaatcgctgaactggcaggcttctccgtaccagaaaccaccaagattctgatcggtgaagttacggtcgttgacgaaagcgaaccgttcgcacacgaaaaactgtctccgactctggcgatgtatcgtgcgaaagatttcgaagaagcggtagaaaaagcagaaaaactggtcgctatgggcggtatcggtcacacctcctgcctgtacactgaccaggataatcagccagaacgcgttgcttacttcggtcagatgatgaaaaccgcgcgtatcctgatcaacaccccggcctctcagggtggtatcggtgacctgtacaacttcaaactcgcaccttccctgacgttgggttgtggttcctggggtggtaactccatctctgaaaacgttggtccgaaacacctgatcaacaagaaaaccgttgctaagcgagctgaaaacatgttgtggcacaaacttccgaaatctatctacttccgccgtggctctttgcccatcgcgctggatgaagtgattactgatggccacaaacgtgcgctcatcgtgactgaccgcttcctgttcaacaacggctatgcagaccagatcacctctgtgctgaaagcggctggcgttgaaaccgaagtcttcttcgaagttgaagccgacccgacgctttccgttgttcgcaaaggcgctgagctggcgaactccttcaaaccggacgtgatcatcgcgctgggcggcggttccccgatggacgccgcgaaaatcatgtgggtcatgtacgaacatccggaaactcacttcgaagaactggcgctgcgctttatggacatccgtaaacgtatctacaagttcccgaaaatgggcgtgaaagcgaaaatgatcgccgtcaccaccacttccggtaccggttctgaagtcacaccgtttgcggttgtgaccgacgatgcaaccggtcagaaatatccgctggctgactacgccctgaccccggatatggcgattgtcgacgccaacctggtgatggatatgccgaagtccctgtgtgcgttcggtggtctggatgcggtaactcacgctctggaagcttatgtttccgtactggcttctgagttctctgacggtcaggctctgcaggctctgaaactgctgaaagaaaacctgccggcgtcttaccacgaagggtctaaaaatccagttgcgcgtgaacgtgttcacagtgcagcgactatcgccggtatcgcgtttgccaacgccttcctcggtgtatgtcactccatggcgcacaaactgggctctcagttccacattccgcacggtctggcgaacgccctgctgatttgtaacgttatccgctacaacgcgaatgacaacccgaccaagcagaccgctttcagccagtacgatcgtccgcaggcacgccgtcgttacgctgaaattgctgaccacctgggcctgagcgcgccgggcgaccgtaccgccgctaagattgaaaaactgctggcatggctggaaagcattaaagctgagctgggtattcctaagtctatccgtgaagcaggcgtacaggaagctgacttcctggcacacgttgacaaactgtctgaagatgccttcgatgaccagtgcaccggcgctaacccgcgttatccgctgatctccgaactgaaacagattctgctggatacctactacggtcgtgatttcaccgaaggtgaagttgcagcgaagaaagacgtcgttgccgcaccgaaagcagagaaaaaaacgaaaaaatccgcttaa

SEQ ID NO: 39806 - protein, 892 aa, Salmonella enterica subsp. enterica serovar Choleraesuis str
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKEATNKAADIVLQAAIAAGAPKDLIGWIDQPSVELSNALMRHPDINLILATGGPGMVKAAYSSGKPAIGVGAGNTPVVIDETADIKRAVASVLMSKTFDNGVICASEQSVVVVDSVYDAVRERFASHGGYMLQGQELKAVQNVILKNGALNAAIVGQPAYKIAELAGFSVPETTKILIGEVTVVDESEPFAHEKLSPTLAMYRAKDFEEAVEKAEKLVAMGGIGHTSCLYTDQDNQPERVAYFGQMMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSVVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHALEAYVSVLASEFSDGQALQALKLLKENLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLESIKAELGIPKSIREAGVQEADFLAHVDKLSEDAFDDQCTGANPRYPLISELKQILLDTYYGRDFTEGEVAAKKDVVAAPKAEKKTKKSA

SEQ ID NO: 39807 - DNA, 1113 bp, Salmonella enterica subsp. enterica serovar Choleraesuis str
  CDS (1)..(1113): transl_table=11
atgaataccttctcactacaaacgcggttgtacagcggtcagggcagcctggcggtgctcaagcgctttaccaataagcacatctggataatctgcgatggttttctggcgcgctctccgctgctggataccctgcgtaacgcgctgcccgcagataaccgcatcagcgtatttagcgagataacgccggaccccaccatccacacagtggttcagggcattgcgcaaatgcaggctctgcaaccgcaggtggtgatcggttttggcggcggctcggcaatggacgcggcgaaagcgattgtctggtttagccagcaaagcggcatcaatatcgaaacctgcgtggcgatcccgaccaccagcggcaccggttcggaagtcaccagcgcctgcgtaattagcgacccggataaaggcattaagtatccgctgttcaacaatgcgctgtatccggatatggcgatccttgacccggagctggtggtcagcgttccgccgcagattaccgccaacaccggtatggacgtgctgacccacgccctggaggcttgggtgtcaccgcacgccagcgactttaccgacgcgctggcggaaaaagccgccaaactggtgctccagtatctgcccacggcggtggaaaaaggcgactgcgtggcgacgcgcgggaaaatgcataacgcctcaacgctcgccgggatggccttcagccaagcggggctggggcttaaccacgcgatagcccaccagctcggcggacagttccatctgccgcacgggctggccaatgcgctgctgctcacgacggtgatccgctttaacgcgggtgacccgcgcgccgccaaacgctacgcgcggatggccaaagcctgcggtttttgcccggcagaagccaatgacgttgcggcgatcaatgcgctgattcagcaaatcgaactgcttaagcaacgctgtgcccttccctcactggccgttgcgcttaaagaaggaagatccgacttttccgcacgtattccggcgatggtgcaggccgcgctggcggatatcacgctgcgcaccaacccgcgcccggccagcgccgaggaaattcgcgagctgctggaggaactgctatga

SEQ ID NO: 39808 - protein, 370 aa, Salmonella enterica subsp. enterica serovar Choleraesuis str
MNTFSLQTRLYSGQGSLAVLKRFTNKHIWIICDGFLARSPLLDTLRNALPADNRISVFSEITPDPTIHTVVQGIAQMQALQPQVVIGFGGGSAMDAAKAIVWFSQQSGINIETCVAIPTTSGTGSEVTSACVISDPDKGIKYPLFNNALYPDMAILDPELVVSVPPQITANTGMDVLTHALEAWVSPHASDFTDALAEKAAKLVLQYLPTAVEKGDCVATRGKMHNASTLAGMAFSQAGLGLNHAIAHQLGGQFHLPHGLANALLLTTVIRFNAGDPRAAKRYARMAKACGFCPAEANDVAAINALIQQIELLKQRCALPSLAVALKEGRSDFSARIPAMVQAALADITLRTNPRPASAEEIRELLEELL

SEQ ID NO: 39809 - DNA, 1188 bp, Salmonella enterica subsp. enterica serovar Choleraesuis str
  CDS (1)..(1188): transl_table=11
atgcaagctgaactacagacggcgctgtttcaggcattcgacaccctgaatctgcaacgggtgaaaacgttcagcgtaccgccggtcacgctgtgcggacttggggcgctcggcgcctgcggccaggaagcgcaagcgcgaggcgtaagccatctgtttgtgatggtcgacagcttcctgcatcaggcgggaatgaccgcgccgctggcacgcagcctggcgatgaaaggcgtggcgatgacagtctggccgtgtccgccaggcgagccgtgcatcaccgatgtttgcgcggcggtggcgcaactgcgtgaggcggcgtgcgacggcgtagtggcctttggcggcggttcggtgctggacgcggcgaaagcggtcgccctgctggtgactaaccctgaccagacgctgagcgccatgaccgagcgcagtacattacgcccgcgtctgccgctgattgcggtgccgaccaccgccggaaccggttctgaaaccaccaacgtgacggtgattatcgacgcggtcagcgggcgcaagcaggtgctggcacacgcgtcactaatgccggacgtggcgattcttgatgctgccgtgaccgaaggcgttccgccaaacgtgacggcgatgaccggtatcgatgcgttgacgcatgcgattgaggcctacagcgcgctcaacgccacgccgtttaccgacagcctggcgattggcgcgatagcgatgattggcaaatcgctgccgaaagccgtggggtacggccacgatctggcggcgcgtgaaaatatgttgttggcctcctgtatggcgggaatggccttttccagcgccggtctggggctgtgtcacgcgatggcgcaccagccaggggcggcgctgcatattccgcacggccaggccaacgccatgctgctaccgacggtcatgggctttaaccggatggtttgccgcgaacgcttcagtcaaatcggtcgggcgttaaccaataagaaatcggacgatcgcgatgcgattgcggcggtgagcgagctgattgccgaagtgggccagagcaaacggctggctgacgctggcgccaaacccgaacactacagcgcgtgggcgcaagccgcgctggaggatatttgtctgcgcagtaacccacgcaccgccacacaggcacagattatcgacctgtacgcggctgccgggtaa

SEQ ID NO: 39810 - protein, 395 aa, Salmonella enterica subsp. enterica serovar Choleraesuis str
MQAELQTALFQAFDTLNLQRVKTFSVPPVTLCGLGALGACGQEAQARGVSHLFVMVDSFLHQAGMTAPLARSLAMKGVAMTVWPCPPGEPCITDVCAAVAQLREAACDGVVAFGGGSVLDAAKAVALLVTNPDQTLSAMTERSTLRPRLPLIAVPTTAGTGSETTNVTVIIDAVSGRKQVLAHASLMPDVAILDAAVTEGVPPNVTAMTGIDALTHAIEAYSALNATPFTDSLAIGAIAMIGKSLPKAVGYGHDLAARENMLLASCMAGMAFSSAGLGLCHAMAHQPGAALHIPHGQANAMLLPTVMGFNRMVCRERFSQIGRALTNKKSDDRDAIAAVSELIAEVGQSKRLADAGAKPEHYSAWAQAALEDICLRSNPRTATQAQIIDLYAAAG

SEQ ID NO: 39811 - DNA, 1143 bp, Salmonella enterica subsp. enterica serovar Choleraesuis str
  CDS (1)..(1143): transl_table=11
atggcgaacagaatgattctgaatgaaacggcatggtttggccggggagcggtggacgcattaaccgatgaggtgacgcgccgcggttatcataacgcgctgattgttaccgataaaacgctggtgcaatgcggtgtggtcgataaagtgacaagcagaatggatgccgcagggctggcgtgggagatttatgctggcgtgatccctaatcctacgatttccgttgtccaggaagggcttaaggtctttacccaaagtggcgtggactatctcatcgccattggcggcggttctccgcaggatacctgcaaagcgatcggtattatcagtaacaatccggaatttgccgatgtgcgcagtctggaagggctatcgccgacccgtaaacccagcgtgccgattatggcgatcccgacaacggcgggaaccgcggcggaagtcactatcaattatgtgattaccgatgaagagaaacggcgcaaattcgtttgtgtcgatccgcatgatattccgcaggcggcatttatcgatgccgatatgatggacggtatgccacccgcgctgaaagcggcaacgggcgtggatgcgctaacccatgctattgaaggctatattacccgggccgcatgggcgctgacggatgcattacatatcaaagccattgagattattgcgggtgcgctgcgcggcgccgtggccggagaaaaagaggccggtgaggcaatggcgctggggcaatatgttgccgggatggggttttccaatgtggggctggtgcatgggatggcgcatccgctgggcgcgttttacaacacgccgcacggcgtcgcgaatgctattttgcttccgcatgtgatgcgttttaatgccgggtataccaacgagaaattccgtgatatcgcccgggcgatgggggtgaaggtagaaggattgagtcttgaagaggcgcgtaatgccgcagtggaagccgtatttacgctaaatcgcgatgtgggaattccgctgcatttgcgtgatgtcggcgttcgaaaagaggatatcccggcgctggcgcaggcggcgttcgatgatgtctgtacgggcggcaatccgcgtgaagcgagtctggcggacattgtcgaactgtatcataccgcttggtaa

SEQ ID NO: 39812 - protein, 380 aa, Salmonella enterica subsp. enterica serovar Choleraesuis str
MANRMILNETAWFGRGAVDALTDEVTRRGYHNALIVTDKTLVQCGVVDKVTSRMDAAGLAWEIYAGVIPNPTISVVQEGLKVFTQSGVDYLIAIGGGSPQDTCKAIGIISNNPEFADVRSLEGLSPTRKPSVPIMAIPTTAGTAAEVTINYVITDEEKRRKFVCVDPHDIPQAAFIDADMMDGMPPALKAATGVDALTHAIEGYITRAAWALTDALHIKAIEIIAGALRGAVAGEKEAGEAMALGQYVAGMGFSNVGLVHGMAHPLGAFYNTPHGVANAILLPHVMRFNAGYTNEKFRDIARAMGVKVEGLSLEEARNAAVEAVFTLNRDVGIPLHLRDVGVRKEDIPALAQAAFDDVCTGGNPREASLADIVELYHTAW

SEQ ID NO: 39813 - DNA, 1149 bp, Salmonella enterica subsp. enterica serovar Choleraesuis str
  CDS (1)..(1149): transl_table=11
atgagctttatgttggcactgccaaaaattagcctgcatggcgctggagcgattgccgatatggtgaacctcgtggcgaataagcaatggggcaaagcgctgatcgttaccgatggtcaactggtaaagctgggcctgctggatagcctgtttagcgcactggataaacatcaaatgtcttaccacctgtttgatgaggtgttcccaaacccgacagaagagctggtgcagaaaggttttgcggcatatcagagcgcagaatgtgactacattatcgccttcggcggcggcagcccgatcgataccgcaaaagcggtgaaaattctgaccgccaacccaggtccatctaccgcctactccggcgtcggcaaagtgaaaaacgccggcgtaccgctggtagcgattaacactacggcaggtaccgcggcagagatgaccagcaacgcggtgattatcgactctgcccgtaaggtcaaagaggtgattatcgacccgaacatcatcccggatattgccgtggatgacgccagcgttatgctggaaatccccgcttctgtgaccgccgcaaccggcatggatgccctgacccatgcggtggaagcctatgtctccgttggcgcgcatccgctcaccgacgctaacgcgctggaagcgattcgcttaatcaatgtgtggctaccgaaagcggttgacgatggccataacctcgaagcccgtgagcaaatggcattcggccagtacctggcgggtatggcgttcaacagcgccggtttggggctggttcacgcgctggcgcaccagccgggcgcaacccacaacctgccgcacggcgtctgcaacgctatcctgctgccaattgtcgagaactttaaccgtccgaatgccgtcgagcgttttgcccgcatcgcacaggcgatgggcgtggagacgcgcggtatgtctgacgaagccgcaagtcaggaagcgattaacgctatccgtacgctgagcaaacgcgtcggcattccagaaggtttcagcaagctgggcgtcacaaaagaagatatcgaaggctggctggataaagccctcgccgacccgtgcgcgccgtgtaacgcgcgcaccgccagccgcgatgaagttcgcgggctgtacctggaggcgttatga

SEQ ID NO: 39814 - protein, 382 aa, Salmonella enterica subsp. enterica serovar Choleraesuis str
MSFMLALPKISLHGAGAIADMVNLVANKQWGKALIVTDGQLVKLGLLDSLFSALDKHQMSYHLFDEVFPNPTEELVQKGFAAYQSAECDYIIAFGGGSPIDTAKAVKILTANPGPSTAYSGVGKVKNAGVPLVAINTTAGTAAEMTSNAVIIDSARKVKEVIIDPNIIPDIAVDDASVMLEIPASVTAATGMDALTHAVEAYVSVGAHPLTDANALEAIRLINVWLPKAVDDGHNLEAREQMAFGQYLAGMAFNSAGLGLVHALAHQPGATHNLPHGVCNAILLPIVENFNRPNAVERFARIAQAMGVETRGMSDEAASQEAINAIRTLSKRVGIPEGFSKLGVTKEDIEGWLDKALADPCAPCNARTASRDEVRGLYLEAL

SEQ ID NO: 39815 - DNA, 1170 bp, Brucella abortus biovar 1 str. 9-941
  CDS (1)..(1170): transl_table=11
atgaccacattgaccgcgaaatggaactttccgaccactgtgcttttcgggccggggcacatcaaggagcttccagccgtcctgaaagccgcaggcatcgagcacccgcttttcgtcaccgatccgggcctcgccaaactgcctgtggtcgcctcgacattggccgttctggatgcggcgggcgtgcaatatggcgtgttttccgatgtgaaacccaatccggtcgagagcaatcttcatgccggcgtaaaggttttccgggaaggcaggcatgacggcgtcatcgcctttggcggcggttccgcgctcgatctcggcaagctcatcgcctttcaggccggacagacccggcccgtctgggattttgaagatatcggcgactggtggacccgcgccgacagcaacgccatagctcccgtcattgccgtgccgaccaccgcaggcaccggctcggaagtggggcgcgcgggcgttctcaccaatgaatccacccacacgaagaaggtcatcttccaccccaaaatgctgcccgtaacggtgatcgccgatcccgaactttccactggcatgccgcccttcatcacggcgggtacgggcatggatgcactggcgcactgccttgaagcctattgcgcaccgggcttccatcccatggccgatggcattgccgtggagggcatccgccttgtctttgagaacctgcccaaagcctatgccaatggcggggatatcgaagcgcgtgccaatatgatggcagccgctgccatgggcgccacggccttccagaagggcctcggtgcgatccattcgctctcgcaccccatcggcgcgctctatgacacacatcacggcatgaccaatgccgtcttcatgccctatgtgctgcaccacaaccgggatgccatcgaaaagcgcattgcccggctggccgattatctcggcatcgaaggcgggttcgacggctttgccgatgcgatcatgaagctgcgcaccgaacttggcgtgccgcgcaccctgcccgatctcatcaagaaccttcagatggacaatgcccgcaaggagctgatcgccgaaatggcagtggcagatcccaccgcaggcggaaacccggttgaacttacaaaaaacgacgcgctaaagttgctcaatgcagcattggaaggtagataa

SEQ ID NO: 39816 - protein, 389 aa, Brucella abortus biovar 1 str. 9-941
MTTLTAKWNFPTTVLFGPGHIKELPAVLKAAGIEHPLFVTDPGLAKLPVVASTLAVLDAAGVQYGVFSDVKPNPVESNLHAGVKVFREGRHDGVIAFGGGSALDLGKLIAFQAGQTRPVWDFEDIGDWWTRADSNAIAPVIAVPTTAGTGSEVGRAGVLTNESTHTKKVIFHPKMLPVTVIADPELSTGMPPFITAGTGMDALAHCLEAYCAPGFHPMADGIAVEGIRLVFENLPKAYANGGDIEARANMMAAAAMGATAFQKGLGAIHSLSHPIGALYDTHHGMTNAVFMPYVLHHNRDAIEKRIARLADYLGIEGGFDGFADAIMKLRTELGVPRTLPDLIKNLQMDNARKELIAEMAVADPTAGGNPVELTKNDALKLLNAALEGR

SEQ ID NO: 39817 - DNA, 1155 bp, Pseudomonas syringae pv. syringae B728a
  CDS (1)..(1155): transl_table=11
atgcaccgcaacgactggcactacccgacttccatccgcgcaggcgcaggacgcgtcaacgaactggccgacgcctgcagggtgaccggcatacaacgtccgctgctgatcaccgacagctttctcggcagcaccgatatgatcaccagcgccgtggaggactgccgcaatcaattgggccactgcggcctgtttgaccgggtcaagggcaacccgaccggcaccaacgtcgccgaggggctgcacgcttacagaaccggaggctacgacggtgtgattgcgtttggcggcggctcggcgctggacgctgccaaggcagtcgcgctgatgtcgggccagacccgcccgttatgggatttcgaagacgtcaacgacaaccacctgcgcgccgatccggatggcattgcgccggtgattgcgctgccgacaacggccgggaccggctctgaagtagggcgtgcgtcggtgattaccgatgagcaggcgcaggtcaaacgcaccattctgcaccttcgcatgatgccgcgcatcgcgattctggatgccacgctgacgctcgacctgcccaggcacctgaccgccgccaccggcgccgatgccttgacccactgcatggagtcctggtgttcgccggcctggcacccgatggccgaagcggtttcggtcaagggcatgcagatgatcaaggcgtttttaccgcgtgtcgtcgccgacgggcaggacctggaggcgcggcagcagatgctggtggcctccagcctcggcgcggccgcgtttcagcgcggtctgggcggcgtacacgcaatcgcgcagagccttggggcgctctacgaccagcatcatggcttgctgaacgcaatcctgctgccctacgtgctggaggccaatcgctcggtgctgcagacgcaaatggacgatctggcggtttacctgcggttgccgtcgcccggtttctccggggtgatggactggctgctgacactgcgcgagcagatcggcattccacatacgctgggcgagatcggtatcgacgatcgcgacgccgagcgggtcgggcggatggctttcgccgatggctgctcgcacaccaacccgattcgccattcggcgcaggcctacgcgcagatcttcagccgtgcagtgaggggcgagtga

SEQ ID NO: 39818 - protein, 384 aa, Pseudomonas syringae pv. syringae B728a
MHRNDWHYPTSIRAGAGRVNELADACRVTGIQRPLLITDSFLGSTDMITSAVEDCRNQLGHCGLFDRVKGNPTGTNVAEGLHAYRTGGYDGVIAFGGGSALDAAKAVALMSGQTRPLWDFEDVNDNHLRADPDGIAPVIALPTTAGTGSEVGRASVITDEQAQVKRTILHLRMMPRIAILDATLTLDLPRHLTAATGADALTHCMESWCSPAWHPMAEAVSVKGMQMIKAFLPRVVADGQDLEARQQMLVASSLGAAAFQRGLGGVHAIAQSLGALYDQHHGLLNAILLPYVLEANRSVLQTQMDDLAVYLRLPSPGFSGVMDWLLTLREQIGIPHTLGEIGIDDRDAERVGRMAFADGCSHTNPIRHSAQAYAQIFSRAVRGE

SEQ ID NO: 39819 - DNA, 1149 bp, Pseudomonas syringae pv. syringae B728a
  CDS (1)..(1149): transl_table=11
atgatcagcacttttttcatccccgctgtgaacatcatcggcactggctgcattgacgaagccatgctcgccatacgcaaatacggatttcgcaaggccctgatcgtcacggatgctggccttgccagggccggagtagccagtcaggtcgccgggctgttggtggagcagggcattgactcggttgtgtacgacggtgcccggcccaacccgaccatcgccaacgtcgagaacggcctggccctgttgcaggagcgccagtgcgatttcgtcatatcgctgggcggtggctcgcctcacgactgtgcaaaaggtattgccctgtgcgccagcaacggggggcatatcagcgattatgagggcgtcgaccgttcggcaaaaccgcagttgccattgattgccatcaataccaccgccggaaccgcgagtgaaatgacccgcttctgcatcattaccgacgaagcccggcacgtaaaaatggcgatcatcgaccgcaacgtcacgccgctgctgtccgtgaatgatcccgacatgatggtcgccatgcccaggtcgctgactgccgccactggcatggatgccttgactcacgcaatcgaagcctatgtctccacggctgccaacccgatcactgacgcctgtgcgttacaggctatggcgctgatcgccaacaatttgcgcgacgcattcaacaacggggccaatatcactgcccgcgagaacatggcgtatgcccagtttctggctggcatggcgttcaataacgcgtcactgggctacgtgcacgccatggcgcaccagttgggcggcttttatgatttgccccacggtgtgtgcaacgccgtattgctgccccatgtgcagcgcttcaacgccagcgtcagcgctgcacgcctgaccgacgttgcacacgccatgggcagcaatatccgtgggctctctccggaagaaggcgctcaggcagccatcgacgcgattcgtgcattgtcggctgccgtggaaatcccggcaggtcttgctacgctgggcgtcaaggaggaagacttcccgatgctggccagcaatgccctgaaagatgcctgcggcctgaccaacccgcgtcctgccgatcttgagcagattcaggatatatttcgccaggcgctttaa

SEQ ID NO: 39820 - protein, 382 aa, Pseudomonas syringae pv. syringae B728a
MISTFFIPAVNIIGTGCIDEAMLAIRKYGFRKALIVTDAGLARAGVASQVAGLLVEQGIDSVVYDGARPNPTIANVENGLALLQERQCDFVISLGGGSPHDCAKGIALCASNGGHISDYEGVDRSAKPQLPLIAINTTAGTASEMTRFCIITDEARHVKMAIIDRNVTPLLSVNDPDMMVAMPRSLTAATGMDALTHAIEAYVSTAANPITDACALQAMALIANNLRDAFNNGANITARENMAYAQFLAGMAFNNASLGYVHAMAHQLGGFYDLPHGVCNAVLLPHVQRFNASVSAARLTDVAHAMGSNIRGLSPEEGAQAAIDAIRALSAAVEIPAGLATLGVKEEDFPMLASNALKDACGLTNPRPADLEQIQDIFRQAL

SEQ ID NO: 39821 - DNA, 1149 bp, Pseudomonas fluorescens Pf-5
  CDS (1)..(1149): transl_table=11
atgagcagcacctttttcattccagccgtgaacatcatgggcatcggctgtctcgacgaggccatgagcgccatccgcaactatggatttcgcaaggcgctgatcgtcactgacacgggcctggccaaggctggcgtggccagcatggtggccgagaagctggccatgcaggacatcgattcggtgatcttcgacggtgccaagcccaaccccagcattgccaacgtcgagcagggcctggcgcaattgcagcaggcacagtgcgatttcgtcatctccctgggcggcggatcgccccatgactgcgccaagggcattgccctgtgtgccaccaatggcgggcagatccgcgattacgaaggcgtcgaccagtcggccaagccgcaactgcccttgatcgccatcaacaccaccgccggcactgccagcgaaatgacccgtttctgcatcatcaccgacgaatcgcgccatgtgaaaatggccatcgtcgaccgcaacgtcacgccgttgctgtcggtgaacgatccggcactgatggtggcgatgcccaagggcctgaccgccgccaccggcatggatgccctgacccacgcggtggaagcctatgtgtccaccgccgccaaccccatcaccgatgcctgcgccctgaaggccgtggaaatgatcagcgccaacctgcgccaggcggtgcacgacggcaacgatctgctggcacgggagaacatggcctatgcgcagttcctcgccggcatggcattcaacaatgcgtccctgggtttcgtgcacgccatggcccaccagctgggcggcttctacgacctgccccatggcgtgtgcaacgcggtgctgttgccccatgtgcagagcttcaacgccacggtatgcgcccagcgcctgaccgatgtggcccacgcgctgggagcggacattcgcggtttcagcccggaagagggcgcccaggcggccatcgcggcgatccgcaccctggcccgtgatgtggagattcccgccggtttgcgcgagttgggcgccaagttgcaggacattccgctattggcggccaatgctctcaaggatgcctgcggcctgaccaacccgcgtccggcggatcagcggcagatcgaggagattttccgcaacgcgttctga

SEQ ID NO: 39822 - protein, 382 aa, Pseudomonas fluorescens Pf-5
MSSTFFIPAVNIMGIGCLDEAMSAIRNYGFRKALIVTDTGLAKAGVASMVAEKLAMQDIDSVIFDGAKPNPSIANVEQGLAQLQQAQCDFVISLGGGSPHDCAKGIALCATNGGQIRDYEGVDQSAKPQLPLIAINTTAGTASEMTRFCIITDESRHVKMAIVDRNVTPLLSVNDPALMVAMPKGLTAATGMDALTHAVEAYVSTAANPITDACALKAVEMISANLRQAVHDGNDLLARENMAYAQFLAGMAFNNASLGFVHAMAHQLGGFYDLPHGVCNAVLLPHVQSFNATVCAQRLTDVAHALGADIRGFSPEEGAQAAIAAIRTLARDVEIPAGLRELGAKLQDIPLLAANALKDACGLTNPRPADQRQIEEIFRNAF

SEQ ID NO: 39823 - DNA, 1164 bp, Pseudomonas fluorescens Pf-5
  CDS (1)..(1164): transl_table=11
atgggccagaatctcagtctgctgcgcaagttcgtctctccggaaatcatctttggcgccggttgccggcacaacgtcggcaactatgcgaagaccttcggtgcgcgcaaggtgctggtggtcaccgaccccggggtgatcgccgccggctgggtcgccgatgtcgaggccagcctgctggcccagggcgtcgagtactgcctgtacagcgcagtgtcgcccaacccgcgggtggaggaggtgatgcacggcgcgcagatctaccgggaaaacgcctgcgatgtgatcgtcgcggtcggtggcggcagccccatggattgcggcaagggcatcggcatcgtcgccgcccacgggcgcagcatcctcgagttcgagggggtggacaccatccgcatgcccagccccccgctgatcatgatcccgaccaccgcgggcacctcggcggatgtctcgcagttcgtgatcatctccaaccagcaggagcggatgaagttctccatcgtcagcaaggcggtggtccctgatgtgtcgctgatcgacccggaaaccacccagggcatggaccccttcctgtccgcctgcaccggcatcgacgccctggtgcatgccatcgaggctttcgtttccaccggccacgggccgctgaccgatccccacgccctggaagccatgcgcctgatcaacggcaacctggtgcagatgatcgccaacccctcggacatcgccctgcgcgagaagatcatgctcggcagcatgcaggccgggctggcgttctccaacgcgatcctcggcgcggtgcatgccatgtcccacagcctggggggctttctcgacctgcctcacgggctgtgcaacgcggtgctggtggagcatgtggtggccttcaactacagcgcggcgccggagcgattcaaggtgattgccgagactttcggcatcgactgccgcgggctcaaccagcggcagatctgcgggcgcctggtggagcacctgatcgccctcaagcgcgccatcggcttccacgagaccctgggcctgcatggggtcagcagcagcgatattccgttcctctcgcagcacgcaatgggcgacccatgcatcctcaccaaccctcgtgaatccagccagcgtgatgtcgaggtggtctatggcgaggccctctga

SEQ ID NO: 39824 - protein, 387 aa, Pseudomonas fluorescens Pf-5
MGQNLSLLRKFVSPEIIFGAGCRHNVGNYAKTFGARKVLVVTDPGVIAAGWVADVEASLLAQGVEYCLYSAVSPNPRVEEVMHGAQIYRENACDVIVAVGGGSPMDCGKGIGIVAAHGRSILEFEGVDTIRMPSPPLIMIPTTAGTSADVSQFVIISNQQERMKFSIVSKAVVPDVSLIDPETTQGMDPFLSACTGIDALVHAIEAFVSTGHGPLTDPHALEAMRLINGNLVQMIANPSDIALREKIMLGSMQAGLAFSNAILGAVHAMSHSLGGFLDLPHGLCNAVLVEHVVAFNYSAAPERFKVIAETFGIDCRGLNQRQICGRLVEHLIALKRAIGFHETLGLHGVSSSDIPFLSQHAMGDPCILTNPRESSQRDVEVVYGEAL

SEQ ID NO: 39825 - DNA, 1197 bp, Pseudomonas fluorescens Pf-5
  CDS (1)..(1197): transl_table=11
atgcccccgtccatccactactggaactaccccaccgagatcttctgcggcgccgaggccctgcacggcctggcccagcgctgcgccctgctgggcatggccaggcccttgctggtcaccgacccgggcatgctcgaactggaaccctttggcctgttgaccgcgcacctggagcagagccgccagggctttgcggtatttgccgaactggccagcaacccgagcctggacgatgtgcagcgcggcgtccaagccttcagggccggcggccacgactcgctgatcgccctgggcggcggcagcgccatggacgccgccaagggcatcgccctggccgccgtggacccgcaagggctgcagcgtttcgagtggtcccaggtgatcgagcattacccgagcctcagtgactttccgcgcctgggcctgccgcccctgatcgccctgcccaccactgccggcaccggctccgaactgggccgcgaagcggtactgaccgacagccagcagcaggtcaagcgggtcatcagccaccccgaactgctgcccgcctgcgtgatcctcgacccgctgctgacccgcggcctgccgcccgcgctgaccgccgccaccggcatggatgccctgacccaccatatcgaggcgttctgctcgcccctgtaccacccgatgtccagcgcgattgccgtggaaggcatgcgcctggtgcagcagcacctgcgccgggcagtgagccacggccaggacctggacgcccgggaaggcatgctggtggcctcggcgatggctgcggtggccttccagaagggcctggggggcgtccacgccctggcccacccgctgggcgcccgctatcaccgtcaccatggcctgctcaatgccgtcctcctgccctatgtgctggtggccaaccagccggtgattgccgaggagatcgggcgcctggcccgttacctggacttgccccggggggatttccaggggttcctggactggatcctggccctgcgcgccgagctgggcatcccccactgcctggcggatatcggcctggacagccatgaagccgagtgggtcggggcccaggccctggcggatatttcgtcctccgacaccaatgcccgaccgctgagcgccgccgactacagccagatcttccgcaacgccgtgcacggcgtcctgccaggagcccgcccatga

SEQ ID NO: 39826 - protein, 398 aa, Pseudomonas fluorescens Pf-5
MPPSIHYWNYPTEIFCGAEALHGLAQRCALLGMARPLLVTDPGMLELEPFGLLTAHLEQSRQGFAVFAELASNPSLDDVQRGVQAFRAGGHDSLIALGGGSAMDAAKGIALAAVDPQGLQRFEWSQVIEHYPSLSDFPRLGLPPLIALPTTAGTGSELGREAVLTDSQQQVKRVISHPELLPACVILDPLLTRGLPPALTAATGMDALTHHIEAFCSPLYHPMSSAIAVEGMRLVQQHLRRAVSHGQDLDAREGMLVASAMAAVAFQKGLGGVHALAHPLGARYHRHHGLLNAVLLPYVLVANQPVIAEEIGRLARYLDLPRGDFQGFLDWILALRAELGIPHCLADIGLDSHEAEWVGAQALADISSSDTNARPLSAADYSQIFRNAVHGVLPGARP

SEQ ID NO: 39827 - DNA, 1149 bp, Pseudomonas fluorescens Pf-5
  CDS (1)..(1149): transl_table=11
atgagtatttcctctttcaagatcgcccataaattgctgaccggcagcaccgccatcgagcaactggctgccgagctgacccgcctggatgtcgataacccgctgatcgtcaccgatactgccctgctcaggtccggcacggtggagctggcgctggcccacctgggggagcgcagttacgaagtcttcgaccgggtgcagcctgatccggaaatcgccatcgtcgaggactgcatgcaggtgtaccgcgagggcgggcatgacgggctgatcggcctgggcggcggcagcgccatcgatatcgccaagagtgtcggggcctatgccggctatcacggcgccctggaggatctgttcggcatcgaccaggtgccgcgcaaggggccgccgctgatcgccattcccaccaccgcaggcactggttcggaagtgaccaatgtggcgatcctctcggaccgggtcgcgcaattgaagaaaggcatcatcagcgactacctgctgccggacgtggccctggtcagcccgcagatgaccctgacctgtccaccgcgtgtcaccgcggccagcggcgtcgatgccctggcgcatgccattgaggcttacctgtccctcaatgcttccgcgatcaccgactccctggccatcggcgccatcaagctgatcgtcaaggctttgcccaaggcctttgccaacccggcccacctgcaggcccgggaggacatggccaccgccagcctgatggccggcatggccttcggcaatgccggggtcggtgcggtgcatgcgatggcctatcccctgggcggccgctttcatatgtcccacggggtcagcaatgccttgctgctgccctatgtcatgacctggaacaagatggcctgcgtcgagcgtatgcaggatatcgccgaggccatgggggtacagaccgcgcacctgagtgccagcgaggcggccgaccgggcagtggaggccatggcagcgttgtgtgcggcggtggaaattcccagcggcttgcgcagcttcggcgtgcccgaggatgcgatcccggccatggccgtcgaggccgcgggtatcgagcgcttgatgcgcaacaacccgcgccggctgagccccgccgatatcgagaagatctatcgcgcggcctactga

SEQ ID NO: 39828 - protein, 382 aa, Pseudomonas fluorescens Pf-5
MSISSFKIAHKLLTGSTAIEQLAAELTRLDVDNPLIVTDTALLRSGTVELALAHLGERSYEVFDRVQPDPEIAIVEDCMQVYREGGHDGLIGLGGGSAIDIAKSVGAYAGYHGALEDLFGIDQVPRKGPPLIAIPTTAGTGSEVTNVAILSDRVAQLKKGIISDYLLPDVALVSPQMTLTCPPRVTAASGVDALAHAIEAYLSLNASAITDSLAIGAIKLIVKALPKAFANPAHLQAREDMATASLMAGMAFGNAGVGAVHAMAYPLGGRFHMSHGVSNALLLPYVMTWNKMACVERMQDIAEAMGVQTAHLSASEAADRAVEAMAALCAAVEIPSGLRSFGVPEDAIPAMAVEAAGIERLMRNNPRRLSPADIEKIYRAAY

SEQ ID NO: 39829 - DNA, 1149 bp, Pseudomonas fluorescens Pf-5
  CDS (1)..(1149): transl_table=11
atgagtatttctgcgttcaagattgccaacaaactgattaccggccagggcgccatcgaacagctggacgccgaactggcgcgcctgcagatcagcaacccgctgatcgtcaccgatgcgatcctggtcaagtccggcaccgtcgatctggccttggcccacctgggcgggcgcgcttaccggatcttcgacgaggtccagccggagccggaaatcgccatagtccaggcctgcacccaggcttaccgggccggtggccacgatggcctgatcggcctgggcggcggcagcgccattgatatcgccaaggcggtggccgcgttcgccggccatgaaggcgcgctggaagagctgttcggggtggatcaggtgcagcgcaaggggccgccgctgattgccattcctaccactgcgggcaccggttcggaggtgaccaacgtggcgatcctctcggacaaggtggcccagttgaaaaagggcatcgtcagcgattacctgctgccggacgtagcgctggtgagcccggtgatgaccctgacctgcccgcgcagcgtcaccgccgccagtggcgtcgacgcgctggtgcatgcggtggagtcctacctgtcgctcaacggttcgccgatcaccgactccctggccctgggcgcgatccgcctgatcgtcagggcgctgcccaaggcctacgccaacccggccaacctgcaggcccgggaagacatggccaccgccagcctgatggccggcatggccttcggcaatgccggagtcggtgcagtgcatgccctggcctatcccctgggcgggcgcttcaatatcgcccacggggtgagcaacgcgctgctactgccctacgtcatggcctggaacaagatggcctgtgtcgagcgctttcgcgatatcgcccaggccatggacctgccgatcgccgggctcagtgatggccaggccgcagagcaggcggtccaggccatggctgcgctgtgcgctgcggtggacatccccacgggcatgcgcagcttcggtgtgcccgaggacgcgatcccggccatggccgtggaagcggcgggtatccagcggctgatgcgcaacaacccgcgccaactgagccccggcgatatcgagcagatctaccgggctgcctattga

SEQ ID NO: 39830 - protein, 382 aa, Pseudomonas fluorescens Pf-5
MSISAFKIANKLITGQGAIEQLDAELARLQISNPLIVTDAILVKSGTVDLALAHLGGRAYRIFDEVQPEPEIAIVQACTQAYRAGGHDGLIGLGGGSAIDIAKAVAAFAGHEGALEELFGVDQVQRKGPPLIAIPTTAGTGSEVTNVAILSDKVAQLKKGIVSDYLLPDVALVSPVMTLTCPRSVTAASGVDALVHAVESYLSLNGSPITDSLALGAIRLIVRALPKAYANPANLQAREDMATASLMAGMAFGNAGVGAVHALAYPLGGRFNIAHGVSNALLLPYVMAWNKMACVERFRDIAQAMDLPIAGLSDGQAAEQAVQAMAALCAAVDIPTGMRSFGVPEDAIPAMAVEAAGIQRLMRNNPRQLSPGDIEQIYRAAY

SEQ ID NO: 39831 - DNA, 1164 bp, Psychrobacter arcticum 273-4
  CDS (1)..(1164): transl_table=11
atgataggaatagagttttatactaacggacacatcgttagcgaagctgacagcatgcgccaaaagctaggggatttagcaaagcaatactatgcaacatctgccattattattacagacgctggcatctctgagctgggctacgttgatatcgcacggaagtctttagagaaggccggtgctaatgtcgttgttttcgatagtgtcgttgctgatccacctattgaagtcgtcgaagaagctatcgaacttgccagagcgaaccagtgtgatttggtcatcggcttaggaggtggcagctctattgatactgcgaaaattgtcgcgctataccccaatgaatttgagtcggtcaatgagcttttagaggcagatattagtggttttaaaaaaatgccgctgtttgcgattcccaccactgcaggtactggcgcagaagctacctttgtatctgtaatcacagcaaaagatggcagcaaaaaagccatatacacgcctaaaatcttacctgatgtcgcgattttagatgcaacgcttacccttaagcttcctcgccatatcactgctgccactgctctagatgctatggttcattgcattgaagcttacacgagccgcactaagaagaaccccatttcagatgcactggctgttaaaggcttgcaaatgctgtggagcaattttgacaaagtgctcaatcacggcgatgacattgatgctcgcactgagatgttattaggttcaactctagctggcattgcttttgtcaacgcttccgtagcagctgtacatggactctcctacccacttagcatcaactttcatgtacctcatgggcatgctaacgcgctcgtcatgtgcggtgtatttaatttcaacttaccggtagcagcacccctttatgcagaattagctcgtgcggtgatgcctatcgaaacttctggcatgaatgatctagaggctgccaatcaatttatcaatcaactaagagacttcttaaaaacaagtggtctaaagtatcgcttaaatgagttagatataacagaacaagatatccctgcgttagctgatatagtcattaatacttatgctcgtctcattgaaaccaatccaatgaacatgtctttagaagaggtaaaaatgatatacaaagagatactctaa

SEQ ID NO: 39832 - protein, 387 aa, Psychrobacter arcticum 273-4
MIGIEFYTNGHIVSEADSMRQKLGDLAKQYYATSAIIITDAGISELGYVDIARKSLEKAGANVVVFDSVVADPPIEVVEEAIELARANQCDLVIGLGGGSSIDTAKIVALYPNEFESVNELLEADISGFKKMPLFAIPTTAGTGAEATFVSVITAKDGSKKAIYTPKILPDVAILDATLTLKLPRHITAATALDAMVHCIEAYTSRTKKNPISDALAVKGLQMLWSNFDKVLNHGDDIDARTEMLLGSTLAGIAFVNASVAAVHGLSYPLSINFHVPHGHANALVMCGVFNFNLPVAAPLYAELARAVMPIETSGMNDLEAANQFINQLRDFLKTSGLKYRLNELDITEQDIPALADIVINTYARLIETNPMNMSLEEVKMIYKEIL

SEQ ID NO: 39833 - DNA, 1326 bp, Psychrobacter arcticum 273-4
  CDS (1)..(1326): transl_table=11
atgaaaaaacaaaacagtattgctaaattagtaagtagcaaattagtcagtagcaatggattacagtatactggctatttagctgttgccaagacacgcgccaaagtactaaaagccttcgcttatattattccgattagaagaccgatgttattcgtcggcgagagctcttgtgatgagctatgcgatatgctcattaatgaaggtagcaccaatgtctttatcgtgactgatggagtgctaaataagctcggcataccagccaaagtcactgattatctagatagtaaaaatatcagctataaagtctatgacggtattacaccagaccctacttttaaagtggttgaagaaggactacgcatatccgttgatgctaaatgcgattcaattattgcaatcggcggtgggtcggtcattgatgcagctaaaatgatagccatgtcacaaggcaacaattgcaagccgcagcagcttatcggcattcttaaagcaagaaagccttctgtaccgttgtactgtgtgcctacaactgctggtactggttcggaagcgacacttggtgcggttgtatcagacgataaaactcatcaaaaagccctatctatcgatccaagaatggtgccattagcagcggctattgacccagttatcatgaaaggtatgccggctcatatcacagcggatacgggtatcgatgtgttgacacatgccctagaagcttggatgagtgccaatgctagcgtagagactgattattatgctgcctctgcggttaagtcagttatgcagaatctgccaatagtatacgaagacggcggcaatctcaaagccagagaagcaatgggtattgcggctcactacggcgggattgcctttaataaagcaggccttggttatgtccatgccatcgctcatcagctaggggcgtattatagtattcctcatggtcgcgccaatgccatcgtgttaccttatgtacttgatgtcaatcgtcaagcgagcaaaaagagattggctgagctggctagaaaaacgggcatggtaaaatctggtcaagctagcagcagtgatagcgatatcgccgattatctcatcgcccaagtacgtgaattgattgcaaccttaaacatcgatccaacagttaaaggtatgaaagccagtgattttgatagtattgctaaagcagcggctaaagaagtcagtgatacttatgcggtaccgacttatctgtcagcgtctgaaataaaagatatcttattgaagattaagcaggcaagtgaagatgctgctggtactgacgctaaaaatgataaagttgcatag

SEQ ID NO: 39834 - protein, 441 aa, Psychrobacter arcticum 273-4
MKKQNSIAKLVSSKLVSSNGLQYTGYLAVAKTRAKVLKAFAYIIPIRRPMLFVGESSCDELCDMLINEGSTNVFIVTDGVLNKLGIPAKVTDYLDSKNISYKVYDGITPDPTFKVVEEGLRISVDAKCDSIIAIGGGSVIDAAKMIAMSQGNNCKPQQLIGILKARKPSVPLYCVPTTAGTGSEATLGAVVSDDKTHQKALSIDPRMVPLAAAIDPVIMKGMPAHITADTGIDVLTHALEAWMSANASVETDYYAASAVKSVMQNLPIVYEDGGNLKAREAMGIAAHYGGIAFNKAGLGYVHAIAHQLGAYYSIPHGRANAIVLPYVLDVNRQASKKRLAELARKTGMVKSGQASSSDSDIADYLIAQVRELIATLNIDPTVKGMKASDFDSIAKAAAKEVSDTYAVPTYLSASEIKDILLKIKQASEDAAGTDAKNDKVA

SEQ ID NO: 39835 - DNA, 1167 bp, Candidatus Pelagibacter ubique HTCC1062
  CDS (1)..(1167): transl_table=11
atgcaaaaatacaactggaattatcctactacaatgtgggtaggtgaaaatagaattaatgatgttgcttcagcatgtaaaaatttaaacattaaaaagccactgcttgttactgataatggattagctcaatcagttattgttaaaaacactttatcgattttaaaagagggtggaattattgcagcattatattcaaatgttgttggtaacccaactggcacgaatgttaatgaaggtgctgattattataaaaaaaacaattgtgatggtgttattgcgtttggaggtggtagtggtttagatgttggtaaagcagttgcttttatgtcaggtcaaaatctacctatttgggatttcgaagatgttggagataattggactaaagcaaactctgataagattgctcccattattgcagtacctactactgcgggcactggttctgaaactggcagagcatcagtaatattaaatgaagaaacaggcgtgaaaaatattatttttcatccaaaatttttaccatcaatagttattttagatccaattttaacagttggattaccagcaaaaatgactgcagcaactggaatggatgcactagcacataatttagaagcctattgtgcaccaggctatcatccgatggcagatggaattgctttagaaggaatgagattaattgataagtggctattagaagctgttagcaatggatctaatattgaagcaagaatgaatatgttaacagcagctagtatgggctcaactgcatttcaaaaaggactaggagcaattcattctctaagtcaccctgtcaatgcattaaataatattcatcacggtttatctaatgcaatatttatgccttacgtgttaactttcaacaaagatgtaattgaaaataagataattaaaatttgtgactatttagaacttaaagacagatcttttgatggttttgttaactgggttttagatttaagaaaaaaacttgatatgcctcataaattatcagaagtgattgatgaaaaagattttgatattgatagattatcaaaaatggctttagcagacccatctactggaggaaatccaaaaaaattaactgaggatgatatgaggataatgtaccagaacagtatgacaggtgaattgtttaaatga

SEQ ID NO: 39836 - protein, 388 aa, Candidatus Pelagibacter ubique HTCC1062
MQKYNWNYPTTMWVGENRINDVASACKNLNIKKPLLVTDNGLAQSVIVKNTLSILKEGGIIAALYSNVVGNPTGTNVNEGADYYKKNNCDGVIAFGGGSGLDVGKAVAFMSGQNLPIWDFEDVGDNWTKANSDKIAPIIAVPTTAGTGSETGRASVILNEETGVKNIIFHPKFLPSIVILDPILTVGLPAKMTAATGMDALAHNLEAYCAPGYHPMADGIALEGMRLIDKWLLEAVSNGSNIEARMNMLTAASMGSTAFQKGLGAIHSLSHPVNALNNIHHGLSNAIFMPYVLTFNKDVIENKIIKICDYLELKDRSFDGFVNWVLDLRKKLDMPHKLSEVIDEKDFDIDRLSKMALADPSTGGNPKKLTEDDMRIMYQNSMTGELFK

SEQ ID NO: 39837 - DNA, 1161 bp, Colwellia psychrerythraea 34H
  CDS (1)..(1161): transl_table=11
atgtctactcaagttattctgccacgtattatgcaggtgggtgaaaacgcaagtcaggaaatagccaacgtattagttagtattggctgtacccgaccattgattattactgacaagatgatggtgggattgggctacgctcgtcgaattcaagtcagtttaggcgcacatcatattcccgcccatatcttcgacgataccgtgccagagcctacagttgaatctattcaagcgggtgttgataaggcacgagagggtaattacgattgtattatcgcccttggtggtggaagtccaatcgatagtgctaaagccattgctatcttggccaaacatggtggtgtgatgcaagattaccgttttcctcgtatggttatagagcaaggcttacctgtcattgccgtacctactacggcggggactggatctgaagtcactaaatttaccatcattaccgatgaaaaaaacgacgaaaagatgctgtgtgtcggcattggcttcatgcccgttgcagcattggtggattataaattaaccattagtttgcctcctaggaccactgccgatactggaatcgatgccttgacccatgcaattgaagcgtatgtgagtaaaaaagcaaacccatatagtgatagtcaggcaattgctgcgattaaattgattggacctaatttgagaaaggtctatcacagcggcgaagatcaagatgctcgtgaagctatgatgctgggttcgaccttagctggtattgcattctctaacgcatcggtggcattagtgcatggtatgagtcgacctattggtgccttttttcatgtacctcatggtctctcaaatgcgatgttattgcccagtgttaccgctttttctattcctgcggcaccagcgcgttatgcggattgtgctcgggcgatgggtattgcagctgagcaagatagcaatgaagttgccaatcagaaattattaatcgagcttcgttcactaaatgaagaattagcagtaccaacgccacaggaatttggtattaagcgcgatgagttttttgaggtgtgtcaaacaatggctgaacaagcattagcttcaggctcaccgagtaataaccctattgagccatctatcaacgaaattatcagtatttaccaggggctatgggattaa

SEQ ID NO: 39838 - protein, 386 aa, Colwellia psychrerythraea 34H
MSTQVILPRIMQVGENASQEIANVLVSIGCTRPLIITDKMMVGLGYARRIQVSLGAHHIPAHIFDDTVPEPTVESIQAGVDKAREGNYDCIIALGGGSPIDSAKAIAILAKHGGVMQDYRFPRMVIEQGLPVIAVPTTAGTGSEVTKFTIITDEKNDEKMLCVGIGFMPVAALVDYKLTISLPPRTTADTGIDALTHAIEAYVSKKANPYSDSQAIAAIKLIGPNLRKVYHSGEDQDAREAMMLGSTLAGIAFSNASVALVHGMSRPIGAFFHVPHGLSNAMLLPSVTAFSIPAAPARYADCARAMGIAAEQDSNEVANQKLLIELRSLNEELAVPTPQEFGIKRDEFFEVCQTMAEQALASGSPSNNPIEPSINEIISIYQGLWD

SEQ ID NO: 39839 - DNA, 1155 bp, Pseudomonas syringae pv. phaseolicola 1448A
  CDS (1)..(1155): transl_table=11
atgcacagcaacgactggcactacccgacttcaatccgtgcaggcgctggacgcgtcaatgaactggtcgacgcctgccggaagaccggcataaaacggccgttactgattaccgacagctttctcggcagcaccgatatgatcgccagcgccgtggaggattgccgcagccaattaggccattgcggcctgtttgaccgagtcaagggtaacccgaccggcaccaacgtcgccgagggcctgcacgcctacagaaccggtggctacgacggcgtcatcgcgtttggcggcggctcggcgctggacgctgccaaagcggtggcgctgatgtcaggccagacccgcccgttgtgggatttcgaagacatcggccagaaccacctgcgcgccgatccagacggtattgcgccagtagttgcgctgccgacgacggctggcaccggctctgaagtggggcgtgcgtcggtgattaccgatgaacaggcacaggtcaagcgcaccatcctgcacattcgcatgatgccgcgcattgcgattctggatgccacgctgaccctgaacctgccaacgcacctgactgccgcgacgggtgcggacgccttgactcactgcatggaatcctggtgttcaccggcctggcacccgatggccgaagcggtgtcggtcaagggcatgcagatgatcaaggaatatttgcctcgggttgttgctgacggccaggacctggaggcgcggcagcagatgctggtggcctccagcctgggtgccgccgcgtttcagcgcggtctgggtggcgtacacgcgattgctcagagcctgggggcgctctacgaccagcatcatggtttactgaatgcgattctgctgccctacgtgctggaggccaatcgctcggtgctgctgaagcaaatggatgatctggcggtttacctgcggttgcccacgcccggttttaccggggtaatggactggttactggcgctacgcgagcagatcggcattgcgcatacgctgggcgaaataggtatcgacgatcgcgacgccgagcgggtcggacgcatggcatttgccgacggctgctcgcacaccaatccgattcgtcattcggccgaggcgtatgcgcagatcttcagccgtgcagtgaagggcctgtga

SEQ ID NO: 39840 - protein, 384 aa, Pseudomonas syringae pv. phaseolicola 1448A
MHSNDWHYPTSIRAGAGRVNELVDACRKTGIKRPLLITDSFLGSTDMIASAVEDCRSQLGHCGLFDRVKGNPTGTNVAEGLHAYRTGGYDGVIAFGGGSALDAAKAVALMSGQTRPLWDFEDIGQNHLRADPDGIAPVVALPTTAGTGSEVGRASVITDEQAQVKRTILHIRMMPRIAILDATLTLNLPTHLTAATGADALTHCMESWCSPAWHPMAEAVSVKGMQMIKEYLPRVVADGQDLEARQQMLVASSLGAAAFQRGLGGVHAIAQSLGALYDQHHGLLNAILLPYVLEANRSVLLKQMDDLAVYLRLPTPGFTGVMDWLLALREQIGIAHTLGEIGIDDRDAERVGRMAFADGCSHTNPIRHSAEAYAQIFSRAVKGL

SEQ ID NO: 39841 - DNA, 1149 bp, Pseudomonas syringae pv. phaseolicola 1448A
  CDS (1)..(1149): transl_table=11
atgatcagcacctttttcatccccgcagtgaacatcatcggcactggctgcattgatgaagccatgctcgccattcgcaaatacggatttctcaaggcgctgatcgtgaccgacgcagggctggccaaggccggtgtggccagtcaggtcgcggggctgttggtggagcagggcatcgactcggtggtgtatgacggtgccaaacccaacccgaccatcgccaacgtcgagaacggtctggccttgctgcgggaacgccagtgtgatttcgtgatttctctgggcggcggttcacctcacgactgcgccaagggcattgccctgtgcgccagtaacggtgggcatatcagcgactatgaaggcgtcgaccgttcggcaaaaccgcagttgccgctgatcgcgatcaacaccaccgccggaaccgccagcgaaatgacccgcttctgcatcattaccgacgaagcgcgccacgtaaaaatggccatcattgaccgtaacgtgacgccactgttatccgtaaacgacccgaacatgatgattgccatgcccaagtcactgaccgctgccaccggtatggatgccttgactcacgcgatagaggcctatgtctcgacggctgccaatccgatcacggatgcctgcgcgttgcaggccatggcactgattgccaacaatctgcgcgacgccttcaccaatggagcgaacattactgcacgcgagaacatggcctacgcacagtttctggccggcatggcgttcaacaacgcatcattgggctatgtacacgccatggcgcatcaactgggcggcttctatgatttgccgcacggtgtgtgcaacgccgtattgctgcctcatgttcagcgtttcaacgccagcgtcagcgctgcgcgcctgactgatgttgcgcatgcgatgggctgcaatattcgtggtctttctccgcaagaaggtgctcaggcggcaatcgaggccattcgcgcactgtcggctgccgtggaaatcccggcggggctggcggtgcttggcgtcaaggaagaggatttcccgatcctggccaccaatgccctgaaagatgcgtgcggtctgaccaatccgcgtcgtgccgatcttgagcagattcaggagatatttcgtcaggcaatgtga

SEQ ID NO: 39842 - protein, 382 aa, Pseudomonas syringae pv. phaseolicola 1448A
MISTFFIPAVNIIGTGCIDEAMLAIRKYGFLKALIVTDAGLAKAGVASQVAGLLVEQGIDSVVYDGAKPNPTIANVENGLALLRERQCDFVISLGGGSPHDCAKGIALCASNGGHISDYEGVDRSAKPQLPLIAINTTAGTASEMTRFCIITDEARHVKMAIIDRNVTPLLSVNDPNMMIAMPKSLTAATGMDALTHAIEAYVSTAANPITDACALQAMALIANNLRDAFTNGANITARENMAYAQFLAGMAFNNASLGYVHAMAHQLGGFYDLPHGVCNAVLLPHVQRFNASVSAARLTDVAHAMGCNIRGLSPQEGAQAAIEAIRALSAAVEIPAGLAVLGVKEEDFPILATNALKDACGLTNPRRADLEQIQEIFRQAM

SEQ ID NO: 39843 - DNA, 2643 bp, Streptococcus pyogenes MGAS6180
  CDS (1)..(2643): transl_table=11
atgactgaaggacataatactgttgaaacaacctctgtttctgtgacaattaatgctcttgttcaaaaaggtttagctgctcttgaagagatgcgtaagcttgaccaagaacaagttgattatatcgtagccaaagcttctgttgctgccttggatgctcacggtgaacttgctaaacatgcttatgaagaaacaggtcgcggtgtctttgaagataaagcaacaaaaaatctatttgcttgtgagcatgtggttaataacatgcgccatcaaaaaacagtaggaattattgaagaagatgatgtgacaggtttgacattaattgctgagccggtgggtgttatctgtgggattacacccacaactaacccaacttcaacagctatctttaaatctttgatctcgttaaaaacacgtaatccaattatttttgcctttcacccatcagcacaagaatcatcagcacatgccgctcgtattgttcgtgatgctgctattgccgctggtgctcctgaaaattgtgtgcagtgggttgaaacaccatcacttgaagcaacaaatgctttgatgaatcatgacggcattgccactatccttgcgacaggtggaaatgcgatggttaaagcggcatactcatgtgggaaacctgcccttggggtaggtgctggtaacgttccagcttatgttgaaaaatcagctaatatccgtcaagccgctcatgatattgtgatgtctaaatcatttgataatggtatggtctgtgcctctgaacaagctgttatcatcgataaagaaatctacgacgattttgtagcagaattcaaatcttaccatacttattttgtaaataaaaaagaaaaagcccttcttgaagaattctgttttggtgccaaagcaaatagcaaaaactgtgctggtgcaaaattaaatccaaatattgtaggaaaaccagctacttggattgcagaacaagctggatttactgttccagaaggaaccaatattcttgctgcagaatgtaaagaagtttcagaaaatgagcctttaacacgtgaaaaattatctccagtcattgctgttttgaaatctgaatcacgtgaagacggtgttgaaaaagctcgtcaaatggttgaatttaatggactcggtcactcagctgccattcatacagcagatgcagagttggcaaaagaatttggaactagaatccgtgctatccgcgtcatctggaattcaccttctacatttggtggtatcggggatgtttacaatgctttcttgccatcattgactcttggttgtggttcgtatggacgtaacgcagttggtgataatgttagtgctataaatctcttgaacatcaaaaaagtaggaagacgtagaaataatatgcaatggtttaaagttccttcaaaaacatacttcgaacgtgattcaattcaatatttgcaaaaatgtcgtgacgttgaacgtgtcatgattgttacagatcacgctatggttgagcttggtttcttggatcgtatcattgaacaacttgatcttcgtcgcaataaagttgtttatcagatctttgctgaagtagaaccagatccagacattacaactgttatgaaaggtactgaattaatgcgtaccttcaaaccagacaccattattgcccttggcgggggatctcctatggatgcagccaaagttatgtggctcttctacgagcaaccagaagttgatttccatgacctcgttcaaaaattcatggatatccgcaaacgtgcgttcaaattcccagaacttggtaagaaaacaaaatttgttgctatcccaacaacttctggaacaggttcagaggtgacaccatttgccgttatctctgacaaagcaaataatcgtaaatatccaatcgctgattactcattaacaccaactgtagccattgttgacccagctttggtattgactgttccaggctttattgctgctgatactggtatggacgttttgacacacgcaaccgaagcttacgtgtcacaaatggccaatgactttacggatggtttagctcttcaagccattaaaattgtttttgataatcttgaaaaatcagttaaaatagccgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacggcgacatggcctaagtataattactaccgtgcggatgaaaaataccaagacattgcgaaattgttagggcttccagcttctacaccagaagaagcagtggaatcttatgcgaaagctgtttatgatctgggttgccgagttggtattcaaatgaacttcaaagctcaaggtatcgacgaaaatgaatggaaagaacattctcgtgaattggcttaccttgcttatgaagaccaatgttcacctgctaacccacgtcttccaatggttgatcacatgcaagaaattattgaagatgcttactatggttatgctgaacgtccaggacgacgtaagtga

SEQ ID NO: 39844 - protein, 880 aa, Streptococcus pyogenes MGAS6180
MTEGHNTVETTSVSVTINALVQKGLAALEEMRKLDQEQVDYIVAKASVAALDAHGELAKHAYEETGRGVFEDKATKNLFACEHVVNNMRHQKTVGIIEEDDVTGLTLIAEPVGVICGITPTTNPTSTAIFKSLISLKTRNPIIFAFHPSAQESSAHAARIVRDAAIAAGAPENCVQWVETPSLEATNALMNHDGIATILATGGNAMVKAAYSCGKPALGVGAGNVPAYVEKSANIRQAAHDIVMSKSFDNGMVCASEQAVIIDKEIYDDFVAEFKSYHTYFVNKKEKALLEEFCFGAKANSKNCAGAKLNPNIVGKPATWIAEQAGFTVPEGTNILAAECKEVSENEPLTREKLSPVIAVLKSESREDGVEKARQMVEFNGLGHSAAIHTADAELAKEFGTRIRAIRVIWNSPSTFGGIGDVYNAFLPSLTLGCGSYGRNAVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTELMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVLTVPGFIAADTGMDVLTHATEAYVSQMANDFTDGLALQAIKIVFDNLEKSVKIADFEAREKMHNASTMAGMAFANAFLGISHSMAHKIGAQFHTVHGRTNAILLPYVIRYNGTRPAKTATWPKYNYYRADEKYQDIAKLLGLPASTPEEAVESYAKAVYDLGCRVGIQMNFKAQGIDENEWKEHSRELAYLAYEDQCSPANPRLPMVDHMQEIIEDAYYGYAERPGRRK

SEQ ID NO: 39845 - DNA, 2643 bp, Streptococcus pyogenes MGAS5005
  CDS (1)..(2643): transl_table=11
atgactgaaggacataatactgttgaaacaacctctgtttctgtgacaattgatgctcttgttcaaaaaggtttagctgctcttgaagagatgcgtaagcttgaccaagaacaagttgattatatcgtagccaaagcttctgttgctgctttggatgctcacggtgaacttgctaaacatgcttatgaagaaacaggtcgcggtgtctttgaagataaagcaacaaaaaatctatttgcttgtgagcatgtggttaataacatgcgccatcaaaaaacagtaggaattattgaagaagatgatgtgacaggtttgacattaattgctgagccggtgggtgttatctgtgggattacaccaacaactaacccaacttcaacagctatctttaaatctttgatttcgttaaaaacacgtaatccaattatttttgcctttcacccatcagcacaagaatcatcagcacatgccgctcgtattgttcgtgatgctgctattgccgctggtgctcctgaaaattgtgtgcagtgggttgaaacaccatcacttgaagcaacaaatgctttgatgaatcatgacggcattgccactatccttgcgacaggtggaaatgcgatggttaaagcggcatactcatgtgggaaacctgcccttggggtaggtgctggtaacgttccagcttatgttgaaaaatcagctaatatccgtcaagccgctcatgatattgtgatgtctaaatcatttgataatggtatggtctgtgcctctgaacaagctgttatcatcgataaagaaatctatgacgattttgtagcagaattcaaatcttaccatacttattttgtaaataaaaaagaaaaagcccttcttgaagaattctgttttggtgccaaagcaaatagcaaaaactgtgctggtgcaaaattaaatccaaatattgtaggaaaaccagctacttggattgcagaacaagctggatttactgttccagaaggaaccaatattcttgctgcagaatgtaaagaagtttcagaaaatgagcctttaacacgtgaaaaattatctccagtcattgctgttttaaaatctgaatcacgtgaagacggtgttgaaaaagctcgtcaaatggttgaatttaatggactcggtcactcagctgccattcatacagcagatgcagaattggcaaaagaatttggaactagaatccgtgctatccgcgtcatctggaattcaccttctacatttggtggtatcggggatgtttacaatgctttcttaccatcattgactcttggttgtggttcgtatggacgtaacgcagttggtgataacgttagtgctataaatctcttgaacatcaaaaaagtaggaagacgtagaaataatatgcaatggtttaaagttccttcaaaaacatacttcgaacgtgattcaattcaatatttgcaaaaatgtcgtgacgttgaacgtgtcatgattgttacagatcacgctatggttgagcttggtttcttggatcgtatcattgaacaacttgatcttcgtcgcaataaagttgtttatcagatctttgctgaagtagaaccagatccagacattacaactgttatgaaaggtactgaattaatgcgtaccttcaaaccagacaccattattgcccttggcgggggatcccctatggatgcagccaaagttatgtggctcttctacgagcaaccagaagttgatttccatgacctcgttcaaaaattcatggatatccgcaaacgtgcgttcaaattcccagaacttggtaagaaaacaaaatttgttgctatcccaacaacttctggaacaggttcagaggtgacaccatttgccgttatctctgacaaagcaaataatcgtaaatatccaatcgctgattactcattaacaccaactgtagccattgttgacccagctttggtattgactgttccaggctttattgctgctgatactggtatggacgttttgacacacgcaaccgaagcttacgtgtcacaaatggccaatgactttacggatggtttagctcttcaagccattaaaattgtttttgataatcttgaaaaatcagttaaaacagccgattttgaagcacgtgaaaagatgcataatgcgtcaactatggcaggtatggctttcgccaatgcattcttaggtatttctcactcaatggcgcataaaattggcgcacaattccataccgtacacggacgtacaaatgcaattcttttgccgtatgttatccgctataatgggactcgtccagctaaaacggcgacatggcctaagtataattactaccgtgcggatgaaaaataccaagacattgcgaaattgttagggcttccagcttctacaccagaagaagcagtggaatcttatgcgaaagctgtttatgatctgggttgccgagttggtattcaaatgaacttcaaagctcaaggtatcgacgaaaacgaatggaaagaacattctcgtgaattggcttaccttgcttatgaagaccaatgttcacctgctaacccacgtcttccaatggttgatcacatgcaagaaattattgaagatgcttactatggttatgctgaacgtccaggacgacgtaagtga

SEQ ID NO: 39846 - protein, 880 aa, Streptococcus pyogenes MGAS5005
MTEGHNTVETTSVSVTIDALVQKGLAALEEMRKLDQEQVDYIVAKASVAALDAHGELAKHAYEETGRGVFEDKATKNLFACEHVVNNMRHQKTVGIIEEDDVTGLTLIAEPVGVICGITPTTNPTSTAIFKSLISLKTRNPIIFAFHPSAQESSAHAARIVRDAAIAAGAPENCVQWVETPSLEATNALMNHDGIATILATGGNAMVKAAYSCGKPALGVGAGNVPAYVEKSANIRQAAHDIVMSKSFDNGMVCASEQAVIIDKEIYDDFVAEFKSYHTYFVNKKEKALLEEFCFGAKANSKNCAGAKLNPNIVGKPATWIAEQAGFTVPEGTNILAAECKEVSENEPLTREKLSPVIAVLKSESREDGVEKARQMVEFNGLGHSAAIHTADAELAKEFGTRIRAIRVIWNSPSTFGGIGDVYNAFLPSLTLGCGSYGRNAVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTELMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVLTVPGFIAADTGMDVLTHATEAYVSQMANDFTDGLALQAIKIVFDNLEKSVKTADFEAREKMHNASTMAGMAFANAFLGISHSMAHKIGAQFHTVHGRTNAILLPYVIRYNGTRPAKTATWPKYNYYRADEKYQDIAKLLGLPASTPEEAVESYAKAVYDLGCRVGIQMNFKAQGIDENEWKEHSRELAYLAYEDQCSPANPRLPMVDHMQEIIEDAYYGYAERPGRRK

SEQ ID NO: 39847 - DNA, 1131 bp, Ralstonia eutropha JMP134
  CDS (1)..(1131): transl_table=11
atggctgtcatcaactacctgactaccgttcacatcgacttcggcgccatccggatgctgggggccgagctgcagcgcctgggcatccagcgaccgctgatcgtcaccgaccggggcatccgcgccgccggtatcgccgacaaggtgctcgacgccctgggcccagattgcacgcccactgtcttcgaggacaccccatccaacccgacggaagccgccgtgtccgccgcgaccggcctttacctcggcaatggctgcgacggcatcgtggccgtgggcggcgggtcgcccatcgacctgggcaaggccaccgcgctgctggcgacccacccggcaccgctgcagacctacgcggcggtggagggcggcgcgagccggatcaccagccgggtcgccccgctggtggccatcccgacgactgcgggtaccggtagcgaagtgggccggggcgctgtcatcgtcatggagtccggccgcaagctcggcctgcttagtccgttcctgctgccgaagctcgccatctgcgaccccgaactcacgctgggattgcctccggccctgaccgccgcgaccggcatggacgccatcgcccactgcatcgagaccttcctggcgccggccatcaacccgcccgccgaggcgatcgccctggacggcctgtgccgcggcgtggccaatatcggcaaggccaccgccgacggctgcgaccgcgacgcgcgctggaacatgatgatggccgccatggaaggcgcgctggccttccagaaggggctgggcgcggtgcatgccctgtcgcacccgctgggcgcggtgcccggcgtctcgttgcaccacggcacgctgaacgccgtgctgctgccggccgtgctgcgcttcaacaagccggcgaccgaagccaagcaggccgcactggtgcaggccatgggcctgcccgccggcgcggacccggctctggccatcagcgaactcaacgcccgtcttggcttgccggctggtctcggcgccatgggtgtgccgcgtgacgtgctggagaacatcgcggtcgccgccacgaaggaccactgccacgccaccaatccccgcactgccacggtcgatgactacctggcgatgctgcaagaatcgtattga

SEQ ID NO: 39848 - protein, 376 aa, Ralstonia eutropha JMP134
MAVINYLTTVHIDFGAIRMLGAELQRLGIQRPLIVTDRGIRAAGIADKVLDALGPDCTPTVFEDTPSNPTEAAVSAATGLYLGNGCDGIVAVGGGSPIDLGKATALLATHPAPLQTYAAVEGGASRITSRVAPLVAIPTTAGTGSEVGRGAVIVMESGRKLGLLSPFLLPKLAICDPELTLGLPPALTAATGMDAIAHCIETFLAPAINPPAEAIALDGLCRGVANIGKATADGCDRDARWNMMMAAMEGALAFQKGLGAVHALSHPLGAVPGVSLHHGTLNAVLLPAVLRFNKPATEAKQAALVQAMGLPAGADPALAISELNARLGLPAGLGAMGVPRDVLENIAVAATKDHCHATNPRTATVDDYLAMLQESY

SEQ ID NO: 39849 - DNA, 1149 bp, Ralstonia eutropha JMP134
  CDS (1)..(1149): transl_table=11
atggcctttatctactatctgacgcacattcatctcgactttggcgccgtgagcctgctaaaggccgaatgtgaacgcatcggcatccgccgcccgctgctagtgacggacaagggcgtggtcgcagccggcgtggcacagcgagcgatcgacgcgatgcagggcctgccggtggcggtgtttgacgagacgccgtcgaatccgaccgaagccatggtgcgcaaggccgccgagcagtaccgtgacgcaggctgcgacgggctggtggcggtcggcggcggttcgtcgatcgatctcgccaagggcatcgcgatcatcgccacgcacccgggcgaactgacgacctacgccaccatcgaaggcggcagcacgaagatcaccgagcgcgccgcgccgctgatcgccgtgccgaccacatcgggcaccggcagcgaagtggcgcgcggcgcgatcatcatcctcgaagacgggcgcaagctcggcttccattcgtggcacctgctgccgaaatcggccatctgcgacccggaactcacgctggggctgcctgcgggcctgaccgccgcgaccggcatggacgccattgcccattgcgtcgagaccttcctggcacctgccttcaacccgcccgccgacggcattgcgctggatggcctggagcgaggctgggcccacatcgaacgcgccacgcgcgacggcaaggaccgcgacgcgcggctcaacatgatgagcgcgtcgatgcagggcgccatggcgttccagaagggccttggctgcgtgcattcgctgtcgcacccgctcggcggactgaagatcgacggcaagaccggcctgcaccacggcaccctcaacgcggtggtcatgcccgcggtgctgcgcttcaacgccgacgcgcccaccgtggtgcgcgacgaccgctacgcgcgcctgcgccgcgccatgcacctgcccgaaggcgccgacgtcgcccaggccgtgcacgacatgacggcccggctggggctgccgaccgggctgcgccagatgggcgtcaccgaagacatgttcgacaaggtgattgcgggcgccctgctcgaccactgccacaagaccaatccaaaagaggccagcgcggcggattatcggcgtatgcttggagcgtccatgtag

SEQ ID NO: 39850 - protein, 382 aa, Ralstonia eutropha JMP134
MAFIYYLTHIHLDFGAVSLLKAECERIGIRRPLLVTDKGVVAAGVAQRAIDAMQGLPVAVFDETPSNPTEAMVRKAAEQYRDAGCDGLVAVGGGSSIDLAKGIAIIATHPGELTTYATIEGGSTKITERAAPLIAVPTTSGTGSEVARGAIIILEDGRKLGFHSWHLLPKSAICDPELTLGLPAGLTAATGMDAIAHCVETFLAPAFNPPADGIALDGLERGWAHIERATRDGKDRDARLNMMSASMQGAMAFQKGLGCVHSLSHPLGGLKIDGKTGLHHGTLNAVVMPAVLRFNADAPTVVRDDRYARLRRAMHLPEGADVAQAVHDMTARLGLPTGLRQMGVTEDMFDKVIAGALLDHCHKTNPKEASAADYRRMLGASM

SEQ ID NO: 39851 - DNA, 2676 bp, Shigella sonnei Ss046
  CDS (1)..(2676): transl_table=11
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttgcaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggctcgtatcctgattaacaccccagcgtctcagggtggtatcggtgacctgtataacttcaaactcgcaccttccctgactctgggttgtggttcctgggggggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagattatgtgggttatgtacgaacatccggaaactcacttcgaagagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcaactatcgcgggtatcgcatttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagatcctgctggatacctactacggtcgtgattatgtagaaggtgaaactgcagcgaaaaaagaagccgctccggctaaagctgagaaaaaagcgaaaaaatccgcttaa

SEQ ID NO: 39852 - protein, 891 aa, Shigella sonnei Ss046
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 39853 - DNA, 1215 bp, Shigella sonnei Ss046
  CDS (1)..(1215): transl_table=11
gtgggcgagagaaagcggaggggctatatgcaaaatgaattgcagaccgcgctctttcaggcgttcgataccctgaatctgcaacgggtaaaaacatttagcgttccaccggtgacgctttgcggtccgggctcggtgagcagttgcggacagcaagcgcaaacgcgtgggctgaaacatctgttcgtgatggcagacagctttttgcatcaggcagggatgaccgccgggctgacgcgcagcctggctgttaaaggcatcgccatgacgctctggccatgtccggtgggcgaaccgtgcatcaccgacgtgtgtgcagccgtggcgcagttgcgtgagtcaggctgtgatggggtgatcgcatttggcggcggctcggtgctggatgcggcgaaagccgtggcgttgctggtgacgaacccggatagcacgctggcagagatgtcagaaaccagcgttctgcaaccgcgcttgccgctgattgccattccaacgaccgccggaaccggctctgaaaccaccaatgtaacggtgattatcgacgcggtgagcgggcgcaagcaggtgttagcccatgcctcgctgatgccggatgtggcgattctcgacgccgcgttgaccgaaggtgtgccgtcgcatgtcacggcgatgaccggcattgatgcgttaacccatgccattgaagcatacagcgccctgaacgctacaccgtttaccgacagtctggcgattggtgccattgcgatgattggcaaatcgctgccgaaagcggtgggctacggtcacgaccttgccgcgcgcgagagcatgttgctggcttcatgtatggcgggaatggcgttttccagtgcgggtcttgggttgtgccacgcgatggcgcatcagccgggcgcggcgctgcatattccacacggtctggcgaacgccatgttgctgccaacggtgatggaatttaaccggatggtttgtcgtgaacgctttagtcagattggtcgggcactgcgaactaaaaaatccgacgatcgtgacgctattaacgcggtaagtgagctgattgcggaagttgggattggtaaacgactgggcgatgttggtgcgacatctgcgcattacggcgcatgggcgcaggccgcgctggaagatatttgtctgcgcagtaacccgcgtaccgccagcctggaacagattgtcggactgtacgcggcggcgcaataa

SEQ ID NO: 39854 - protein, 404 aa, Shigella sonnei Ss046
MGERKRRGYMQNELQTALFQAFDTLNLQRVKTFSVPPVTLCGPGSVSSCGQQAQTRGLKHLFVMADSFLHQAGMTAGLTRSLAVKGIAMTLWPCPVGEPCITDVCAAVAQLRESGCDGVIAFGGGSVLDAAKAVALLVTNPDSTLAEMSETSVLQPRLPLIAIPTTAGTGSETTNVTVIIDAVSGRKQVLAHASLMPDVAILDAALTEGVPSHVTAMTGIDALTHAIEAYSALNATPFTDSLAIGAIAMIGKSLPKAVGYGHDLAARESMLLASCMAGMAFSSAGLGLCHAMAHQPGAALHIPHGLANAMLLPTVMEFNRMVCRERFSQIGRALRTKKSDDRDAINAVSELIAEVGIGKRLGDVGATSAHYGAWAQAALEDICLRSNPRTASLEQIVGLYAAAQ

SEQ ID NO: 39855 - DNA, 1152 bp, Bifidobacterium longum DJO10A
  CDS (1)..(1152)
atggtgtaccgcatgattttcaaccagactgcatacttcggacgtggcgcgatcaaggaaatcccggccgtcgccaagcagcacggcttcaccaaggcatttatcgtcactgatccggtactgctggagaccggcaccgccgagaaggtcaccaaggttctggatgaggccggcctgccgtacgaggtgttctccaacgtcaagccgaacccgccggtcgagtgcatcaaggacggcgtcgccaagttcgccgactccggtgcggacttcctgatcggcctgggcggcggctccccgcaagacacctgcaagggcatcggcatcatcaccgccaacccggagttcgccgacgtgctctccctggaaggcgtcgcggataccaagaacccgtccgtcccgatcttcggcgtgccgaccaccgccggtaccgcttccgagacgaccatcaactacgtggtcaccgataccgccaacaagcgcaagttcgtggccgtcgacccgcacgacatcccgatcgtcgccttcgtggacccggatctgaccgactccatgccgcgcggcctgaaggtcgccaccggacttgacgccctgacccacgccatcgagggttacattaccccgggtgcctggagcctgtccgactgcctgtccatgcagaccatccgcatgattgccaagaacctggccaagtccgccgacggcgacattccggccggcgagcagatggcctacgcctcctacatcaccggtatggcctactccaacgtgggcctcggtctggtgcacggcatggctcacccgctgggcggccgtctgggcgtggcccacggtgtggccaacggtattctgctggccccggtcatggaatacaacaaggacttcaccggtgagaagtaccgcgacatcgccgatgcgttcggtgttgaggacgcctacaccggcgacctggagaaggtgcgcgaagaggccgtgcaggccgtccacaagctgaccgtggatctgaagaacccgaccacgatttccgaagtgggcgccaccgaggccgaccttgagccgctggctcacgacgccttcaacgacgtgtgcacccccggcaacccgcgtcaggcaaccgaagaggacatcctcgcgatttacaagtcgctgatgtga

SEQ ID NO: 39856 - protein, 383 aa, Bifidobacterium longum DJO10A
MVYRMIFNQTAYFGRGAIKEIPAVAKQHGFTKAFIVTDPVLLETGTAEKVTKVLDEAGLPYEVFSNVKPNPPVECIKDGVAKFADSGADFLIGLGGGSPQDTCKGIGIITANPEFADVLSLEGVADTKNPSVPIFGVPTTAGTASETTINYVVTDTANKRKFVAVDPHDIPIVAFVDPDLTDSMPRGLKVATGLDALTHAIEGYITPGAWSLSDCLSMQTIRMIAKNLAKSADGDIPAGEQMAYASYITGMAYSNVGLGLVHGMAHPLGGRLGVAHGVANGILLAPVMEYNKDFTGEKYRDIADAFGVEDAYTGDLEKVREEAVQAVHKLTVDLKNPTTISEVGATEADLEPLAHDAFNDVCTPGNPRQATEEDILAIYKSLM

SEQ ID NO: 39857 - DNA, 1152 bp, Actinobacillus pleuropneumoniae serovar 1 str. 4074
  CDS (1)..(1152)
atgtcaaatcgtttgattctgaatgaaaccagttaccacggtaaaggcgcgattcagcatattgtgtatgaagtcaaaagtcgcagttttaagaaagcgttagtggttaccgataaagatttaattaagtataacgtcgcttctaaagtaaccgatttattggatacggcaggtttaccgtatgaaatttttgatgaagttaaagcgaatccgtcggtcgatgtgatcaaagccggtgtagaaaaatttaaagcatccggtgcggattatctgattgccatcggtggcggatccccgattgatagtgcgaaagcaatcgggattatcatcaataaccctgaatttagcgatgtattatcgttagaaggtgtggcaccgacgcatcaaaaatgtattccgatcattgcagtaccaaccaccgctggtacggcagcagaggttacaattaattacgtgattaccgatgaagagaaaaaacgtaagttcgtttgtgtggatgtgcacgacgtaccggcggttgcggtggttgatccggatatgatgtcctctatgccgaaaggcttaaccgcggcaaccggtatggatgctttaacccatgcgattgaaggttatatcactaaagcggcgtgggaattaaccgatgcgttacacttaaaagcgatcgaaattattgctcgtagcttacgcagtgcggtggaaaatgatccgcaagggcgtgagggaatggctctcggtcaatatgttgccggtatgggtttctcaaatgtcggtttgggtgtagtacacggaatggcacatcctctttctgcttattacgatacgccgcacggtatcgccaacgcggtgttattaccttatgtgatggaatttaataaaaattacacgggtgagaaatatcgtgaaatcgcacgcgcgatgggcgtgaaaggcgtggatgaaatggctcaagcggaataccgagatgcagcagtagcagcggtaaaacagcttgcgatagatgtcggtattccggaaaaactttcgcaaatcggagtaaaagaagaagatttggttgcgctttctattgatgcgtttaacgacgtatgtacgccgggaaatccgagagagtgtacggcggaagaaattttggaagtatataaattagcttattaa

SEQ ID NO: 39858 - protein, 383 aa, Actinobacillus pleuropneumoniae serovar 1 str. 4074
MSNRLILNETSYHGKGAIQHIVYEVKSRSFKKALVVTDKDLIKYNVASKVTDLLDTAGLPYEIFDEVKANPSVDVIKAGVEKFKASGADYLIAIGGGSPIDSAKAIGIIINNPEFSDVLSLEGVAPTHQKCIPIIAVPTTAGTAAEVTINYVITDEEKKRKFVCVDVHDVPAVAVVDPDMMSSMPKGLTAATGMDALTHAIEGYITKAAWELTDALHLKAIEIIARSLRSAVENDPQGREGMALGQYVAGMGFSNVGLGVVHGMAHPLSAYYDTPHGIANAVLLPYVMEFNKNYTGEKYREIARAMGVKGVDEMAQAEYRDAAVAAVKQLAIDVGIPEKLSQIGVKEEDLVALSIDAFNDVCTPGNPRECTAEEILEVYKLAY

SEQ ID NO: 39859 - DNA, 1170 bp, Pediococcus pentosaceus ATCC 25745
  CDS (1)..(1170)
atgaaagaaaattttgatttccttatgcctagtgtcaacttctttggctctggagttattgcaaagattggtgaccgcgctaagatggtcaatatgtctaaagtattgatcgttactgataaatttttggaaaaaatggaaaatggacccgttgaacaaacccttcgttcacttgatcaagcgggtgtcgattacgttatttacaacggagtagagcctaatcctaaagttagaaatatccaagaagcaaaacaagtttatttggataatgactgtgatggaattatcactattggtggtggttcagctcatgatgctggaaaaggtactggtattattttgacgaatggcgacgatatcaccaaacttgctggaatcgaaacgctcgaaaatgcacttccaccattgatcgcggttaatactactgcaggaactgcttcagaattaactcgtcactgcgttattaccaacgaagaaacgcatcttaagttcgtagtggtttcgtggcgtaatgttcccctcgtatcatttaatgatccaaaattaatgctcggggttccacctgctctaactgctgcaactgggatggacacatttgtccaagccattgaaccttacgtttctactaaccgcaacgatattactgatggtcaatgtctccaagctatcaagttagtggaagaaagccttcgtgaagctgtatctaacggtgaaaacctagaagctagaactaagatggtagaagctgaaatgttgggagggatggctttcaataatgccgatcttggttacgtacatgctatggcccatcaattaggtggacaatacgacgctcctcatggcgtttgctgtgctatcctattaccaattgtagaacgcttcaacttagttgcttgccctgatcgtttcgcagacttagctgtcgccatgggtgaaaatatcgacggcctttccattagagctgccgctgataaagctattgatgccatgcaacaacttaacgacgatgttggtattccaagaagtatcaaagatttgggtgctgatcctaaagatttcgaactaatggctgaaaatgctttgaaggatggcaatgccttctccaacccacgcaaagctactaagcaacaaattgtggaacttttccaacaagcttacgacgcaaaataa

SEQ ID NO: 39860 - protein, 389 aa, Pediococcus pentosaceus ATCC 25745
MKENFDFLMPSVNFFGSGVIAKIGDRAKMVNMSKVLIVTDKFLEKMENGPVEQTLRSLDQAGVDYVIYNGVEPNPKVRNIQEAKQVYLDNDCDGIITIGGGSAHDAGKGTGIILTNGDDITKLAGIETLENALPPLIAVNTTAGTASELTRHCVITNEETHLKFVVVSWRNVPLVSFNDPKLMLGVPPALTAATGMDTFVQAIEPYVSTNRNDITDGQCLQAIKLVEESLREAVSNGENLEARTKMVEAEMLGGMAFNNADLGYVHAMAHQLGGQYDAPHGVCCAILLPIVERFNLVACPDRFADLAVAMGENIDGLSIRAAADKAIDAMQQLNDDVGIPRSIKDLGADPKDFELMAENALKDGNAFSNPRKATKQQIVELFQQAYDAK

SEQ ID NO: 39861 - DNA, 1149 bp, Shewanella baltica OS155
  CDS (1)..(1149): transl_table=11
atggctgctaaattttttattccttctgtcaacgtgttaggccaaggcgcagtggatgacgctatcggtgacatcaaaaccttaggctttaaacacgcactcatagtgacagacaaacccttagtcaaaattggcttagtcggtgaagtggccgaaaaacttggtcaaaatggcattacctccaccatctatgatggcgtacaacctaacccaaccgtaacgaacgtcgaagcaggtttagccctgttaaaagccaacaagtgtgactttgtgatttcactcggtggcggctcaccccatgattgcgccaaaggtatcgcccttgttgccaccaatggcggcagcattaaggattacgaagggttagatcaatccgcaaaaccacagttgccattagtggctattaatacgacggcaggtactgccagtgaaatgacgcgcttctgtatcattaccgacgaagcccgccacattaaaatggcgattgtcgataagcacaccacgcctttgctgtcggtcaatgaccctgaactcatgctgaaaaagcctgcgagcctcacggccgcaaccggtatggatgcactgactcacgcggttgaagcctatgtgtctattgctgccaacccgatcaccgacgcctgcgcgatcaaggctatggaattgattcaggctaacttagtcaacgcggttgaaaacggtcaagacatcaatgcccgtgaacaaatggcctacgcacagttcttagcgggtatggcctttaacaatgccagcttaggttatgtgcatgcgatggcgcaccagttaggcggtttctacgatctgccccacggtgtgtgtaacgccctgctgctgccccatgtacaggaatacaacgcccaggtcgtccctgctcgcttgaaagacattgccaaggctatgggtgtggatgtgtccagcatgaccgatgagcaaggtgccagtgcggcgatagcggcaatcaaaaagctgtcttttgcggttaagatcccagaaaacctgaccttgttaggcgtaaaagcggaagatattccaacacttgcggataacgcgttaaaagatgcctgtggattcaccaatccaaaacaagcgacccaagcggagatctgtcagatcttcactaatgcgctgtag

SEQ ID NO: 39862 - protein, 382 aa, Shewanella baltica OS155
MAAKFFIPSVNVLGQGAVDDAIGDIKTLGFKHALIVTDKPLVKIGLVGEVAEKLGQNGITSTIYDGVQPNPTVTNVEAGLALLKANKCDFVISLGGGSPHDCAKGIALVATNGGSIKDYEGLDQSAKPQLPLVAINTTAGTASEMTRFCIITDEARHIKMAIVDKHTTPLLSVNDPELMLKKPASLTAATGMDALTHAVEAYVSIAANPITDACAIKAMELIQANLVNAVENGQDINAREQMAYAQFLAGMAFNNASLGYVHAMAHQLGGFYDLPHGVCNALLLPHVQEYNAQVVPARLKDIAKAMGVDVSSMTDEQGASAAIAAIKKLSFAVKIPENLTLLGVKAEDIPTLADNALKDACGFTNPKQATQAEICQIFTNAL

SEQ ID NO: 39863 - DNA, 1149 bp, Shewanella amazonensis SB2B
  CDS (1)..(1149): transl_table=11
atggctgcgaaattttttatcccttctgttaacgtgctcggccagggcgccgtagacgaggccatcggtgacatagtcaccctgggttttaaacaggccctgatagtcacagataaacctttggtacagataggtattgccggtgaactggtggaaaaactcggtgagcgcggtattaccgccgtcgtgttcgatggtgtacaacccaaccccacaacagccaacgtggaggcgggccttgcactgctcaacgcccatggctgtgactttgtgatttccctcggcggcggctcgccccacgactgcgccaagggcatcgccctggtcgccaccaatggcggcagcatcaaagactacgaaggcgtcgataagtccgccaagccacagttgcccctggttgccatcaatactaccgccggcaccgccagtgaaatgacccgcttttgcatcatcaccgacgaggctcgccatattaaaatggccatcgtcgacaagcacaccacccccattctgtcggtgaacgatcctgagttgatggtgaaaaagccagctgccttgaccgcggccaccgggatggatgccctgacccacgccgttgaggcttatgtgtctgttgccgccaatcccatcacagatgcctgcgccatcaaggccatcgagcttattcagcaataccttgagcgggcggtgaaacaggggcaggacctacaggcccgcgagcaaatggcctatgcccagttcctcgccggtatggcctttaacaacgccagcctgggttatgtgcacgctatggcccaccagctcggtggcttctacgacctgccccacggtgtctgtaacgccctgttgctgccatacgtgcaggaatacaacgcggcggtggcggcggcacgtttgaaagatgtcgccaaagccatgggtgttgccgtagacgggcttgatgaccaagaaggtgccaaggccgccattagtgccatcaaggcgctgtccaaggcggtaaacatcccggagaatctgactgtgcttggcgtaaaagaagaggatattccgttactggccgacaacgccctcaaagatgcctgcggatttaccaaccccaaacaggccacccatgaggaaatctgtcagattttctgtaacgcactttaa

SEQ ID NO: 39864 - protein, 382 aa, Shewanella amazonensis SB2B
MAAKFFIPSVNVLGQGAVDEAIGDIVTLGFKQALIVTDKPLVQIGIAGELVEKLGERGITAVVFDGVQPNPTTANVEAGLALLNAHGCDFVISLGGGSPHDCAKGIALVATNGGSIKDYEGVDKSAKPQLPLVAINTTAGTASEMTRFCIITDEARHIKMAIVDKHTTPILSVNDPELMVKKPAALTAATGMDALTHAVEAYVSVAANPITDACAIKAIELIQQYLERAVKQGQDLQAREQMAYAQFLAGMAFNNASLGYVHAMAHQLGGFYDLPHGVCNALLLPYVQEYNAAVAAARLKDVAKAMGVAVDGLDDQEGAKAAISAIKALSKAVNIPENLTVLGVKEEDIPLLADNALKDACGFTNPKQATHEEICQIFCNAL

SEQ ID NO: 39865 - DNA, 1152 bp, Enterococcus faecium DO
  CDS (1)..(1152): transl_table=11
atgagtaatcgaatgattttaaatgaaacatcgtattttggaaaaggagcgattgagtcgatcgtccctgaatttcagcagcgaggattcggcaaagcagctgtcattactgacaaaggattgatcgagcacggtatagcaacaaaagtaacagaacttctagataaagcagcaatcgcttatgctttatacgacgggatcgtacctaatccaacgatccaaaatgtaaaagatggagtggcttttgttaaagaggcagaggcagactgtttgatcgcaatcggtggaggttcgccaatcgatacggcaaaagccattgggattattttgacgaatccagagttttcagacgtcattagtttagaaggtgttgctgatacgaaaaatccatgtttacctatattagctataccaacgacttctggaacagcagcagaagtaacgatcaactacgtcatcacagatgaagtaaatcaccgaaaatttgtttgtgttgatcctcatgatatcccaatcgtcgcgttcatcgacagcgatatgatgatgggaatgccgaaaaaattggctgcatcaacaggtatggatgctatgacgcatgctattgaagggtttatcacaaaaggcgcttgggaaatgactgatatgctgcatttaaaagcaatcgaaatcatcggccattctttggaagtttctgtagatggcgatcaaaatgggcgagaaaaaatggcattaggacagtatattgcgggaatgggcttctcaaatgtcggtttaggactggtacacgggatggctcacccgttaagtgcatggtacaacattcctcatggcgtagcgtgtgcagcacttttgccaactgtcatgaaatataacaaagaatatactggagaaaagtaccgtgagatcgctcttgttctagggattaaaggagcagctgaaatgtctttagaagatgtaagagaagcggcttgtggtgagatcgatcggttgagcaaagcggttggaatcccagaaaccatttctgaattaggtgtaaaagaagcagatattccagcaattgcagaagatgctttgcgagatgtatgcacaccaggaaatccaagagaaacgacagtagaagaaatcattgctttatatcaaagtttgatgtaa

SEQ ID NO: 39866 - protein, 383 aa, Enterococcus faecium DO
MSNRMILNETSYFGKGAIESIVPEFQQRGFGKAAVITDKGLIEHGIATKVTELLDKAAIAYALYDGIVPNPTIQNVKDGVAFVKEAEADCLIAIGGGSPIDTAKAIGIILTNPEFSDVISLEGVADTKNPCLPILAIPTTSGTAAEVTINYVITDEVNHRKFVCVDPHDIPIVAFIDSDMMMGMPKKLAASTGMDAMTHAIEGFITKGAWEMTDMLHLKAIEIIGHSLEVSVDGDQNGREKMALGQYIAGMGFSNVGLGLVHGMAHPLSAWYNIPHGVACAALLPTVMKYNKEYTGEKYREIALVLGIKGAAEMSLEDVREAACGEIDRLSKAVGIPETISELGVKEADIPAIAEDALRDVCTPGNPRETTVEEIIALYQSLM

SEQ ID NO: 39867 - DNA, 1158 bp, Clostridium pasteurianum
  CDS (1)..(1158): transl_table=11
atgagaatgtatgattttttagcaccaaatgtaaactttatgggagcaggtgcaataaaattagtgggagaaagatgtaaaatattaggcggaaagaaagctttaatagttacagataaattcttgagaaatatggaagatggagctgtagctcaaacggttaaatatattaaagaagcaggaatagatgttgctttttatgatgatgtagagcctaatcctaaggatactaatgttagagatggattaaaagtatatagaaaagaaaactgtgatttaatagttactgtaggaggaggaagttctcatgactgtggaaagggaataggtattgcagctacacacgagggagatctttatgactatgctggtatagaaacccttactaatccattgcctccgatagtagctgtaaatacaacagctggaacaggcagcgaggttactcgtcattgtgttatcacaaacacaaaaacaaagattaaatttgttattgtaagctggagaaatctgccgttagtatccattaatgatccaatacttatgattaaaaagcctgcaggattaacagcagctacaggaatggatgccttaactcatgccatagagtcctatgtttctaaagatgcaaacccagtaacagatgccttagctatacaagcaataaaattaatagctaacaatctgcgtcaggcagtagcccttggagaaaatctggaagctagagaaaatatggcctacgcatcacttctggcaggaatggcatttaataatgcaaatttaggatatgtacatgctatggcacatcaattaggaggcctgtatgatatggcacatggtgttgccaatgccatgttattaccacatgtagaacgctataatcttatatcaaatcctaagaaatttgcagatatagcagaattcatgggagagaatattgaaggactttcagtaatggaagcagcagaaaaagctatagatgctatgtttagactttcaaaggatgttgggataccagcaagtcttaaagaaatgggagttaatgaaggagattttgaatatatggcaaaaatggcattgaaagatggaaatgcattcagtaatccaagaaaaggtaatgaaaaagatatagttaaaatatttagagaagcattttaa

SEQ ID NO: 39868 - protein, 385 aa, Clostridium pasteurianum
MRMYDFLAPNVNFMGAGAIKLVGERCKILGGKKALIVTDKFLRNMEDGAVAQTVKYIKEAGIDVAFYDDVEPNPKDTNVRDGLKVYRKENCDLIVTVGGGSSHDCGKGIGIAATHEGDLYDYAGIETLTNPLPPIVAVNTTAGTGSEVTRHCVITNTKTKIKFVIVSWRNLPLVSINDPILMIKKPAGLTAATGMDALTHAIESYVSKDANPVTDALAIQAIKLIANNLRQAVALGENLEARENMAYASLLAGMAFNNANLGYVHAMAHQLGGLYDMAHGVANAMLLPHVERYNLISNPKKFADIAEFMGENIEGLSVMEAAEKAIDAMFRLSKDVGIPASLKEMGVNEGDFEYMAKMALKDGNAFSNPRKGNEKDIVKIFREAF

SEQ ID NO: 39869 - DNA, 1152 bp, Zymomonas mobilis
  CDS (1)..(1152): transl_table=11
atggcttcttcaactttttatattcctttcgtcaacgaaatgggcgaaggttcgcttgaaaaagcaatcaaggatcttaacggcagcggctttaaaaatgcgctgatcgtttctgatgctttcatgaacaaatccggtgttgtgaagcaggttgctgacctgttgaaagcacagggtattaattctgctgtttatgatggcgttatgccgaacccgactgttaccgcagttctggaaggccttaagatcctgaaggataacaattcagacttcgtcatctccctcggtggtggttctccccatgactgcgccaaagccatcgctctggtcgcaaccaatggtggtgaagtcaaagactacgaaggtatcgacaaatctaagaaacctgccctgcctttgatgtcaatcaacacgacggctggtacggcttctgaaatgacgcgtttctgcatcatcactgatgaagtccgtcacgttaagatggccattgttgaccgtcacgttaccccgatggtttccgtcaacgatcctctgttgatggttggtatgccaaaaggcctgaccgccgccaccggtatggatgctctgacccacgcatttgaagcttattcttcaacggcagctactccgatcaccgatgcttgcgctttgaaagcagcttccatgatcgctaagaatctgaagaccgcttgcgacaacggtaaggatatgccggctcgtgaagctatggcttatgcccaattcctcgctggtatggccttcaacaacgcttcgcttggttatgtccatgctatggctcaccagttgggcggttactacaacctgccgcatggtgtctgcaacgctgttctgcttccgcatgttctggcttataacgcctctgtcgttgctggtcgtctgaaagacgttggtgttgctatgggtctcgatatcgccaatctcggtgataaagaaggcgcagaagccaccattcaggctgttcgcgatctggctgctcccattggtattccagcaaacctgaccgagctgggtgctaagaaagaagatgtgccgcttcttgctgaccacgctctgaaagatgcttgtgctctgaccaacccgcgtcagggtgatcagaaagaagttgaagaactcttcctgagcgctttctaa

SEQ ID NO: 39870 - protein, 383 aa, Zymomonas mobilis
MASSTFYIPFVNEMGEGSLEKAIKDLNGSGFKNALIVSDAFMNKSGVVKQVADLLKAQGINSAVYDGVMPNPTVTAVLEGLKILKDNNSDFVISLGGGSPHDCAKAIALVATNGGEVKDYEGIDKSKKPALPLMSINTTAGTASEMTRFCIITDEVRHVKMAIVDRHVTPMVSVNDPLLMVGMPKGLTAATGMDALTHAFEAYSSTAATPITDACALKAASMIAKNLKTACDNGKDMPAREAMAYAQFLAGMAFNNASLGYVHAMAHQLGGYYNLPHGVCNAVLLPHVLAYNASVVAGRLKDVGVAMGLDIANLGDKEGAEATIQAVRDLAAPIGIPANLTELGAKKEDVPLLADHALKDACALTNPRQGDQKEVEELFLSAF

SEQ ID NO: 39871 - DNA, 1149 bp, Pseudomonas putida
  CDS (1)..(1149): transl_table=11
atgagtgtttctgcctttcaaatcgccaataagctcctgaccggggccagcgcggtagaacagcttgatgctgagttgacccggttgaaggtgagtaatccattgatcgtgaccgatgcgatcctgctcaagtcgggcacagtcgacctcgccttggcccacttgggtggccgcagttatggcctttacgaccaggctcaaccggagcctgaaatcagtttggtcgaagactgtacccgcgcctttcgcgaggggggccatgatgggctgattgggttgggaggaggaagcgctatcgacatcgcgaaaggtgtcgcggccttcgccggacacgacggcgctctggccgacctgttcggcgtcgatcaggtcagccgcaaggggccgcccctgatcgcgattcctaccactgcaggcacgggttcggaggtactaacgtggcgatcttttccgacaagaaagcgcagctcaagaaaggcattggtgagtgactacctgctgcctgacgttgctctcgtaagtcccggtcttgacgcgcacctgcccacgaacgtaagccgtgccagcggtgtcgatgcacttgtgcatgcgatcgaagcgtacctttcgatcaatcgctcgccgatcaccgacgccattgcccttggagccattaaactgatcgctcgcgctttgcctaaagcgtatgccaaccccgatgatcttgctgcccgggaagacatggctacagcgagtctgatgggcggcatggcttttggaaacgcaggcgtaggggcagtacatgcgctggcctatccgctgggcgggcgcttcaacatagcccacggcgtcagcaatgctttgctgctgccccatgtcatgcgctggaacaagcttgcctgtacggagcgccttcgcgacgtcgcccaggcaatgggcgtgaatatcgccgggttgagcgatagccaggccgcagacgccagtgtcgatgcgatggctgagctgtgtgctgctgtagacattcctaccggtcttcgcgcgttcaacgttccgcaggacgctttggcacccatggccgaggaggccagcaagattgaccggttgatgcgcaataacccgcgcaaattcacggctggggatatcgaggcgatttaccgggctgcctggtaa

SEQ ID NO: 39872 - protein, 382 aa, Pseudomonas putida
MSVSAFQIANKLLTGASAVEQLDAELTRLKVSNPLIVTDAILLKSGTVDLALAHLGGRSYGLYDQAQPEPEISLVEDCTRAFREGGHDGLIGLGGGSAIDIAKGVAAFAGHDGALADLFGVDQVSRKGPPLIAIPTTAGTGSEVLTWRSFPTRKRSSRKALVSDYLLPDVALVSPGLDAHLPTNVSRASGVDALVHAIEAYLSINRSPITDAIALGAIKLIARALPKAYANPDDLAAREDMATASLMGGMAFGNAGVGAVHALAYPLGGRFNIAHGVSNALLLPHVMRWNKLACTERLRDVAQAMGVNIAGLSDSQAADASVDAMAELCAAVDIPTGLRAFNVPQDALAPMAEEASKIDRLMRNNPRKFTAGDIEAIYRAAW

SEQ ID NO: 39873 - DNA, 1110 bp, Actinobacillus pleuropneumoniae
  CDS (1)..(1110): transl_table=11
atggatctcggttttgtcgatagaattaccgaccaattacgccaacgtcgtaataaagtgatgattcagttatttaccgatgttgaaccgaatccaagtttacaaaccgtacaacgcgggacggaacttatgcgtagcttccaaccggataccattattgccttaggtggcggctcgcctatggatgcggcaaaagtaatgtggttattctatgaacaaccggaagtggatttccgtgatttagttcagaaatttatggatattcgtaaacgtgcgttcaaattcccgcaattaggtcgtaaagcgaaatttgtcggtatcccgaccacatccggtaccgtaccgaagtcagccgtttgcgtcattactgacggcgatattaaatatccgttggccgactactctctcacgccgacaattgcgattgtagatcctgcattagtgatgtcagtgccggctcatgttgcagcggataccggtttagacgtattaactcacgcaactgaggcttatacttcaatacttgccaacgactacaccgacggtttagcgttacaggcaattaaactggtatttgaaaatttagaaaaatccgtgaaagaatttgatgaagtcgctcgcgagaaaatgcacaatgcttcaactatggcaggtatagcgtttgcaaacgcattcttaggtatttgtcactcaatggcgcataaaatcggcggtaaattccatacgattcacggtcgtaccaatgcgattttattaccgcacgtaattcgttataacggtactcgcccgactaaagtggcaacttggccgaaatacacaaactatgttgcggataaacgcttccaagacatcgcacgtattttaggtttaccggcgacaacgcctgaagaagcggtggaatcttacgctaaagcggtacatgatttagcagtacgttgtggtgttaaaatgtctttacgtgaacaaggtattgacgaacaagagttcttagacgcacgtcgtgaacttgcattaaatgcctttgaagaccaatgtactccggcaaatccacgtcttgcaatggtagaagatatggaagagataatgacaaaagcttactatggcaaataa

SEQ ID NO: 39874 - protein, 369 aa, Actinobacillus pleuropneumoniae
MDLGFVDRITDQLRQRRNKVMIQLFTDVEPNPSLQTVQRGTELMRSFQPDTIIALGGGSPMDAAKVMWLFYEQPEVDFRDLVQKFMDIRKRAFKFPQLGRKAKFVGIPTTSGTVPKSAVCVITDGDIKYPLADYSLTPTIAIVDPALVMSVPAHVAADTGLDVLTHATEAYTSILANDYTDGLALQAIKLVFENLEKSVKEFDEVAREKMHNASTMAGIAFANAFLGICHSMAHKIGGKFHTIHGRTNAILLPHVIRYNGTRPTKVATWPKYTNYVADKRFQDIARILGLPATTPEEAVESYAKAVHDLAVRCGVKMSLREQGIDEQEFLDARRELALNAFEDQCTPANPRLAMVEDMEEIMTKAYYGK

SEQ ID NO: 39875 - DNA, 1131 bp, Propionibacterium freudenreichii shermanii
  CDS (1)..(1131): transl_table=11
atgaagcaattccaactggccacttctctcgcctgcgggcctgacgcactcaccgcgctggacaggctcggcggacgccgcgtcttggtcatcacggacgccttcatggcctcctcggcactgatggacaccgtgcgcggccacctcggcagcgccgagatcacggtcttcgaccaggtgcagcccaatcccgacgtccaggccgtcgcgcgcggcctgcgggccttccttgactgcgcccccgaggccctgctggccctgggcgggggatcgccgatcgacaccgccaaggcggtgcgcaagattgccctcgagcagggccagccactgtcggcgggcttctatgtggtgcccaccacctcgggaaccgggtcggaggtcagctcgttcgcggtggtcaccgatcccgagcacgacgccaagctccccatgacctcacccgacatggtggcagatgtggccatcctcgaccctgacgcggtgcgcacctgcccgcccacgctcaccgccgactccgggatggacgcgctcagccacgcggtggaggcctatgttgcgctggaccacaacgacatcacggacgcactggccgagaaggcgctgcgactgatcagcgcgaacctggtggccagcttccgcgacgggaacgaccttgcggccagggaacaccagcagaatgcggcgacgatggccggcatcgccttcgagaactccggactgggcatcgtgcacgggttgtcccatgccatcggcggcagcttccatgtggcgcacggcaggctcaacggcatcctgatgccgcatgtgatcggcttcaacgccggcgagctgggcttcggggctgccacgttgtcgcccatcgccgagcgctatgcacagctcgcggcggccatcggcatcgacgcggccacccgacgcggactggtgacggggctcgtcgacttcatcaccgccatacgtcgtgaccttgacatgccggcctcgctcaccgacgccggcgtcgaccgcgccgccttccgggctgccattccacagctgtcccagaccgcattgcgcgacttctgcacatcgggaaacccccggccggtgaccgctcatgagctcgccgggctgttggcccacgccctctag

SEQ ID NO: 39876 - protein, 376 aa, Propionibacterium freudenreichii shermanii
MKQFQLATSLACGPDALTALDRLGGRRVLVITDAFMASSALMDTVRGHLGSAEITVFDQVQPNPDVQAVARGLRAFLDCAPEALLALGGGSPIDTAKAVRKIALEQGQPLSAGFYVVPTTSGTGSEVSSFAVVTDPEHDAKLPMTSPDMVADVAILDPDAVRTCPPTLTADSGMDALSHAVEAYVALDHNDITDALAEKALRLISANLVASFRDGNDLAAREHQQNAATMAGIAFENSGLGIVHGLSHAIGGSFHVAHGRLNGILMPHVIGFNAGELGFGAATLSPIAERYAQLAAAIGIDAATRRGLVTGLVDFITAIRRDLDMPASLTDAGVDRAAFRAAIPQLSQTALRDFCTSGNPRPVTAHELAGLLAHAL

SEQ ID NO: 39877 - DNA, 1164 bp, Escherichia blattae
  CDS (1)..(1164): transl_table=11
atgagcgaccgcatgtatgacttcctggttccaaatgtgaacttctttggcccgggcgccgtttctgttgttggccagcgctgccagctgctggggggtaaaaaagccctgctggtgaccgataagggcctgcgcgccattaaagacggtgctgtcgatcagaccgtgaagcacctgaaagccgccggtattgaggtggtcattttcgacggggtcgagccgaacccgaaagacaccaacgtactcgacggcctggccatgttccgtaaagagcagtgcgatatgataatcaccgtcggcggcggcagcccgcacgactgcggtaaaggcattggtattgcggccacccacccgggtgatctgtacagctatgccggtatcgaaacactcaccaacccgctgccgcccattattgcggtcaacaccaccgccgggaccgccagcgaagtcacccgccactgcgtgctgactaacaccaaaaccaaagtaaaatttgtgattgtcagctggcgcaacctgccttccgtctccattaacgatccgctgctgatgatcggcaagcccgccgggctgaccgccgccaccggtatggatgccctgacccacgcggtagaggcctatatctccaaagacgccaacccggttaccgatgcctctgctattcaggccatcaaactgattgccaccaacctgcgtcaggccgtcgccctggggaccaacctcaaagcccgtgaaaacatggcctgcgcctctctgctggccgggatggcctttaacaacgccaacctgggctatgttcacgccatggctcaccagctgggcggcctgtacgacatggcccacggggtggcgaacgcggtcctgctgccccatgtctgccgctataacctgattgccaacccggaaaaatttgccgatatcgccacctttatgggggaaaacaccaccggtctttccaccatggacgcagcggagctggccatcagcgccattgcccgtctgtctaaagatgtcgggatcccgcagcacctgcgtgaactgggggtaaaagaggccgacttcccgtacatggcagaaatggccctgaaagacggcaacgccttctctaacccgcgtaaagggaacgaaaaagagattgccgacatcttccgccaggcattctga

SEQ ID NO: 39878 - protein, 387 aa, Escherichia blattae
MSDRMYDFLVPNVNFFGPGAVSVVGQRCQLLGGKKALLVTDKGLRAIKDGAVDQTVKHLKAAGIEVVIFDGVEPNPKDTNVLDGLAMFRKEQCDMIITVGGGSPHDCGKGIGIAATHPGDLYSYAGIETLTNPLPPIIAVNTTAGTASEVTRHCVLTNTKTKVKFVIVSWRNLPSVSINDPLLMIGKPAGLTAATGMDALTHAVEAYISKDANPVTDASAIQAIKLIATNLRQAVALGTNLKARENMACASLLAGMAFNNANLGYVHAMAHQLGGLYDMAHGVANAVLLPHVCRYNLIANPEKFADIATFMGENTTGLSTMDAAELAISAIARLSKDVGIPQHLRELGVKEADFPYMAEMALKDGNAFSNPRKGNEKEIADIFRQAF

SEQ ID NO: 39879 - DNA, 1149 bp, Alcaligenes eutrophus
  CDS (1)..(1149): transl_table=11
atggcgtttatctactatctgacccacatccacctggatttcggcgcggtaagcctgctcaagtccgaatgcgagcgcatcggcatccgccgcccgttgctggtgaccgacaagggcgtggtcgccgcgggagtggcgcagcgtgccatcgatgcaatgcagggcctgcaggttgcggtattcgatgaaaccccgtcgaacccgaccgaggccatggtgcgcaaggccgccgcacaataccgcgaggccggctgcgacgggctggtggcagtgggcggcggctcgtcgatcgacctcgccaagggcatcgccatcctggccacgcatgagggcgagctgaccacctatgccaccatcgaaggcggcagcgccaggatcaccgacaaggcggcgccgctgatcgcggtgcccaccacctcgggcaccggcagcgaggtggcgcgcggcgccatcatcatcctggacgacggccgcaagctgggcttccattcctggcatttgctgcccaagtccgccgtctgcgacccggaactgacgctggggctgccggccgggctgaccgcggccaccggcatggatgcgatcgcgcactgcatcgagaccttcctggcccccgccttcaacccgcccgcggacggcattgcgctggacgggctggagcgcggctggggccatatcgaacgcgccacccgcgacggtcaggaccgcgacgcacgcctgaacatgatgagcgcgtcgatgcagggcgcaatggcgttccagaaggggctgggctgcgtgcattcgctgtcgcacccgctgggcgggctgaagatcgacggccgcaccggcctgcaccacggcacgctcaacgcggtggtgatgccggcggtgctgcgcttcaacgccgatgcgcccacggtggtgcgcgacgaccgctacgcacgcctgcgccgcgccatgcacctgcccgacggcgccgatatcgcgcaggccgtgcacgacatgaccgtgcgcctgggcctgcccaccgggctgcgtcagatgggtgtcaccgaggacatgttcgacaaggtgattgccggtgcgctggtcgaccattgccacaagaccaacccgaaagaagccagcgccgcggattatcggcgtatgcttgagcagtccatgtag

SEQ ID NO: 39880 - protein, 382 aa, Alcaligenes eutrophus
MAFIYYLTHIHLDFGAVSLLKSECERIGIRRPLLVTDKGVVAAGVAQRAIDAMQGLQVAVFDETPSNPTEAMVRKAAAQYREAGCDGLVAVGGGSSIDLAKGIAILATHEGELTTYATIEGGSARITDKAAPLIAVPTTSGTGSEVARGAIIILDDGRKLGFHSWHLLPKSAVCDPELTLGLPAGLTAATGMDAIAHCIETFLAPAFNPPADGIALDGLERGWGHIERATRDGQDRDARLNMMSASMQGAMAFQKGLGCVHSLSHPLGGLKIDGRTGLHHGTLNAVVMPAVLRFNADAPTVVRDDRYARLRRAMHLPDGADIAQAVHDMTVRLGLPTGLRQMGVTEDMFDKVIAGALVDHCHKTNPKEASAADYRRMLEQSM

SEQ ID NO: 39881 - DNA, 5163 bp, uncultured bacterium
  CDS (546)..(3245)
ggatccaaagggcggttacttcatttcattcaacgctcttaacggctgtgctaagcgcatagttcagctttgcagtgaagcaggcgttacacttacaggcgcaggtgctacattcccttacggcgttgatcccgatgacaagaacatccgtcttgcacctacatatcctccgatagaggatcttcagaaggctatggagctcttcgttatctgcgtaaagctcgtaagcgctgagaaactccttgcagagaagtaattaaataaaaccgatacaggctgtgcagctaaattgcacagccttttttatttgatattgaaatgcacacagttagactaagataacatatattgacaaaaaattatcaatgtggtattattgtattgacaaaaaaatgtcaaggcgggtgatccgatagtgttttgctccaaccattaaccgacaatgttcagataacggagcaattatgcatgacaggcttagtgacggctataatagaatgaacagcctttcagcagtcatcgtcagaaatcacgcttcgtaaagaatgatacgaagcgatctcggggagctgttcagttctctgataacagaccaaacggaggaatatatggttaaaaagaattatgaaataacagacagtaccgaaaaactcgaaaaaacgatcgagcgggttaaaaacgcccagaaacagtttgcttctttcactcaggaacaggtggacaagattttccttgcagccgctacagctgcaaataaaaacaggatcccgcttgcaaagcttgctgtcgaagaaacaggtatgggcatcgttgaggataaggtaataaagaaccacttcgcttcagaatacatctataacgcttacagaaatgtaaagacctgcggtatcatcgaggaagataaatcagcaggaatcacaaggatagctgaaccgatcggcgttatagcagcagttatacctaccacaaacccgacttcaactgcaattttcaagtcccttcttgccctcaaaacaagaaacggaataataataagtcctcatccgagagctaaaaagtccaccatagaggcagctaagatcgtacttgaagcaacggttgcagcaggcgctcccgaagacataatctcatggatagatgtaccgagtcttgaaatgactaaccttgttatggctgaggctgatatcatccttgctacaggcggtcccggaatggtcaaggctgcttattcaagcggaaagcctgccgtaggtgtaggcgcaggaaacactcccgctataatcgatgaatccgctgatatcattcttgccgtaaattcaataatccactcaaagatctttgataacggtatgatttgtgcttccgagcagtcaactatcgttcataagagcatctacaacaaggtgaaggctgaatttgcagcaagaggctgctatttcctctcaaaggacgaaaaggagaaggtcggcaagactatcctcatcaacggcgctcttaatgcaaagatagttggtcagagcgcatacaggatcgctgaacttgcaggtgttactgttcccgagggtacaaagatacttatcggcgagacagacagcactgagctttcagaggaattcgctcacgagaagctctcccctgttctggcaatgtataaggcgaacgatataaacgatgcattcaacaaagccgaaaaacttatcgccgacggcggttacggtcacacctcttcaatatatctcgacgttcttactcagcaggataaactggaagaattcagaaaaaggatgaagacctgccgtatccttgttaacactccttcatctcacggtggtataggtgatatatacaatttcagcctgactccgtcgctgacacttggctgcggttcatggggaggaaattccgtaagcgaaaatgttggcgtaaagcatctgctcaatataaagacagttgctgaaaggagagaaaatatgctttggttcagagcacctgaaaagatatatatgaagcgcggttgtctgcctacagctcttgacgaactcaaaacaataatgaacaagaaacgtgctttcatagttacagataaattcctttatgaaaacggtttcacaaagcctatcactgacaaactcgacgagctcggcatacagcatgccgcattcttcgacgttgctcccgatcctacacttgcatgcgctaaagaaggtgcagctcagatatccgtattcaatcccgatgtgataatagctgtcggcggcggttcagctatggatgctgcaaagataatgtgggtgctttatgaacatcccgaggttgattttgctgacatggcaatgcgcttcatggatataaggaagagagtgtacaccttcccgaaaatgggagaaaaggcttatttcgtagctatcccgacttccgcaggtacaggctctgaggtaacaccatttgcggttatcactgatgaaagctcaggagtaaaataccctcttgccgattacgagctcctgccgaatatggctataatcgatacagaccttcacatgagcgctcctaagggactcacatccgcttcaggtatagacgcagtaactcacgctcttgaagcctatgcttccgtaatggcaacagatttcacagacggacttgcacttaaggcacttaagatcattttcgagttccttccccgtgcatacgacaacggcccgaacgatcccgaagcaagagaaaaaatggctaatgccgctacaatggcaggtatggcttttgcaaacgctttcctcggagtaagccactctctcgcacacaagctcggtgcttaccaccatatcccacacggtatcgcaaatgcactggtcattgaagacgtacttcgtttcaatgctgcggaaactcctgcaaaaatgggtactttcccacagtacgatcatccgcacacacttgaacgctatgcagaggtcgctgactatctcggactcggcggaaagactccgaaggataagcttgaaaagctcatttccgctataagagagctccgtcataaaataggcatcaaggatacgatcgccgattacggtgtttcagaagaggacttcatggcaactcttgatgagatgacagaaaatgcatttgacgatcagtgtacaggtgcaaatccccgttatcctctcttcagtgagataaagcagatatacctcaatgcatactacggcagaacatttaccgaaaaagagtatccaaaggcttaagaaggaggaaatgctatgaaacttgataattgtatctcagaaagaacaaacaagaagatcttccgtgacggaaacaagtgcataaaactgtttgatgaggtctactccaagtcagacgtactcaacgaagctctcaatcacgcaagagttgaggaaacaggtctgaatgtccccgagctctatgaggtaacacgaatagacggaaaatgggcgatcgtatcgcaatacatcgaaggtgagagcctctcggaccttatagttgcaaacccgaaaaaatacgcagaatacctggaactcttcgtggatatacagcttgatatccagtcaagaagctgcccgctccttagcagactcaaggacaagatgaaccgtaagatagaacttacagaactggatgatacaacaaagtacgatcagcggaccgaccaaaatcgctcccccgaaggttgaaaccgtcatttttgtgcgcaccgcgcaggaaatgcaccgggccgtcatggacgcctgttccaaagcatcgatcatcatcaaagccgcagcggtggccgattaccggccacggataacggctgccgagaaaatcaagaaagaccggggactggccgccgtcgagcttgtgcgcaaccccgatatcattgccgcgatcggcgcgaaaaagaagaaaggccttctggtgggatttgccatggaaacccaggacctgctgaccaacgctcgcgggaaaatgattcgcaaaaaaatggacatgatcgtcgccaacaatctgcgcgacgagggcgccggttttgagacggacaccaacatcatcacgatccttgaccggcagggccatagcatcgctttggaaaagatgaccaaacaggaagcggcgcaccggatcctggatcatatccgctcgctcaaaacgaagaaaggacccgccggaaaaaaatgacgaagtcctttccttcactttcatccgacgcgatccggaatgatttgctgtccctggtgaaatccgtcagggggcaggtgctggacgccgaccgtctgtatgtcgccgtggactgcaaaagaccccccagtccggcgcggaaaaacaagccggacggcagggatcgcggcgaggcgtttcacgccctttctctggaagccgcgaactgctgtcagtgtcctctggcgcagacaagaaagaatgtcgtattcggtgccgggagcttatcggcgcaggtggtttttgtgggcgaagcgccgggtgcggacgaagacgaacagggcctgccctttgtcggcaaggcggggcagcttctgaccaacatcattactgcgatggggctgacgcgaaaggaagtgtatatctgcaatattctcaaatgccgcccgccgggcaaccgcaccccgttgccggaggaaatccgtctgtgcgagcctttcctgaagcggcagctcagcctgattgctccgcagatccttcgccggacggctgtcctgaaggatgccagtgtacgtaccggcatcctccggatgaagatatccgatgtctcaacttccgtgtcaacacccctcgccctccagtagagtctctcattgaaagaagaaccggagaaatccgggaatgggacggtccttcccgagaagttcacaacgtctccttccctggcggcacggtatggtctcaccctgatgagataccgcccgctccggccttccaccacgagcgcgcgcctgtacccccacggccgctccaggaccacttctccttcatcgctgacaggagaaccgtccgcagggggaaaagaatccatccggagggctgcggccagcgaaatgcagaaggccaacagggcgagccccgccatgaaagggaaaaaacgggcgggtcgattttgggatgaaacaaggaggagtcccgcacatacaagggaggcaactgctgcag

SEQ ID NO: 39882 - protein, 899 aa, uncultured bacterium
MIRSDLGELFSSLITDQTEEYMVKKNYEITDSTEKLEKTIERVKNAQKQFASFTQEQVDKIFLAAATAANKNRIPLAKLAVEETGMGIVEDKVIKNHFASEYIYNAYRNVKTCGIIEEDKSAGITRIAEPIGVIAAVIPTTNPTSTAIFKSLLALKTRNGIIISPHPRAKKSTIEAAKIVLEATVAAGAPEDIISWIDVPSLEMTNLVMAEADIILATGGPGMVKAAYSSGKPAVGVGAGNTPAIIDESADIILAVNSIIHSKIFDNGMICASEQSTIVHKSIYNKVKAEFAARGCYFLSKDEKEKVGKTILINGALNAKIVGQSAYRIAELAGVTVPEGTKILIGETDSTELSEEFAHEKLSPVLAMYKANDINDAFNKAEKLIADGGYGHTSSIYLDVLTQQDKLEEFRKRMKTCRILVNTPSSHGGIGDIYNFSLTPSLTLGCGSWGGNSVSENVGVKHLLNIKTVAERRENMLWFRAPEKIYMKRGCLPTALDELKTIMNKKRAFIVTDKFLYENGFTKPITDKLDELGIQHAAFFDVAPDPTLACAKEGAAQISVFNPDVIIAVGGGSAMDAAKIMWVLYEHPEVDFADMAMRFMDIRKRVYTFPKMGEKAYFVAIPTSAGTGSEVTPFAVITDESSGVKYPLADYELLPNMAIIDTDLHMSAPKGLTSASGIDAVTHALEAYASVMATDFTDGLALKALKIIFEFLPRAYDNGPNDPEAREKMANAATMAGMAFANAFLGVSHSLAHKLGAYHHIPHGIANALVIEDVLRFNAAETPAKMGTFPQYDHPHTLERYAEVADYLGLGGKTPKDKLEKLISAIRELRHKIGIKDTIADYGVSEEDFMATLDEMTENAFDDQCTGANPRYPLFSEIKQIYLNAYYGRTFTEKEYPKA

SEQ ID NO: 39883 - DNA, 1167 bp, Clostridium beijerinckii
  CDS (1)..(1167): transl_table=11
atggcacgttttactttaccaagagacatttatcatggagaaggagcacttgaggcacttaaaactttaaaaggtaagaaagctttcttagtagttggtggcggatcaatgaaaagatttggatttcttaaacaagttgaagattatttaaaagaagcaggaatggaagtagaattatttgaaggtgttgaaccagatccatcagtggaaacagtaatgaaaggcgcagaagctatgagaaactttgagcctgattggatagttgcaatgggtggaggatcaccaattgatgctgcaaaggctatgtggatattctacgaatacccagattttacttttgaacaagcagttgttccatttggattaccagaccttagacaaaaagctaagtttgtagctattccatcaacaagcggtacagctacagaagttacagcattctcagttatcacaaattattcagaaaaaattaaatatcctttagctgattttaacataactccagatatagcaatagttgatccagcacttgctcaaactatgccaaaaactttaacagctcatactggaatggatgcattaactcacgctatagaagcatacactgcatcacttcaatcaaatttctcagatccattagcaattaaagctgtagaaatggttcaagaaaatttaatcaaatcatttgaaggagataaagaagctagaaatctaatgcatgaagctcaatgtttagctggaatggcattttctaatgcattacttggaatagttcactcaatggctcataaggttggtgctgtattccatattcctcatggatgtgcaaatgctatatttttaccatatgtaattgagtataacagaacaaaatgcgaaaatagatatggagatattgcgagagccttaaaattaaaaggaaacaatgatgccgagttaactgattcattaattgaattaattaatggattaaatgataagttagagattcctcactcaatgaaagagtatggagttactgaagaagattttaaagctaatctttcatttatcgctcataacgcagtattagatgcatgcacaggatcaaatcctagagaaatagatgatgctacaatggaaaaattatttgaatgcacatactatggaactaaagttaatttgtaa

SEQ ID NO: 39884 - protein, 388 aa, Clostridium beijerinckii
MARFTLPRDIYHGEGALEALKTLKGKKAFLVVGGGSMKRFGFLKQVEDYLKEAGMEVELFEGVEPDPSVETVMKGAEAMRNFEPDWIVAMGGGSPIDAAKAMWIFYEYPDFTFEQAVVPFGLPDLRQKAKFVAIPSTSGTATEVTAFSVITNYSEKIKYPLADFNITPDIAIVDPALAQTMPKTLTAHTGMDALTHAIEAYTASLQSNFSDPLAIKAVEMVQENLIKSFEGDKEARNLMHEAQCLAGMAFSNALLGIVHSMAHKVGAVFHIPHGCANAIFLPYVIEYNRTKCENRYGDIARALKLKGNNDAELTDSLIELINGLNDKLEIPHSMKEYGVTEEDFKANLSFIAHNAVLDACTGSNPREIDDATMEKLFECTYYGTKVNL

SEQ ID NO: 39885 - DNA, 2601 bp, Listeria welshimeri
  CDS (1)..(2601): transl_table=11
atggcaattaaagaaaatgcggcccaagaagtattagaagttcaaaaagtgattaacagattagcagacaatggacaacaagcattgaaagcatttgagaattacgaccaagaacaagtagataatatcgtacatgcaatggcgcttgccggactcgaccaacatatgccccttgcaaaattagcagtagaagaaacaggacgaggattatacgaagataaatgtattaaaaatatctttgcaacagaatatatttggaacaacattaaaaacaacaagacagtcggcgttattcacgaagacgttcaaactggtgttatcgaaattgcagaaccagttggtgttgttgccggggttacaccagtaactaacccaacatctactacacttttcaaagcaattatcgcaattaaaacacgaaacccaatcatcttcgctttccatccaagtgcacaacgttgttcagcagcagcagcaaaagttgtttatgatgcggcagttgcagctggagcgccagaacattgtattcaatgggtagaaaaaccttccctagaagcaaccaaacaattaatgaatcacgataaagtagcacttgtacttgcaactggtggtgctggaatggttaaatcagcatactctactggtaaaccggcactaggtgttggcccgggtaacgtaccagcttacattgacaaaacagctaaaatcaaacgttctgttaatgacatcattctttctaaatcttttggccaaggaatgatttgtgcttctgaacaagcagttatcgtggacaaagaagtcgctaaagaagtaaaagcagaaatggaagccaataaatgctacttcgttaaaggcgctgaatttaaaaaattagaaagctatgtaatcaaccctgaaaaaggaacacttaacccagatgtagttggtaaatcccctgcatggattgcaaaccaagctggcttcaaagttcctgaagacacaaaaattcttgtggctgaaattaaaggtgttggcgataaatacccactatctcatgaaaaattaagcccagttcttgcattcatcgaagcagctaaccaagcagaagcattcgatcgttgtgaagaaatgctcgtatacggaggacttggacactctgcagttattcactctacagataaagaagttcaaaaagcattcggtatccgtatgaaagcttgccgtatcattgtaaatgcaccaagcgctcaaagtggtattggtgacatctataacggcttcatcccttccctaacacttggttgtggatcttatggtaaaaactctgtatcacaaaatgtaagtgcgactaacttgctgaacgttaaacgtatcgcggatcggagaaataatatgcaatggttcaaacttccaccaaaaattttctttgaaaaatattccactcaataccttcaaaaaatggaaggcgttgaacgcgtatttatcgtaactgacccaggtatggttcaattcaaatacgttgatgtagtaatcgaacacctgaaaaaacgcggtaacgacgtagcttaccaagtattcgctgatgttgaaccagatccatctgacgttacagtttataaaggtgcagaattaatgaaagactttaaaccagatacaatcatcgctcttggtggtggttctgcaatggatgctgctaaaggtatgtggttattctatgaacacccagaagcttcattctttggcttgaaacaaaaattcttagatatccgcaaacgtactttcaaatatcctaaacttggtggaaaagcgaaattcgttgcaattccaacaacaagtggtactggttctgaagtaactccatttgcggttattacagacaaagaaaataacattaaataccctcttgctgactacgaattaactccagacgttgcgattgtcgatgcacaatatgtaactactgttccagcacacattactgctgatactggtatggacgttctaactcatgcaattgaatcttatgtatccgtaatggcaagcgattatactcgtggattatccatccgtgcaatcgaacttgtttttgaaaacttacgtgaatccgttcttactggtgatccagatgcacgtgaaaaaatgcataatgcttctgccctagctggtatggcatttgcgaatgcgttcctaggaattaaccatagcttggcacacaaaattggacctgaattccacattcctcacggtcgtgcgaatgcaatccttatgccacatgttatccgctataacgcacttaaacctaaaaaacatgcgttattcccaagatatgaaagcttccgtgccgatgaagattatgctcgtatttctcgtattatcggtttaccagctgcaactacagaagaaggcgttaaatctcttgtagatgcaattatcaaacttggtaaagatgttggtatcgacatgagtcttaaaggacaaaatgttgctaaaaaagacttggatgctgtagtagatacgcttgctgatcgcgcattcatggaccaatgtactactgccaaccctaaacaaccacttgtaagcgaattgaaagaaatctatcttgaagcttacaaaggggtttga

SEQ ID NO: 39886 - protein, 866 aa, Listeria welshimeri
MAIKENAAQEVLEVQKVINRLADNGQQALKAFENYDQEQVDNIVHAMALAGLDQHMPLAKLAVEETGRGLYEDKCIKNIFATEYIWNNIKNNKTVGVIHEDVQTGVIEIAEPVGVVAGVTPVTNPTSTTLFKAIIAIKTRNPIIFAFHPSAQRCSAAAAKVVYDAAVAAGAPEHCIQWVEKPSLEATKQLMNHDKVALVLATGGAGMVKSAYSTGKPALGVGPGNVPAYIDKTAKIKRSVNDIILSKSFGQGMICASEQAVIVDKEVAKEVKAEMEANKCYFVKGAEFKKLESYVINPEKGTLNPDVVGKSPAWIANQAGFKVPEDTKILVAEIKGVGDKYPLSHEKLSPVLAFIEAANQAEAFDRCEEMLVYGGLGHSAVIHSTDKEVQKAFGIRMKACRIIVNAPSAQSGIGDIYNGFIPSLTLGCGSYGKNSVSQNVSATNLLNVKRIADRRNNMQWFKLPPKIFFEKYSTQYLQKMEGVERVFIVTDPGMVQFKYVDVVIEHLKKRGNDVAYQVFADVEPDPSDVTVYKGAELMKDFKPDTIIALGGGSAMDAAKGMWLFYEHPEASFFGLKQKFLDIRKRTFKYPKLGGKAKFVAIPTTSGTGSEVTPFAVITDKENNIKYPLADYELTPDVAIVDAQYVTTVPAHITADTGMDVLTHAIESYVSVMASDYTRGLSIRAIELVFENLRESVLTGDPDAREKMHNASALAGMAFANAFLGINHSLAHKIGPEFHIPHGRANAILMPHVIRYNALKPKKHALFPRYESFRADEDYARISRIIGLPAATTEEGVKSLVDAIIKLGKDVGIDMSLKGQNVAKKDLDAVVDTLADRAFMDQCTTANPKQPLVSELKEIYLEAYKGV

SEQ ID NO: 39887 - DNA, 2601 bp, Listeria seeligeri
  CDS (1)..(2601): n means a or g or c or t/u, s means g or c
atggcaattaaagaaaatgcggcccaagaagtattagaagttcaaaaagtgattgacagattagcagacaatggacaaaaagcattgaaagcatttgaaaattacgatcaagaacaagtggacaatatcgtacatgcgatggcgctcgccggacttgaccaacatatgccccttgcaaaattagcagtagaagaaactggacgtggattatacgaagataaatgtattaaaaacatcttcgcaacagaatatatttggaacaacattaaaaacaacaaaacagttggtgttattaatgaagacgtgcaaacaggcgttatcgaaattgctgaaccagttggtgtggttgccggagttacacctgtaacaaaccctacctccactactcttttcaaagcaattatcgctattaaaactcgtaacccaatcatctttgctttccatccaagcgcacaaggttgttcatctgcagcagcaaaagttgtctacgatgcagcaatcgcagctggagcaccagaacattgtattcaatgggtagaaaaaccttccctagaagcaacaaaacaattaatgaaccatgaaaaagttgccttagttcttgcaactggtggtgctggaatggttaaatcagcctactcaactggtaaaccggcactaggtgttggaccaggtaacgtaccagcttacattgacaaaacagctaaaatcaaacgttctgtaaatgacattattctttctaaatcttttgaccaaggtatgatttgtgcttctgaacaagcagttatcgtggacaaagaagtagccaaagaagtaaaagcagaaatggaagctaacaattgttacttcgttaaaggcgctgaattcaagaaattagaaagctacgtaatcaatcctgaaaaaggaacacttaacccagatgtagttggtaaatcccctgcctggattgctaaccaagccggttttaaagttccagaagatacaaaaattcttgttgctgaaattaaaggtgttggcgacaaatatccactatctcatgaaaaacttagcccagttcttgcatttatcgaagcagctaaccaagcagaagcattcgatcgttgtgaagaaatgctagtatacggaggacttggacactctgcagttatccattccactgataaagaagttcaaaaagcatttggtattcgtatgaaagcttgccgtatcattgtaaacgcaccaagcgctcaaggcggtatcggtgacatttataacggcttcatcccttccctaactcttggttgtggatcttatggtaaaaactctgtatcacaaaatgtaagtgcgactaacttgctgaacgttaaacgtatcgcggatcggagaaataatatgcaatggttcaaacttccaccaaaaatcttctttgaaaaatattccactcaataccttcaaaaaatggaaggcgttgaacgtgtatttatcgtaactgacccaggaatggttcaattcaaatatgttgatgttgtaatcgaacatttgnaaaaacgtggcaacgacgtatcttaccaagtatttgctgacgttgaaccagatccatctgatgtaactgtttataaaggtgccgaattaatgaaagacttcaaacctgatacaattatcgctcttggtggtggttcagcaatggatgctgctaaaggtatgtggttattctatgaacacccagaagcttctttcttcggactaaaacaaaaattcttagatatccgtaaacgtacttttaaatatcctaaacttggtggaaaagcgaaatttgttgctattccaacaacaagtggtactggatctgaggtaactcctttcgcggttattactgataaagaaaataacattaaataccctcttgctgactatgaactaactccagacgttgcgatngtcgatgcacaatacgtaacaactgttccagcacacatcactgctgatactggtatggacgttttaactcacgcaattgaatcttatgtttctgtaatggcaggtgattatactcgtggtttatctatccgagcaatcgaacttgtatttgaaaacctacgtgattccgttcttaagggtgatcctgatgcacgcgaaaaaatgcataacgcttctgccctagctggtatggcgtttgccaatgcgttccttggaattaaccatagcttggcacacaaaattggacctgaattccacattcctcatggtcgtgcgaatgccatccttatgccacacgttattcgttataacgcacttaaacctaaaaaacatgcgctattcccaagatatgaaagcttccgtgcagatgaagattatgctcgtatctctcgtattatcggcttccctgctgcaactacagaagaaggcgttaaatcacttgtggatgaaatcatcaaacttggtaaagatgttggtatcgacatgagtcttaaaggacaaaatgttgataaaaaagacttggatgctgttgtagatacacttgcagatcgcgcattcatggaccaatgtactactgccaaccctaaacaaccacttgtaagcgaactaaaagaaatctacctagaagcttacaaaggtgtatga

SEQ ID NO: 39888 - protein, 866 aa, Listeria seeligeri
  Xaa in positions 508 and 639 is unknown
MAIKENAAQEVLEVQKVIDRLADNGQKALKAFENYDQEQVDNIVHAMALAGLDQHMPLAKLAVEETGRGLYEDKCIKNIFATEYIWNNIKNNKTVGVINEDVQTGVIEIAEPVGVVAGVTPVTNPTSTTLFKAIIAIKTRNPIIFAFHPSAQGCSSAAAKVVYDAAIAAGAPEHCIQWVEKPSLEATKQLMNHEKVALVLATGGAGMVKSAYSTGKPALGVGPGNVPAYIDKTAKIKRSVNDIILSKSFDQGMICASEQAVIVDKEVAKEVKAEMEANNCYFVKGAEFKKLESYVINPEKGTLNPDVVGKSPAWIANQAGFKVPEDTKILVAEIKGVGDKYPLSHEKLSPVLAFIEAANQAEAFDRCEEMLVYGGLGHSAVIHSTDKEVQKAFGIRMKACRIIVNAPSAQGGIGDIYNGFIPSLTLGCGSYGKNSVSQNVSATNLLNVKRIADRRNNMQWFKLPPKIFFEKYSTQYLQKMEGVERVFIVTDPGMVQFKYVDVVIEHLXKRGNDVSYQVFADVEPDPSDVTVYKGAELMKDFKPDTIIALGGGSAMDAAKGMWLFYEHPEASFFGLKQKFLDIRKRTFKYPKLGGKAKFVAIPTTSGTGSEVTPFAVITDKENNIKYPLADYELTPDVAXVDAQYVTTVPAHITADTGMDVLTHAIESYVSVMAGDYTRGLSIRAIELVFENLRDSVLKGDPDAREKMHNASALAGMAFANAFLGINHSLAHKIGPEFHIPHGRANAILMPHVIRYNALKPKKHALFPRYESFRADEDYARISRIIGFPAATTEEGVKSLVDEIIKLGKDVGIDMSLKGQNVDKKDLDAVVDTLADRAFMDQCTTANPKQPLVSELKEIYLEAYKGV

SEQ ID NO: 39889 - DNA, 2601 bp, Listeria innocua
  CDS (1)..(2601): transl_table=11
atggcaattaaagaaaatgcggcccaagaagtattagaagttcaaaaagtgattgacagattagcagacaatggacaaaaagcattgaaagcatttgaaagttacaaccaagaacaagtagataatatcgtacacgcaatggcgcttgccggacttgaccaacatatgccccttgcaaaattagcagtagaagaaacaggacgtggattatacgaagataaatgtattaaaaacatcttcgcaacagaatatatttggaacaacattaaaaacaacaaaacagtcggagttattaacgaagatactcaaactggtgttatcgaaattgctgaaccagtcggagtagttgccggggttacaccagtaactaacccaacttcaacaacacttttcaaagcaattatcgcgattaaaacgcgtaacccaatcatcttcgctttccatccaagtgcgcaacgttgttcatctgaagcagcaaaagttgtttatgatgcagcagttgcagctggagcaccagaacattgtattcaatgggtagaaaaaccttccctagaagcaacaaaacaattaatgaaccacgataaagtagcacttgtacttgcaactggtggtgctggaatggttaaatcagcatactctactggtaaacctgcactaggtgttggaccaggtaacgtaccagcttacattgacaaaacagctaaaatcaaacgttctgttaatgacatcattctttctaaatcttttgaccaaggtatgatttgtgcttctgaacaagcagttatcgtggacaaagaagttgctaaagaagtaaaagcagaaatggaagcaaacaaatgctacttcgttaaaggcgctgaatttaaaaaattagaaagctatgtaatcaaccctgaaaaaggaacacttaacccagatgtagttggtaaatcccctgcatggattgcaaaccaagctggtttcaaagttccagaagatacaaaaattcttgtagctgaaattaaaggtgttggcgacaaatacccactatctcacgaaaaattaagcccagttcttgcatttatcgaagctgctacccaagcagaagcattcgatcgttgtgaagaaatgttagtatacggcggacttggacactcagcagttattcactctactgataaagaagttcaaaaagcatttggtatccgtatgaaagcttgccgtatcatcgtaaatgcaccaagcgctcaaggcggtatcggtgacatttataacggcttcatcccttccctaacactaggttgtggatcttatggtaaaaactctgtatcacaaaatgtaagtgcgactaacttgctgaacgttaaacgtatcgcggatcggagaaataatatgcaatggttcaaacttccaccaaaaattttctttgaaaaatattctactcaataccttcaaaaaatggaaggcgttgaacgcgtatttatcgtaactgacccaggtatggttcaattcaaatacgttgatgtagtaatcgaacacctgaaaaaacgtggtaacgacgtagcttatcaagtattcgctgatgttgaaccagatccatctgacgtaacagtttacaaaggtgcagaattaatgaaagacttcaaaccagatacaattatcgctcttggtggtggttccgcaatggatgctgccaaaggtatgtggttattctatgaacacccagaagcttcattcttcggcttgaaacaaaaattcttagatatccgtaaacgtactttcaaatatcctaaacttggtggaaaagcgaaattcgttgcgattccaacaacaagtggtacaggttctgaagtaactccatttgcggttattacagacaaagaaaacaacattaaataccctcttgctgactacgaattaactccagacgttgcgattgtcgatgcacaatatgtaacaactgttccagcacacattactgctgatactggtatggacgttctaactcacgcaattgaatcttatgtatccgtaatggcaagcgattatacacgtggattatctatccgtgcaatcgaacttgtttttgaaaacttacgtgaatccgttcttactggtgatcctgatgcgcgtgaaaaaatgcataatgcttctgccctagctggtatggcgtttgcgaatgcgttcctaggaattaaccatagtttggcacacaaaattggacctgaattccacattcctcacggtcgtgcgaatgcaatccttatgccacacgttatccgttataacgcacttaaacctaaaaaacatgcgttattcccaagatatgaaagcttccgtgctgatgaagattatgctcgtatctctcgtattatcggcttccctgctgcaactacagaagaaggcgttaaatcacttgtagatgaaatcatcaaacttggtaaagatgttggtatcgacatgagtcttaaaggacaaaatgttgctaaaaaagacttggatgcagttgtagatacacttgcagatcgcgcattcatggaccaatgtactactgccaaccctaaacaaccacttgtaagcgaactaaaagaaatttaccttgaagcttacaaaggtgtttaa

SEQ ID NO: 39890 - protein, 866 aa, Listeria innocua
MAIKENAAQEVLEVQKVIDRLADNGQKALKAFESYNQEQVDNIVHAMALAGLDQHMPLAKLAVEETGRGLYEDKCIKNIFATEYIWNNIKNNKTVGVINEDTQTGVIEIAEPVGVVAGVTPVTNPTSTTLFKAIIAIKTRNPIIFAFHPSAQRCSSEAAKVVYDAAVAAGAPEHCIQWVEKPSLEATKQLMNHDKVALVLATGGAGMVKSAYSTGKPALGVGPGNVPAYIDKTAKIKRSVNDIILSKSFDQGMICASEQAVIVDKEVAKEVKAEMEANKCYFVKGAEFKKLESYVINPEKGTLNPDVVGKSPAWIANQAGFKVPEDTKILVAEIKGVGDKYPLSHEKLSPVLAFIEAATQAEAFDRCEEMLVYGGLGHSAVIHSTDKEVQKAFGIRMKACRIIVNAPSAQGGIGDIYNGFIPSLTLGCGSYGKNSVSQNVSATNLLNVKRIADRRNNMQWFKLPPKIFFEKYSTQYLQKMEGVERVFIVTDPGMVQFKYVDVVIEHLKKRGNDVAYQVFADVEPDPSDVTVYKGAELMKDFKPDTIIALGGGSAMDAAKGMWLFYEHPEASFFGLKQKFLDIRKRTFKYPKLGGKAKFVAIPTTSGTGSEVTPFAVITDKENNIKYPLADYELTPDVAIVDAQYVTTVPAHITADTGMDVLTHAIESYVSVMASDYTRGLSIRAIELVFENLRESVLTGDPDAREKMHNASALAGMAFANAFLGINHSLAHKIGPEFHIPHGRANAILMPHVIRYNALKPKKHALFPRYESFRADEDYARISRIIGFPAATTEEGVKSLVDEIIKLGKDVGIDMSLKGQNVAKKDLDAVVDTLADRAFMDQCTTANPKQPLVSELKEIYLEAYKGV

SEQ ID NO: 39891 - DNA, 2601 bp, Listeria monocytogenes
  CDS (1)..(2601): transl_table=11
atggcaattaaagaaaatgcggcccaagaagtattagaagttcaaaaagtgattgacagattagcagacaatggacaaaaagcattgaaagcatttgaaagttacaatcaagaacaagtagacaatatcgttcacgcaatggcacttgccggacttgaccaacatatgccccttgcaaaattagcagtagaagaaactggacgtggattatacgaagataaatgtattaaaaacatcttcgcgacagaatatatttggaacaacattaaaaacaacaaaacagtaggcgttattaatgaagatgtacaaactggtgtgattgaaattgctgaaccagttggagttgttgccggggttacacctgtaactaacccaacatccactactcttttcaaagcaattatcgctatcaaaacacgtaacccaatcatctttgctttccatccaagtgcacagcgttgttcatctgcagcagcgaaagttgtatacgatgcagcaattgcagctggagcaccagaacattgtattcaatgggtagaaaaaccttccctagaagcaacgaaacaattaatgaatcacgataaagtagcacttgtacttgcaactggtggtgctggaatggttaaatcagcatactctactggtaaacctgcactaggtgttggaccaggtaacgtaccagcttacattgacaaaacagccaaaattaaacgttctgttaatgacattattctttctaaatcttttgaccaaggtatgatttgtgcttctgaacaagcagtcatcgtggacaaagaagtagctaaagaagtaaaagcagaaatggaagcaaacaaatgctacttcgttaaaggcgctgaattcaaaaaattagaaagctacgtaatcaatcctgaaaaaggaacacttaacccagatgtagttggtaaatcccctgcatggattgcaaatcaagctggcttcaaagttccagaagatacaaaaatccttgtagctgaaattaaaggtgttggcgacaaatacccactatctcacgaaaaattaagcccagttcttgcattcatcgaagctgctaaccaagcagaagcattcgatcgttgtgaagaaatgttagtatacggaggacttggacactccgcagttattcactctacggataaagaagttcaaaaagcatttggtattcgtatgaaagcttgccgtatcatcgtaaatgcaccaagcgcacaaggcggtatcggtgacatttataacggcttcatcccttccctaacactaggttgtggatcttacggtaaaaactctgtatcacaaaatgtaagtgcgactaacttgctgaacgttaaacgtatcgcggatcggagaaataatatgcaatggttcaaacttccaccaaaaattttctttgaaaaatattccactcaataccttcaaaaaatggaaggcgttgaacgcgtatttatcgtaactgacccaggaatgggttcattcaaatacgtggatgtcgtaatcgaacacctgaaaaaacgtggcaacgatgtagcttaccaagtatttgctgacgttgaaccagatccatctgacgtaacagtttacaaaggtgcagaactaatgaaagacttcaaacctgatacaattatcgctcttggtggtggttctgcaatggatgctgccaaaggtatgtggttattctatgaacacccagaagcttcattcttcggcttgaaacaaaaattcttagatatccgtaaacgtacattcaaatatcctaaacttggtggaaaagcgaaattcgttgcaattccaacaacaagtggtacaggttctgaagtaactccatttgcggttattacagacaaagaaaacaacattaaataccctcttgcagactacgaattaactccagatgttgcgattgtcgatgcacaatatgtaactactgttccagcacacattactgctgacactggtatggacgttctaactcacgcaattgaatcttatgtatccgtaatggcaagcgattatactcgtggattatctatccgcgcaatcgaacttgtatttgaaaacttacgtgaatctgttcttactggtgatccagatgcgcgtgaaaaaatgcataatgcttctgccctagctggtatggcgtttgcaaatgcgttcctaggaattaaccacagcttggcacacaaaattggacctgaattccacattcctcacggtcgtgcgaatgcaatccttatgccacatgttattcgttataacgcacttaaacctaaaaaacatgcgttattccctagatatgaaagcttccgtgctgatgaagattatgctcgtatctctcgtattatcggcttccctgcagcaactacagaagaaggcgttaaatcacttgtagatgaaatcatcaaacttggtaaagacgttggtatcgacatgagtcttaaaggacaaaatgttgctaaaaaagatttggatgcagttgtagatacacttgcagatcgcgcattcatggaccaatgtactactgccaaccctaaacaaccacttgtaagtgaactaaaagaaatctacctagaagcttacaaaggtgtttga

SEQ ID NO: 39892 - protein, 866 aa, Listeria monocytogenes
MAIKENAAQEVLEVQKVIDRLADNGQKALKAFESYNQEQVDNIVHAMALAGLDQHMPLAKLAVEETGRGLYEDKCIKNIFATEYIWNNIKNNKTVGVINEDVQTGVIEIAEPVGVVAGVTPVTNPTSTTLFKAIIAIKTRNPIIFAFHPSAQRCSSAAAKVVYDAAIAAGAPEHCIQWVEKPSLEATKQLMNHDKVALVLATGGAGMVKSAYSTGKPALGVGPGNVPAYIDKTAKIKRSVNDIILSKSFDQGMICASEQAVIVDKEVAKEVKAEMEANKCYFVKGAEFKKLESYVINPEKGTLNPDVVGKSPAWIANQAGFKVPEDTKILVAEIKGVGDKYPLSHEKLSPVLAFIEAANQAEAFDRCEEMLVYGGLGHSAVIHSTDKEVQKAFGIRMKACRIIVNAPSAQGGIGDIYNGFIPSLTLGCGSYGKNSVSQNVSATNLLNVKRIADRRNNMQWFKLPPKIFFEKYSTQYLQKMEGVERVFIVTDPGMGSFKYVDVVIEHLKKRGNDVAYQVFADVEPDPSDVTVYKGAELMKDFKPDTIIALGGGSAMDAAKGMWLFYEHPEASFFGLKQKFLDIRKRTFKYPKLGGKAKFVAIPTTSGTGSEVTPFAVITDKENNIKYPLADYELTPDVAIVDAQYVTTVPAHITADTGMDVLTHAIESYVSVMASDYTRGLSIRAIELVFENLRESVLTGDPDAREKMHNASALAGMAFANAFLGINHSLAHKIGPEFHIPHGRANAILMPHVIRYNALKPKKHALFPRYESFRADEDYARISRIIGFPAATTEEGVKSLVDEIIKLGKDVGIDMSLKGQNVAKKDLDAVVDTLADRAFMDQCTTANPKQPLVSELKEIYLEAYKGV

SEQ ID NO: 39893 - DNA, 1164 bp, Clostridium pasteurianum
  CDS (1)..(1164): transl_table=11
atgagctatcgtatgtttgattatctggtgccaaatgtgaacttttttggcccgaatgctatttccgttgtcggcgaacgctgcaaactgttgggcggtaaaaaagcgctgctggtgactgataaaggtctgcgagccattaaggacggcgcggttgataaaaccctcgaacatctgcgtgaagccggtattgacgtggtggtgtttgacggcgtcgagccaaaccctaaagacaccaacgtgcgcgacggcctggacgtttttcgtaaagagcaatgcgatatcatcgttaccgtcggcggtggtagcccgcatgactgcggtaaaggcatcggtatcgcggcgacgcacgaaggcgatctctatagctatgccgggattgaaaccctgaccaatccgctgccgccgatcgtcgcggtgaataccaccgccggtaccgccagcgaagtcacccgtcactgcgtgctgaccaataccaaaaccaaagtgaagtttgtgattgtcagttggcgcaacctgccgtcggtttccattaatgaccctctgctgatgctcggcaaacctgcgccactgactgcggcaacaggaatggacgccctgacccacgccgttgaggcctatatttcaaaagatgccaacccggttaccgacgccgccgctatccaggcaattcgtctgatcgcccgcaacttacgccaggccgtagcactgggcagcaacctgaaagctcgcgagaatatggcctatgcctctttgctggcgggtatggccttcaacaacgccaaccttggctacgttcacgcgatggcgcatcagcttggcggtctgtacgacatgccgcacggcgtggcaaatgccgtcctgctgccgcacgtggcgcgctataacctgatcgctaatccggagaaatttgccgacatcgcggagtttatgggtgagaacactgacggtctgtccaccatggatgctgccgagctggcgattcgcgccatcgctcgcctgtcagccgatatcggtattccgcagcatctgcgcgagctgggcgtcaaagaagccgatttcccgtatatggcggaaatggcgctgaaagacggcaatgccttctccaacccgcgcaaagggaacgagaaagaaattgccgagattttccgccaggcattctga

SEQ ID NO: 39894 - protein, 387 aa, Clostridium pasteurianum
MSYRMFDYLVPNVNFFGPNAISVVGERCKLLGGKKALLVTDKGLRAIKDGAVDKTLEHLREAGIDVVVFDGVEPNPKDTNVRDGLDVFRKEQCDIIVTVGGGSPHDCGKGIGIAATHEGDLYSYAGIETLTNPLPPIVAVNTTAGTASEVTRHCVLTNTKTKVKFVIVSWRNLPSVSINDPLLMLGKPAPLTAATGMDALTHAVEAYISKDANPVTDAAAIQAIRLIARNLRQAVALGSNLKARENMAYASLLAGMAFNNANLGYVHAMAHQLGGLYDMPHGVANAVLLPHVARYNLIANPEKFADIAEFMGENTDGLSTMDAAELAIRAIARLSADIGIPQHLRELGVKEADFPYMAEMALKDGNAFSNPRKGNEKEIAEIFRQAF

SEQ ID NO: 39895 - DNA, 1152 bp, Actinobacillus pleuropneumoniae serovar 7
  CDS (1)..(1152): transl_table=11
atgtcaaatcgtttgattttgaatgaaaccagttaccacggtaaaggcgcgattcagcatattgtgtatgaagtcaaaagtcgcagttttaagaaagcgttagtggttaccgataaagatttaattaagtataacgtcgcttctaaagtaaccgatttattggatacggcaggtttaccgtatgaaatttttgatgaagttaaagcgaatccgtcggtcgatgtgatcaaagccggtgtagaaaaatttaaagcatccggtccgaattatctaattgccatcggtggcggatccccgatggatagtgcgaaagcaatcggtattatcatcaataaccctgaatttaaccatggaggatcgttacaaggtgtggcaccgacgcatcaaaaatgtattccgatcattgcagcaccaaccaccgttggtacggcagcagaggttacgattaattacgtgattaccgatgaagaaaaaaaacgtaagttcgtttgtgtggatgtgcacgacgtaccggcggttgcggtggttgatccgaatatgatgtcctctatgccgaaaggcttaaccgcggcaaccggtatggatgctttaacccatgcgattgaaggttatatcactaaagcggcgtgggaattaaccgatgcgttacacttaaaagcgatcgaaattattgctcgtagcttacgcagtgcggtggaaaatgatccgcaagggcgtgagggaatggctctcggtcaatatgttgccggtatgggtttctcaaatgtcggtttgggtgtagtacacggaatggcacatcctctttccgcttattacgatacgccgcacggtatcgccaacgcggtgttattaccttatgtgatggaatttaataaaaatcacacgggtgagaaatatcgtgaaatcgcacgcgcgatgggcgtgaaaggcgtgaatgaaatgatgcaagccgaataccgagatgcagcagtagcagcggtaaaacagcttgcgatagatgtcggtattccggaaaaactttcgcaaatcggagtaaaagaagaagatatgcctgcgctttctattgatgcgtttaacaaagtatgtacgccgggaaatccgagagagtgtacgtcacaaaatattttgggggtattttatgaagcttattaa

SEQ ID NO: 39896 - protein, 383 aa, Actinobacillus pleuropneumoniae serovar 7
MSNRLILNETSYHGKGAIQHIVYEVKSRSFKKALVVTDKDLIKYNVASKVTDLLDTAGLPYEIFDEVKANPSVDVIKAGVEKFKASGPNYLIAIGGGSPMDSAKAIGIIINNPEFNHGGSLQGVAPTHQKCIPIIAAPTTVGTAAEVTINYVITDEEKKRKFVCVDVHDVPAVAVVDPNMMSSMPKGLTAATGMDALTHAIEGYITKAAWELTDALHLKAIEIIARSLRSAVENDPQGREGMALGQYVAGMGFSNVGLGVVHGMAHPLSAYYDTPHGIANAVLLPYVMEFNKNHTGEKYREIARAMGVKGVNEMMQAEYRDAAVAAVKQLAIDVGIPEKLSQIGVKEEDMPALSIDAFNKVCTPGNPRECTSQNILGVFYEAY

SEQ ID NO: 39897 - DNA, 2658 bp, Piromyces sp
  CDS (1)..(2658)
atgtccggattacaaatgttccaaaacctttctctttacggtagtctcgccgaaatcgatactagcgaaaagcttaacgaagctatggacaaattaactgctgcccaagaacaattcagagaatacaaccaagaacaagttgacaaaatcttcaaggctgttgctttagctgcttctcaaaaccgtgttgctttcgctaagtacgcacacgaagaaacccaaaagggtgttttcgaagataaggttatcaagaacgaattcgctgctgattacatttaccacaagtactgcaatgacaagaccgccggtatcattgaatatgatgaagccaatggtcttatggaaattgctgaaccagttggtccagttgttggtattgctccagttactaacccaacttctactatcatctacaagtctttaattgccttaaagacccgtaactgtattatcttctcaccacatccaggagctcacaaggcctctgttttcgttgttaaggtcttacaccaagctgctgttaaggctggtgccccagaaaactgtattcaaatcatcttcccaaagatggatttaactactgaattattacaccaccaaaagactcgtttcatttgggctactggtggtccaggtttagttcacgcctcttacacttctggtaagccagctcttggtggtggtccaggtaatgctccagctcttattgatgaaacttgtgatatgaacgaagctgttggttctatcgttgtttctaagactttcgattgtggtatgatctgtgccactgaaaacgctgttgtcgttgtcgaatctgtctacgaaaacttcgttgctaccatgaagaagcgtggtgcctacttcatgactccagaagaaaccaagaaggcttctaaccttcttttcggagaaggtatgagattaaatgctaaggctgttggtcaaactgccaagactttagctgaaatggccggtttcgaagtcccagaaaacaccgttgttctctgtggtgaagcttctgaagttaaattcgaagaaccaatggctcacgaaaagttaactactatcctcggtatctacaaggctaaggactttgacgatggtgtcagattatgtaaggaattagttactttcggtggtaagggtcacactgctgttctctacaccaaccaaaacaacaaggaccgtattgaaaagtaccaaaacgaagttccagccttccacatcttagttgacatgccatcttccctcggttgtattggtgatatgtacaacttccgtcttgctccagctcttaccattacttgtggtactatgggtggtggttcctcctctgataacattggtccaaagcacttacttaacatcaagcgtgttggtatgagacgcgaaaacatgctttggttcaagattccaaagtctgtctacttcaagcgtgctatcctttctgaagctttatctgacttacgtgacacccacaagcgtgctatcattattaccgatagaactatgactatgttaggtcaaactgacaagatcattaaggcttgtgaaggtcatggtatggtctgcactgtctacgataaggttgtcccagatccaactatcaagtgtattatggaaggtgttaatgaaatgaacgtcttcaagccagatttagctattgctcttggtggtggttctgctatggatgccgctaagatgatgcgtttattctacgaatacccagaccaagacttacaagatattgctactcgtttcgtcgatatccgtaagcgtgttgttggttgtccaaagcttggtagacttattaagactcttgtctgtatcccaactacctctggtactggtgccgaagttactccattcgctgtcgttacctctgaagaaggtcgtaagtacccattagtcgactacgaacttactccagatatggctattgttgatccagaattcgctgttggtatgccaaagcgtttaacttcttggactggtattgatgctcttacccacgccattgaatcttacgtttctattatggctactgacttcactagaccatactctctccgtgctgttggtcttatcttcgaatccctttcccttgcttacaacaacggtaaggatattgaagctcgtgaaaagatgcacaatgcttctgctattgctggtatggcctttgccaacgctttccttggttgttgtcactctgttgctcaccaacttggttccgtctaccacattccacacggtcttgccaacgctttaatgctttctcacatcattaagtacaacgctactgactctccagttaagatgggtaccttcccacaatacaagtacccacaagctatgcgtcactacgctgaaattgctgaactcttattaccaccaactcaagttgttaagatgactgatgttgataaggttcaatacttaattgaccgtgttgaacaattaaaggctgacgttggtattccaaagtctattaaggaaactggaatggttactgaagaagacttcttcaacaaggttgaccaagttgctatcatggccttcgatgaccaatgtactggtgctaacccacgttacccattagtttctgaattaaaacaattaatgattgatgcctggaacggtgttgtcccaaagctctaa

SEQ ID NO: 39898 - protein, 885 aa, Piromyces sp
MSGLQMFQNLSLYGSLAEIDTSEKLNEAMDKLTAAQEQFREYNQEQVDKIFKAVALAASQNRVAFAKYAHEETQKGVFEDKVIKNEFAADYIYHKYCNDKTAGIIEYDEANGLMEIAEPVGPVVGIAPVTNPTSTIIYKSLIALKTRNCIIFSPHPGAHKASVFVVKVLHQAAVKAGAPENCIQIIFPKMDLTTELLHHQKTRFIWATGGPGLVHASYTSGKPALGGGPGNAPALIDETCDMNEAVGSIVVSKTFDCGMICATENAVVVVESVYENFVATMKKRGAYFMTPEETKKASNLLFGEGMRLNAKAVGQTAKTLAEMAGFEVPENTVVLCGEASEVKFEEPMAHEKLTTILGIYKAKDFDDGVRLCKELVTFGGKGHTAVLYTNQNNKDRIEKYQNEVPAFHILVDMPSSLGCIGDMYNFRLAPALTITCGTMGGGSSSDNIGPKHLLNIKRVGMRRENMLWFKIPKSVYFKRAILSEALSDLRDTHKRAIIITDRTMTMLGQTDKIIKACEGHGMVCTVYDKVVPDPTIKCIMEGVNEMNVFKPDLAIALGGGSAMDAAKMMRLFYEYPDQDLQDIATRFVDIRKRVVGCPKLGRLIKTLVCIPTTSGTGAEVTPFAVVTSEEGRKYPLVDYELTPDMAIVDPEFAVGMPKRLTSWTGIDALTHAIESYVSIMATDFTRPYSLRAVGLIFESLSLAYNNGKDIEAREKMHNASAIAGMAFANAFLGCCHSVAHQLGSVYHIPHGLANALMLSHIIKYNATDSPVKMGTFPQYKYPQAMRHYAEIAELLLPPTQVVKMTDVDKVQYLIDRVEQLKADVGIPKSIKETGMVTEEDFFNKVDQVAIMAFDDQCTGANPRYPLVSELKQLMIDAWNGVVPKL

SEQ ID NO: 39899 - DNA, 2682 bp, Streptococcus bovis
  CDS (1)..(2682): transl_table=11
atggctaaagcaacaaatgcagatgtaaagaataacgagttgagcgcagaagaattggctcaacagtacacaggagctcttgtcgaaaaagctcttgaagctgaacgtgtttatgcaacttattcacaagaacaagttgataacattgtcgcagctatggctcttgcaggttcagaagcttcacttgaattggcaaaagaagctcatgcagaaacaggtcgtggtgtcgttgaggataaggatattaaaaaccactttgctactgagtacgtttacgaacgtattaaaaacgaaaaaacagtaggcattattggggaagataaagtttcaggaagtatccaaattgcagcaccacttggtgtcttggctggtattgttccaacaactaacccaacttcaacaacaatgttcaagattttggttgcgttgaagacacgtaatgcaattgtttttgcattccacccacaagcccaaaaatgttcagcacacgcagcacaaattctttacgacgctgctgttaaagctggtgcaccagaaaacattgttcaatggattgaaacaccatctcttgcaaacacatcagcacttattcaaaatccgaaaattgcttctatcttggcaactggtggacctggtatggtaaatgccgctcttaaatcaggtaacccatcaatgggtgttggtgctggtaacggtgctatctacgttgatgcaacagctcacgttgaccgtgcagtagaagatttgttgttatcaaaacgtttcgataatggtatgatttgtgccacagaaaactctgcagtcgttgaagctcctatttacgatgaatggcttcaaaaaatgcaagacaaaggtgcctaccttgtacctaagaaggactataaaaaacttgaagactttgtctttaatgacagacacggtgttaacggtccagttgctggtatgccagctcgctggatttgtgaacaagccggtgtgaaattgccagaaggtaaagatgttctcttgtttgaacttgataagaaaaatatcggtgaaaaactatcttctgaaaaactttctccactcctttcagtttacaaagctaaagatcgtgctgaaggtgttgaaattgttgaagcacttcttgactaccaaggtgcaggacacaatgctggtattcaaattggttctcaagcagacccatttgttgctgaatatggcgatgctgtgaaagcatcacgtgtcttggttaaccaaccagattcagtcggaggtattggtgatgtctacacagacgcacttaaagctagcttaacacttggaacaggatcatgggggaaaaattcattgtcacacaatctttcaactggcgatctcttaaatgttaagacagttgccaaacgtcgcaaccgtcctcaatggattcgcctaccagaaaaaacttactacgaaaaaaatgctatttcttacttgcaagatgaatacgaaccaatgcaacgcgctttgattgttgccgacccaggtatggttcaatttggttttgttgatactgttcttgctcaattggcattgcgtgatgaaaaagttgcgacatcaatttacggtacaatcaaaccagatccaacacttggtcaaacgattgaaattgctaaacaaatgcgtgatttcaaaccagacacagttatcgcagtcggtggtggttctgctcttgatgcagctaaaattgcacgttacatctacgaatactcacttgatcaagaagctgatttccttgacagctacgaaaatgtcagcgaactcttcttacgtttgcaacaaaaattcatcgatatccgtaaacgtatcgtgaaattcaaacaccaaacagcaacacgtctcttctgtatcccaacaacatctggtacaggttcagaagttacaccatacgctgttatcactgatgaccacactcacgttaaatatcctttgactgactatgaattgactccacaagttgctatcgtagacccagaatttgttatgacagtgccaaaacgcacagtagctctttctggtcttgatactttgtcacatgcccttgaagcttatgtttcagttatggcatctgatttgactcgtccatggtcacttgaagctatcaagttggttatcgaaaacttggaagattcatataactatgatcctaaacacccaacacttcgtggtgaacaagcacgtgaaaacatgcactacgcagcaactcttgctggtatggccttctcaaatgccttcctaggtattaatcactcaatcgcacacaaaactggtggtgaatttggccttcctcacggtttagctatctcaattgctatgcaacacgttatccgctacaacggtgtggctggaaatgtaaaacgttcagtcttcccacgctatgaagaataccgtgcacaacgtgattacgctgatattgctcgtagccttggtcttaaaggtaaagatgatgcagcattggtagaagcactttgcgaacgtattgatgctttgatgaaagccgttgatgttgatccacgtctttctgcaaatggtgttacaaaagaagcctttgatgcagcagttgataaattagcatcacttgcatacgatgatcaatgtacacctgctaacccacgtcaaccttacattgctgagttgaaacaattattgattgacatgttctaa

SEQ ID NO: 39900 - protein, 893 aa, Streptococcus bovis
MAKATNADVKNNELSAEELAQQYTGALVEKALEAERVYATYSQEQVDNIVAAMALAGSEASLELAKEAHAETGRGVVEDKDIKNHFATEYVYERIKNEKTVGIIGEDKVSGSIQIAAPLGVLAGIVPTTNPTSTTMFKILVALKTRNAIVFAFHPQAQKCSAHAAQILYDAAVKAGAPENIVQWIETPSLANTSALIQNPKIASILATGGPGMVNAALKSGNPSMGVGAGNGAIYVDATAHVDRAVEDLLLSKRFDNGMICATENSAVVEAPIYDEWLQKMQDKGAYLVPKKDYKKLEDFVFNDRHGVNGPVAGMPARWICEQAGVKLPEGKDVLLFELDKKNIGEKLSSEKLSPLLSVYKAKDRAEGVEIVEALLDYQGAGHNAGIQIGSQADPFVAEYGDAVKASRVLVNQPDSVGGIGDVYTDALKASLTLGTGSWGKNSLSHNLSTGDLLNVKTVAKRRNRPQWIRLPEKTYYEKNAISYLQDEYEPMQRALIVADPGMVQFGFVDTVLAQLALRDEKVATSIYGTIKPDPTLGQTIEIAKQMRDFKPDTVIAVGGGSALDAAKIARYIYEYSLDQEADFLDSYENVSELFLRLQQKFIDIRKRIVKFKHQTATRLFCIPTTSGTGSEVTPYAVITDDHTHVKYPLTDYELTPQVAIVDPEFVMTVPKRTVALSGLDTLSHALEAYVSVMASDLTRPWSLEAIKLVIENLEDSYNYDPKHPTLRGEQARENMHYAATLAGMAFSNAFLGINHSIAHKTGGEFGLPHGLAISIAMQHVIRYNGVAGNVKRSVFPRYEEYRAQRDYADIARSLGLKGKDDAALVEALCERIDALMKAVDVDPRLSANGVTKEAFDAAVDKLASLAYDDQCTPANPRQPYIAELKQLLIDMF

SEQ ID NO: 39901 - DNA, 1164 bp, Klebsiella pneumoniae
  CDS (1)..(1164): transl_table=11
atgagctatcgtatgtttgattatctggtgccaaacgttaacttttttggccccaacgccatttccgtagtcggcgaacgctgccagctgctgggggggaaaaaagccctgctggtcaccgacaaaggcctgcgggcaattaaagatggcgcggtggacaaaaccctgcattatctgcgggaggccgggatcgaggtggcgatctttgacggcgtcgagccgaacccgaaagacaccaacgtgcgcgacggcctcgccgtgtttcgccgcgaacagtgcgacatcatcgtcaccgtgggcggcggcagcccgcacgattgcggcaaaggcatcggcatcgccgccacccatgagggcgatctgtaccagtatgccggaatcgagaccctgaccaacccgctgccgcctatcgtcgcggtcaataccaccgccggcaccgccagcgaggtcacccgccactgcgtcctgaccaacaccgaaaccaaagtgaagtttgtgatcgtcagctggcgcaacctgccgtcggtctctatcaacgatccgctgctgatgatcggtaaaccggccgccctgaccgcggcgaccgggatggatgccctgacccacgccgtagaggcctatatctccaaagacgctaacccggtgacggacgccgccgccatgcaggcgatccgcctcatcgcccgcaacctgcgccaggccgtggccctcggcagcaatctgcaggcgcgggaatacatggcctatgcctctctgctggccgggatggctttcaataacgccaacctcggctacgtgcacgccatggcgcaccagctgggcggcctgtacgacatgccgcacggcgtggccaacgctgtcctgctgccgcatgtggcgcgctacaacctgatcgccaacccggagaaattcgccgatatcgctgaactgatgggcgaaaatatcaccggactgtccactctcgacgcggcggaaaaagccatcgccgctatcacgcgtctgtcgatggatatcggtattccgcagcatctgcgcgatctgggggtaaaagagaccgacttcccctacatggcggagatggctctgaaagacggcaatgcgttctcgaacccgcgtaaaggcaacgagcaggagattgccgcgattttccgccaggcattctga

SEQ ID NO: 39902 - protein, 387 aa, Klebsiella pneumoniae
MSYRMFDYLVPNVNFFGPNAISVVGERCQLLGGKKALLVTDKGLRAIKDGAVDKTLHYLREAGIEVAIFDGVEPNPKDTNVRDGLAVFRREQCDIIVTVGGGSPHDCGKGIGIAATHEGDLYQYAGIETLTNPLPPIVAVNTTAGTASEVTRHCVLTNTETKVKFVIVSWRNLPSVSINDPLLMIGKPAALTAATGMDALTHAVEAYISKDANPVTDAAAMQAIRLIARNLRQAVALGSNLQAREYMAYASLLAGMAFNNANLGYVHAMAHQLGGLYDMPHGVANAVLLPHVARYNLIANPEKFADIAELMGENITGLSTLDAAEKAIAAITRLSMDIGIPQHLRDLGVKETDFPYMAEMALKDGNAFSNPRKGNEQEIAAIFRQAF

SEQ ID NO: 39903 - DNA, 2646 bp, Spironucleus barkhanus
  CDS (1)..(2646): transl_table=6
atgcgagcttaaatgaaggtcgctacttccgaagatcttaacaaacttatggacatggctttagagtcccactttgaattccttaaacttaactaggaataagtcaacaagatcttttatgctgcatcttttgctgcaaattctgctcgtatccctcttgcttaataggctgttattgatactggtatgggtgttgttgaagacaaggttatcaagaataactatgcttctgaatacatctttaatagatataaaaatgagaagactgttggtttgatttctgaagataaaatcaacggtaaggccacttatgctgaaccattaggtatcttggctggtattatccccaccaccaatcctacttctactgttatcttcaagtgcttgatcgctcttaagacacgtaattgtatagttatttcacctcatcctcgtgctgctaaatgttctattgaggctgctcgtattgtacgtgatgctgctatagctaatggtgctcctaaaaactgtattagctggattactgatccatctgtcgctctttctggagaacttatgaagcataaacttacctcatgtattcttgctactggtggtccagctatggtaactgctgcttactcttctggaaatcctgccttaggtgttggcccaggtaacaactgcgctatcattgatgagctatgcaatattaaggatgcagtttcttctataattttatcaaagacttttgataatggtatgatctgtgcttctgagtaatcttgcgtggttgttgattctgtctatgaataaatcaaggaggaattcaagtatcgtggttgcttcttccttaataaggaggaaactgcaaaaataggtgacttctgtcttcctattaaccctaagactggcatcagaggtttgaatccagcagctgttggctaacctgctcgtaagattgctgaaatggctggtgtttccgttcccgccgaacatccttgtaaagttctcattggtgaggatacgaatgatcacattggtcatacacatgccatgagtcttgaaaagcttgctccagttttaggtatgttcaaggccaaaaatttcgacgaagcattagaggtagcttccaagtgtatccatatggcaggtaaaggtcatactggttccatccatactgcttttgaggcttaagaccgtatcaataaatttgcccaggttgtttaagccggtcgtttaattgtcaattaaccttctgcccatggtggtattggcgatttatataacttcacccttgatcctaccttgactattggttgcggttcccacggtggtaactccgtatctcagaacgttggctgccagcatttactcaattataaaaatgtagttgttaaacgtgaaaattgcctctggttcaaatccccacctaagatctacttcaaatatggttgccttaccgaagccatcaaagatctttatcacttcaagagatgttttattataactgataaaatcttattcgatcttggatatactgacaacattatcaaacctctcgaagccaaaggtattaaaacaacaatattctctgaagtagcccctgacccagatcttgcctgttgtagctcttgtttgaagttggttaaggctttcaaacctgactgctttatcgcccttggtggtggttctgctatggatctcatgaagatggtacgtttgcaatacgaacatggtgatgctgatttcatcggactcgcctaacgtttcgcagatatcaggaagcgtatttatgagttccctgaattacttgaccttaagaaggttaagacttattccgtatgtatccctacttcttctggtactggggctgaggttactcctttcgcagttattactgataacaccattggtgttaagtaccctcttgctgattacatgctcgttcctcaaatggcaatcgttgactcatctcttgctatgaccatgccaagattccttgctgcatggactggcgttgacgctcttactcacgctatcgaatcctatgtgtcccttttggccactgaattcacttaaccattgtcattataggccatgaagcttatcttccagtatctccctgaatcttgcaacaaggttactaaggaatctcgtgaagctattcatcatgctgctacaattgctggtatggcttttggtaatgctttcttaggtatctgtcattctatggctcacaagctaggttaaaaattccacgttccacacggtcttgctaacgctatatgcctctgccctactatcaagtttaactctactgatgtgcctaccaagatgggtgctttccctcagtacaagtatccttaagccatataacgttatggcgaaatcgttgactatctcggtttcaagcctaaagttaacacaccaatgggtaaagttgaatgtctcatcgaaaatattttggaactttataagtaattagatgtttctccttatattaaagactttagaaatgctcctaccaaggaataatatgttgaagctttagattacctcagttatcacgcctttgatgatcagtgcactggtgctaaccctcgttaccccttaattgctgaattgaaggaagttctggctactttgtatgaaccttccaagtga

SEQ ID NO: 39904 - protein, 881 aa, Spironucleus barkhanus
MRAQMKVATSEDLNKLMDMALESHFEFLKLNQEQVNKIFYAASFAANSARIPLAQQAVIDTGMGVVEDKVIKNNYASEYIFNRYKNEKTVGLISEDKINGKATYAEPLGILAGIIPTTNPTSTVIFKCLIALKTRNCIVISPHPRAAKCSIEAARIVRDAAIANGAPKNCISWITDPSVALSGELMKHKLTSCILATGGPAMVTAAYSSGNPALGVGPGNNCAIIDELCNIKDAVSSIILSKTFDNGMICASEQSCVVVDSVYEQIKEEFKYRGCFFLNKEETAKIGDFCLPINPKTGIRGLNPAAVGQPARKIAEMAGVSVPAEHPCKVLIGEDTNDHIGHTHAMSLEKLAPVLGMFKAKNFDEALEVASKCIHMAGKGHTGSIHTAFEAQDRINKFAQVVQAGRLIVNQPSAHGGIGDLYNFTLDPTLTIGCGSHGGNSVSQNVGCQHLLNYKNVVVKRENCLWFKSPPKIYFKYGCLTEAIKDLYHFKRCFIITDKILFDLGYTDNIIKPLEAKGIKTTIFSEVAPDPDLACCSSCLKLVKAFKPDCFIALGGGSAMDLMKMVRLQYEHGDADFIGLAQRFADIRKRIYEFPELLDLKKVKTYSVCIPTSSGTGAEVTPFAVITDNTIGVKYPLADYMLVPQMAIVDSSLAMTMPRFLAAWTGVDALTHAIESYVSLLATEFTQPLSLQAMKLIFQYLPESCNKVTKESREAIHHAATIAGMAFGNAFLGICHSMAHKLGQKFHVPHGLANAICLCPTIKFNSTDVPTKMGAFPQYKYPQAIQRYGEIVDYLGFKPKVNTPMGKVECLIENILELYKQLDVSPYIKDFRNAPTKEQYVEALDYLSYHAFDDQCTGANPRYPLIAELKEVLATLYEPSK

SEQ ID NO: 39905 - DNA, 1191 bp, Trichomonas vaginalis
  CDS (1)..(1191)
atgggccgtttcacactcccacgcgttctctatcatggcaagggcgctctcgagaatctcaagacactcaagggcaagagagccttcgtcgtcacaggttcccacgctatgcgcaaattcggattccttgacaaggttgttaactacctcaaggaagccaagttcgaggttcatgtcttcgatggtgtcgagcaagacccatctgtcgaaacagtcttcaagggcgctaaggccatggaagaattcaagccagactggattgttgctctcggtggtggctctccaatcgatgctgccaaggccatgtgggctgtttacgaatacccagagatgaccttcgaaaagctcatcgtcccattctcattcccagaactccgccaaaaggcccacttctgcgccatcacatcaacatctggcacagctacagaagtcacagccttctctgtcatcacagactaccagaagggcatcaagtacccacttgctgatttcaacatcacaccagatgttgccattgtcgatccagatcttgctgagacaatgccaaagaagctcgtcgctttcacaggcatggatgccctcacacacgctttcgaagcctacgtttctacacttcactgcgattacactgatggcttggccctccactccatcaagctcatcttcgaaacactcgaagcttccttcaacggctgcatgaaggcccgcgctacaatgcacaacgctcagtgccttgctggtatggccttctccaacgccctcctcggcattgtccactcaatggcccacaagacaggcgctgcttacacaagtggccacatcgtccacggctgcgctaacgccatgtaccttccaaaggttatcaagtacaactccaagaacgaagaggccctccaccgctatggtgacatcgctcgcttccttggaatgcaaggcaaggatgatgtcgaactcgtcgatgctatctgccagagaatccgtgacctctgcgtcaagatcgaagtcccactctgcatcaaggactacgagaacggaatgatcaacgaacaggagtaccttgccaagctcaaggatgttgctacaaacgctatcggcgatgcttgcacaggctctaacccacgccagccaacccaggaggaaatggagaagctcctcctcgctgtcttctttgacaagccaatcgatttctaa

SEQ ID NO: 39906 - protein, 396 aa, Trichomonas vaginalis
MGRFTLPRVLYHGKGALENLKTLKGKRAFVVTGSHAMRKFGFLDKVVNYLKEAKFEVHVFDGVEQDPSVETVFKGAKAMEEFKPDWIVALGGGSPIDAAKAMWAVYEYPEMTFEKLIVPFSFPELRQKAHFCAITSTSGTATEVTAFSVITDYQKGIKYPLADFNITPDVAIVDPDLAETMPKKLVAFTGMDALTHAFEAYVSTLHCDYTDGLALHSIKLIFETLEASFNGCMKARATMHNAQCLAGMAFSNALLGIVHSMAHKTGAAYTSGHIVHGCANAMYLPKVIKYNSKNEEALHRYGDIARFLGMQGKDDVELVDAICQRIRDLCVKIEVPLCIKDYENGMINEQEYLAKLKDVATNAIGDACTGSNPRQPTQEEMEKLLLAVFFDKPIDF

SEQ ID NO: 39907 - DNA, 1155 bp, Escherichia coli
  CDS (1)..(1155): transl_table=11
atgagtgagtttttgctgaaaccccggatctgcttcggtcaagacgcgctgtcagtcctggacgagctaaccgcctgtcatgttttgctggttaccgatcaggcgatggtcaaattcggtcttgctgaacgtgtcacgcagcgtctctgtgcgcgcggcattgactggcaggtgtgggatgacgttgtcgccgatccggatatcgctaccgtggtccgagggatgaagttgatggacagctgctacccggatctggttatcgcactcggcggtggttcggtcattgacgcagccaaagcggttattttcgccctggcgcaaacccgtccggaagcaggacgtgaacgcccctgctttgtggctattccaaccaccagcggtacgggctcagaagtgaccagtttctcggtggtgaaagcccatgccgaaaaactggtgctggttgactcgtcgctgctaccggatatcgccattcttgatccgtcactggtggcatccgtgccacctgctatcaccgctgacaccggaatggatgtgttgtgccacgctctggaggcttatgtctcccttgccgccagcgacttttccgatgcacttgctgaaaaagtggtgcaacaggtgttcagctacctgccgggctgctggcgtaacggccaggatttgcaggctcgggagaaaatgcacaacgcctcatgtatggcaggaatggcgtttaccaatgcctctcttggcatcacccatagcctagctcatgcccttggtggtgttttccgtgtccctcatgggcgcgcaaatgccctgctaatggcacacgttgtggcatggaatgctgactaccacggtcaatgcgacacccttgctgcgcggaaatatgcacgtctggcacatctgttggatctgcctgccagcacgcctcgtgaaggagtaacaagcctgctggtcgcaatccaaacgctgaaagatgaaatgaatatgcccagggggattaacgacaccggcgtgaatgccgctgatttcgatcagcgcctggcggagatggttgcccaggcactgcgtgacagttgcaccccaaccaacccgcgcgaaccggatgcccgcgccctgactgaactttatcgccaggcctggagcggcaatatcgctcaatgccactga

SEQ ID NO: 39908 - protein, 384 aa, Escherichia coli
MSEFLLKPRICFGQDALSVLDELTACHVLLVTDQAMVKFGLAERVTQRLCARGIDWQVWDDVVADPDIATVVRGMKLMDSCYPDLVIALGGGSVIDAAKAVIFALAQTRPEAGRERPCFVAIPTTSGTGSEVTSFSVVKAHAEKLVLVDSSLLPDIAILDPSLVASVPPAITADTGMDVLCHALEAYVSLAASDFSDALAEKVVQQVFSYLPGCWRNGQDLQAREKMHNASCMAGMAFTNASLGITHSLAHALGGVFRVPHGRANALLMAHVVAWNADYHGQCDTLAARKYARLAHLLDLPASTPREGVTSLLVAIQTLKDEMNMPRGINDTGVNAADFDQRLAEMVAQALRDSCTPTNPREPDARALTELYRQAWSGNIAQCH

SEQ ID NO: 39909 - DNA, 1155 bp, Comamonas sp
  CDS (1)..(1155): transl_table=11
atgaatcctttccacttcgaaaccacgccgcgcatcatctgtcacaacggtgccagtaccaagctgggggaagcggcgcgcaatctgggcatacgccatgccttcttcgtgaccgataaaggcgtgcaccaggcaggtttgacaagcgctgccatggactcgctcaaggcggcggatattgccgtgacgatattcagcgaggtgcaggccgatccgcccgagtccgtcatcgtgcaagctgccgctgcagcacgcgaggccggtgcgaacggaatcatcggattcggcggtggcagttccatggatacagccaagctggttgcactgctggtcaaatctccgcaggagctgtccgcgatctacggcgcaggattggctcgaggtcctcgcctgccgctgattcagattccaacgacggcgggcaccggctccgaggtcacgcccatttccgtcgtcaccacgccgactgacgagaaaaagcccgtggtctcctccctgctgttgcccgacatcgcattgctggatgcgcagctgacgattgcactgccgcccgcagtcaccggtgcaaccggagtcgatgccctggtgcatgccatcgaagccttgtccacacgcctcaaacgcaatccattgtctgatttgctggctatcaaggcagtgcagatgatttacgaccacctgccactggcggtcaaggagggcagcaaccttgaagtgcgcgagcagatgctgctggcatcgctgttcgccggcatggcgttctccaatgcctcggtgggggcggtccacgcattcgcctacccgcttggcgtgcgctttcacgtcccgcacggtctatcgaattcattgatgctgccgcatatcctgcgatttaaccagcaggctgcagagtccacctacgccttgctgggacgcagcattcggcccgagctggagagtgcatccgacgccgccgcctcagcggcattcgtcgatgcaatgtcggagttggtggcccagatgccatacgcccagagcttgcgtgagctcggcgtcgagcgtgacgacctggcgatgctggccaaggatgtcatgggaattcagcggctgttggatcacaacccctgtcccatcacacacgaggatgcgatgaagctatacgcccgtgccttctga

SEQ ID NO: 39910 - protein, 384 aa, Comamonas sp
MNPFHFETTPRIICHNGASTKLGEAARNLGIRHAFFVTDKGVHQAGLTSAAMDSLKAADIAVTIFSEVQADPPESVIVQAAAAAREAGANGIIGFGGGSSMDTAKLVALLVKSPQELSAIYGAGLARGPRLPLIQIPTTAGTGSEVTPISVVTTPTDEKKPVVSSLLLPDIALLDAQLTIALPPAVTGATGVDALVHAIEALSTRLKRNPLSDLLAIKAVQMIYDHLPLAVKEGSNLEVREQMLLASLFAGMAFSNASVGAVHAFAYPLGVRFHVPHGLSNSLMLPHILRFNQQAAESTYALLGRSIRPELESASDAAASAAFVDAMSELVAQMPYAQSLRELGVERDDLAMLAKDVMGIQRLLDHNPCPITHEDAMKLYARAF

SEQ ID NO: 39911 - DNA, 1158 bp, Clostridium butyricum
  CDS (1)..(1158): transl_table=11
atgagaatgtatgattatttagtaccaagtgtaaactttatgggagcaaattcagtatcagtagtaggtgaaagatgcaaaatattaggtggaaaaaaagcattgatagttacagataagtttctaaaagatatggaaggtggagctgttgaattaacagttaaatatttaaaagaagctggattagatgttgtatattatgacggagttgaaccaaatccaaaagatgttaatgttatagaaggattaaaaatatttaaagaagaaaattgtgacatgatagtaactgtaggtggaggaagttcgcatgattgcggtaagggaataggaattgctgcaacacatgaaggagatctttatgattatgcaggaatagaaacacttgtcaatccattgccaccaatagtagctgtaaatactactgcaggaactgctagtgaattaactcgtcattgtgtattgactaatacaaaaaagaaaataaaatttgttatagttagctggagaaatttgcctctagtatctataaatgatccaatgcttatggtcaaaaaacctgcaggattaacagcagctacaggaatggatgctttaacacatgcaatagaagcatatgtatcaaaagatgcaaatccagtaacagatgcttcagcaatacaagctattaaattaatttcacaaaatttaagacaagctgtagctttaggagaaaatcttgaagcaagagaaaatatggcttatgcatcattactagcgggaatggcatttaataatgctaatttaggatatgtacatgcaatggctcatcaattagggggactgtatgatatgcctcatggagttgctaatgctatgctattaccacatgttgaacgttataatatgctatcaaatcctaagaagtttgcagatatagcagaatttatgggagaaaatatatctggactttctgtaatggaagcagcagagaaagccataaatgcaatgttcaggctttcagaggatgttggaattccgaaaagtctaaaggagatgggagtgaaacaagaagattttgagcatatggcagaactagctcttttagatggaaatgcctttagcaatccaagaaaaggaaatgcaaaagatattataaatatttttaaggctgcttattaa

SEQ ID NO: 39912 - protein, 385 aa, Clostridium butyricum
MRMYDYLVPSVNFMGANSVSVVGERCKILGGKKALIVTDKFLKDMEGGAVELTVKYLKEAGLDVVYYDGVEPNPKDVNVIEGLKIFKEENCDMIVTVGGGSSHDCGKGIGIAATHEGDLYDYAGIETLVNPLPPIVAVNTTAGTASELTRHCVLTNTKKKIKFVIVSWRNLPLVSINDPMLMVKKPAGLTAATGMDALTHAIEAYVSKDANPVTDASAIQAIKLISQNLRQAVALGENLEARENMAYASLLAGMAFNNANLGYVHAMAHQLGGLYDMPHGVANAMLLPHVERYNMLSNPKKFADIAEFMGENISGLSVMEAAEKAINAMFRLSEDVGIPKSLKEMGVKQEDFEHMAELALLDGNAFSNPRKGNAKDIINIFKAAY

SEQ ID NO: 39913 - DNA, 2649 bp, Mastigamoeba balamuthi
  CDS (1)..(2649)
atggacatcatcctcgagaaggtcgtcgccgcgcagcagatctacgccacctacacccaggagcaggtcgacaagatcttcgaggccgtcgccatggctgcctgcatgcagaggatccccctcgcgcagatggctgtcgaggacaccggcatgggtgtgatggaggacaaggtcatcaagaaccagttcgcctcggagttcatctacaacaagtacaggttcgagaagacctgcggcctcgtcaggtcggaccccgcgaacggcttcagccagtacgccgagcctctgggcgtcatcgccggcatcatcccgacgaccaaccccacgtcgacgacgatcttcaaggcgctgatcgccctcaagacccgcaacgccatcgtcttctcgccccacccccgcgccaagcgctgcaccatcgccgcggccaagatctgcctcgacgccgccatcaaggccggcgcccccgccaacatcatctcgtggatcgagaacccctcgatcgcgctgagcgccgcgctgatgggccaccgcctggtcaacctgatcctcgcgactggcggccccggcatggtcaaggccgcgtacaagagcggcaaccccgccatcggtgtcggcgccggcaactgccccgcgctcatcgacgagacggccgacatcaagatggccgtggcgtcgatcatcatgtccaagacgttcgacaacggcatgatctgcgcctcggagcagacggtcgtcgtgcacgagaaggtctacgacgaggtcaagcgcgagttccaggcccgcggctgccactttgtgacgccgtcggagaaggccgagctcgacaagatcatcctcgtcaacggcctccccaacgccaagatcgtcggccagaaggcggccacgatcatcgacatcgcggggctcaaggacaagatcccctcggacacccccgtgctgctggccgagattactgaggtcggcaagcaggagccgtggtcgctcgagaagctgtgcccgaccctgggcatgttcaaggtcccctcgttcgaggccggcgtcgacctggcgttccgcgccgtgcagttcggccgtggccacacgagcagcctgttcacgcacccccagaacaccgaccgcatccactacctcagcgcgcgcatgccctgcagccgcatcgtctgcaactgcccgtcggcccacggtggcatcggcgacatctacaacttcgtcatggcgcccgccctgaccctcggctgcggcagctggggcagcaactcggtctcggagaacatcggccccaagcacctgctcaacttcaagagcgtcgccgagcgccgcgagaacatgctgtggatgcagctgccccctcgcgtctacttcaagttcggctgcatgcacacggcgctgaccagcgagctgcgcaacaagaagcgcgcgctcgtcgtcactgacgtcccgctgttcaacctcggcttcgccaagaagatcaccgactcgctcaacactgtcggcgtgctctgcgagaccttctacgacgtcgagcccgacccgagcttcgacacggtccgcaagggcctcgagcgcatcaggctgttcaagcccgacgtgatcatcgcgatcggcggcggctcgcccatggacgcggccaagatgatgtggctcttctacgagttccccgagtacgagaacaagatcgaccagctctgcgcgcgcttcatggacatccgcaagcgcatctgctcgctgcccaagcccacggccaagaagtgccagctggtctgcatcccgacgacctcgggcactggctcggaggtgaccccgttctcggtcatcaccaacaagcaggagggcatcaagtacccgatcaccgactacgtcctcgtccccgacatcgccatcgccgaccccgagctgactctgtcggtcccccgcggcctggtcgcgtcgtgcggtctggacgtcctcacccacgcgctcgaggcgttcacgagcaccttctcgactccgttcacggccggctactgcctgcaggccgccgacatgatcttcaagtacctcgagcgcagctacgtcaacggcggcaaggaccaggaggcccgcgagggtgtccactacgccgcgacgctcgccggcatcgccttcgccaactcgttcctcggcctcgcccacagctgcgcgcacaagctcggcagcacgttccacatcccccacggcactgccaacgccctcgtcctgccgtacgtcatctactacaacagctcggacgcccccagcaagttcgtgccgttcccccagtaccagtacccgcaggccaaggagcgctacgcccaggtcgcgcacatgctgcacctcggcgccaacctcgacgacaacggcaaggtcatggccctcatcgacgcgatcgaggacctcaagatgaagacgaacctgcctctgtcgatccaggactacgggatccccgagtccgagttcctcgccaaggtcgacgaggttgccctgctggccttcgacgaccagtgcaccggcaccaacccccgctacccgctcgtctcggagatcaagaacctgctcctcgactcgtactacggcaccctgtcgcccaagaaccccaagcgcatgcagggcatccacatcaacagggagctctcgaagctcgcctcgcactga

SEQ ID NO: 39914 - protein, 882 aa, Mastigamoeba balamuthi
MDIILEKVVAAQQIYATYTQEQVDKIFEAVAMAACMQRIPLAQMAVEDTGMGVMEDKVIKNQFASEFIYNKYRFEKTCGLVRSDPANGFSQYAEPLGVIAGIIPTTNPTSTTIFKALIALKTRNAIVFSPHPRAKRCTIAAAKICLDAAIKAGAPANIISWIENPSIALSAALMGHRLVNLILATGGPGMVKAAYKSGNPAIGVGAGNCPALIDETADIKMAVASIIMSKTFDNGMICASEQTVVVHEKVYDEVKREFQARGCHFVTPSEKAELDKIILVNGLPNAKIVGQKAATIIDIAGLKDKIPSDTPVLLAEITEVGKQEPWSLEKLCPTLGMFKVPSFEAGVDLAFRAVQFGRGHTSSLFTHPQNTDRIHYLSARMPCSRIVCNCPSAHGGIGDIYNFVMAPALTLGCGSWGSNSVSENIGPKHLLNFKSVAERRENMLWMQLPPRVYFKFGCMHTALTSELRNKKRALVVTDVPLFNLGFAKKITDSLNTVGVLCETFYDVEPDPSFDTVRKGLERIRLFKPDVIIAIGGGSPMDAAKMMWLFYEFPEYENKIDQLCARFMDIRKRICSLPKPTAKKCQLVCIPTTSGTGSEVTPFSVITNKQEGIKYPITDYVLVPDIAIADPELTLSVPRGLVASCGLDVLTHALEAFTSTFSTPFTAGYCLQAADMIFKYLERSYVNGGKDQEAREGVHYAATLAGIAFANSFLGLAHSCAHKLGSTFHIPHGTANALVLPYVIYYNSSDAPSKFVPFPQYQYPQAKERYAQVAHMLHLGANLDDNGKVMALIDAIEDLKMKTNLPLSIQDYGIPESEFLAKVDEVALLAFDDQCTGTNPRYPLVSEIKNLLLDSYYGTLSPKNPKRMQGIHINRELSKLASH

SEQ ID NO: 39915 - DNA, 1167 bp, Clostridium beijerinckii
  CDS (1)..(1167): transl_table=11
atggcacgttttactttacctagggacttgtatcatggagaaggggcacttgaagtacttaaaactttaaaaggcaaaaaagcttttgtagttgttggtggaggatcaatgaaaagatttggttttcttaaacaagttgaagattatttaacagaagcaggaatggaagtagaactatttgaaggagtagaaccagatccatcagtagaaacagtaatgaagggtgccgaagcaatgagaaacttcgagcctgattggatagttgctatgggtggaggatcaccaatagatgctgcaaaagctatgtggatattctatgaatacccagattttacttttgaacaagctgttgttccatttggtttaccagagcttagacaaaaagctaaatttgtagctattccatcaacaagtggtacagctacagaagttacagctttttcagttataacaaattacacagaaaagattaaatatcctttagctgattttaacataactccagatatagcaatagttgatccagtattagctcaaactatgccaaaaacattaacagctcatactggaatggatgcactaactcatgctatagaagcatatactgcatcgcttagatcaaatttttctgatcctttagcaattaaggcattgcaaatggtacaagaaaatttaatcaagtcttttgaaggagacaaggaagctagaaatctaatgcatgaagctcaatgtttagcaggaatggcattttctaatgcattacttggaatagttcattcaatggctcacaaggttggtgctgtattccatattcctcatggatgtgcgaatgctatattcttaccatatgtaattcaatataatagaacaaaatgcgaagatagatatggagatattgcgagagccttaaaattaaaaggaaacaatgatgccgagttaactgattcattaatcgaattaattaatggattaaatgataagttagaaattcctcactcaatgaaagcgtatggagttactgaagaagattttaaagctaatctttcatttatcgctcataacgcagtattagatgcatgtacaggatcaaatcctagagaaatagatgatgctacaatggaaaaattatttgaatgcacatactatggaactaaagttaatttgtaa

SEQ ID NO: 39916 - protein, 388 aa, Clostridium beijerinckii
MARFTLPRDLYHGEGALEVLKTLKGKKAFVVVGGGSMKRFGFLKQVEDYLTEAGMEVELFEGVEPDPSVETVMKGAEAMRNFEPDWIVAMGGGSPIDAAKAMWIFYEYPDFTFEQAVVPFGLPELRQKAKFVAIPSTSGTATEVTAFSVITNYTEKIKYPLADFNITPDIAIVDPVLAQTMPKTLTAHTGMDALTHAIEAYTASLRSNFSDPLAIKALQMVQENLIKSFEGDKEARNLMHEAQCLAGMAFSNALLGIVHSMAHKVGAVFHIPHGCANAIFLPYVIQYNRTKCEDRYGDIARALKLKGNNDAELTDSLIELINGLNDKLEIPHSMKAYGVTEEDFKANLSFIAHNAVLDACTGSNPREIDDATMEKLFECTYYGTKVNL

SEQ ID NO: 39917 - DNA, 1167 bp, Clostridium beijerinckii
  CDS (1)..(1167): transl_table=11
atggcacgttttactttaccaagagacatttatcatggagaaggagcacttgaggcacttaaaactttaaaaggtaagaaagctttcttagtagttggtggcggatcaatgaaaagatttggatttcttaaacaagttgaagattatttaaaagaagcaggaatggaagtagaattatttgaaggtgttgaaccagatccatcagtggaaacagtaatgaaaggcgcagaagctatgagaaactttgagcctgattggatagttgcaatgggtggaggatcaccaattgatgctgcaaaggctatgtggatattctacgaatacccagattttacttttgaacaagcagttgttccatttggattaccagaccttagacaaaaagctaagtttgtagctattccatcaacaagcggtacagctacagaagttacagcattctcagttatcacaaattattcagaaaaaattaaatatcctttagctgattttaacataactccagatatagcaatagttgatccagcacttgctcaaactatgccaaaaactttaacagctcatactggaatggatgcattaactcacgctatagaagcatacactgcatcacttcaatcaaatttctcagatccattagcaattaaagctgtagaaatggttcaagaaaatttaatcaaatcatttgaaggggataaagaagctagaaatctaatgcatgaagctcaatgtttagctggaatggcattttctaatgcattacttggaatagttcactcaatggctcataaggttggtgctgtattccatattcctcatggatgtgcaaatgctatatttttaccatatgtaattgagtataacagaacaaaatgcgaaaatagatatggagatattgcgagagccttaaaattaaaaggaaacaatgatgccgagttaactgattcattaatcgaattaattaatggattaaatgataagttagaaattcctcactcaatgaaagcgtatggagttactgaagaagattttaaagctaatctttcatttatcgctcataacgcagtattagatgcatgtacaggatcaaatcctagagaaatagatgatgctacaatggaaaaattatttgaatgcacatactatggaactaaagttaatttgtaa

SEQ ID NO: 39918 - protein, 388 aa, Clostridium beijerinckii
MARFTLPRDIYHGEGALEALKTLKGKKAFLVVGGGSMKRFGFLKQVEDYLKEAGMEVELFEGVEPDPSVETVMKGAEAMRNFEPDWIVAMGGGSPIDAAKAMWIFYEYPDFTFEQAVVPFGLPDLRQKAKFVAIPSTSGTATEVTAFSVITNYSEKIKYPLADFNITPDIAIVDPALAQTMPKTLTAHTGMDALTHAIEAYTASLQSNFSDPLAIKAVEMVQENLIKSFEGDKEARNLMHEAQCLAGMAFSNALLGIVHSMAHKVGAVFHIPHGCANAIFLPYVIEYNRTKCENRYGDIARALKLKGNNDAELTDSLIELINGLNDKLEIPHSMKAYGVTEEDFKANLSFIAHNAVLDACTGSNPREIDDATMEKLFECTYYGTKVNL

SEQ ID NO: 39919 - DNA, 1248 bp, Pseudomonas aeruginosa
  CDS (1)..(1248): transl_table=11
atgcatcacacgccggagccgttggttcgccctgcgcgtgaattcctccactgccgttcaacaacgacaaaaatcgagcaagaggtacgtatggaattcaagttcttactccccgccaaagtcgtgatgggacccgacctgcgtgagcgcaccggcgaatacctgcgggaactcggcgtggcgcatgtgctgatcgtgacggacgccggggtaaaggccgcaggcctgttgaatggcgtgtatgccagcctgaatgagtgggagatcgcgttcgacgagatatcggacgtcaaggcaaaccctcgcagcgaagacatcaaccaggcggcgcagctgtatcgcggcaaaggtatccacggcctgctggccatcggcggcggcagcgcgatggacgcggccaaggcgatcagcctgctgctgacccacgagggtcggatcgaagactacgagggctctttcaccctcaggcacgccatcccgcctatcgtcgccatcccgaccaccgccggaaccggcagcgaagtgacctgcttctcggtgatcaccgataccgcccggcatttcaagatgagcgtccaggattaccgggtgggccccgttctggcattgctcgactcccgcattctcgacacgctgcctgcatcgattgccgccgcaaccggcatggatgccctcacccacgccatcgaagcctacacctgccgtgtgtcgaatccgatcagcgacgggctggcgctgcatgccatccgcctgatcagccaatacctcaggcccgccgtactggagccgggcaacctgcatgcacgcgagcaaatgctggtggccagcctgatcgccggcatggccttcggtaacgcggacgtcggcagcgtgcactgcatttccgaagccatcggtggcatgtacgacacgccacacggcgtgggcaacgcgatcttcctgcccttcgtgttcggccataaccgcgacgccgacatcacccgccacgcgcaggtcgcctatgcactgggtatcgaccccaacctctcgccggccgaggccgccgaggccgctgtcggctacctgttccagatgagcaaggacctgggcatcccccgcttcgccgaggtgaaaggcgtgcgcgaggaagacttcctgagcatcgccgaaaagtcgaagaagaatttctccgacggcagcaatgccaagcaaatgacggtggaaacctaccgtgaaatcgtcgccgccgcttaccactacgtagcgtga

SEQ ID NO: 39920 - protein, 415 aa, Pseudomonas aeruginosa
MHHTPEPLVRPAREFLHCRSTTTKIEQEVRMEFKFLLPAKVVMGPDLRERTGEYLRELGVAHVLIVTDAGVKAAGLLNGVYASLNEWEIAFDEISDVKANPRSEDINQAAQLYRGKGIHGLLAIGGGSAMDAAKAISLLLTHEGRIEDYEGSFTLRHAIPPIVAIPTTAGTGSEVTCFSVITDTARHFKMSVQDYRVGPVLALLDSRILDTLPASIAAATGMDALTHAIEAYTCRVSNPISDGLALHAIRLISQYLRPAVLEPGNLHAREQMLVASLIAGMAFGNADVGSVHCISEAIGGMYDTPHGVGNAIFLPFVFGHNRDADITRHAQVAYALGIDPNLSPAEAAEAAVGYLFQMSKDLGIPRFAEVKGVREEDFLSIAEKSKKNFSDGSNAKQMTVETYREIVAAAYHYVA

SEQ ID NO: 39921 - DNA, 1290 bp, Amycolatopsis methanolica
  CDS (1)..(1290): transl_table=11
atgcaggtcgacgaattgctgaagccgttccccatcaaggagttccacccgttcccgcgggcgctcctcggccccggggcccacgagatgatcggcccggaggcgctgaagctgggcttcaagaagacgctggtgatgacgagcgggctgcgcgggtccgacatcgtccacaagatcaccgagtcgatgaagtaccacgggctggaggtcgtgctctacgacaaggtcgagtccaaccccaaggactacaacgtcatggacgcggtcaagctgtaccaggagaacaagtgtgacagcttcgtctccatcggcggcgggtcctcgcacgacgcctgcaagggcgcccgcatctcggtcgcgcacgacggccgcaacgtcaacgacttcgagggcttcaacaagtccgagaacccgcgcaacccaccgcacatcgcggtgtccaccacggcgggcaccggctcggagacatcctgggcctacgtcatcaccgacaccaccaccgacccggacaacccgcacaagtacgtggcgttcgacgacgcctcggtggccacactggctatcgacgacccggtgctgtactacagctgcccgatcgactacaccgcgcagtgcggtttcgacgtgctcgcgcacgcgtccgagccgtacgtgtcgcggctgaacttcgagccgtcgctgggcaacgcgctgcgggccatcaagctcacggcggagaacctgcggcaggccacctggaacccgtccgagctgtccggccgtgagggcatgatgtacgcgcagtacatcgccgcgcaggcgttcaactccggcgggctcgggatcatccactccatctcgcacgcggtcagcgcgttctacgacacccaccacggcctgaacaacgcgatcgccctgccgcgcgtgtgggcgttcaacatgccggtggcgtacaagcggttcgccgacatggccgaggcgatgggcgtggacacgcacggcatgaccgacgtgcaggccgcggacgcgctggcggccgcgatccggctgctgcgcgacgtgggcatcccggagaagttcaccgacgtcacccaggacagctactcgaagaaccggctcggccagggcccgacgaagttctacgagcaggcgagcgtcatcaagggcgacgacgaggacgtggaccgcatcacgaaccacgtcctcggcgacgcctgcacgccgggcaatgccaaggaatgcaccttcgagaccgtgcgtccggtggtcgaccactgcatgaacggcgacctggacgacctgctcagctga

SEQ ID NO: 39922 - protein, 429 aa, Amycolatopsis methanolica
MQVDELLKPFPIKEFHPFPRALLGPGAHEMIGPEALKLGFKKTLVMTSGLRGSDIVHKITESMKYHGLEVVLYDKVESNPKDYNVMDAVKLYQENKCDSFVSIGGGSSHDACKGARISVAHDGRNVNDFEGFNKSENPRNPPHIAVSTTAGTGSETSWAYVITDTTTDPDNPHKYVAFDDASVATLAIDDPVLYYSCPIDYTAQCGFDVLAHASEPYVSRLNFEPSLGNALRAIKLTAENLRQATWNPSELSGREGMMYAQYIAAQAFNSGGLGIIHSISHAVSAFYDTHHGLNNAIALPRVWAFNMPVAYKRFADMAEAMGVDTHGMTDVQAADALAAAIRLLRDVGIPEKFTDVTQDSYSKNRLGQGPTKFYEQASVIKGDDEDVDRITNHVLGDACTPGNAKECTFETVRPVVDHCMNGDLDDLLS

SEQ ID NO: 39923 - DNA, 1152 bp, Rhodospirillum rubrum
  CDS (1)..(1152): transl_table=11
atgactcagaccgcttttttcatcccctcgatcaacctcatgggggcgggctgcttggccaccgccgtcaacaccatcaatgagcgcggcttcaagcgcgccctgatcgtcaccgacgcggtgcttgaaaagctgggcgtcgccggcaaggtgaccgagctgcttgatgaccatggcgtggaaagcatcgttttcggcggcgcccagcccaatccgacggtgtcgaatgtcgaggcgggtctggcgatcttgcgcgaggccgaatgcgattgcgtgatctcgctgggcggcggctcgccccatgactgcgccaagggcatcgcgctgtgcgccaccaacggcggggtcatcggtgattacgagggcgtcgataaatcggcccatccgcaattgccgctgatcgccatcaacaccacggccggcaccgccagcgaaatgacgcggttttgtatcatcaccgacgaaagccgtctggtgaagatggcgatcgtcgaccgccacgtcacgccgatcatgtcggtcaatgaccccgaactgatgatcggcaagcccgccgccctgaccgccgccaccggcatggacgccctgacccacgccatcgaagcctatgtctcgatcgccgccacgccgatcaccgacgcctgcgccctgaaggcggtgtcgatcatcgcccgcaccctgcgccgggcggtggccgatggcgccgatatcaaggcccgcgaggccatgtcctatgcccagttcctggccggcatggccttcaacaacgcctccctcggcttcgttcacgccatggcccaccagttgggcggcttttatgacctgccccatggcgtgtgcaacgccgtgctgttgccccatgtcgccgccttcaacgccagcgttgccggggcccgcctcaaggatgtcgccgaggcgatgggcgtcgacatcgccaatctgtccgacgatcagggggcggaggcctgcatcgccgccatccgcaccctagccgccgatatcggcatccccgccggccttacggaacttggcgtcaaggacggcgacgtgccgaccctggcgatcaacgccctgaaagacgcctgcggcctgaccaacccgcgcccggcgacccaggccgaaatcgaggcgatcttccgcgccgccgcctga

SEQ ID NO: 39924 - protein, 383 aa, Rhodospirillum rubrum
MTQTAFFIPSINLMGAGCLATAVNTINERGFKRALIVTDAVLEKLGVAGKVTELLDDHGVESIVFGGAQPNPTVSNVEAGLAILREAECDCVISLGGGSPHDCAKGIALCATNGGVIGDYEGVDKSAHPQLPLIAINTTAGTASEMTRFCIITDESRLVKMAIVDRHVTPIMSVNDPELMIGKPAALTAATGMDALTHAIEAYVSIAATPITDACALKAVSIIARTLRRAVADGADIKAREAMSYAQFLAGMAFNNASLGFVHAMAHQLGGFYDLPHGVCNAVLLPHVAAFNASVAGARLKDVAEAMGVDIANLSDDQGAEACIAAIRTLAADIGIPAGLTELGVKDGDVPTLAINALKDACGLTNPRPATQAEIEAIFRAAA

SEQ ID NO: 39925 - DNA, 1167 bp, Clostridium saccharobutylicum
  CDS (1)..(1167): transl_table=11
atgatgagatttacattaccaagagatatttattatggaaaaggatcactagaacaactaaaaaatcttaaaggtaaaaaggcaatgctagtacttggtggcggttcgatgaaaagatttggatttgtcgataaggtgttaggatacttaaaggaagctggaatagaagtaaaattaatagaaggagttgaaccagacccatcagttgaaacagtgttcaagggcgctgagttaatgagacaatttgaaccagattggattatagctatgggtggtggatcaccaattgatgctgcaaaagcaatgtggattttttatgaacacccagaaaaaacttttgatgacattaaagatccgtttacagtaccagaattaagaaataaggctaagttcctagcgattccatcaacaagtggtacagcaacagaagtaacagcattttctgtaattacagattataagactgaaataaaatatcctttagctgattttaatataactccagatgtagctgtagtagattcagaattagctgaaacaatgccacctaagttaactgcccatacaggaatggatgcattaactcatgcaattgaagcttatgtagcaacattacattcaccatttactgatccactagctatgcaagcgattgaaatgattaatgaacatttatttaaatcatatgaaggcgataaagaagctagagaacaaatgcattatgctcaatgtttagctggaatggctttctctaatgcactattaggaatatgtcatagtatggcgcataaaacaggggctgtattccatatccctcatggatgtgcgaatgcaatctatttaccatatgtaattaagtttaattcaaaaacttcattagaaagatatgctaaaatagcaaaacaaatttcattagcaggaaatacaaatgaggaattagttgattcattaataaacttagttaaagaattaaataagaagatgcaaataccaacaacattaaaagaatatggtattcatgaacaagaatttaagaataaggttgatttgatttcagaaagagctattggagatgcttgtactggatcaaatccaagacaattaaataaagatgaaatgaaaaagatttttgaatgcgtatattatggtacagaagttgatttttaa

SEQ ID NO: 39926 - protein, 388 aa, Clostridium saccharobutylicum
MMRFTLPRDIYYGKGSLEQLKNLKGKKAMLVLGGGSMKRFGFVDKVLGYLKEAGIEVKLIEGVEPDPSVETVFKGAELMRQFEPDWIIAMGGGSPIDAAKAMWIFYEHPEKTFDDIKDPFTVPELRNKAKFLAIPSTSGTATEVTAFSVITDYKTEIKYPLADFNITPDVAVVDSELAETMPPKLTAHTGMDALTHAIEAYVATLHSPFTDPLAMQAIEMINEHLFKSYEGDKEAREQMHYAQCLAGMAFSNALLGICHSMAHKTGAVFHIPHGCANAIYLPYVIKFNSKTSLERYAKIAKQISLAGNTNEELVDSLINLVKELNKKMQIPTTLKEYGIHEQEFKNKVDLISERAIGDACTGSNPRQLNKDEMKKIFECVYYGTEVDF

SEQ ID NO: 39927 - DNA, 1152 bp, Escherichia coli
  CDS (1)..(1152): transl_table=11
atggcagcttcaacgttctttattccttctgtgaatgtcatcggcgctgattcattgactgatgcaatgaatatgatggcagattatggatttacccgtaccttaattgtcactgacaatatgttaacgaaattaggtatggcgggcgatgtgcaaaaagcactggaagaacgcaatatttttagcgttatttatgatggcacccaacctaaccccaccacggaaaacgtcgccgcaggtttgaaattacttaaagagaataattgcgatagcgtgatctccttaggcggtggttctccacacgactgcgcaaaaggtattgcgctggtggcagccaatggcggcgatattcgcgattacgaaggcgttgaccgctctgcaaaaccgcagctgccgatgatcgccatcaataccacggcgggtacggcctctgaaatgacccgtttctgcatcatcactgacgaagcgcgtcatatcaaaatggcgattgttgataaacatgtcactccgctgctttctgtcaatgactcctctctgatgattggtatgccgaagtcactgaccgccgcaacgggtatggatgccttaacgcacgctatcgaagcatatgtttctattgccgccacgccgatcactgacgcttgtgcactgaaagccgtgaccatgattgccgaaaacctgccgttagccgttgaagatggcagtaatgcgaaagcgcgtgaagcaatggcttatgcccagttcctcgccggtatggcgttcaataatgcttctctgggttatgttcatgcgatggcgcaccagctgggcggtttctacaacctgccacacggtgtatgtaacgccgttttgctgccgcacgttcaggtattcaacagcaaagtcgccgctgcacgtctgcgtgactgtgccgctgcaatgggcgtgaacgtgacaggtaaaaacgacgcggaaggtgctgaagcctgcattaacgccatccgtgaactggcgaagaaagtggatatcccggcaggcctacgcgacctgaacgtgaaagaagaagatttcgcggtattggcgactaatgccctgaaagatgcctgtggctttactaacccgatccaggcaactcacgaagaaattgtggcgatttatcgcgcagcgatgtaa

SEQ ID NO: 39928 - protein, 383 aa, Escherichia coli
MAASTFFIPSVNVIGADSLTDAMNMMADYGFTRTLIVTDNMLTKLGMAGDVQKALEERNIFSVIYDGTQPNPTTENVAAGLKLLKENNCDSVISLGGGSPHDCAKGIALVAANGGDIRDYEGVDRSAKPQLPMIAINTTAGTASEMTRFCIITDEARHIKMAIVDKHVTPLLSVNDSSLMIGMPKSLTAATGMDALTHAIEAYVSIAATPITDACALKAVTMIAENLPLAVEDGSNAKAREAMAYAQFLAGMAFNNASLGYVHAMAHQLGGFYNLPHGVCNAVLLPHVQVFNSKVAAARLRDCAAAMGVNVTGKNDAEGAEACINAIRELAKKVDIPAGLRDLNVKEEDFAVLATNALKDACGFTNPIQATHEEIVAIYRAAM

SEQ ID NO: 39929 - DNA, 2613 bp, Entamoeba histolytica
  CDS (1)..(2613)
atgtcaacacaacaaactatgactgtagatgaacatattaatcaacttgttcgtaaagcacaagttgcacttaaagaatatcttaaaccagaatatacacaagaaaaaatagattatattgtaaagaaagcatcagttgcagcacttgatcaacattgtgcacttgcagcagctgcagttgaagaaacaggaagaggtatttttgaagataaagctactaaaaatatatttgcatgtgaacatgttacacatgaaatgagacatgctaaaacagttggtattattaatgtagatccactttatggaattacagaaattgcagaaccagttggagttgtttgtggagttacaccagttactaatccaacatcaacagctattttcaagtcacttatttcaattaaaacaagaaatccaattgtattttcattccatccatcagcacttaaatgttctattatggcagctaaaattgttagagatgcagctattgcagcaggagcaccagaaaattgtattcaatggattgaatttggaggaattgaagcatcaaataaattaatgaatcatccaggagttgctactattcttgctacaggaggaaatgctatggttaaagcagcatattcatcaggaaaaccagcacttggagtaggagcaggaaatgtaccaacatatattgaaaaaacatgtaatattaaacaagcagcaaatgatgtagttatgtcaaaatcatttgataatggtatgatttgtgcatcagaacaagcagcaattattgataaagaaatttatgatcaagtagttgaagaaatgaaaacacttggagcatatttcattaatgaagaagaaaaagctaaattagaaaagtttatgtttggagttaatgcatattcagcagatgttaataatgcaagacttaatccaaaatgtccaggtatgtcaccacaatggtttgctgaacaagttggaattaaagttccagaagattgtaatattatttgtgcagtttgtaaagaagttggaccaaatgaaccattaacaagagaaaaattatcaccagttcttgctattcttaaagcagaaaatacacaagatggtattgataaagctgaagctatggttgaatttaatggtagaggacattcagcagctattcattcgaatgataaagcagtagttgaaaagtatgcacttacaatgaaagcatgcagaattttacataatacaccatcatcacaaggaggaattggatcaatttataactatatttggccatcatttacacttggatgtggatcatatggaggaaattctgtatcagctaatgttacatatcataatttattaaatattaaaagacttgcagatagaagaaacaaccttcaatggttcagagttccaccaaagattttctttgaaccacattctattagatatcttgctgaacttaaggaacttagtaaaatattcattgtttcagatagaatgatgtataaattaggatatgtagatagagttatggatgtattgaaaagaagaagtaatgaagtagaaattgaaattttcattgatgtagaaccagatccatctattcaaaccgttcaaaaaggacttgctgttatgaatacatttggaccagataatattattgctattggaggaggatcagctatggatgcagctaagattatgtggttactttatgaacatccagaagccgatttctttgcaatgaaacaaaaattcattgatcttagaaagagagcatttaaattcccaacaatgggtaagaaagctagattaatttgtattccaacaacatcaggaactggatcagaagttacaccatttgcagttatttcagatcatgaaacaggtaagaaatatccacttgctgattattcacttacaccatcagttgctattgttgatccaatgtttactatgtcacttccaaagagagctattgctgatactggacttgatgtattggttcatgcaacagaagcatatgtttcagttatggctaatgaatatactgatggacttgctagagaagcagttaaattagtctttgaaaatcttcttaaatcatataatggagatttagaagcaagagaaaagatgcacaatgctgcaacaattgcaggtatggcatttgcatcagcattccttggtatggaccattccatggcacataaagttggagcagcattccatcttccacatggtagatgtgtagcagtattattaccacatgtcattagatataatggacaaaaaccaagaaagcttgcaatgtggccaaaatataatttctataaggcagaccaaagatatatggaacttgcacaaatggttggacttaaatgtaatacaccagctgaaggagttgaagcatttgctaaagcatgtgaagaattaatgaaagccacagagactattactggattcaagaaagcaaatattgatgaagcagcatggatgagtaaagtaccagaaatggcacttcttgcatttgaagatcaatgttcaccagctaatccaagagtcccaatggttaaggatatggaaaagattctcaaagctgcatattatccaattgcttaa

SEQ ID NO: 39930 - protein, 870 aa, Entamoeba histolytica
MSTQQTMTVDEHINQLVRKAQVALKEYLKPEYTQEKIDYIVKKASVAALDQHCALAAAAVEETGRGIFEDKATKNIFACEHVTHEMRHAKTVGIINVDPLYGITEIAEPVGVVCGVTPVTNPTSTAIFKSLISIKTRNPIVFSFHPSALKCSIMAAKIVRDAAIAAGAPENCIQWIEFGGIEASNKLMNHPGVATILATGGNAMVKAAYSSGKPALGVGAGNVPTYIEKTCNIKQAANDVVMSKSFDNGMICASEQAAIIDKEIYDQVVEEMKTLGAYFINEEEKAKLEKFMFGVNAYSADVNNARLNPKCPGMSPQWFAEQVGIKVPEDCNIICAVCKEVGPNEPLTREKLSPVLAILKAENTQDGIDKAEAMVEFNGRGHSAAIHSNDKAVVEKYALTMKACRILHNTPSSQGGIGSIYNYIWPSFTLGCGSYGGNSVSANVTYHNLLNIKRLADRRNNLQWFRVPPKIFFEPHSIRYLAELKELSKIFIVSDRMMYKLGYVDRVMDVLKRRSNEVEIEIFIDVEPDPSIQTVQKGLAVMNTFGPDNIIAIGGGSAMDAAKIMWLLYEHPEADFFAMKQKFIDLRKRAFKFPTMGKKARLICIPTTSGTGSEVTPFAVISDHETGKKYPLADYSLTPSVAIVDPMFTMSLPKRAIADTGLDVLVHATEAYVSVMANEYTDGLAREAVKLVFENLLKSYNGDLEAREKMHNAATIAGMAFASAFLGMDHSMAHKVGAAFHLPHGRCVAVLLPHVIRYNGQKPRKLAMWPKYNFYKADQRYMELAQMVGLKCNTPAEGVEAFAKACEELMKATETITGFKKANIDEAAWMSKVPEMALLAFEDQCSPANPRVPMVKDMEKILKAAYYPIA

SEQ ID NO: 39931 - DNA, 1269 bp, Schizosaccharomyces pombe
  CDS (1)..(1269)
atgtccattcttcgttctccatttcgtttaattcgatcgcctgctcgattctttccgtcactctttcattcctcttgtaatcaatcttttactaatggcttaaagcatcaatcaacctcttcgaaagccatgcctgttagcgcattctacataccttctttcaaccttttcggtaaaggttgtcttgctgaagccgccaagcaaattaagatgagcggcttcaaaaacaccttaattgttaccgatcctggtattattaaggtcggtttgtatgacaaagttaaggctctgttggaagaacaaagcatcactgttcacctttacgatggtgttcaacctaatcccaccgttggaaatgtcaaccaaggtctcgaaatcgttaagaaggaaaactgtgattctatggtatcaattggtggtggttctgctcacgattgtgccaaaggtattgctttgttagctactaatggcggtaaaattgcggattatgaaggtgttgataaatcctccaaacctcaacttcccttgattgcaatcaatacgactgcaggaactgcttctgaaatgactcgtttcgcaattatcaccgaagagacccgtcatattaaaatggctattatcgataagcatactatgcctatcctttccgttaacgatcctgaaacaatgtatggattacctccttccttgaccgctgctactggtatggacgctttgactcatgctgttgaagcttacgtctctactgctgctaatcccatcaccgatgcttgtgctgtcaaatgcatcgaactcgttaataagtatttgaagcgtgctgtcgacaacggcaaggacgaagaggctagagacaatatggcttatgccgaattccttggtggtatggcatttaacaacgcatctttgggttatgttcatgctatggctcatcaacttggtggtttctacggtattccacatggcgtctgtaacgctgttcttcttgcccatgtacagaaatttaattctagggatccaagagcaaatgctcgccttggtgatattgcttttcacttgggttgtgaagagcatactgccgaagcagctcttgaccgcatcagtcaacttgttcttgaagttaaaattcgtcctcatctagttgatctaggtgtcaaggaaaaagattttgatgtcttggttgaccacgctatgaaggatgcttgtggtgctactaaccctattcagcctacacatgacgaggtaaaggctattttcaaatcggctatgtaa

SEQ ID NO: 39932 - protein, 422 aa, Schizosaccharomyces pombe
MSILRSPFRLIRSPARFFPSLFHSSCNQSFTNGLKHQSTSSKAMPVSAFYIPSFNLFGKGCLAEAAKQIKMSGFKNTLIVTDPGIIKVGLYDKVKALLEEQSITVHLYDGVQPNPTVGNVNQGLEIVKKENCDSMVSIGGGSAHDCAKGIALLATNGGKIADYEGVDKSSKPQLPLIAINTTAGTASEMTRFAIITEETRHIKMAIIDKHTMPILSVNDPETMYGLPPSLTAATGMDALTHAVEAYVSTAANPITDACAVKCIELVNKYLKRAVDNGKDEEARDNMAYAEFLGGMAFNNASLGYVHAMAHQLGGFYGIPHGVCNAVLLAHVQKFNSRDPRANARLGDIAFHLGCEEHTAEAALDRISQLVLEVKIRPHLVDLGVKEKDFDVLVDHAMKDACGATNPIQPTHDEVKAIFKSAM

SEQ ID NO: 39933 - DNA, 1398 bp, Saccharomyces cerevisiae
  CDS (1)..(1398)
atgcttgggatcacgtatgccgttaactctacaaagcaattgatattttgctgcctcaaatatctcacactactaggatatattcttttatcaaacaggaaaaaagggcagcgtaccaacatgtataaaagggttattagcatttctggtttattaaagactggagtcaaacgtttttcttctgtctattgcaaaacaaccatcaacaacaagtttacatttgcaacaactaatagtcaaataagaaaaatgtcttccgttactgggttttacattccaccaatctctttctttggtgaaggtgctttagaagaaaccgctgattacatcaaaaacaaggattacaaaaaggctttgatcgttactgatcctggtattgcagctattggtctctccggtagagtccaaaagatgttggaagaacgtgacttaaacgttgctatctatgacaaaactcaaccaaacccaaatattgccaatgtcacagctggtttgaaggttttgaaggaacaaaactctgaaattgttgtttccattggtggtggttctgctcacgacaatgctaaggccattgctttattggctactaacggtggggaaatcggagactatgaaggtgtcaatcaatctaagaaggctgctttaccactatttgccatcaacactactgctggtactgcttccgaaatgaccagattcactattatctctaatgaagaaaagaaaatcaagatggctatcattgacaacaacgtcactccagctgttgctgtcaacgatccatctaccatgtttggtttgccacctgctttgactgctgctactggtctagatgctttgactcactgtatcgaagcttatgtttccaccgcctctaacccaatcaccgatgcctgtgctttgaagggtattgatttgatcaatgaaagcttagtcgctgcatacaaagacggtaaagacaagaaggccagaactgacatgtgttacgctgaatacttggcaggtatggctttcaacaatgcttctctaggttatgttcatgcccttgctcatcaacttggtggtttctaccacttgcctcatggtgtttgtaacgctgtcttgttgcctcatgttcaagaggccaacatgcaatgtccaaaggccaagaagagattaggtgaaattgctttgcatttcggtgcttctcaagaagatccagaagaaaccatcaaggctttgcacgttttaaacagaaccatgaacattccaagaaacttgaaagaattaggtgttaaaaccgaagattttgaaattttggctgaacacgccatgcatgatgcctgccatttgactaacccagttcaattcaccaaagaacaagtggttgccattatcaagaaagcctatgaatattaa

SEQ ID NO: 39934 - protein, 465 aa, Saccharomyces cerevisiae
MLGITYAVNSTKQLIFCCLKYLTLLGYILLSNRKKGQRTNMYKRVISISGLLKTGVKRFSSVYCKTTINNKFTFATTNSQIRKMSSVTGFYIPPISFFGEGALEETADYIKNKDYKKALIVTDPGIAAIGLSGRVQKMLEERDLNVAIYDKTQPNPNIANVTAGLKVLKEQNSEIVVSIGGGSAHDNAKAIALLATNGGEIGDYEGVNQSKKAALPLFAINTTAGTASEMTRFTIISNEEKKIKMAIIDNNVTPAVAVNDPSTMFGLPPALTAATGLDALTHCIEAYVSTASNPITDACALKGIDLINESLVAAYKDGKDKKARTDMCYAEYLAGMAFNNASLGYVHALAHQLGGFYHLPHGVCNAVLLPHVQEANMQCPKAKKRLGEIALHFGASQEDPEETIKALHVLNRTMNIPRNLKELGVKTEDFEILAEHAMHDACHLTNPVQFTKEQVVAIIKKAYEY

SEQ ID NO: 39935 - DNA, 1164 bp, Citrobacter freundii
  CDS (1)..(1164): transl_table=11
atgagctatcgtatgtttgattacctggtgccaaatgtgaacttctttggccccaatgctatttccgtggtcggcgaacgctgcaaactgttgggcggtaaaaaagcgctgctggtcactgataaaggtctgcgggcgattaaagacggcgcggtagataaaaccctcacacatctgcgtgaagccggtattgacgtcgtggtttttgacggcgttgagccaaaccccaaagacaccaacgtgcgcgacggcctggaggtctttcggaaagagcattgcgacatcatcgttaccgttggcggcggtagcccgcatgactgcggtaaaggcatcggtatcgccgcgactcacgaaggggatctctacagctatgccgggattgaaaccctgaccaacccgctgccgccgatcgttgcggtgaataccaccgccggtaccgccagcgaagtcacccgccactgcgtgctgaccaataccaaaaccaaagtgaagtttgtgattgtcagctggcgcaacctgccgtcggtctccattaacgatccgctgctaatgctcggcaagccagccccactgactgcggctaccgggatggacgccctgacccacgccgtggaagcctacatttccaaagatgccaacccggtcaccgacgctgccgctatccaggcgatccgcctgatcgcccgtaacttgcgccaggccgtggcgctgggcagcaacctgaaagctcgcgagaacatggcctacgcctccctgctggcgggtatggccttcaacaacgccaacctcggctacgttcacgcgatggcgcatcagcttggcggtctttacgacatgccgcacggcgtggcgaatgccgtactgctgccgcacgtagcgcgctataacctgatcgctaacccggaaaaatttgccgacatcgcagagtttatgggcgagaacacggacggactctccaccatggatgccgccgagctggccattcatgctattgcccgcctctccgccgacatcggtattccgcagcatctgcgcgatctgggcgtcaaagaagccgatttcccgtatatggctgaaatggcactgaaggacggcaacgccttctccaacccacgcaaagggaacgagaaagaaattgccgagatcttccgtcaggcattctga

SEQ ID NO: 39936 - protein, 387 aa, Citrobacter freundii
MSYRMFDYLVPNVNFFGPNAISVVGERCKLLGGKKALLVTDKGLRAIKDGAVDKTLTHLREAGIDVVVFDGVEPNPKDTNVRDGLEVFRKEHCDIIVTVGGGSPHDCGKGIGIAATHEGDLYSYAGIETLTNPLPPIVAVNTTAGTASEVTRHCVLTNTKTKVKFVIVSWRNLPSVSINDPLLMLGKPAPLTAATGMDALTHAVEAYISKDANPVTDAAAIQAIRLIARNLRQAVALGSNLKARENMAYASLLAGMAFNNANLGYVHAMAHQLGGLYDMPHGVANAVLLPHVARYNLIANPEKFADIAEFMGENTDGLSTMDAAELAIHAIARLSADIGIPQHLRDLGVKEADFPYMAEMALKDGNAFSNPRKGNEKEIAEIFRQAF

SEQ ID NO: 39937 - DNA, 1164 bp, Klebsiella pneumoniae
  CDS (1)..(1164): transl_table=11
atgagctatcgtatgtttgattatctggtgccaaacgttaacttttttggccccaacgccatttccgtagtcggcgaacgctgccagctgctgggggggaaaaaagccctgctggtcaccgacaaaggcctgcgggcaattaaagatggcgcggtggacaaaaccctgcattatctgcgggaggccgggatcgaggtggcgatctttgacggcgtcgagccgaacccgaaagacaccaacgtgcgcgacggcctcgccgtgtttcgccgcgaacagtgcgacatcatcgtcaccgtgggcggcggcagcccgcacgattgcggcaaaggcatcggcatcgccgccacccatgagggcgatctgtaccagtatgccggaatcgagaccctgaccaacccgctgccgcctatcgtcgcggtcaataccaccgccggcaccgccagcgaggtcacccgccactgcgtcctgaccaacaccgaaaccaaagtgaagtttgtgatcgtcagctggcgcaacctgccgtcggtctctatcaacgatccactgctgatgatcggtaaaccggccgccctgaccgcggcgaccgggatggatgccctgacccacgccgtagaggcctatatctccaaagacgctaacccggtgacggacgccgccgccatgcaggcgatccgcctcatcgcccgcaacctgcgccaggccgtggccctcggcagcaatctgcaggcgcgggaaaacatggcctatgcttctctgctggccgggatggctttcaataacgccaacctcggctacgtgcacgccatggcgcaccagctgggcggcctgtacgacatgccgcacggcgtggccaacgctgtcctgctgccgcatgtggcgcgctacaacctgatcgccaacccggagaaattcgccgatatcgctgaactgatgggcgaaaatatcaccggactgtccactctcgacgcggcggaaaaagccatcgccgctatcacgcgtctgtcgatggatatcggtattccgcagcatctgcgcgatctgggggtaaaagaggccgacttcccctacatggcggagatggctctaaaagacggcaatgcgttctcgaacccgcgtaaaggcaacgagcaggagattgccgcgattttccgccaggcattctga

SEQ ID NO: 39938 - protein, 387 aa, Klebsiella pneumoniae
MSYRMFDYLVPNVNFFGPNAISVVGERCQLLGGKKALLVTDKGLRAIKDGAVDKTLHYLREAGIEVAIFDGVEPNPKDTNVRDGLAVFRREQCDIIVTVGGGSPHDCGKGIGIAATHEGDLYQYAGIETLTNPLPPIVAVNTTAGTASEVTRHCVLTNTETKVKFVIVSWRNLPSVSINDPLLMIGKPAALTAATGMDALTHAVEAYISKDANPVTDAAAMQAIRLIARNLRQAVALGSNLQARENMAYASLLAGMAFNNANLGYVHAMAHQLGGLYDMPHGVANAVLLPHVARYNLIANPEKFADIAELMGENITGLSTLDAAEKAIAAITRLSMDIGIPQHLRDLGVKEADFPYMAEMALKDGNAFSNPRKGNEQEIAAIFRQAF

SEQ ID NO: 39939 - DNA, 1188 bp, Salmonella typhimurium
  CDS (1)..(1188): transl_table=11
atgcaagctgaactacagacggcgctgtttcaggcattcgacaccctgaatctgcaacgggtgaaaacgttcagcgtaccgccggtcacgctgtgcggacttggggcgctcggcgcctgtggacaggaagcgcaagcgcgaggcgtaagccatctgtttgtgatggtcgacagcttcctgcatcaggcgggaatgaccgcgccgctggcacgcagcctggcgatgaagggcgtggcgatgacggtctggccgtgtccgcctggcgagccgtgcatcaccgatgtctgcgcggcggtggcgcaactgcgtgaggcggcgtgcgacggcgtagtggcctttggcggcggttcggtgctggacgcggcgaaagcggtcgccctgctggtgactaaccctgaccagacgctgagcgccatgaccgagcacagtacattacgcccgcgtctgccgctgattgcggtgccgaccaccgccggaaccggttctgaaaccaccaacgtaacggtgattatcgacgcggtcagcgggcgcaagcaggtgctggcgcacgcgtcactaatgccggacgtggcgattcttgatgctgccgtgaccgaaggcgttccgccaaacgtgacggcgatgaccggtatcgatgcgttgacgcatgcgattgaggcctacagcgcgctcaacgccacgccgtttaccgacagcctggcgattggcgcgatagcgatgattggcaaatcgctgccgaaagccgtgggttacggccacgatctggcggcgcgtgaaaatatgttgctggcctcctgtatggcgggaatggccttttccagcgccggtctggggctgtgtcatgcgatggcgcaccagcctggggcggcgctgcatattccgcacggccaggccaacgccatgctgctgccaacagtcatgggctttaaccggatggtttgccgcgagcgcttcagtcaaataggtcgggcgttaaccaataagaaatcggacgatcgcgatgcgattgcggcggtgtgcgagctgattgccgaagtgggacagagcaaacggctggctgacgctggcgccaaacccgaacactacagcgcgtgggcgcaagccgcgctggaggatatttgtctgcgcagtaacccacgcaccgccacacaggcacagattatcgacctgtacgcggctgccgggtaa

SEQ ID NO: 39940 - protein, 395 aa, Salmonella typhimurium
MQAELQTALFQAFDTLNLQRVKTFSVPPVTLCGLGALGACGQEAQARGVSHLFVMVDSFLHQAGMTAPLARSLAMKGVAMTVWPCPPGEPCITDVCAAVAQLREAACDGVVAFGGGSVLDAAKAVALLVTNPDQTLSAMTEHSTLRPRLPLIAVPTTAGTGSETTNVTVIIDAVSGRKQVLAHASLMPDVAILDAAVTEGVPPNVTAMTGIDALTHAIEAYSALNATPFTDSLAIGAIAMIGKSLPKAVGYGHDLAARENMLLASCMAGMAFSSAGLGLCHAMAHQPGAALHIPHGQANAMLLPTVMGFNRMVCRERFSQIGRALTNKKSDDRDAIAAVCELIAEVGQSKRLADAGAKPEHYSAWAQAALEDICLRSNPRTATQAQIIDLYAAAG

SEQ ID NO: 39941 - DNA, 25 bp, Artificial sequence
  (1)..(25): primer
atgatggctaacagaatgattctga

SEQ ID NO: 39942 - DNA, 23 bp, Artificial sequence
  (1)..(23): primer
ttaccaggcggtatggtaaagct

SEQ ID NO: 39943 - protein, 429 aa, Artificial sequence
  Variant (5)..(6): xaa in position 5 to 6 is any amino acid
  Variant (8)..(8): xaa in position 8 is any amino acid
  Variant (9)..(12): xaa in position 9 to 12 is any or no amino acid
  Variant (14)..(19): xaa in position 14 to 19 is any amino acid
  Variant (20)..(21): xaa in position 20 to 21 is any or no amino acid
  Variant (23)..(27): xaa in position 23 to 27 is any amino acid
  Variant (28)..(32): xaa in position 28 to 32 is any or no amino acid
  Variant (35)..(40): xaa in position 35 to 40 is any amino acid
  Variant (42)..(45): xaa in position 42 to 45 is any amino acid
  Variant (47)..(48): xaa in position 47 to 48 is any amino acid
  Variant (50)..(58): xaa in position 50 to 58 is any amino acid
  Variant (59)..(59): xaa in position 59 is any or no amino acid
  Variant (61)..(61): xaa in position 61 is any amino acid
  Variant (64)..(64): xaa in position 64 is any amino acid
  Variant (70)..(71): xaa in position 70 to 71 is any amino acid
  Variant (73)..(73): xaa in position 73 is any amino acid
  Variant (76)..(76): xaa in position 76 is any amino acid
  Variant (78)..(78): xaa in position 78 is any amino acid
  Variant (80)..(91): xaa in position 80 to 91 is any amino acid
  Variant (92)..(127): xaa in position 92 to 127 is any or no amino acid
  Variant (129)..(129): xaa in position 129 is any amino acid
  Variant (131)..(131): xaa in position 131 is any amino acid
  Variant (142)..(144): xaa in position 142 to 144 is any amino acid
  Variant (148)..(150): xaa in position 148 to 150 is any amino acid
  Variant (151)..(157): xaa in position 151 to 157 is any or no amino acid
  Variant (159)..(160): xaa in position 159 to 160 is any amino acid
  Variant (162)..(167): xaa in position 162 to 167 is any amino acid
  Variant (169)..(169): xaa in position 169 is any amino acid
  Variant (173)..(173): xaa in position 173 is any amino acid
  Variant (175)..(176): xaa in position 175 to 176 is any amino acid
  Variant (178)..(180): xaa in position 178 to 180 is any amino acid
  Variant (183)..(184): xaa in position 183 to 184 is any amino acid
  Variant (186)..(186): xaa in position 186 is any amino acid
  Variant (188)..(188): xaa in position 188 is any amino acid
  Variant (193)..(193): xaa in position 193 is any amino acid
  Variant (195)..(195): xaa in position 195 is any amino acid
  Variant (202)..(202): xaa in position 202 is any amino acid
  Variant (204)..(209): xaa in position 204 to 209 is any amino acid
  Variant (210)..(224): xaa in position 210 to 224 is any or no amino acid
  Variant (227)..(228): xaa in position 227 to 228 is any amino acid
  Variant (231)..(231): xaa in position 231 is any amino acid
  Variant (234)..(234): xaa in position 234 is any amino acid
  Variant (237)..(239): xaa in position 237 to 239 is any amino acid
  Variant (241)..(242): xaa in position 241 to 242 is any amino acid
  Variant (244)..(249): xaa in position 244 to 249 is any amino acid
  Variant (250)..(257): xaa in position 250 to 257 is any or no amino acid
  Variant (260)..(261): xaa in position 260 to 261 is any amino acid
  Variant (263)..(264): xaa in position 263 to 264 is any amino acid
  Variant (266)..(267): xaa in position 266 to 267 is any amino acid
  Variant (274)..(275): xaa in position 274 to 275 is any amino acid
  Variant (277)..(277): xaa in position 277 is any amino acid
  Variant (280)..(281): xaa in position 280 to 281 is any amino acid
  Variant (287)..(287): xaa in position 287 is any amino acid
  Variant (291)..(292): xaa in position 291 to 292 is any amino acid
  Variant (293)..(298): xaa in position 293 to 298 is any or no amino acid
  Variant (300)..(300): xaa in position 300 is any amino acid
  Variant (303)..(304): xaa in position 303 to 304 is any amino acid
  Variant (310)..(311): xaa in position 310 to 311 is any amino acid
  Variant (313)..(314): xaa in position 313 to 314 is any amino acid
  Variant (317)..(325): xaa in position 317 to 325 is any amino acid
  Variant (326)..(342): xaa in position 326 to 342 is any or no amino acid
  Variant (344)..(350): xaa in position 344 to 350 is any amino acid
  Variant (351)..(364): xaa in position 351 to 364 is any or no amino acid
  Variant (366)..(367): xaa in position 366 to 367 is any amino acid
  Variant (369)..(370): xaa in position 369 to 370 is any amino acid
  Variant (372)..(373): xaa in position 372 to 373 is any amino acid
  Variant (374)..(375): xaa in position 374 to 375 is any or no amino acid
  Variant (377)..(377): xaa in position 377 is any or no amino acid
  Variant (379)..(380): xaa in position 379 to 380 is any amino acid
  Variant (381)..(381): xaa in position 381 is any or no amino acid
  Variant (383)..(385): xaa in position 383 to 385 is any amino acid
  Variant (387)..(392): xaa in position 387 to 392 is any amino acid
  Variant (393)..(401): xaa in position 393 to 401 is any or no amino acid
  Variant (404)..(405): xaa in position 404 to 405 is any amino acid
  Variant (407)..(408): xaa in position 407 to 408 is any amino acid
  Variant (410)..(414): xaa in position 410 to 414 is any amino acid
  Variant (416)..(417): xaa in position 416 to 417 is any or no amino acid
  Variant (420)..(425): xaa in position 420 to 425 is any amino acid
  Variant (427)..(428): xaa in position 427 to 428 is any amino acid
IVTDXXLXXXXXGXXXXXXXXLXXXXXXXXXXVFXXXXXXPXXXXVXXGXXXXXXXXXXDXIIXLGGGSXXDXAKXIXLXXXXXXXXXXXXXXXXXXXXXXXXXXXXXXXXXXXXXXXXXXXXXXXXIXIXTTAGTGSEVTXXXVITXXXXXXXXXXKXXIXXXXXXPXVAIXDXXLXXXMPXXLXAXTGMDXLXHAIEAYXSXXXXXXXXXXXXXXXXXXXXXTDXXALXAIXLIXXXLXXAXXXXXXXXXXXXXXARXXMXXAXXLAGMAFXXAXLGXXHAMAHXLGGXXXXXXXXLXHGXXNAILLXXVXXYNXXXXXXXXXXXXXXXXXXXXXXXXXXAXXXXXXXXXXXXXXXXXXXXXIXXIXXLXXXXLXIXXXLXXXGXXXXXXXXXXXXXXXLAXXAXXDXXXXXNXXPRXXXXXXIXXI

SEQ ID NO: 39944 - protein, 16 aa, Artificial sequence
  Variant (2)..(2): xaa in position 2 is any amino acid
  Variant (3)..(4): xaa in position 3 to 4 is Ile, Leu or Val
  Variant (5)..(5): xaa in position 5 is Ala, Gly, Ser or Thr
  Variant (6)..(6): xaa in position 6 is Phe, Ile, Leu, Met or Val
  Variant (11)..(12): xaa in position 11 to 12 is any amino acid
  Variant (14)..(14): xaa in position 14 is any amino acid
  Variant (15)..(15): xaa in position 15 is Ala, Cys, Gly, Ser or Thr
DXXXXXGGGSXXDXXK

SEQ ID NO: 39945 - protein, 14 aa, Artificial sequence
  Variant (2)..(2): xaa in position 2 is Ala or Ser
  Variant (5)..(5): xaa in position 5 is Ala or Gly
  Variant (6)..(6): xaa in position 6 is Ala or Ser
  Variant (8)..(8): xaa in position 8 is any amino acid
  Variant (9)..(9): xaa in position 9 is Gly or Thr
  Variant (10)..(12): xaa in position 10 to 12 is any amino acid
  Variant (13)..(13): xaa in position 13 is Ile or Val
  Variant (14)..(14): xaa in position 14 is Ile, Leu or Val
TXGTXXEXXXXXXX

SEQ ID NO: 39946 - protein, 32 aa, Artificial sequence
  Variant (2)..(8): xaa in position 2 to 8 is any amino acid
  Variant (9)..(13): xaa in position 9 to 13 is any or no amino acid
  Variant (15)..(16): xaa in position 15 to 16 is any amino acid
  Variant (17)..(17): xaa in position 17 is Ile, Leu or Val
  Variant (18)..(18): xaa in position 18 is Ala, Cys, Thr or Val
  Variant (20)..(20): xaa in position 20 is any amino acid
  Variant (21)..(21): xaa in position 21 is Gly, Ser or Thr
  Variant (23)..(23): xaa in position 23 is any amino acid
  Variant (25)..(25): xaa in position 25 is Ala or Val
  Variant (26)..(26): xaa in position 26 is Phe, Ile, Leu, Met or Val
  Variant (27)..(27): xaa in position 27 is Ala, Cys, Ser, Thr or Val
  Variant (29)..(30): xaa in position 29 to 30 is any amino acid
  Variant (32)..(32): xaa in position 32 is Ala, Cys, Gly, Ser or Thr
DXXXXXXXXXXXXPXXXXAXXGXDXXXHXXEX

SEQ ID NO: 39947 - protein, 32 aa, Artificial sequence
  Variant (2)..(10): xaa in position 2 to 10 is any amino acid
  Variant (11)..(11): xaa in position 11 is any or no amino acid
  Variant (13)..(13): xaa in position 13 is any amino acid
  Variant (14)..(14): xaa in position 14 is any or no amino acid
  Variant (17)..(23): xaa in position 17 to 23 is any amino acid
  Variant (24)..(24): xaa in position 24 is any or no amino acid
  Variant (26)..(26): xaa in position 26 is Ala, Gly or Ser
  Variant (27)..(27): xaa in position 27 is Phe, Ile, Leu, Met or Val
  Variant (28)..(28): xaa in position 28 is Ala, Gly, Gln or Ser
  Variant (29)..(31): xaa in position 29 to 31 is any amino acid
RXXXXXXXXXXGXXAFXXXXXXXXHXXXXXXG

SEQ ID NO: 39948 - protein, 16 aa, Artificial sequence
  Variant (3)..(4): xaa in position 3 to 4 is any amino acid
  Variant (5)..(5): xaa in position 5 is Asn or Val
  Variant (6)..(6): xaa in position 6 is Ala, Gly, Ser or Thr
  Variant (7)..(8): xaa in position 7 to 8 is any amino acid
  Variant (9)..(9): xaa in position 9 is Phe, Ile, Leu, Met or Val
  Variant (10)..(11): xaa in position 10 to 11 is any amino acid
  Variant (13)..(15): xaa in position 13 to 15 is any amino acid
HGXXXXXXXXXVXXXN

SEQ ID NO: 39949 - DNA, 1434 bp, Escherichia coli K12; identical to SEQ ID NO: 4679
  CDS (1)..(1434)

SEQ ID NO: 39950 - protein, 477 aa, Escherichia coli K12 [sequence omitted]

SEQ ID NO: 39951 - DNA, 1314 bp, Pyrococcus abyssi; identical to SEQ ID NO: 4681
  CDS (1)..(1314)

SEQ ID NO: 39952 - protein, 437 aa, Pyrococcus abyssi; identical to SEQ ID NO: 4682

SEQ ID NO: 39953 - DNA, 1425 bp, Chlamydia muridarum, Chlamydia trachomatis MoPn; identical to SEQ ID NO: 4683
  CDS (1)..(1425)

SEQ ID NO: 39954 - protein, 474 aa, Chlamydia muridarum, Chlamydia trachomatis MoPn; identical to SEQ ID NO: 4684

SEQ ID NO: 39955 - DNA, 1434 bp, Clostridium acetobutylicum; identical to SEQ ID NO: 4685
  CDS (1)..(1434)

SEQ ID NO: 39956 - protein, 477 aa, Clostridium acetobutylicum; identical to SEQ ID NO: 4686

SEQ ID NO: 39957 - DNA, 1431 bp, Yersinia pestis; identical to SEQ ID NO: 4687
  CDS (1)..(1431)

SEQ ID NO: 39958 - protein, 476 aa, Yersinia pestis; identical to SEQ ID NO: 4688

SEQ ID NO: 39959 - DNA, 1443 bp, Agrobacterium tumefaciens; identical to SEQ ID NO: 4689
  CDS (1)..(1443)

SEQ ID NO: 39960 - protein, 480 aa, Agrobacterium tumefaciens; identical to SEQ ID NO: 4690

SEQ ID NO: 39961 - DNA, 1479 bp, Nostoc sp. PCC 7120; identical to SEQ ID NO: 4691
  CDS (1)..(1479)

SEQ ID NO: 39962 - protein, 492 aa, Nostoc sp. PCC 7120; identical to SEQ ID NO: 4692

SEQ ID NO: 39963 - DNA, 1419 bp, Nostoc sp. PCC 7120; identical to SEQ ID NO: 4693
  CDS (1)..(1419)

SEQ ID NO: 39964 - protein, 472 aa, Nostoc sp. PCC 7120; identical to SEQ ID NO: 4694

SEQ ID NO: 39965 - DNA, 1431 bp, Haemophilus influenzae; identical to SEQ ID NO: 4695
  CDS (1)..(1431)

SEQ ID NO: 39966 - protein, 476 aa, Haemophilus influenzae; identical to SEQ ID NO: 4696

SEQ ID NO: 39967 - DNA, 1392 bp, Aquifex aeolicus; identical to SEQ ID NO: 4697
  CDS (1)..(1392)

SEQ ID NO: 39968 - protein, 463 aa, Aquifex aeolicus; identical to SEQ ID NO: 4698

SEQ ID NO: 39969 - DNA, 1371 bp, Pyrococcus horikoshii; identical to SEQ ID NO: 4699
  CDS (1)..(1371)

SEQ ID NO: 39970 - protein, 456 aa, Pyrococcus horikoshii; identical to SEQ ID NO: 4700

SEQ ID NO: 39971 - DNA, 1431 bp, Chlamydophila pneumoniae, Chlamydia pneumoniae; identical to SEQ ID NO: 4701
  CDS (1)..(1431)

SEQ ID NO: 39972 - protein, 476 aa, Chlamydophila pneumoniae, Chlamydia pneumoniae; identical to SEQ ID NO: 4702

SEQ ID NO: 39973 - DNA, 1452 bp, Lactococcus lactis subsp. lactis; identical to SEQ ID NO: 4703
  CDS (1)..(1452)

SEQ ID NO: 39974 - protein, 483 aa, Lactococcus lactis subsp. lactis; identical to SEQ ID NO: 4704

SEQ ID NO: 39975 - DNA, 1461 bp, Sinorhizobium meliloti; identical to SEQ ID NO: 4705
  CDS (1)..(1461)

SEQ ID NO: 39976 - protein, 486 aa, Sinorhizobium meliloti; identical to SEQ ID NO: 4706

SEQ ID NO: 39977 - DNA, 1425 bp, Chlamydia trachomatis; identical to SEQ ID NO: 4707
  CDS (1)..(1425)

SEQ ID NO: 39978 - protein, 474 aa, Chlamydia trachomatis; identical to SEQ ID NO: 4708

SEQ ID NO: 39979 - DNA, 1701 bp, Sulfolobus solfataricus; identical to SEQ ID NO: 4709
  CDS (1)..(1701)

SEQ ID NO: 39980 - protein, 566 aa, Sulfolobus solfataricus; identical to SEQ ID NO: 4710

SEQ ID NO: 39981 - DNA, 1566 bp, Methanococcus jannaschii; identical to SEQ ID NO: 4711
  CDS (1)..(1566)

SEQ ID NO: 39982 - protein, 521 aa, Methanococcus jannaschii; identical to SEQ ID NO: 4712

SEQ ID NO: 39983 - DNA, 1431 bp, Bacillus halodurans; identical to SEQ ID NO: 4713
  CDS (1)..(1431)

SEQ ID NO: 39984 - protein, 476 aa, Bacillus halodurans; identical to SEQ ID NO: 4714

SEQ ID NO: 39985 - DNA, 1455 bp, Vibrio cholerae; identical to SEQ ID NO: 4715
  CDS (1)..(1455)

SEQ ID NO: 39986 - protein, 484 aa, Vibrio cholerae; identical to SEQ ID NO: 4716

SEQ ID NO: 39987 - DNA, 1833 bp, Arabidopsis thaliana (mouse-ear cress); identical to SEQ ID NO: 4717
  CDS (1)..(1833)

SEQ ID NO: 39988 - protein, 610 aa, Arabidopsis thaliana (mouse-ear cress); identical to SEQ ID NO: 4718

SEQ ID NO: 39989 - DNA, 1461 bp, Thermotoga maritima; identical to SEQ ID NO: 4719
  CDS (1)..(1461)

SEQ ID NO: 39990 - protein, 486 aa, Thermotoga maritima; identical to SEQ ID NO: 4720

SEQ ID NO: 39991 - DNA, 1542 bp, Pseudomonas aeruginosa; identical to SEQ ID NO: 4721
  CDS (1)..(1542)

SEQ ID NO: 39992 - protein, 513 aa, Pseudomonas aeruginosa; identical to SEQ ID NO: 4722

SEQ ID NO: 39993 - DNA, 3078 bp, Arabidopsis thaliana (mouse-ear cress); identical to SEQ ID NO: 4723
  CDS (1)..(3078)

SEQ ID NO: 39994 - protein, 1025 aa, Arabidopsis thaliana (mouse-ear cress); identical to SEQ ID NO: 4724

SEQ ID NO: 39995 - DNA, 1434 bp, Streptococcus pneumoniae; identical to SEQ ID NO: 4725
  CDS (1)..(1434)

SEQ ID NO: 39996 - protein, 477 aa, Streptococcus pneumoniae; identical to SEQ ID NO: 4726

SEQ ID NO: 39997 - DNA, 2533 bp, Oryza sativa (rice); identical to SEQ ID NO: 4727
  CDS (114)..(1994)

SEQ ID NO: 39998 - protein, 626 aa, Oryza sativa (rice); identical to SEQ ID NO: 4728

SEQ ID NO: 39999 - DNA, 1818 bp, Zea mays (maize); identical to SEQ ID NO: 4729
  CDS (1)..(1818)

SEQ ID NO: 40000 - protein, 605 aa, Zea mays (maize); identical to SEQ ID NO: 4730

SEQ ID NO: 40001 - DNA, 1455 bp, Bacillus subtilis; identical to SEQ ID NO: 4731
  CDS (1)..(1455)

SEQ ID NO: 40002 - protein, 484 aa, Bacillus subtilis; identical to SEQ ID NO: 4732

SEQ ID NO: 40003 - DNA, 2168 bp, Manihot esculenta (cassava); identical to SEQ ID NO: 4733
  CDS (75)..(1901)

SEQ ID NO: 40004 - protein, 608 aa, Manihot esculenta (cassava); identical to SEQ ID NO: 4734

SEQ ID NO: 40005 - DNA, 2035 bp, Pisum sativum (garden pea); identical to SEQ ID NO: 4735
  CDS (82)..(1893)

SEQ ID NO: 40006 - protein, 603 aa, Pisum sativum (garden pea); identical to SEQ ID NO: 4736

SEQ ID NO: 40007 - DNA, 1476 bp, Synechocystis sp; identical to SEQ ID NO: 4737
  CDS (1)..(1476)

SEQ ID NO: 40008 - protein, 491 aa, Synechocystis sp; identical to SEQ ID NO: 4738

SEQ ID NO: 40009 - DNA, 1434 bp, Synechocystis sp; identical to SEQ ID NO: 4739
  CDS (1)..(1434)

SEQ ID NO: 40010 - protein, 477 aa, Synechocystis sp; identical to SEQ ID NO: 4740

SEQ ID NO: 40011 - DNA, 2868 bp, Zea mays (maize); identical to SEQ ID NO: 4741
  CDS (670)..(2868)

SEQ ID NO: 40012 - protein, 732 aa, Zea mays (maize); identical to SEQ ID NO: 4742

SEQ ID NO: 40013 - DNA, 2480 bp, Zea mays (maize); identical to SEQ ID NO: 4743
  CDS (58)..(2154)

SEQ ID NO: 40014 - protein, 698 aa, Zea mays (maize); identical to SEQ ID NO: 4744

SEQ ID NO: 40015 - DNA, 6027 bp, Zea mays (maize); identical to SEQ ID NO: 4745
  CDS (120)..(5144)

SEQ ID NO: 40016 - protein, 1674 aa, Zea mays (maize); identical to SEQ ID NO: 4746

SEQ ID NO: 40017 - DNA, 2991 bp, Zea mays (maize); identical to SEQ ID NO: 4747
  CDS (602)..(2470): n means a or g or c or t/u, s means g or c

SEQ ID NO: 40018 - protein, 622 aa, Zea mays (maize); identical to SEQ ID NO: 4748

SEQ ID NO: 40019 - DNA, 2360 bp, Solanum tuberosum (potato); identical to SEQ ID NO: 4749
  CDS (68)..(1993)

SEQ ID NO: 40020 - protein, 641 aa, Solanum tuberosum (potato); identical to SEQ ID NO: 4750

SEQ ID NO: 40021 - DNA, 2124 bp, Ipomoea batatas (sweet potato); identical to SEQ ID NO: 4751
  CDS (23)..(1849)

SEQ ID NO: 40022 - protein, 608 aa, Ipomoea batatas (sweet potato); identical to SEQ ID NO: 4752

SEQ ID NO: 40023 - DNA, 2287 bp, Sorghum bicolor (sorghum); identical to SEQ ID NO: 4753
  CDS (207)..(2033)

SEQ ID NO: 40024 - protein, 608 aa, Sorghum bicolor (sorghum); identical to SEQ ID NO: 4754

SEQ ID NO: 40025 - DNA, 4110 bp, Schizosaccharomyces pombe; identical to SEQ ID NO: 4755
  CDS (1)..(4110)

SEQ ID NO: 40026 - protein, 1369 aa, Schizosaccharomyces pombe; identical to SEQ ID NO: 4756

SEQ ID NO: 40027 - DNA, 1812 bp, Hordeum vulgare (barley); identical to SEQ ID NO: 4757
  CDS (1)..(1812)

SEQ ID NO: 40028 - protein, 603 aa, Hordeum vulgare (barley); identical to SEQ ID NO: 4758

SEQ ID NO: 40029 - DNA, 2161 bp, Solanum tuberosum (potato); identical to SEQ ID NO: 4759
  CDS (37)..(1860)

SEQ ID NO: 40030 - protein, 607 aa, Solanum tuberosum (potato); identical to SEQ ID NO: 4760

SEQ ID NO: 40031 - DNA, 2825 bp, Triticum aestivum; identical to SEQ ID NO: 4761
  CDS (162)..(2561)

SEQ ID NO: 40032 - protein, 799 aa, Triticum aestivum; identical to SEQ ID NO: 4762

SEQ ID NO: 40033 - DNA, 2771 bp, Triticum aestivum; identical to SEQ ID NO: 4763
  CDS (280)..(2550)

SEQ ID NO: 40034 - protein, 756 aa, Triticum aestivum; identical to SEQ ID NO: 4764

SEQ ID NO: 40035 - DNA, 4121 bp, Zea mays; identical to SEQ ID NO: 4765
  CDS (442)..(3954)

SEQ ID NO: 40036 - protein, 1170 aa, Zea mays; identical to SEQ ID NO: 4766

SEQ ID NO: 40037 - DNA, 3240 bp, Chlamydomonas reinhardtii; identical to SEQ ID NO: 4767
  CDS (138)..(2264)

SEQ ID NO: 40038 - protein, 708 aa, Chlamydomonas reinhardtii; identical to SEQ ID NO: 4768

SEQ ID NO: 40039 - DNA, 3049 bp, Chlamydomonas reinhardtii; identical to SEQ ID NO: 4769
  CDS (190)..(1920)

SEQ ID NO: 40040 - protein, 576 aa, Chlamydomonas reinhardtii; identical to SEQ ID NO: 4770

SEQ ID NO: 40041 - DNA, 2716 bp, Chlamydomonas reinhardtii; identical to SEQ ID NO: 4771
  CDS (93)..(2048)

SEQ ID NO: 40042 - protein, 651 aa, Chlamydomonas reinhardtii; identical to SEQ ID NO: 4772

SEQ ID NO: 40043 - DNA, 2325 bp, Ipomoea batatas; identical to SEQ ID NO: 4773
  CDS (155)..(2047)

SEQ ID NO: 40044 - protein, 630 aa, Ipomoea batatas; identical to SEQ ID NO: 4774

SEQ ID NO: 40045 - DNA, 1440 bp, Erwinia carotovora subsp; identical to SEQ ID NO: 4775
  CDS (1)..(1440)

SEQ ID NO: 40046 - protein, 479 aa, Erwinia carotovora subsp; identical to SEQ ID NO: 4776

SEQ ID NO: 40047 - DNA, 1497 bp, Bacillus thuringiensis serovar konkukian str; identical to SEQ ID NO: 4777
  CDS (1)..(1497)

SEQ ID NO: 40048 - protein, 498 aa, Bacillus thuringiensis serovar konkukian str; identical to SEQ ID NO: 4778

SEQ ID NO: 40049 - DNA, 1431 bp, Mycoplasma mobile; identical to SEQ ID NO: 4779
  CDS (1)..(1431): transl-table=4

SEQ ID NO: 40050 - protein, 476 aa, Mycoplasma mobile; identical to SEQ ID NO: 4780

SEQ ID NO: 40051 - DNA, 1815 bp, Hordeum bulbosum; identical to SEQ ID NO: 4781
  CDS (1)..(1815)

SEQ ID NO: 40052 - protein, 604 aa, Hordeum bulbosum; identical to SEQ ID NO: 4782

SEQ ID NO: 40053 - DNA, 1527 bp, Photobacterium profundum; identical to SEQ ID NO: 4783
  CDS (1)..(1527)

SEQ ID NO: 40054 - protein, 508 aa, Photobacterium profundum; identical to SEQ ID NO: 4784

SEQ ID NO: 40055 - DNA, 1569 bp, Methanococcus maripaludis; identical to SEQ ID NO: 4785
  CDS (1)..(1569)

SEQ ID NO: 40056 - protein, 522 aa, Methanococcus maripaludis; identical to SEQ ID NO: 4786

SEQ ID NO: 40057 - DNA, 1503 bp, Parachlamydia sp; identical to SEQ ID NO: 4787
  CDS (1)..(1503)

SEQ ID NO: 40058 - protein, 500 aa, Parachlamydia sp; identical to SEQ ID NO: 4788

SEQ ID NO: 40059 - DNA, 1452 bp, Rhodopseudomonas palustris; identical to SEQ ID NO: 4789
  CDS (1)..(1452)

SEQ ID NO: 40060 - protein, 483 aa, Rhodopseudomonas palustris; identical to SEQ ID NO: 4790

SEQ ID NO: 40061 - DNA, 1173 bp, Corynebacterium diphtheriae; identical to SEQ ID NO: 4791
  CDS (1)..(1173)

SEQ ID NO: 40062 - protein, 390 aa, Corynebacterium diphtheriae; identical to SEQ ID NO: 4792

SEQ ID NO: 40063 - DNA, 1578 bp, Ostreococcus tauri; identical to SEQ ID NO: 4793
  CDS (1)..(1578)

SEQ ID NO: 40064 - protein, 525 aa, Ostreococcus tauri; identical to SEQ ID NO: 4794

SEQ ID NO: 40065 - DNA, 1725 bp, Ostreococcus tauri; identical to SEQ ID NO: 4795
  CDS (1)..(1725)

SEQ ID NO: 40066 - protein, 574 aa, Ostreococcus tauri; identical to SEQ ID NO: 4796

SEQ ID NO: 40067 - DNA, 2022 bp, Ostreococcus tauri; identical to SEQ ID NO: 4797
  CDS (1)..(2022)

SEQ ID NO: 40068 - protein, 673 aa, Ostreococcus tauri; identical to SEQ ID NO: 4798

SEQ ID NO: 40069 - DNA, 2939 bp, Colocasia esculenta; identical to SEQ ID NO: 4799
  CDS (220)..(2634)

SEQ ID NO: 40070 - protein, 804 aa, Colocasia esculenta; identical to SEQ ID NO: 4800

SEQ ID NO: 40071 - DNA, 1554 bp, Thermoproteus tenax; identical to SEQ ID NO: 4801
  CDS (1)..(1554)

SEQ ID NO: 40072 - protein, 517 aa, Thermoproteus tenax; identical to SEQ ID NO: 4802

SEQ ID NO: 40073 - DNA, 1470 bp, Desulfovibrio vulgaris; identical to SEQ ID NO: 4803
  CDS (1)..(1470)

SEQ ID NO: 40074 - protein, 489 aa, Desulfovibrio vulgaris; identical to SEQ ID NO: 4804

SEQ ID NO: 40075 - DNA, 1323 bp, Thermus thermophilus; identical to SEQ ID NO: 4805
  CDS (1)..(1323)

SEQ ID NO: 40076 - protein, 440 aa, Thermus thermophilus; identical to SEQ ID NO: 4806

SEQ ID NO: 40077 - DNA, 1431 bp, Bacillus cereus; identical to SEQ ID NO: 4807
  CDS (1)..(1431)

SEQ ID NO: 40078 - protein, 476 aa, Bacillus cereus; identical to SEQ ID NO: 4808

SEQ ID NO: 40079 - DNA, 1476 bp, Treponema denticola; identical to SEQ ID NO: 4809
  CDS (1)..(1476)

SEQ ID NO: 40080 - protein, 491 aa, Treponema denticola; identical to SEQ ID NO: 4810

SEQ ID NO: 40081 - DNA, 1173 bp, Mycobacterium paratuberculosis; identical to SEQ ID NO: 4811
  CDS (1)..(1173)

SEQ ID NO: 40082 - protein, 390 aa, Mycobacterium paratuberculosis; identical to SEQ ID NO: 4812

SEQ ID NO: 40083 - DNA, 2486 bp, Phaseolus vulgaris; identical to SEQ ID NO: 4813
  CDS (39)..(2255)

SEQ ID NO: 40084 - protein, 738 aa, Phaseolus vulgaris; identical to SEQ ID NO: 4814

SEQ ID NO: 40085 - DNA, 2570 bp, Phaseolus vulgaris; identical to SEQ ID NO: 4815
  CDS (135)..(2309)

SEQ ID NO: 40086 - protein, 724 aa, Phaseolus vulgaris; identical to SEQ ID NO: 4816

SEQ ID NO: 40087 - DNA, 2444 bp, Phaseolus vulgaris; identical to SEQ ID NO: 4817
  CDS (78)..(2015)

SEQ ID NO: 40088 - protein, 645 aa, Phaseolus vulgaris; identical to SEQ ID NO: 4818

SEQ ID NO: 40089 - DNA, 1827 bp, Hordeum spontaneum; identical to SEQ ID NO: 4819
  CDS (1)..(1827)

SEQ ID NO: 40090 - protein, 608 aa, Hordeum spontaneum; identical to SEQ ID NO: 4820

SEQ ID NO: 40091 - DNA, 1248 bp, Gloeobacter violaceus; identical to SEQ ID NO: 4821
  CDS (1)..(1248)

SEQ ID NO: 40092 - protein, 415 aa, Gloeobacter violaceus; identical to SEQ ID NO: 4822

SEQ ID NO: 40093 - DNA, 3219 bp, Oryza sativa; identical to SEQ ID NO: 4823
  CDS (1)..(3219)

SEQ ID NO: 40094 - protein, 1072 aa, Oryza sativa; identical to SEQ ID NO: 4824

SEQ ID NO: 40095 - DNA, 2547 bp, Oryza sativa; identical to SEQ ID NO: 4825
  CDS (97)..(2022)

SEQ ID NO: 40096 - protein, 641 aa, Oryza sativa; identical to SEQ ID NO: 4826

SEQ ID NO: 40097 - DNA, 1242 bp, Streptomyces avermitilis; identical to SEQ ID NO: 4827
  CDS (1)..(1242)

SEQ ID NO: 40098 - protein, 413 aa, Streptomyces avermitilis; identical to SEQ ID NO: 4828

SEQ ID NO: 40099 - DNA, 2208 bp, Phaseolus vulgaris; identical to SEQ ID NO: 4829
  CDS (144)..(1991)

SEQ ID NO: 40100 - protein, 615 aa, Phaseolus vulgaris; identical to SEQ ID NO: 4830

SEQ ID NO: 40101 - DNA, 2748 bp, Oryza sativa; identical to SEQ ID NO: 4831
  CDS (1)..(2748)

SEQ ID NO: 40102 - protein, 915 aa, Oryza sativa; identical to SEQ ID NO: 4832

SEQ ID NO: 40103 - DNA, 1605 bp, Shewanella oneidensis; identical to SEQ ID NO: 4833
  CDS (1)..(1605)

SEQ ID NO: 40104 - protein, 534 aa, Shewanella oneidensis; identical to SEQ ID NO: 4834

SEQ ID NO: 40105 - DNA, 1173 bp, Corynebacterium efficiens; identical to SEQ ID NO: 4835
  CDS (1)..(1173)

SEQ ID NO: 40106 - protein, 390 aa, Corynebacterium efficiens; identical to SEQ ID NO: 4836

SEQ ID NO: 40107 - DNA, 2340 bp, Colocasia esculenta; identical to SEQ ID NO: 4837
  CDS (155)..(2086)

SEQ ID NO: 40108 - protein, 643 aa, Colocasia esculenta; identical to SEQ ID NO: 4838

SEQ ID NO: 40109 - DNA, 2409 bp, Hordeum vulgare; identical to SEQ ID NO: 4839
  CDS (1)..(2409)

SEQ ID NO: 40110 - protein, 802 aa, Hordeum vulgare; identical to SEQ ID NO: 4840

SEQ ID NO: 40111 - DNA, 2115 bp, Setaria italica; identical to SEQ ID NO: 4841
  CDS (142)..(1959)

SEQ ID NO: 40112 - protein, 605 aa, Setaria italica; identical to SEQ ID NO: 4842

SEQ ID NO: 40113 - DNA, 2081 bp, Triticum aestivum; identical to SEQ ID NO: 4843
  CDS (1)..(1800)

SEQ ID NO: 40114 - protein, 599 aa, Triticum aestivum; identical to SEQ ID NO: 4844

SEQ ID NO: 40115 - DNA, 1230 bp, Corynebacterium glutamicum; identical to SEQ ID NO: 4845
  CDS (1)..(1230)

SEQ ID NO: 40116 - protein, 409 aa, Corynebacterium glutamicum; identical to SEQ ID NO: 4846

SEQ ID NO: 40117 - DNA, 1356 bp, Pyrococcus furiosus; identical to SEQ ID NO: 4847
  CDS (1)..(1356)

SEQ ID NO: 40118 - protein, 451 aa, Pyrococcus furiosus; identical to SEQ ID NO: 4848

SEQ ID NO: 40119 - DNA, 2112 bp, Oryza sativa; identical to SEQ ID NO: 4849
  CDS (61)..(1887)

SEQ ID NO: 40120 - protein, 608 aa, Oryza sativa; identical to SEQ ID NO: 4850

SEQ ID NO: 40121 - DNA, 2496 bp, Oryza sativa; identical to SEQ ID NO: 4851
  CDS (1)..(2496)

SEQ ID NO: 40122 - protein, 831 aa, Oryza sativa; identical to SEQ ID NO: 4852

SEQ ID NO: 40123 - DNA, 1443 bp, Rhizobium loti; identical to SEQ ID NO: 4853
  CDS (1)..(1443)

SEQ ID NO: 40124 - protein, 480 aa, Rhizobium loti; identical to SEQ ID NO: 4854

SEQ ID NO: 40125 - DNA, 2100 bp, Pisum sativum; identical to SEQ ID NO: 4855
  CDS (6)..(1847)

SEQ ID NO: 40126 - protein, 613 aa, Pisum sativum; identical to SEQ ID NO: 4856

SEQ ID NO: 40127 - DNA, 3386 bp, Triticum aestivum; identical to SEQ ID NO: 4857
  CDS (251)..(2995)

SEQ ID NO: 40128 - protein, 914 aa, Triticum aestivum; identical to SEQ ID NO: 4858

SEQ ID NO: 40129 - DNA, 2919 bp, Oryza sativa; identical to SEQ ID NO: 4859
  CDS (165)..(2597)

SEQ ID NO: 40130 - protein, 810 aa, Oryza sativa; identical to SEQ ID NO: 4860

SEQ ID NO: 40131 - DNA, 2394 bp, Oryza sativa; identical to SEQ ID NO: 4861
  CDS (34)..(2118)

SEQ ID NO: 40132 - protein, 694 aa, Oryza sativa; identical to SEQ ID NO: 4862

SEQ ID NO: 40133 - DNA, 2903 bp, Oryza sativa; identical to SEQ ID NO: 4863
  CDS (86)..(2335)

SEQ ID NO: 40134 - protein, 749 aa, Oryza sativa; identical to SEQ ID NO: 4864

SEQ ID NO: 40135 - DNA, 1719 bp, Sulfolobus tokodaii; identical to SEQ ID NO: 4865
  CDS (1)..(1719)

SEQ ID NO: 40136 - protein, 572 aa, Sulfolobus tokodaii; identical to SEQ ID NO: 4866

SEQ ID NO: 40137 - DNA, 2270 bp, Perilla frutescens; identical to SEQ ID NO: 4867
  CDS (172)..(1986)

SEQ ID NO: 40138 - protein, 604 aa, Perilla frutescens; identical to SEQ ID NO: 4868

SEQ ID NO: 40139 - DNA, 1701 bp, Sulfolobus acidocaldarius; identical to SEQ ID NO: 4869
  CDS (1)..(1701)

SEQ ID NO: 40140 - protein, 566 aa, Sulfolobus acidocaldarius; identical to SEQ ID NO: 4870

SEQ ID NO: 40141 - DNA, 2793 bp, Triticum aestivum; identical to SEQ ID NO: 4871
  CDS (135)..(2531)

SEQ ID NO: 40142 - protein, 798 aa, Triticum aestivum; identical to SEQ ID NO: 4872

SEQ ID NO: 40143 - DNA, 5346 bp, Triticum aestivum; identical to SEQ ID NO: 4873
  CDS (29)..(4915)

SEQ ID NO: 40144 - protein, 1628 aa, Triticum aestivum; identical to SEQ ID NO: 4874

SEQ ID NO: 40145 - DNA, 2502 bp, Arabidopsis thaliana; identical to SEQ ID NO: 4875
  CDS (1)..(2379)

SEQ ID NO: 40146 - protein, 792 aa, Arabidopsis thaliana; identical to SEQ ID NO: 4876

SEQ ID NO: 40147 - DNA, 2592 bp, Sorghum bicolor; identical to SEQ ID NO: 4877
  CDS (59)..(1948)

SEQ ID NO: 40148 - protein, 629 aa, Sorghum bicolor; identical to SEQ ID NO: 4878

SEQ ID NO: 40149 - DNA, 1815 bp, Triticum turgidum subsp; identical to SEQ ID NO: 4879
  CDS (1)..(1815)

SEQ ID NO: 40150 - protein, 604 aa, Triticum turgidum subsp; identical to SEQ ID NO: 4880

SEQ ID NO: 40151 - DNA, 2575 bp, Manihot esculenta; identical to SEQ ID NO: 4881
  CDS (50)..(2305)

SEQ ID NO: 40152 - protein, 751 aa, Manihot esculenta; identical to SEQ ID NO: 4882

SEQ ID NO: 40153 - DNA, 2842 bp, Triticum aestivum; identical to SEQ ID NO: 4883
  CDS (89)..(2488)

SEQ ID NO: 40154 - protein, 799 aa, Triticum aestivum; identical to SEQ ID NO: 4884

SEQ ID NO: 40155 - DNA, 1818 bp, Triticum monococcum; identical to SEQ ID NO: 4885
  CDS (1)..(1818)

SEQ ID NO: 40156 - protein, 605 aa, Triticum monococcum; identical to SEQ ID NO: 4886

SEQ ID NO: 40157 - DNA, 2081 bp, Triticum aestivum; identical to SEQ ID NO: 4887
  CDS (120)..(1919)

SEQ ID NO: 40158 - protein, 599 aa, Triticum aestivum; identical to SEQ ID NO: 4888

SEQ ID NO: 40159 - DNA, 2591 bp, Triticum aestivum; identical to SEQ ID NO: 4889
  CDS (256)..(2199)

SEQ ID NO: 40160 - protein, 647 aa, Triticum aestivum; identical to SEQ ID NO: 4890

SEQ ID NO: 40161 - DNA, 1872 bp, Oryza sativa; identical to SEQ ID NO: 4891
  CDS (1)..(1872)

SEQ ID NO: 40162 - protein, 623 aa, Oryza sativa; identical to SEQ ID NO: 4892

SEQ ID NO: 40163 - DNA, 2028 bp, Triticum aestivum; identical to SEQ ID NO: 4893
  CDS (30)..(1754)

SEQ ID NO: 40164 - protein, 574 aa, Triticum aestivum; identical to SEQ ID NO: 4894

SEQ ID NO: 40165 - DNA, 3901 bp, Vigna unguiculata; identical to SEQ ID NO: 4895
  CDS (161)..(3604)

SEQ ID NO: 40166 - protein, 1147 aa, Vigna unguiculata; identical to SEQ ID NO: 4896

SEQ ID NO: 40167 - DNA, 3519 bp, Vigna unguiculata; identical to SEQ ID NO: 4897
  CDS (386)..(3010)

SEQ ID NO: 40168 - protein, 874 aa, Vigna unguiculata; identical to SEQ ID NO: 4898

SEQ ID NO: 40169 - DNA, 2221 bp, Phaseolus vulgaris; identical to SEQ ID NO: 4899
  CDS (30)..(1850)

SEQ ID NO: 40170 - protein, 606 aa, Phaseolus vulgaris; identical to SEQ ID NO: 4900

SEQ ID NO: 40171 - DNA, 2107 bp, Astragalus membranaceus; identical to SEQ ID NO: 4901
  CDS (96)..(1919)

SEQ ID NO: 40172 - protein, 607 aa, Astragalus membranaceus; identical to SEQ ID NO: 4902

SEQ ID NO: 40173 - DNA, 1389 bp, Bradyrhizobium japonicum; identical to SEQ ID NO: 4903
  CDS (1)..(1389)

SEQ ID NO: 40174 - protein, 462 aa, Bradyrhizobium japonicum; identical to SEQ ID NO: 4904

SEQ ID NO: 40175 - DNA, 1530 bp, Agrobacterium tumefaciens; identical to SEQ ID NO: 4905
  CDS (1)..(1530)

SEQ ID NO: 40176 - protein, 509 aa, Agrobacterium tumefaciens; identical to SEQ ID NO: 4906

SEQ ID NO: 40177 - DNA, 1449 bp, Bradyrhizobium japonicum; identical to SEQ ID NO: 4907
  CDS (1)..(1449)

SEQ ID NO: 40178 - protein, 482 aa, Bradyrhizobium japonicum; identical to SEQ ID NO: 4908

SEQ ID NO: 40179 - DNA, 1431 bp, Bacillus cereus; identical to SEQ ID NO: 4909
  CDS (1)..(1431)

SEQ ID NO: 40180 - protein, 476 aa, Bacillus cereus; identical to SEQ ID NO: 4910

SEQ ID NO: 40181 - DNA, 1458 bp, Bacillus stearothermophilus; identical to SEQ ID NO: 4911
  CDS (1)..(1458)

SEQ ID NO: 40182 - protein, 485 aa, Bacillus stearothermophilus; identical to SEQ ID NO: 4912

SEQ ID NO: 40183 - DNA, 1533 bp, Bordetella bronchiseptica; identical to SEQ ID NO: 4913
  CDS (1)..(1533)

SEQ ID NO: 40184 - protein, 510 aa, Bordetella bronchiseptica; identical to SEQ ID NO: 4914

SEQ ID NO: 40185 - DNA, 1428 bp, Chlamydophila caviae; identical to SEQ ID NO: 4915
  CDS (1)..(1428)

SEQ ID NO: 40186 - protein, 475 aa, Chlamydophila caviae; identical to SEQ ID NO: 4916

SEQ ID NO: 40187 - DNA, 1467 bp, Chlorobium tepidum; identical to SEQ ID NO: 4917
  CDS (1)..(1467)

SEQ ID NO: 40188 - protein, 488 aa, Chlorobium tepidum; identical to SEQ ID NO: 4918

SEQ ID NO: 40189 - DNA, 1449 bp, Clostridium perfringens; identical to SEQ ID NO: 4919
  CDS (1)..(1449)

SEQ ID NO: 40190 - protein, 482 aa, Clostridium perfringens; identical to SEQ ID NO: 4920

SEQ ID NO: 40191 - DNA, 1335 bp, Deinococcus radiodurans; identical to SEQ ID NO: 4921
  CDS (1)..(1335)

SEQ ID NO: 40192 - protein, 444 aa, Deinococcus radiodurans; identical to SEQ ID NO: 4922

SEQ ID NO: 40193 - DNA, 1386 bp, Fusobacterium nucleatum; identical to SEQ ID NO: 4923
  CDS (1)..(1386)

SEQ ID NO: 40194 - protein, 461 aa, Fusobacterium nucleatum; identical to SEQ ID NO: 4924

SEQ ID NO: 40195 - DNA, 1377 bp, Gloeobacter violaceus; identical to SEQ ID NO: 4925
  CDS (1)..(1377)

SEQ ID NO: 40196 - protein, 458 aa, Gloeobacter violaceus; identical to SEQ ID NO: 4926

SEQ ID NO: 40197 - DNA, 1440 bp, Lactobacillus plantarum; identical to SEQ ID NO: 4927
  CDS (1)..(1440)

SEQ ID NO: 40198 - protein, 479 aa, Lactobacillus plantarum; identical to SEQ ID NO: 4928

SEQ ID NO: 40199 - DNA, 1488 bp, Nitrosomonas europaea; identical to SEQ ID NO: 4929
  CDS (1)..(1488)

SEQ ID NO: 40200 - protein, 495 aa, Nitrosomonas europaea; identical to SEQ ID NO: 4930

SEQ ID NO: 40201 - DNA, 1434 bp, Oceanobacillus iheyensis; identical to SEQ ID NO: 4931
  CDS (1)..(1434)

SEQ ID NO: 40202 - protein, 477 aa, Oceanobacillus iheyensis; identical to SEQ ID NO: 4932

SEQ ID NO: 40203 - DNA, 1443 bp, Pasteurella multocida; identical to SEQ ID NO: 4933
  CDS (1)..(1443)

SEQ ID NO: 40204 - protein, 480 aa, Pasteurella multocida; identical to SEQ ID NO: 4934

SEQ ID NO: 40205 - DNA, 1506 bp, Prochlorococcus marinus; identical to SEQ ID NO: 4935
  CDS (1)..(1506)

SEQ ID NO: 40206 - protein, 501 aa, Prochlorococcus marinus; identical to SEQ ID NO: 4936

SEQ ID NO: 40207 - DNA, 1500 bp, Prochlorococcus marinus; identical to SEQ ID NO: 4937
  CDS (1)..(1500)

SEQ ID NO: 40208 - protein, 499 aa, Prochlorococcus marinus; identical to SEQ ID NO: 4938

SEQ ID NO: 40209 - DNA, 1452 bp, Prochlorococcus marinus subsp; identical to SEQ ID NO: 4939
  CDS (1)..(1452)

SEQ ID NO: 40210 - protein, 483 aa, Prochlorococcus marinus subsp; identical to SEQ ID NO: 4940

SEQ ID NO: 40211 - DNA, 1560 bp, Pseudomonas putida; identical to SEQ ID NO: 4941
  CDS (1)..(1560)

SEQ ID NO: 40212 - protein, 519 aa, Pseudomonas putida; identical to SEQ ID NO: 4942

SEQ ID NO: 40213 - DNA, 1455 bp, Pseudomonas syringae; identical to SEQ ID NO: 4943
  CDS (1)..(1455)

SEQ ID NO: 40214 - protein, 484 aa, Pseudomonas syringae; identical to SEQ ID NO: 4944

SEQ ID NO: 40215 - DNA, 1626 bp, Ralstonia solanacearum; identical to SEQ ID NO: 4945
  CDS (1)..(1626)

SEQ ID NO: 40216 - protein, 541 aa, Ralstonia solanacearum; identical to SEQ ID NO: 4946

SEQ ID NO: 40217 - DNA, 1446 bp, Rhizobium loti; identical to SEQ ID NO: 4947
  CDS (1)..(1446)

SEQ ID NO: 40218 - protein, 481 aa, Rhizobium loti; identical to SEQ ID NO: 4948

SEQ ID NO: 40219 - DNA, 1443 bp, Rhizobium tropici; identical to SEQ ID NO: 4949
  CDS (1)..(1443)

SEQ ID NO: 40220 - protein, 480 aa, Rhizobium tropici; identical to SEQ ID NO: 4950

SEQ ID NO: 40221 - DNA, 1524 bp, Rhodopirellula baltica; identical to SEQ ID NO: 4951
  CDS (1)..(1524)

SEQ ID NO: 40222 - protein, 507 aa, Rhodopirellula baltica; identical to SEQ ID NO: 4952

SEQ ID NO: 40223 - DNA, 1434 bp, Rhodobacter sphaeroides; identical to SEQ ID NO: 4953
  CDS (1)..(1434)

SEQ ID NO: 40224 - protein, 477 aa, Rhodobacter sphaeroides; identical to SEQ ID NO: 4954

SEQ ID NO: 40225 - DNA, 1434 bp, Salmonella typhimurium; identical to SEQ ID NO: 4955
  CDS (1)..(1434)

SEQ ID NO: 40226 - protein, 477 aa, Salmonella typhimurium; identical to SEQ ID NO: 4956

SEQ ID NO: 40227 - DNA, 1431 bp, Streptococcus mutans; identical to SEQ ID NO: 4957
  CDS (1)..(1431)

SEQ ID NO: 40228 - protein, 476 aa, Streptococcus mutans; identical to SEQ ID NO: 4958

SEQ ID NO: 40229 - DNA, 1425 bp, Synechococcus elongatus; identical to SEQ ID NO: 4959
  CDS (1)..(1425)

SEQ ID NO: 40230 - protein, 474 aa, Synechococcus elongatus; identical to SEQ ID NO: 4960

SEQ ID NO: 40231 - DNA, 1398 bp, Synechococcus sp; identical to SEQ ID NO: 4961
  CDS (1)..(1398)

SEQ ID NO: 40232 - protein, 465 aa, Synechococcus sp; identical to SEQ ID NO: 4962

SEQ ID NO: 40233 - DNA, 1542 bp, Synechococcus sp; identical to SEQ ID NO: 4963
  CDS (1)..(1542)

SEQ ID NO: 40234 - protein, 513 aa, Synechococcus sp; identical to SEQ ID NO: 4964

SEQ ID NO: 40235 - DNA, 1317 bp, Thermus caldophilus; identical to SEQ ID NO: 4965
  CDS (1)..(1317)

SEQ ID NO: 40236 - protein, 438 aa, Thermus caldophilus; identical to SEQ ID NO: 4966

SEQ ID NO: 40237 - DNA, 1458 bp, Vibrio parahaemolyticus; identical to SEQ ID NO: 4967
  CDS (1)..(1458)

SEQ ID NO: 40238 - protein, 485 aa, Vibrio parahaemolyticus; identical to SEQ ID NO: 4968

SEQ ID NO: 40239 - DNA, 1458 bp, Vibrio vulnificus; identical to SEQ ID NO: 4969
  CDS (1)..(1458)

SEQ ID NO: 40240 - protein, 485 aa, Vibrio vulnificus; identical to SEQ ID NO: 4970

SEQ ID NO: 40241 - DNA, 1425 bp, Xanthomonas axonopodis; identical to SEQ ID NO: 4971
  CDS (1)..(1425)

SEQ ID NO: 40242 - protein, 474 aa, Xanthomonas axonopodis; identical to SEQ ID NO: 4972

SEQ ID NO: 40243 - DNA, 1425 bp, Xanthomonas campestris; identical to SEQ ID NO: 4973
  CDS (1)..(1425)

SEQ ID NO: 40244 - protein, 474 aa, Xanthomonas campestris; identical to SEQ ID NO: 4974

SEQ ID NO: 40245 - DNA, 2345 bp, Antirrhinum majus; identical to SEQ ID NO: 4975
  CDS (10)..(1836)

SEQ ID NO: 40246 - protein, 608 aa, Antirrhinum majus; identical to SEQ ID NO: 4976

SEQ ID NO: 40247 - DNA, 2211 bp, Ipomoea batatas; identical to SEQ ID NO: 4977
  CDS (93)..(1919)

SEQ ID NO: 40248 - protein, 608 aa, Ipomoea batatas; identical to SEQ ID NO: 4978

SEQ ID NO: 40249 - DNA, 2988 bp, Pisum sativum; identical to SEQ ID NO: 4979
  CDS (140)..(2398)

SEQ ID NO: 40250 - protein, 752 aa, Pisum sativum; identical to SEQ ID NO: 4980

SEQ ID NO: 40251 - DNA, 2329 bp, Arabidopsis thaliana; identical to SEQ ID NO: 4981
  CDS (67)..(2025)

SEQ ID NO: 40252 - protein, 652 aa, Arabidopsis thaliana; identical to SEQ ID NO: 4982

SEQ ID NO: 40253 - DNA, 4127 bp, Solanum tuberosum; identical to SEQ ID NO: 4983
  CDS (143)..(3835)

SEQ ID NO: 40254 - protein, 1230 aa, Solanum tuberosum; identical to SEQ ID NO: 4984

SEQ ID NO: 40255 - DNA, 25 bp, Artificial sequence
  (1)..(25): primer
atgcaggttttacatgtatgttcag

SEQ ID NO: 40256 - DNA, 26 bp, Artificial sequence
  (1)..(26): primer
ttatttcaagcgatagtaaagctcac

SEQ ID NO: 40257 - protein, 974 aa, Artificial sequence; identical to SEQ ID NO: 32738
  Variant (2)..(2): xaa in position 2 is any amino acid
  Variant (5)..(5): xaa in position 5 is any amino acid
  Variant (10)..(10): xaa in position 10 is any amino acid
  Variant (14)..(14): xaa in position 14 is any amino acid
  Variant (18)..(108): xaa in position 18 to 108 is any or no amino acid
  Variant (119)..(119): xaa in position 119 is any amino acid
  Variant (123)..(124): xaa in position 123 to 124 is any amino acid
  Variant (126)..(151): xaa in position 126 to 151 is any or no amino acid
  Variant (153)..(153): xaa in position 153 is any amino acid
  Variant (155)..(155): xaa in position 155 is any amino acid
  Variant (160)..(160): xaa in position 160 is any amino acid
  Variant (162)..(171): xaa in position 162 to 171 is any amino acid
  Variant (173)..(178): xaa in position 173 to 178 is any amino acid
  Variant (179)..(209): xaa in position 179 to 209 is any or no amino acid
  Variant (211)..(216): xaa in position 211 to 216 is any amino acid
  Variant (217)..(218): xaa in position 217 to 218 is any or no amino acid
  Variant (221)..(223): xaa in position 221 to 223 is any amino acid
  Variant (227)..(227): xaa in position 227 is any amino acid
  Variant (229)..(229): xaa in position 229 is any amino acid
  Variant (231)..(232): xaa in position 231 to 232 is any amino acid
  Variant (234)..(234): xaa in position 234 is any amino acid
  Variant (235)..(262): xaa in position 235 to 262 is any or no amino acid
  Variant (264)..(264): xaa in position 264 is any amino acid
  Variant (266)..(268): xaa in position 266 to 268 is any amino acid
  Variant (272)..(275): xaa in position 272 to 275 is any amino acid
  Variant (279)..(280): xaa in position 279 to 280 is any amino acid
  Variant (281)..(406): xaa in position 281 to 406 is any or no amino acid
  Variant (420)..(420): xaa in position 420 is any amino acid
  Variant (424)..(425): xaa in position 424 to 425 is any or no amino acid
  Variant (427)..(429): xaa in position 427 to 429 is any or no amino acid
  Variant (431)..(442): xaa in position 431 to 442 is any or no amino acid
  Variant (446)..(446): xaa in position 446 is any amino acid
  Variant (456)..(456): xaa in position 456 is any amino acid
  Variant (457)..(464): xaa in position 457 to 464 is any or no amino acid
  Variant (466)..(475): xaa in position 466 to 475 is any or no amino acid
  Variant (477)..(491): xaa in position 477 to 491 is any or no amino acid
  Variant (493)..(514): xaa in position 493 to 514 is any or no amino acid
  Variant (523)..(524): xaa in position 523 to 524 is any or no amino acid
  Variant (529)..(529): xaa in position 529 is any amino acid
  Variant (537)..(537): xaa in position 537 is any amino acid
  Variant (540)..(540): xaa in position 540 is any amino acid
  Variant (542)..(549): xaa in position 542 to 549 is any or no amino acid
  Variant (551)..(551): xaa in position 551 is any or no amino acid
  Variant (553)..(553): xaa in position 553 is any or no amino acid
  Variant (557)..(557): xaa in position 557 is any or no amino acid
  Variant (560)..(560): xaa in position 560 is any amino acid
  Variant (561)..(567): xaa in position 561 to 567 is any or no amino acid
  Variant (569)..(569): xaa in position 569 is any amino acid
  Variant (577)..(578): xaa in position 577 to 578 is any amino acid
  Variant (579)..(579): xaa in position 579 is any or no amino acid
  Variant (583)..(584): xaa in position 583 to 584 is any amino acid
  Variant (586)..(587): xaa in position 586 to 587 is any or no amino acid
  Variant (589)..(607): xaa in position 589 to 607 is any or no amino acid
  Variant (609)..(612): xaa in position 609 to 612 is any or no amino acid
  Variant (614)..(641): xaa in position 614 to 641 is any or no amino acid
  Variant (643)..(645): xaa in position 643 to 645 is any or no amino acid
  Variant (647)..(647): xaa in position 647 is any or no amino acid
  Variant (651)..(652): xaa in position 651 to 652 is any amino acid
  Variant (656)..(656): xaa in position 656 is any amino acid
  Variant (658)..(663): xaa in position 658 to 663 is any or no amino acid
  Variant (668)..(668): xaa in position 668 is any amino acid
  Variant (673)..(674): xaa in position 673 to 674 is any amino acid
  Variant (682)..(683): xaa in position 682 to 683 is any amino acid
  Variant (686)..(687): xaa in position 686 to 687 is any amino acid
  Variant (690)..(692): xaa in position 690 to 692 is any amino acid
  Variant (693)..(704): xaa in position 693 to 704 is any or no amino acid
  Variant (715)..(715): xaa in position 715 is any amino acid
  Variant (716)..(729): xaa in position 716 to 729 is any or no amino acid
  Variant (732)..(733): xaa in position 732 to 733 is any or no amino acid
  Variant (735)..(736): xaa in position 735 to 736 is any amino acid
  Variant (738)..(739): xaa in position 738 to 739 is any amino acid
  Variant (740)..(740): xaa in position 740 is any or no amino acid
  Variant (742)..(743): xaa in position 742 to 743 is any amino acid
  Variant (745)..(748): xaa in position 745 to 748 is any or no amino acid
  Variant (750)..(752): xaa in position 750 to 752 is any or no amino acid
  Variant (754)..(754): xaa in position 754 is any or no amino acid
  Variant (756)..(758): xaa in position 756 to 758 is any amino acid
  Variant (762)..(762): xaa in position 762 is any amino acid
  Variant (764)..(764): xaa in position 764 is any amino acid
  Variant (782)..(844): xaa in position 782 to 844 is any or no amino acid
  Variant (847)..(847): xaa in position 847 is any amino acid
  Variant (858)..(859): xaa in position 858 to 859 is any amino acid
  Variant (864)..(864): xaa in position 864 is any amino acid
  Variant (868)..(868): xaa in position 868 is any amino acid
  Variant (870)..(871): xaa in position 870 to 871 is any amino acid
  Variant (872)..(892): xaa in position 872 to 892 is any or no amino acid
  Variant (894)..(894): xaa in position 894 is any or no amino acid
  Variant (897)..(897): xaa in position 897 is any amino acid
  Variant (900)..(901): xaa in position 900 to 901 is any amino acid
  Variant (903)..(905): xaa in position 903 to 905 is any amino acid
  Variant (907)..(908): xaa in position 907 to 908 is any amino acid
  Variant (911)..(911): xaa in position 911 is any amino acid
  Variant (915)..(916): xaa in position 915 to 916 is any or no amino acid
  Variant (918)..(942): xaa in position 918 to 942 is any or no amino acid
  Variant (944)..(945): xaa in position 944 to 945 is any or no amino acid
  Variant (947)..(952): xaa in position 947 to 952 is any or no amino acid
  Variant (955)..(956): xaa in position 955 to 956 is any amino acid
  Variant (961)..(962): xaa in position 961 to 962 is any amino acid
  Variant (965)..(966): xaa in position 965 to 966 is any amino acid
  Variant (968)..(969): xaa in position 968 to 969 is any amino acid
  Variant (972)..(973): xaa in position 972 to 973 is any amino acid

SEQ ID NO: 40258 - protein, 56 aa, Artificial sequence; identical to SEQ ID NO: 6176
  Variant (1)..(1): xaa in position 1 is Gly or Ala
  Variant (2)..(4): xaa in position 2 to 4 is any amino acid
  Variant (5)..(5): xaa in position 5 is Ala, Ser or Cys
  Variant (6)..(7): xaa in position 6 to 7 is any amino acid
  Variant (8)..(8): xaa in position 8 is Val, Ile, Leu or Ala
  Variant (9)..(9): xaa in position 9 is any amino acid
  Variant (10)..(10): xaa in position 10 is Thr, Ala or Val
  Variant (13)..(14): xaa in position 13 to 14 is any amino acid
  Variant (15)..(15): xaa in position 15 is Tyr, Met or His
  Variant (16)..(16): xaa in position 16 is Ala, Ser, Leu, Lys or Val
  Variant (17)..(17): xaa in position 17 is any amino acid
  Variant (18)..(18): xaa in position 18 is Glu, Gln or Asp
  Variant (19)..(19): xaa in position 19 is Ile, Leu, Val or Glu
  Variant (20)..(28): xaa in position 20 to 28 is any amino acid
  Variant (29)..(43): xaa in position 29 to 43 is any or no amino acid
  Variant (44)..(44): xaa in position 44 is Gly, Val or Tyr
  Variant (45)..(45): xaa in position 45 is Ile or Val
  Variant (46)..(46): xaa in position 46 is any amino acid
  Variant (49)..(49): xaa in position 49 is Ile, Met, Val, Leu or Cys
  Variant (51)..(52): xaa in position 51 to 52 is any amino acid
  Variant (53)..(53): xaa in position 53 is any or no amino acid
  Variant (54)..(54): xaa in position 54 is Trp, Tyr, Phe or Leu
  Variant (55)..(55): xaa in position 55 is any amino acid
  Variant (56)..(56): xaa in position 56 is Pro or Glu

SEQ ID NO: 40259 - protein, 65 aa, Artificial sequence; identical to SEQ ID NO: 6177
  Variant (1)..(1): xaa in position 1 is Lys, Arg or Phe
  Variant (2)..(4): xaa in position 2 to 4 is any amino acid
  Variant (5)..(5): xaa in position 5 is Lys, Arg, Ala or Glu
  Variant (6)..(7): xaa in position 6 to 7 is any amino acid
  Variant (8)..(8): xaa in position 8 is Leu, Val or Ile
  Variant (9)..(11): xaa in position 9 to 11 is any amino acid
  Variant (12)..(12): xaa in position 12 is Leu, Val, Phe, Met or Thr
  Variant (13)..(13): xaa in position 13 is any amino acid
  Variant (14)..(14): xaa in position 14 is Leu, Ile, Phe or Val
  Variant (15)..(19): xaa in position 15 to 19 is any amino acid
  Variant (20)..(22): xaa in position 20 to 22 is any or no amino acid
  Variant (23)..(23): xaa in position 23 is Leu, Val, Ile or Met
  Variant (24)..(24): xaa in position 24 is Ile, Val, Phe, Leu, Tyr or Met
  Variant (25)..(26): xaa in position 25 to 26 is any amino acid
  Variant (27)..(27): xaa in position 27 is Ile or Val
  Variant (28)..(28): xaa in position 28 is Gly, Ser, Thr, Cys or Ala
  Variant (30)..(30): xaa in position 30 is Leu, Ile or Phe
  Variant (31)..(32): xaa in position 31 to 32 is any amino acid
  Variant (33)..(33): xaa in position 33 is any or no amino acid
  Variant (37)..(37): xaa in position 37 is any amino acid
  Variant (38)..(38): xaa in position 38 is Asp, His or Glu
  Variant (39)..(39): xaa in position 39 is any amino acid
  Variant (40)..(40): xaa in position 40 is Ile, Leu, Val, Met, Ala or Thr
  Variant (41)..(54): xaa in position 41 to 54 is any amino acid
  Variant (55)..(59): xaa in position 55 to 59 is any or no amino acid
  Variant (60)..(60): xaa in position 60 is Val, Ile, Ala, Leu or Tyr
  Variant (61)..(61): xaa in position 61 is Leu, Ile, Val, Met or Cys
  Variant (62)..(62): xaa in position 62 is Leu, Val, Ile or Ala
  Variant (64)..(64): xaa in position 64 is any amino acid
  Variant (65)..(65): xaa in position 65 is Gly, Ala, Ser, Pro or Cys

SEQ ID NO: 40260 - protein, 51 aa, Artificial sequence; identical to SEQ ID NO: 6178
  Variant (1)..(1): xaa in position 1 is Phe, Tyr, Leu or His
  Variant (2)..(5): xaa in position 2 to 5 is any amino acid
  Variant (6)..(6): xaa in position 6 is Ala, Ser, Ile or Val
  Variant (7)..(7): xaa in position 7 is His, Arg or Gln
  Variant (8)..(8): xaa in position 8 is any amino acid
  Variant (9)..(9): xaa in position 9 is Ile, Val, Leu, Met or Ala
  Variant (10)..(10): xaa in position 10 is any amino acid
  Variant (11)..(11): xaa in position 11 is Ala, Gly or Thr
  Variant (12)..(12): xaa in position 12 is Gly, Ala or Ser
  Variant (13)..(13): xaa in position 13 is any amino acid
  Variant (15)..(16): xaa in position 15 to 16 is any amino acid
  Variant (17)..(17): xaa in position 17 is Leu, Ile, Val, Ala, Met or Cys
  Variant (18)..(18): xaa in position 18 is Met, Ile, Val, His or Cys
  Variant (19)..(19): xaa in position 19 is Pro or Thr
  Variant (21)..(21): xaa in position 21 is any amino acid
  Variant (22)..(22): xaa in position 22 is Phe or Tyr
  Variant (24)..(24): xaa in position 24 is Pro or Ala
  Variant (25)..(25): xaa in position 25 is Cys, Phe or Leu
  Variant (27)..(27): xaa in position 27 is Leu or Ile
  Variant (28)..(28): xaa in position 28 is any amino acid
  Variant (29)..(29): xaa in position 29 is Gln, Asn or Pro
  Variant (30)..(30): xaa in position 30 is Leu, Met or Ile
  Variant (31)..(31): xaa in position 31 is any amino acid
  Variant (32)..(32): xaa in position 32 is Ala, Gly or Ser
  Variant (33)..(33): xaa in position 33 is Met, Leu or Gln
  Variant (34)..(34): xaa in position 34 is any amino acid
  Variant (35)..(35): xaa in position 35 is Tyr, Phe, Cys or Leu
  Variant (36)..(36): xaa in position 36 is Gly, Ala or Asn
  Variant (37)..(37): xaa in position 37 is Thr, Ser, Ala or Cys
  Variant (38)..(38): xaa in position 38 is Val, Ile, Leu, Pro or Ala
  Variant (39)..(39): xaa in position 39 is Pro, Cys or Val
  Variant (40)..(40): xaa in position 40 is Ile, Val, Leu or Ala
  Variant (41)..(41): xaa in position 41 is Val, Ala or Cys
  Variant (42)..(42): xaa in position 42 is Arg, His, Ala, Ser or Thr
  Variant (43)..(43): xaa in position 43 is any amino acid
  Variant (44)..(44): xaa in position 44 is Thr or Val
  Variant (47)..(47): xaa in position 47 is Leu or Ile
  Variant (48)..(48): xaa in position 48 is any amino acid
  Variant (49)..(49): xaa in position 49 is Asp or Glu
  Variant (50)..(50): xaa in position 50 is Thr, Ser or Val
  Variant (51)..(51): xaa in position 51 is Val or Ile

SEQ ID NO: 40261 - DNA, 1182 bp, Escherichia coli
  CDS (1)..(1182)
atgtcgaaaagcaatccgtctgaagtgaaattggccgtaccgacatccggtggcttctccgggctgaaatcactgaatttgcaggtcttcgtgatgattgcagctatcatcgcaatcatgctgttctttacctggaccaccgatggtgcctacttaagcgcccgtaacgtctccaacctgttacgccagaccgcgattaccggcatcctcgcggtaggaatggtgttcgtcataatttctgctgaaatcgacctttccgtcggctcaatgatggggctgttaggtggcgtcgcggcgatttgtgacgtctggttaggctggcctttgccacttaccatcattgtgacgctggttctgggactgcttctcggtgcctggaacggatggtgggtcgcgtaccgtaaagtcccttcatttattgtcaccctcgcgggcatgttggcatttcgcggcatactcattggcatcaccaacggcacgactgtatcccccaccagcgccgcgatgtcacaaattgggcaaagctatctccccgccagtaccggcttcatcattggcgcgcttggcttaatggcttttgttggttggcaatggcgcggaagaatgcgccgtcaggctttgggtttacagtctccggcctctaccgcagtagtcggtcgccaggctttaaccgctatcatcgtattaggcgcaatctggctgttgaatgattaccgtggcgttcccactcctgttctgctgctgacgttgctgttactcggcggaatgtttatggcaacgcggacggcatttggacgacgcatttatgccatcggcggcaatctggaagcagcacgtctctccgggattaacgttgaacgcaccaaacttgccgtgttcgcgattaacggattaatggtagccatcgccggattaatccttagttctcgacttggcgctggttcaccttctgcgggaaatatcgccgaactggacgcaattgcagcatgcgtgattggcggcaccagcctggctggcggtgtgggaagcgttgccggagcagtaatgggggcatttatcatggcttcactggataacggcatgagtatgatggatgtaccgaccttctggcagtatatcgttaaaggtgcgattctgttgctggcagtatggatggactccgcaaccaaacgccgttcttga

SEQ ID NO: 40262 - protein, 393 aa, Escherichia coli
MSKSNPSEVKLAVPTSGGFSGLKSLNLQVFVMIAAIIAIMLFFTWTTDGAYLSARNVSNLLRQTAITGILAVGMVFVIISAEIDLSVGSMMGLLGGVAAICDVWLGWPLPLTIIVTLVLGLLLGAWNGWWVAYRKVPSFIVTLAGMLAFRGILIGITNGTTVSPTSAAMSQIGQSYLPASTGFIIGALGLMAFVGWQWRGRMRRQALGLQSPASTAVVGRQALTAIIVLGAIWLLNDYRGVPTPVLLLTLLLLGGMFMATRTAFGRRIYAIGGNLEAARLSGINVERTKLAVFAINGLMVAIAGLILSSRLGAGSPSAGNIAELDAIAACVIGGTSLAGGVGSVAGAVMGAFIMASLDNGMSMMDVPTFWQYIVKGAILLLAVWMDSATKRRS

SEQ ID NO: 40263 - DNA, 996 bp, Mesorhizobium loti MAFF303099
  CDS (1)..(996): transl_table=11
atggctgagatgacaacgggacaaggattggcgtcgatccggccggggtcggtgggtcggttgcgaggctgggcgcaaagccttggcctgctctgggtcctgatagtgttgtgcgccttcgcagtgtatctgtcgccgagcttcatccagaccggcaacatgttgaatgtcggccgccaggtcgcgctgtttggcatcgtcagcgtcggcatgaccttcgtgattctgacacgcggcatcgatctttccgtcggttccatcgtcggtgtcgtcgcggttgccacagcgctgatgctctcatctggcgttccaatcccgttggcgatgattgcggcgctggggatgggagccgtgttcggcgccatcaacggagcaggcgtcgttttctttggcatgccgcccttcatcatgaccctcggcacgctggtgatggggcgcggcattgccatgaccatcgccaacggcgagccgaagacgcttggcgatgcctcggatgccttctcctatctgggaagcggttttctcttcggcattcccgtaccgatctggatcttcgttgccatagccgccgtggctttcgttgtcctacgacacacgcctttcggtcgccaaatctacgcggtcggttcaaacaccgaggcggcgcggcttgccggcatcaacgtgccgcgcgtgctgatgtcggtctatgccatctcgggcgtgctgtcggcgctgaccgccctggtttttgtctcacggctcaccgttggtgagcccaccgctggcaccaatctcgaactcgaggccatctcgatcgtcgtcatcggcggcaccagcctgtttggcggcgaaggcggcgtcatcggcaccgtgatcggcgccgcaatcattgccgtcatggctaatatattgaatttgctaggtatatcgccattcacacagcagatcgtgaagggcgccatcatcatcgccgcggtgatgttcgaggtctaccgtcacaaaagacggtcctga

SEQ ID NO: 40264 - protein, 331 aa, Mesorhizobium loti MAFF303099
MAEMTTGQGLASIRPGSVGRLRGWAQSLGLLWVLIVLCAFAVYLSPSFIQTGNMLNVGRQVALFGIVSVGMTFVILTRGIDLSVGSIVGVVAVATALMLSSGVPIPLAMIAALGMGAVFGAINGAGVVFFGMPPFIMTLGTLVMGRGIAMTIANGEPKTLGDASDAFSYLGSGFLFGIPVPIWIFVAIAAVAFVVLRHTPFGRQIYAVGSNTEAARLAGINVPRVLMSVYAISGVLSALTALVFVSRLTVGEPTAGTNLELEAISIVVIGGTSLFGGEGGVIGTVIGAAIIAVMANILNLLGISPFTQQIVKGAIIIAAVMFEVYRHKRRS

SEQ ID NO: 40265 - DNA, 987 bp, Mesorhizobium loti MAFF303099
  CDS (1)..(987): transl_table=11
atgaccgacatccaaagcccggcgaaagctgcagccgctcagccaggcggtcgctccgcgttacaacatctgctgcagggcgagcggccctacatgctctatgtcgccttcgccgtcatgctgatcgtcttcagcctagcgtcaccctggttcctgtcgatcgacaattttctcaacatcggccgccagacgacactggtctcgatcatcgcggtgggcatgacattcgtcatcatctccaggcagatcgacctgtccgtcgcctcgacgctggcgctttcgggcatgagcgcatcgctggccatggcctttgtcgccaacaactgggtcgtcggtgccgcggcggggctgggcaccggggcgctgatcgggctgctcaacggtgtcctgaccacgcgcctcgaaatcccgtccttcctggtgacgctgggcacgctgagcggcgcgcgcggcctggcgctgatggtcaccaacaccaagccggtcatcatcaccaacgaatattatttcgcgatcttcggcgagggctcggtgctcggtataccggcgccgatcctgtggacgctcggcgtcaccatcgccggcatcttgctgctgcactacagcgtctatgggcggcgggtttacgccgccggcggcaacccgacggccgcgctctattccggcgtccacatcaagcaggtcacgacgcttgccttcgtgctgaccggcacgctcgccgggctggcgtcgctgatcctgtcggcgcgctcgcacgcggcgcggcccgatgtggtgcaaggcatggagctcgacgtcatcgcctcggtcatccttggcggctgcagcctgttcggcggccgcggcttcgtgctcggcacgctgctcggcagcctgatcatcggcacgctcaacaacgggctggtgctgctcggcgtcagctcgtcgctgcaactcgtcatcaagggggcaatcatcgtcgccgcggtcgcgttcacgaggaggtaa

SEQ ID NO: 40266 - protein, 328 aa, Mesorhizobium loti MAFF303099
MTDIQSPAKAAAAQPGGRSALQHLLQGERPYMLYVAFAVMLIVFSLASPWFLSIDNFLNIGRQTTLVSIIAVGMTFVIISRQIDLSVASTLALSGMSASLAMAFVANNWVVGAAAGLGTGALIGLLNGVLTTRLEIPSFLVTLGTLSGARGLALMVTNTKPVIITNEYYFAIFGEGSVLGIPAPILWTLGVTIAGILLLHYSVYGRRVYAAGGNPTAALYSGVHIKQVTTLAFVLTGTLAGLASLILSARSHAARPDVVQGMELDVIASVILGGCSLFGGRGFVLGTLLGSLIIGTLNNGLVLLGVSSSLQLVIKGAIIVAAVAFTRR

SEQ ID NO: 40267 - DNA, 1017 bp, Mesorhizobium loti MAFF303099
  CDS (1)..(1017): transl_table=11
atgagcatcgccgaagagcagagccagcgcggcggcgcgacgatcgcgcggctgctgatgagtttcgggccgctgctgttcctggcggcgctggtcgtcgtcttcaccgttttgaagccgagcttcatcgacccgatcaatctgttcaacatcacgcggcagatctcgatcaccgggctgatcgcgctcggcatgaccttcgtcatcctcaccgccggtatcgacctctcggtcggctcgctgctggccttctgcggcatggtcgccgccgtcgtcgccaagggcggtgctgccaacacgctgtcgctgtcgacctcaggcacgcagggctatggctggttcgcggcgctgctcgccgccgtcatcgtcggcgccgccgccggcggcgtgcaggggcttgccatcacccgcctgaaagtgccgcccttcgtcgtcacgctgggcgggcttacggtgtttcgcgggctgacgctgaccatctccaatggcggcccgatctcgggcttcgacgcctcgatgcgctggttcggcacggggctgatcggcccggtgccggtcccggcgatcatcttcgccgtcgccgcgatcctgtgccacatcgtgctgcgctacacgcgctatggccgcgccgtctacgccgtcggcggcaatgccgaggccgcacggctgtcgggcctgcgcgtcgaccgcatcctggtctcggtctatgtcatcgtcggcttcttcgccgggctcgccgccttcgtgctgtcggcgcggctcaattcctcggaagcggtcgccggcatcggctatgagctgacggtgatctccgccgtcgtcatcggcggcacctcgctgttcggtggcatcggctcggtcggcggcacggtggtgggcgcggcgctaatcggcgtgctgcagaacgggctgcagttcaacaatgtgtcgtcctacacgcaaagcatcgtgattgggctcatcctgatcctggcggtggcgtttgaccgatggctgaagtcgcgggtgcgaaggtag

SEQ ID NO: 40268 - protein, 338 aa, Mesorhizobium loti MAFF303099
MSIAEEQSQRGGATIARLLMSFGPLLFLAALVVVFTVLKPSFIDPINLFNITRQISITGLIALGMTFVILTAGIDLSVGSLLAFCGMVAAVVAKGGAANTLSLSTSGTQGYGWFAALLAAVIVGAAAGGVQGLAITRLKVPPFVVTLGGLTVFRGLTLTISNGGPISGFDASMRWFGTGLIGPVPVPAIIFAVAAILCHIVLRYTRYGRAVYAVGGNAEAARLSGLRVDRILVSVYVIVGFFAGLAAFVLSARLNSSEAVAGIGYELTVISAVVIGGTSLFGGIGSVGGTVVGAALIGVLQNGLQFNNVSSYTQSIVIGLILILAVAFDRWLKSRVRR

SEQ ID NO: 40269 - DNA, 1098 bp, Mesorhizobium loti MAFF303099
  CDS (1)..(1098): transl_table=11
atggtttcagagattcgcgacgagcgggtccggtccgtttcacgcctgagccgcctgctaagcaggccggagcttggcgcggccgccggtaccgtgctggtcttcgtgttcttcgccatcacggcgggaagcacggggctgttcagtgccaagggcatcgtcaatttcctcgaagtctcggcccagcttggcattctcgccgctcccgtggccctgctgatgatcgccggcgagtttgatctgtcggtcggctcgatgatcggctttgccggcatcctcatcgccatccctgccgtattctggggctggccgatctggctttcgctgctgttcaccttcgccgtctgcggcggcatcggcgcgctgaacgggctcgccgtcgtcaggaccggcctgccctccttcatcgtgacgctcggcagcctcttcatgttgcgcggcctcacgcttggcctcacgcgcggcatttcagggcggacccaggtgtcgggcgtgcacgagctggcgcagaacgatcccctcaacagcctgttctctggccaggtgttcaccggcctgatcgcctggcttgccgacctcggcctgatcggcaagcgggcggacggaatgccgtcgatatcaggcattccggtgtcgatcgtgtggtggatcgtgctgacactggcctgcacctggctcttgacgcgcagccgcttcggcaactggatcttcgccgccgggggcgaagccaatgccgcgcgcaatctcggcgtgccggtggcgcgcaccaagatcacgctgttcgtcatgacggcgctcgcggcggccctgttcgcggcgatccaggtgctggtcaccggctccgccgacacgctgcgcggcacgcagaaggaattcgaggccatcatcgccgtcgtcatcggcggcacgctgctgaccggcggctatggatcggccatcggcgccatgttcggcgccctgatcttcggcgtggtgcagatgggcatcttctacaccggcatcgacaccgactggttcaagctgttcatgggcgccatgatggtcatcgcggtgctgttcaacagctatgtgcgcaaccgcgccatgaggagtcggtaa

SEQ ID NO: 40270 - protein, 365 aa, Mesorhizobium loti MAFF303099
MVSEIRDERVRSVSRLSRLLSRPELGAAAGTVLVFVFFAITAGSTGLFSAKGIVNFLEVSAQLGILAAPVALLMIAGEFDLSVGSMIGFAGILIAIPAVFWGWPIWLSLLFTFAVCGGIGALNGLAVVRTGLPSFIVTLGSLFMLRGLTLGLTRGISGRTQVSGVHELAQNDPLNSLFSGQVFTGLIAWLADLGLIGKRADGMPSISGIPVSIVWWIVLTLACTWLLTRSRFGNWIFAAGGEANAARNLGVPVARTKITLFVMTALAAALFAAIQVLVTGSADTLRGTQKEFEAIIAVVIGGTLLTGGYGSAIGAMFGALIFGVVQMGIFYTGIDTDWFKLFMGAMMVIAVLFNSYVRNRAMRSR

SEQ ID NO: 40271 - DNA, 969 bp, Mesorhizobium loti MAFF303099
  CDS (1)..(969): transl_table=11
atgagcaccgaggcgattgctgccgaaaaacccaagcgcaattacaacgcactgttcgggctgacgctgctggcgctgctggtgttgctctgggtcatcctgtcgctgtcgacatcgagcttcgcctcggccaacaacatctcgaaccttttgcgtcagggttcgatgatcgccatcctggcggtcggccagaccttcgtcatcatcaccggcggcatcgatctgtccgtcggtgcggtggtcggcttcgccaccgtcattgccgcgatgctgatcaatgccggcataccggtcttcctcgccatcctgatcacgctgctggtcggcgttgccatcggcctgttccacggcttcggcatcgtcaagatgggcctgccgcccttcatcatcacgctggcgacgctgacctcgctgcgcggcatcggccttctgatgaccaacggcaactcgatctccatcaacaatgatgccttccaggaattctcgcgcaactccttcctcggcgtgcccaatctgttctggatggtcatcctggtcggcattccggcctatatcttcctgcatcacagccgctggggccgctacctcttctcggtcggctccaacgccgaggcctcgcgcctctccggcgtcaatgtccagcgcaccatctacatggcttacacgctgtcgggcctctgcgcagcctttgtcggcgtgctcctggcctcgcgcatcggcatcggcaacccgacccaggccgagggctgggaattgcaggcgatcgcgtcctcggtcatcggcggcacctcgctgttcggtgcggtcggctcggtgcacggtccgctgctcggcgccttcatcctcgccaccatcaacaacggcgccaacctgctcaacgtcaacgccttctggcagcgcatcatcactggcgtgctgatcatcgtcatcgtctatttcgacggtctgcgccgccgcggcggcaagtga

SEQ ID NO: 40272 - protein, 322 aa, Mesorhizobium loti MAFF303099
MSTEAIAAEKPKRNYNALFGLTLLALLVLLWVILSLSTSSFASANNISNLLRQGSMIAILAVGQTFVIITGGIDLSVGAVVGFATVIAAMLINAGIPVFLAILITLLVGVAIGLFHGFGIVKMGLPPFIITLATLTSLRGIGLLMTNGNSISINNDAFQEFSRNSFLGVPNLFWMVILVGIPAYIFLHHSRWGRYLFSVGSNAEASRLSGVNVQRTIYMAYTLSGLCAAFVGVLLASRIGIGNPTQAEGWELQAIASSVIGGTSLFGAVGSVHGPLLGAFILATINNGANLLNVNAFWQRIITGVLIIVIVYFDGLRRRGGK

SEQ ID NO: 40273 - DNA, 993 bp, Mesorhizobium loti MAFF303099
  CDS (1)..(993): transl_table=11
atgaccgacagaacgacgacgagcgtggatcaggcggcggtcaggagccggcggctgcgcacagccttcgcggcgctcggcatgctgccggtgctggtgctgctggcggcgggcttccagttcatcaatccgcgcttcctcaccgaaaccaatctgctcatcgtcacgcagcaatcgtcgatcaacatcgtgctcgccgccggcatgaccttcgtcatcctgaccggcggcatcgacctgtcggtcggctccatcctcgccgcgtcggcgatggtggcggtgctggtgtcactggtgcccgactggggcctgctcggcgtgccggcggccatcctcgtcggcctcggcttcgggctcgtgaacgggctgctcgtcgcctatatcaggctgccacccttcatcgtcacgctgggttcgctgacggccgtgcgcggcgttgcccgcctgctcgggcaggacacgacggtgttcaattcggacctgccgttcgacttcatcggcaatggctcgctgttcggcattccctggctggtcgtcatcgcgctgtcggtggtcgtgctgtcctggctggtgctcaagcgcaccgtgctcggcgcctggatctatgcggtcggcggcaatgccgaggcggcgcggctgaccggcatcaaggtgccgctggtgctgctcttcgtctatggcgtgtccggcctgctcgccggcctcggcggcgccatgtcggcggcaaggctttacgccgccaacggcctgcagcttggccagtcctacgagctcgacgccatcgccgccgtcatcctcggcggcaccagtttcgtcggcggcgtcggctcgatctggggcacgctgatcggcggcctgatcatcgcggttctgtccaacgggctcatcttggccggtgtctcggacatctggcagtacatcatcaagggattggtcatcatcgtggcggtcgccctcgaccgctaccggctccaggcaggggcgagaacgtga

SEQ ID NO: 40274 - protein, 330 aa, Mesorhizobium loti MAFF303099
MTDRTTTSVDQAAVRSRRLRTAFAALGMLPVLVLLAAGFQFINPRFLTETNLLIVTQQSSINIVLAAGMTFVILTGGIDLSVGSILAASAMVAVLVSLVPDWGLLGVPAAILVGLGFGLVNGLLVAYIRLPPFIVTLGSLTAVRGVARLLGQDTTVFNSDLPFDFIGNGSLFGIPWLVVIALSVVVLSWLVLKRTVLGAWIYAVGGNAEAARLTGIKVPLVLLFVYGVSGLLAGLGGAMSAARLYAANGLQLGQSYELDAIAAVILGGTSFVGGVGSIWGTLIGGLIIAVLSNGLILAGVSDIWQYIIKGLVIIVAVALDRYRLQAGART

SEQ ID NO: 40275 - DNA, 1332 bp, Mesorhizobium loti MAFF303099
  CDS (1)..(1332): transl_table=11
atgaccgacacgacctctaatcaaccggtcggcagcactgcggcggacagggcgcgtgcatccgaactcagcgccgtcgggcggttcctcaaggctaccgagctcgatacgcgcatgctcggcatggtcggcgcgctgctggtcatctgggtcggcatccatatcctgtcgggcgggcttttcctgacgccgcgcaatctgtggaacctgtcggtgcagacctcgtcggtcgcgatcatggcgaccggcatggtgctggtcatcgtcatgcgcaacatcgacctctcggtcggatccgtcgaaggcgtgatcggcatgatcatgggcgtggcgcaggctgaattcctcatccgcgtcgtcggtttccagcttggaaatccctggctctggatcatcgcgctggcggccggcgtggtgcttggcctcctgatcggcgcattccagggcttcatcatcgcctatatggaggttccggccttcatcgtgacgctgggcggcctgctggtctggcgcggcatggcatggctgatcaccagcggccgcacggtcgcgccgctcgacacaaccttccaactgatgggcggcggaccacgcggctcgatcggcgccaccgccagctggatcgtcggaatcgtcgcttgcgcggctgtcgccttcgcgctgctcaacggccggtcacagcgcaaacggttccactttccactgcgcccggtttgggccgagattttgcttggcggggttgcctgcgccgctatccttggcgccgtctggatcgccaattcctatccatggccgatcggcatcgtgcgccagtatgcccagcagaacggcattaccgttcccgaaggcgggctgtacatcgcgcatggcattgccataccggtgctgatggcggtggccgtgggcattatcatgacgttcatcaccaagcgcacgcgtttcggccgctatgttttcgccattggcggcaatccggaggcggccgaacttgccggtatcaacacccgctgggtgaccatgaaggttttcatgatcatgggcgtgctggccgcgatcagcgcggcgatctcttcggcccggctcaacgcatcgaccaatgcgctgggcacgctggacgagcttctggtcatcgccgccgccgtcatcggcggcacgtcgctcgccggcggcgccggcacggtgatgggcgccatgctgggcgcgcttctgatgcagtcattgcagtcgggcatggtgctgctcggcatcgactcgccgctgcagagcatcgtcgtcggcgccgtgctggtcatcgcggtgtggctcgacaccgtctatcgcaagcgggtttag

SEQ ID NO: 40276 - protein, 443 aa, Mesorhizobium loti MAFF303099
MTDTTSNQPVGSTAADRARASELSAVGRFLKATELDTRMLGMVGALLVIWVGIHILSGGLFLTPRNLWNLSVQTSSVAIMATGMVLVIVMRNIDLSVGSVEGVIGMIMGVAQAEFLIRVVGFQLGNPWLWIIALAAGVVLGLLIGAFQGFIIAYMEVPAFIVTLGGLLVWRGMAWLITSGRTVAPLDTTFQLMGGGPRGSIGATASWIVGIVACAAVAFALLNGRSQRKRFHFPLRPVWAEILLGGVACAAILGAVWIANSYPWPIGIVRQYAQQNGITVPEGGLYIAHGIAIPVLMAVAVGIIMTFITKRTRFGRYVFAIGGNPEAAELAGINTRWVTMKVFMIMGVLAAISAAISSARLNASTNALGTLDELLVIAAAVIGGTSLAGGAGTVMGAMLGALLMQSLQSGMVLLGIDSPLQSIVVGAVLVIAVWLDTVYRKRV

SEQ ID NO: 40277 - DNA, 1287 bp, Mesorhizobium loti MAFF303099
  CDS (1)..(1287): transl_table=11
atgagcaccgacagcgcccccgccccgcagggcaacatcgcagaggaccagcgtccacgcatcgccgtctcggcgctgacgacgaacctgcgcgaatacggtctcatcatcgcgctgatcgtcatcatgctgttcttccagttcaccacgtcgggaacgctgttcaagccggtcaacctcagcaatttggtgcagcagaactcgttcatcatcgtgatggcgctgggcatgctgctggtcatcgtttccggctatatcgacctcagcgtcggatcggtcgccggtttcatcggcgcgctggcggcaaacatgatggtcatctggcagctcggaccgctcagcaatccgctggtggtttcgatcgtctgcctgatcgtgggcggcctgatcggtgcggcgcaaggctattggatcgcctaccaccggataccgagcttcatcgtgacattggccggcatgctgatcttccgcggcatctgccaggcgctgctgggcggcggctcttcggtgggcccccttccggacggcttcaaggcgctgagctccggcttcatcccggacgttatcggcccgctgacgctgatcccgccgacggtgaacgccgccggcaagaccatcgtgggcagcggcctgacactgcacatgacgacgatcgtgctcggtctgatcgccgtggtggcctatgcctatttcggggtgaggacacgacgcaagcgcgaacgccacggctatgaagccgagcccttccccctgttcgtcatcaaaacgctggtcgccagcgcgctggcgctgttcctggtctatgagttcgccagctacaggggcctgccggtggtgctgctcgtcatgggcgtactgatctcgctgttcgtcttcgtcaccaagcgcatgaccatcggccgccgcatctacgcgatgggcggcaatcccaaggcggcgcagctgtcgggcatcaacaccgagcggctgacgctgctggtgttcatcaatatgggcgtgctgtcggcgctgggcggcctcatcatcgcggcgcgtctcggccaggccgtgccggcggccggtctgggctcagagctcgacgtcatcgccgccgtcttcatcggcggcgcctcggcgatgggcggcgtcggccaagtcatcggcgccgtggtcggcggcttcatcatgggcgtgatgaacaacggcatgtcgatcatgggtgtcaatgtcgactggcagcaggtggtcaaaggcctggtgctgctcggcgccgtgatcttcgacgtctacaacaagaacaaggcctga

SEQ ID NO: 40278 - protein, 428 aa, Mesorhizobium loti MAFF303099
MSTDSAPAPQGNIAEDQRPRIAVSALTTNLREYGLIIALIVIMLFFQFTTSGTLFKPVNLSNLVQQNSFIIVMALGMLLVIVSGYIDLSVGSVAGFIGALAANMMVIWQLGPLSNPLVVSIVCLIVGGLIGAAQGYWIAYHRIPSFIVTLAGMLIFRGICQALLGGGSSVGPLPDGFKALSSGFIPDVIGPLTLIPPTVNAAGKTIVGSGLTLHMTTIVLGLIAVVAYAYFGVRTRRKRERHGYEAEPFPLFVIKTLVASALALFLVYEFASYRGLPVVLLVMGVLISLFVFVTKRMTIGRRIYAMGGNPKAAQLSGINTERLTLLVFINMGVLSALGGLIIAARLGQAVPAAGLGSELDVIAAVFIGGASAMGGVGQVIGAVVGGFIMGVMNNGMSIMGVNVDWQQVVKGLVLLGAVIFDVYNKNKA

SEQ ID NO: 40279 - DNA, 996 bp, Mesorhizobium loti MAFF303099
  CDS (1)..(996): transl_table=11
atgagcgatatccctgccccgcgccacattcccgaccggctcgacaagccgtttcgctcggcgatcttttcctgggaggcgctgctggtcgtggtggccgttgccatcttcgccatcaacagcttcgcctcgccctatttcctcgacccctattcgctgtcggatctgaccttcaatttcacggagaagggcctgatcgcctttgccatggcgctgctgatcatttcgggcgagatcgacctgtcggtggccgccatcatcgcactggcatcgaccatgatgggcatggcggtgcaggcgggagccggcacgccggtgctggtgctgatcggcatcgtggtgggcctcggctgcggcgccttcaacgggctcttggtgacaaggcttggcctgccgtcgatcgtcgtcaccatcggcacgatgagcctgttccgcggcatcgccttcatcatccttggcgaccaggcctataagggctatcccgaaagcttcgccttcttcggccagggctatgtctggtgggtggtctcgttcgagctggtgctcttcctcatcgccgccgtcgtctactggttcctgctgcatcgcacgagtttcggccgccgcgtctttgccatcggcaacaatccggtcgctgcgcagttttccggcgtgcgcgtcggccgcatcaaattcatccttttctgcctgaccggactgatgtcaggcatagcttcggtgctgatcacctcacggctcggctcgacgaggccgtcgatcgcgcagggctatgagctggaagtcatcaccatggtggtgctcggcggcgtcagcattctgggcggcgccggcagcattgtcggcgtcgtgctggcagccttcatcatggggctggtgaccttcggccttggcctgctcaacgtgccgggcatcgtcatgtcgatcttcatcggcctgctgctgatcatcgtcatcgccctgccgatcgtctggcggcggctgcgcggaggacgttga

SEQ ID NO: 40280 - protein, 331 aa, Mesorhizobium loti MAFF303099
MSDIPAPRHIPDRLDKPFRSAIFSWEALLVVVAVAIFAINSFASPYFLDPYSLSDLTFNFTEKGLIAFAMALLIISGEIDLSVAAIIALASTMMGMAVQAGAGTPVLVLIGIVVGLGCGAFNGLLVTRLGLPSIVVTIGTMSLFRGIAFIILGDQAYKGYPESFAFFGQGYVWWVVSFELVLFLIAAVVYWFLLHRTSFGRRVFAIGNNPVAAQFSGVRVGRIKFILFCLTGLMSGIASVLITSRLGSTRPSIAQGYELEVITMVVLGGVSILGGAGSIVGVVLAAFIMGLVTFGLGLLNVPGIVMSIFIGLLLIIVIALPIVWRRLRGGR

SEQ ID NO: 40281 - DNA, 978 bp, Mesorhizobium loti MAFF303099
  CDS (1)..(978): transl_table=11
atgaaggcctttctcaaataccgcgagatctggctggccgcggctatcatcgtgctgatcgggctgatctcgacccgcttcccggcttttgccgaccccggcaacctgggccaggtgttcaacgacacctcgatcctgatgatcctggcgctcggccagatggtggtgatcctgacgcggtcgatcgacctgtcgatggcctctaatctctgcttcaccggtatggtggtggcgatgctgaacgcggcacacccggcgatcccgatcccggtgttgatcgtcatcgcgctcgctgtcgggcttgcgctgggcgccatcaacggccttctggtgtggcggctgaacattccttcgatcgtggtgactttgggcacgctgaccatctatcgcggcgccactttcgtcctgtccggcggcgcctgggtcaatgccgacaagatgagcccggagttcatcggcttccagcgcgccgccttcctcggcattccggtgctgtcctggattgccatcctggtcatcgcgctgttcttcgtgctgatgacgcgcaccgcgctcggccgctcgatctatgccatcggcgtcaacccgaccgcgtcaatctataccggcatcgatgtcggccgcacgaaattcatcgtcttctgcatctccggcatgatcggcgggcttgccggctatctctggatctcgcgttacgtcatcgcctcggtcgaagtcgccaacggctatgagctcaacatcatcgccgcctgcgtcatcggcggcatttcgatcgccggcggcatcggctcggtcggcggcgcggtgctgggcgcgctgttcctcggcatcatctccaacgcgctcccggtcatcaacatctcgcccttctggcagatggcgatttcgggtagcgccatcatcctggccgtcgtgctcaacgcgcgcggcgaacgccagcagggtcgcatcatcctgagaaaggcggaggcggcatga

SEQ ID NO: 40282 - protein, 325 aa, Mesorhizobium loti MAFF303099
MKAFLKYREIWLAAAIIVLIGLISTRFPAFADPGNLGQVFNDTSILMILALGQMVVILTRSIDLSMASNLCFTGMVVAMLNAAHPAIPIPVLIVIALAVGLALGAINGLLVWRLNIPSIVVTLGTLTIYRGATFVLSGGAWVNADKMSPEFIGFQRAAFLGIPVLSWIAILVIALFFVLMTRTALGRSIYAIGVNPTASIYTGIDVGRTKFIVFCISGMIGGLAGYLWISRYVIASVEVANGYELNIIAACVIGGISIAGGIGSVGGAVLGALFLGIISNALPVINISPFWQMAISGSAIILAVVLNARGERQQGRIILRKAEAA

SEQ ID NO: 40283 - DNA, 999 bp, Mesorhizobium loti MAFF303099
  CDS (1)..(999): transl_table=11
atgaagctcaggaccttcatcgcgctgattgccgtgctggtgttcttctccatcgccgccccgaacttcctgtccgccgccaatctgatcctgatggccaagcatgtggcgctcaacgccttcctcgccatgggcatgaccttcgtcatcatcaccggcggcatcgacctttcggtcggctcgatcgtcggcctgtgcggcatggtggccggctatctcgtgctcaacggcatcgacctgcaattcggctacaccatctacttcaacgtggtggagatcgcattgatcaccctggcggtcggcattttgatcggcgccgtcaacggactgctgatcacccggctcaacgtcgcacccttcatcgccacgctcggcgtcctctatgtggcgcgcggcctggcgctgctgtcgtctgacggccgcaccttccccaatctggtcggcaagccggaactcggcaccaccggcttcggcttcctcggcgcaggccggctcgtcggcttgcccgtctcgatctggatcctgatcgtggtggcgctgggcgcggcgtatctcgcccggtacacgccgctcggccgccacatcttcgccgtcggtggaaacgagcgcgcggcgcgcatttcgggcgtacgcgtcaacatggtcaagatgttcgtctacatgttctccggcttctgcgcggcgatcgtcggcctgatcatctcgtcggagctgatggcctcgcatcctgcaacaggcgagagcttcgaactgaatgccatcgctgcggcggtgcttggaggcacctcgatgtcgggcggccgcggcacgatcggcggcaccatcgtcggcgccttcgtcatcggcatcctgtcggatgggctggtgatgatgggcgtgagctccttctggcagatggtgatcaaaggcctcgtcatcatcgtcgccgtcgtcgtcgaccaggcacagcgccggcttcagcagcgtgtcaccctgatgcagatggcaaaggcgggttga

SEQ ID NO: 40284 - protein, 332 aa, Mesorhizobium loti MAFF303099
MKLRTFIALIAVLVFFSIAAPNFLSAANLILMAKHVALNAFLAMGMTFVIITGGIDLSVGSIVGLCGMVAGYLVLNGIDLQFGYTIYFNVVEIALITLAVGILIGAVNGLLITRLNVAPFIATLGVLYVARGLALLSSDGRTFPNLVGKPELGTTGFGFLGAGRLVGLPVSIWILIVVALGAAYLARYTPLGRHIFAVGGNERAARISGVRVNMVKMFVYMFSGFCAAIVGLIISSELMASHPATGESFELNAIAAAVLGGTSMSGGRGTIGGTIVGAFVIGILSDGLVMMGVSSFWQMVIKGLVIIVAVVVDQAQRRLQQRVTLMQMAKAG

SEQ ID NO: 40285 - DNA, 1002 bp, Mesorhizobium loti MAFF303099
  CDS (1)..(1002): transl_table=11
atgaacagcctcgagcttcgcgcatcgaaagcgcagaccgacgccaggggcgcttccacgcgccttgtggagcgccttggcgttcacaacatcagccttctggtcgcgctcgccattctcatcatcatcttcggctcgttgcgcggcgacgtgttcttctcgagccgaaacctgctcaacatcggccttggcgtcaccattctcggcgtgctggcgatgagccagaccgtggtcatcgtcgccggcggtctcgatatcgctgtcggcgccactgtcggtctaaccacagtctcgacggcaatggccatccaggcgaccgggtcgccggcggccggcatcgttgccggcctggtgcttggtggtcttgccggtctcgtcaacggcctcatcatcacctacgggcgcgtcaacgcggtcattgccacgctcggcaccatggcgatctttcgcggcatcgccttcatcatgtccgacggccagtcaatcgccatcttcagcgatacgttccggttcatcggcattggacgcatcctcggcctgccgttgctggtctggattttggtgctgaccgcgatcgcattccacctcttcctcgcgcgttcgatcgtcggccgcaacatctatgcactgggcggcaatcccgttgtcgcccgcttctcgggcatcaacatcaaccgctaccgcgtcggcatctacatcatgagtggtgttgccgccggattggccgggatcctgctggccgcccgtaccggttcgggtcagcccgtatccgggtcccagggcctggaactcgaggcgataacggcggccgtgctgggtggctgtgccctgcagggcggcaagggcacgattgtcggcgcgctgctcggtgtcgccatcattggcgtgctcaacaacggaatgatactgacgtccgtgccaaccttctatcaattgctggcaaaaggctcactgctgatccttgctgtggtcattgccgagtaccacttgaacaggacatga

SEQ ID NO: 40286 - protein, 333 aa, Mesorhizobium loti MAFF303099
MNSLELRASKAQTDARGASTRLVERLGVHNISLLVALAILIIIFGSLRGDVFFSSRNLLNIGLGVTILGVLAMSQTVVIVAGGLDIAVGATVGLTTVSTAMAIQATGSPAAGIVAGLVLGGLAGLVNGLIITYGRVNAVIATLGTMAIFRGIAFIMSDGQSIAIFSDTFRFIGIGRILGLPLLVWILVLTAIAFHLFLARSIVGRNIYALGGNPVVARFSGININRYRVGIYIMSGVAAGLAGILLAARTGSGQPVSGSQGLELEAITAAVLGGCALQGGKGTIVGALLGVAIIGVLNNGMILTSVPTFYQLLAKGSLLILAVVIAEYHLNRT

SEQ ID NO: 40287 - DNA, 1029 bp, Mesorhizobium loti MAFF303099
  CDS (1)..(1029): transl_table=11
gtggagatcgcggcccgttcaaaaccatgtcgcgggttccctgtggaaaatcattcgcttgtccaacgcctgattgcgcggcctgaattcggtcccttcgtgctgctcgtcgtcgagatcggcgttttctggggcttcaaccacgacttcctgtcgccgcagaacatctccaacacgctggccttcaccgtcgagctcggcctgatcgcgctggcgatgaccttgctgatgacatcgggcgaattcgacctgtccgtcggatccctgttcggcttctcgcccgtgctgatgtggacgctgttcaacggcggcgtcacctcgctggagatgggcttcgtcatcgcgctggtggttgctgccttgatcggcctggtcaatggctggttcgtcacgcagctcaagatcccgtccttcctggtgaccctcggcatgctgctcgtagtgcgcggcagtgcccttttcatcaccgacggttttccgcagcgcacctggagcgccgagggcagctggctggcggaggcgctggtcggcgacttcttcatcgggccgttccgcatctacatgtcgctgttctggttcatcgccgcggcgatcgcgctcggctttgtgctgacgcaaagccggaccggcaactggatccaggcggcgggcggcaatcccaacgcggcgcgcgcccgcggcgtgaatgtcaaccgcgtcaagattggcctgttcgtgctgtcgtcgctcatggcctcgctggccggcgtcatctcttcgttgcgcacgtcggccgccaatcccaacagcggcaccggctacgagctcgaagtcatcgccatggtggtgatcggcggcacggcgctgaccggcggacgcgggaccatcatcggcaccgtgctcggcatcctgatcctgcgcgtgatgcgcaacggcatcgtgctgatcggcgtgcccggtcttgcctacaacatcttcatcggcgcgatcatccttggcatgatggcgctccactcatggctggaacgccggcaccaggcagggacttga

SEQ ID NO: 40288 - protein, 342 aa, Mesorhizobium loti MAFF303099
MEIAARSKPCRGFPVENHSLVQRLIARPEFGPFVLLVVEIGVFWGFNHDFLSPQNISNTLAFTVELGLIALAMTLLMTSGEFDLSVGSLFGFSPVLMWTLFNGGVTSLEMGFVIALVVAALIGLVNGWFVTQLKIPSFLVTLGMLLVVRGSALFITDGFPQRTWSAEGSWLAEALVGDFFIGPFRIYMSLFWFIAAAIALGFVLTQSRTGNWIQAAGGNPNAARARGVNVNRVKIGLFVLSSLMASLAGVISSLRTSAANPNSGTGYELEVIAMVVIGGTALTGGRGTIIGTVLGILILRVMRNGIVLIGVPGLAYNIFIGAIILGMMALHSWLERRHQAGT

SEQ ID NO: 40289 - DNA, 1062 bp, Mesorhizobium loti MAFF303099
  CDS (1)..(1062): transl_table=11
atgactcaagctcaggaattcgagaaggttctctcggccagcgacaccagcgttgccgcgttcgacgaacacaaatcggcagtcaggcgcgtgcagcacttcctgcattcgacgccggcggcagtgccgctcatcgtgctggtcctgtcgatcatcatcttcggcatcaccattggcgggcgcttcttctcgtcctacacgctgacgctgatcctgcaacagatagccatcgtcggtattctgggtgctgcgcagacactggtcatcctgaccgccggcatcgacctgtcgatcggcgtcatcatggtgatctcagccgtgatcatgggcaattgcgccgtcagctacggcttgccgagcgtggtggccgtggcgctcgggcttgccacgggtgccgcctgcgggctgctcaatgggttgctggtcgcctacatgaagctgccgcctttcatcgtgacgctgggcacgtggaacatcgtcatggccacgaactttatctattcggccaatgaaacgatccgtgacaccgacgtcgacacccaggcgccgctgctgcatctgttcgccctgagcttcaaggtgggtaccgcggtgctgacgctcggtgtcatcgccatggtcgcgctggtgttgctcctctggtacgtcctcaaccacaccgcctggggccgacatgtctacgccgttggcgacgaccaggaggcggccaagctgtcgggcatccagaccaagaaggtgctggtgacggtctacacccttgccgggctgatcgccgccttcgccgcctgggtctccatcggccgcaacggttcgatctcaccgtcggcggccgtcaccgactacaatctgcaagcgatcaccgcgacggtgatcggtggtatttccctcttcggcgggcgcggctcgatcctgggcacgctgttcggcgcgatgatcgtcggcgtcgtctccatgggcctcaacatgctgggcgccgacccgcagtggaaagtgctgctcaccggtgtgttgatcatcggcgccgtggcggtcgaccaatggatcagaaaggtttcggcatga

SEQ ID NO: 40290 - protein, 353 aa, Mesorhizobium loti MAFF303099
MTQAQEFEKVLSASDTSVAAFDEHKSAVRRVQHFLHSTPAAVPLIVLVLSIIIFGITIGGRFFSSYTLTLILQQIAIVGILGAAQTLVILTAGIDLSIGVIMVISAVIMGNCAVSYGLPSVVAVALGLATGAACGLLNGLLVAYMKLPPFIVTLGTWNIVMATNFIYSANETIRDTDVDTQAPLLHLFALSFKVGTAVLTLGVIAMVALVLLLWYVLNHTAWGRHVYAVGDDQEAAKLSGIQTKKVLVTVYTLAGLIAAFAAWVSIGRNGSISPSAAVTDYNLQAITATVIGGISLFGGRGSILGTLFGAMIVGVVSMGLNMLGADPQWKVLLTGVLIIGAVAVDQWIRKVSA

SEQ ID NO: 40291 - DNA, 975 bp, Mesorhizobium loti MAFF303099
  CDS (1)..(975): transl_table=11
gtggtgcgcttccagagcctgatcggcctggtcgtggtggcgatcggcggcatcatcttctcgccgcgccggcacggccagatcctgttcctcgatcccgacaacatcgccaacatcgtgcgcgccgtgtcggagaccggcatcatcgccatcggcatgaccttcgtcatcatcaccgccggcatcgacctgtcggtcggcgcggtgctcggcctgtccagcgtcgtcaccgcgtcgatgatgatctcgggcggcttcgggctcattcccaccatcctcgccgtgcttatcatgggcgtcgtcttcggcgccatccagggcaccatctccacccgctttcggctggagccgttcatcgtcacgctcgccggcttgcaggcggcgcgcggcctggcgctggtcgtctcgggcaaccagtacatcaatatttcctatggcgacgggccgggcctggcaccgccggtgtttgcgatcctcggcgagcggctgttcaacaacaccgtgccggtcgccaccatcgtcttcatcgtctttgccgcgatcgcaaccatcgtgctcaacaccacgcgcttcggccgctatgtcttcgccgtcggcggcaatgagcgcgccgcgcgcatttccggcgtgcccgtctcgatggtgaagatctcggtctatgccatcaccggttttgcttcggctctggccggcatcgtccatgccggccagttcaatttcggcagcgccaatgacggcatgggctacgagctcaccgcgatcgccgccgtggtcatcggtggcacaagcctgtttggcggcgccggctcgatggttggcaccgtggccggcaccatcatgctgggcgcgctcgccaacatcctgcagctcaacaacatcacgccggccatgcagttgctcgcgaccgccgcgatcatcgtgctggcggcagtgcttcaatccctcgttcgccgccgcgagggtttgggtcgttag

SEQ ID NO: 40292 - protein, 324 aa, Mesorhizobium loti MAFF303099
MVRFQSLIGLVVVAIGGIIFSPRRHGQILFLDPDNIANIVRAVSETGIIAIGMTFVIITAGIDLSVGAVLGLSSVVTASMMISGGFGLIPTILAVLIMGVVFGAIQGTISTRFRLEPFIVTLAGLQAARGLALVVSGNQYINISYGDGPGLAPPVFAILGERLFNNTVPVATIVFIVFAAIATIVLNTTRFGRYVFAVGGNERAARISGVPVSMVKISVYAITGFASALAGIVHAGQFNFGSANDGMGYELTAIAAVVIGGTSLFGGAGSMVGTVAGTIMLGALANILQLNNITPAMQLLATAAIIVLAAVLQSLVRRREGLGR

SEQ ID NO: 40293 - DNA, 954 bp, Thermotoga maritima MSB8
  CDS (1)..(954): transl_table=11
ttggcttcgaaatttaagaagagaactttcagagaactcggtcctttagttgctctcgtcagtctggctgtttttacggctatcttgaatcctcgctttctgacggcattcaatcttcaggctctcggaaggcagatcgcgatctttggccttttagctatcggggaaacctttgtcatcatctccgggggaggagccatcgacctctcccccggttccatggtggcgctcacaggggtaatggttgcatggctcatgactcacggtgttcccgtgtggatctctgtaattctcattctgttgttctctataggagcaggtgcgtggcatggcttgtttgtcacaaagctcagagttcccgcttttatcatcacccttggaactctgacgatcgcccgaggcatggcagccgtgatcacaaagggatggcctatcatcggactcccgtcttctttcttgaaaatcgggcagggtgaatttttgaagataccgatcccggtgtggattctccttgcagtggctcttgtggcagatttcttcctcagaaagaccgtttatggaaaacacctgagggcttccggcggtaacgaagtcgccgcaagattttccggagtgaacgtagacagagtgcgaatgatagcgttcatggtatcgggattcctcgccggtgtggtggggataatcattgcggcaaggctttctcaagggcaaccaggtgtcggtagtatgtacgaactctatgccatagcctccactgtaatcggtggaacgagtctcacgggaggagaaggaagtgttttaggagcaatcgtaggcgcgagtatcataagtcttctctggaacgctctcgttcttctcaacgtttcgacgtactggcacaacgtagtcatcggaatcgtcatagttgtggcagtaactctcgacatattgagaaggagacttgcaagcaaataa

SEQ ID NO: 40294 - protein, 317 aa, Thermotoga maritima MSB8
MASKFKKRTFRELGPLVALVSLAVFTAILNPRFLTAFNLQALGRQIAIFGLLAIGETFVIISGGGAIDLSPGSMVALTGVMVAWLMTHGVPVWISVILILLFSIGAGAWHGLFVTKLRVPAFIITLGTLTIARGMAAVITKGWPIIGLPSSFLKIGQGEFLKIPIPVWILLAVALVADFFLRKTVYGKHLRASGGNEVAARFSGVNVDRVRMIAFMVSGFLAGVVGIIIAARLSQGQPGVGSMYELYAIASTVIGGTSLTGGEGSVLGAIVGASIISLLWNALVLLNVSTYWHNVVIGIVIVVAVTLDILRRRLASK

SEQ ID NO: 40295 - DNA, 996 bp, Thermotoga maritima MSB8
  CDS (1)..(996): transl_table=11
atgcaggtcgagagatccagagcgaagatttcgtggtatcaaaggatatctcgctatcagtcgattttcatacttcttggtcttatcgtcttgttcagttttctgtccaatcgatttctcactcttgaaaatttctggatcattctcagacaaacagctgttaacctctgtatagctgtgggtatgacgtttgtcattctcacgggaggaatagatctatctgttggttctatccttggattctcgggggctgtaaccgcaaaacttttgaagtatggtctgatactaagtgcgtttggtgtcgtgctcaagttcaatcctcttggtgcatcaataattggagtcttggctggttttgcaataggattgttcaatgggtttattatcacaagattcaatattcccccatttgtggccacactgggaacaatgacagcagttagaggattcatcatgcttctgactaaaggacatcctataacgcgattgggtgatagttttgacttcataggttctgggtggtttttagggattccaatgccagtctggatagccgctatagccacaggagtaggcatttttattctcagaaaaactcagtttggaagatatgtatatgctgttggaggtaatgaaaaagcagcagttctctctggtgtgaattcaaaactgacgaaactctgggtgtacgcgatatcgggtatcctctcggctgttgcaggtctaatagttaccgcccgtttagattcagcccagccaaatgctggtttgatgtacgagctagatgcaatagccgcaacagttattggaggagcctctctttcaggtggaaaaggaactctcataggaactgttgtaggtgcattgataattggtgttttgaacgatgggttggtactcgttggtgtttctcctttctggcaacaggttgcaaagggattcataataatagctgctgtgatagcagaaaaactcggtagaggggaaaaggagtga

SEQ ID NO: 40296 - protein, 331 aa, Thermotoga maritima MSB8
MQVERSRAKISWYQRISRYQSIFILLGLIVLFSFLSNRFLTLENFWIILRQTAVNLCIAVGMTFVILTGGIDLSVGSILGFSGAVTAKLLKYGLILSAFGVVLKFNPLGASIIGVLAGFAIGLFNGFIITRFNIPPFVATLGTMTAVRGFIMLLTKGHPITRLGDSFDFIGSGWFLGIPMPVWIAAIATGVGIFILRKTQFGRYVYAVGGNEKAAVLSGVNSKLTKLWVYAISGILSAVAGLIVTARLDSAQPNAGLMYELDAIAATVIGGASLSGGKGTLIGTVVGALIIGVLNDGLVLVGVSPFWQQVAKGFIIIAAVIAEKLGRGEKE

SEQ ID NO: 40297 - DNA, 1014 bp, Vibrio cholerae O1 biovar eltor str. N16961
  CDS (1)..(1014): transl_table=11
atgactatggatgctgtcaaatcatttgcaattaaacatttaaaagagggcgcaatctacgcagtgctgtttattctgctggcgattattgtgattcaagagccctcatttctaagcttacgtaacctcagtaatatcctgactcaatcctcggtgcgcgtgattattgcgttgggggtagcaggtttgattgtgactcaaggcactgacttatcagctggtcgccaagtgggtctcgccgcggtgatttccgctactttgttgcaatcaatggataacgtgaacaaagtattcccaagcttgggtgaaattccgattcttgcggtcatcattagtgtctgcttgattggtgcgattatcggtttggtcaacggtgtgatcgtcgcttacctcaaagtaacgccgtttatcgcgaccttaggcaccatgatcatcgtctacggcattaactcgctgtactacgactcggtcggtgcatcaccgattgcgggttttgatgaacgcttcactaccttcactcaaggctttatccgaattggggattttcggttctcctacatcaccttctacgccattatcgcgatcatttttatgtgggtactgtggaataaaaccgtgttcggcaaaaacatttttgcggttggtggaaacccagaagcggcgaaagtgtcgggtgttaacgtgcctttgactctgcttaaagtgtatgcgctttccggtgtgttctatgcgtttggcggtatgctcgaagcgggacgaattggtagtgctaccaacaacttaggcttcttatatgagttggatgcgattgcggcgtgtgtggtgggcggtgtctcattcgctggcggggtggggagtatcgctggggtcgtaaccggggtactgatcttcacagtaatcaactacggtatgacctacatcggcgttagcccatactggcagtacatcattaaaggctcgatcatcatcttcgctgtagcgctggattcaatgaaatacgccaataagaagtaa

SEQ ID NO: 40298 - protein, 337 aa, Vibrio cholerae O1 biovar eltor str. N16961
MTMDAVKSFAIKHLKEGAIYAVLFILLAIIVIQEPSFLSLRNLSNILTQSSVRVIIALGVAGLIVTQGTDLSAGRQVGLAAVISATLLQSMDNVNKVFPSLGEIPILAVIISVCLIGAIIGLVNGVIVAYLKVTPFIATLGTMIIVYGINSLYYDSVGASPIAGFDERFTTFTQGFIRIGDFRFSYITFYAIIAIIFMWVLWNKTVFGKNIFAVGGNPEAAKVSGVNVPLTLLKVYALSGVFYAFGGMLEAGRIGSATNNLGFLYELDAIAACVVGGVSFAGGVGSIAGVVTGVLIFTVINYGMTYIGVSPYWQYIIKGSIIIFAVALDSMKYANKK

SEQ ID NO: 40299 - DNA, 999 bp, Vibrio cholerae O1 biovar eltor str. N16961
  CDS (1)..(999): transl_table=11
atgaaacaaggatacagcatgagtacccgaaccatgactaatacgacatctgataaccgtaaaaaactgctcagcaaagagtggttgattgaacaaaaatcgctgatcgcactgctgtttttagtggttgtcgtctctttcttaaacccgaattttttcacggttgataacttactgaatattctgcgccaaacttcggtcaacgcgatcatcgcggtgggtatgaccttggtcatcttaaccgcagggattgatttgagcgttggctcagtattagcactgtgtggcgcttttgcggccaccttagtggcgatggaagttcctgttctggtagctgtgcctacggctttgctggctggtgctgcgcttggcgcaatcagcggcatcatcattgccaaaggcaaagtgcaggcctttatcgcgacgttagtgacgatgactctgctgcgcggtgtcactatggtgtacaccgatgggcgtccgatttcgaccggattcactgatacggcggacacctttgcatggtttggtacaggctacacattgggcattccggttccggtatggctgatggtcgtggtatttgccggcgcttggtacttgctcaatcacactcgctttggccgctatgtgtatgcagtgggcggcaacgaatcagcaactcgcctttcaggtatcaacgtagatcgcgtcaaaatcggcgtgtatgccatctgtggtttactggctgcgctagcaggcatcatcgtcacatctcgcctttcttctgcgcaacctactgcgggtatgggctatgagttggatgcgattgcggctgtggtgctagggggcaccagtttgatgggcggtaaaggtcgcatcatgggcacgctgatcggcgctctcatcatcggatttttaaacaacgcattgaacttgctcgatgtttcctcctactaccaaatgattgcgaaagctgtggttattttgctggcggtcttggtagacaacaaaaaataa

SEQ ID NO: 40300 - protein, 332 aa, Vibrio cholerae O1 biovar eltor str. N16961
MKQGYSMSTRTMTNTTSDNRKKLLSKEWLIEQKSLIALLFLVVVVSFLNPNFFTVDNLLNILRQTSVNAIIAVGMTLVILTAGIDLSVGSVLALCGAFAATLVAMEVPVLVAVPTALLAGAALGAISGIIIAKGKVQAFIATLVTMTLLRGVTMVYTDGRPISTGFTDTADTFAWFGTGYTLGIPVPVWLMVVVFAGAWYLLNHTRFGRYVYAVGGNESATRLSGINVDRVKIGVYAICGLLAALAGIIVTSRLSSAQPTAGMGYELDAIAAVVLGGTSLMGGKGRIMGTLIGALIIGFLNNALNLLDVSSYYQMIAKAVVILLAVLVDNKK

SEQ ID NO: 40301 - DNA, 1167 bp, Bacillus halodurans C-125
  CDS (1)..(1167): transl_table=11
atgaagttagctgaacttttaaaaaataatatgcgttcctatgggatgatcgtcgcgcttatgtttatcattttgttattcagcgtgttgtccgacggaattttgttacgtccactaaatgtaacaaatttaattttgcaaaacagttatattttagttcttgcgatcggtatggtgatggtgattattgcggggcatatcgatttgtccgttggttccgtctgtgcttttgttggggcaattgcggccattttaatgattgatatgcagcttcctacagctcttgctgtactaatctgcttattgctaggtgctcttatcggtgcatggcacggattttttattgcttacttaaaaatgccgtcttttatcgtcacattggccggcatgcttctatttagagggctgacgatggtcgtgttaggcggtcaatcaaagtccccctatccacctgaatttatcttgattagttcaggcttcctacctgatatcccttttttaggattggcctcttatcatacattaacgatgttgatcggtgtggtgctttctctgtttgttatctttagcgagcttaaagaacgacgagtccagataaacaatcaatttatggtacttcccaaagggttttttatcgcaaaattgatcgggatggtagcgattattaacatttttacgtttgtcttagcttcttatagagggattccaaatattcttgtgattctttttgtgcttattgttctcttttcgtttgtcatgaataaaacggtgatcggacgccacatttatgcaacaggaggaaatcaaaaagccgcagagttatccggtgtcaagacgaagcgagtgacgttttgggtttttgttaacatgggttttttatcggccatggcaggattaatttacgccgcccgcctaaactcagcaaccccgagagccggtacgatgtttgagcttgatgcgattgccgctgcttttatcggtggagcttcaatggccggaggagtcgggacgattgtcggtgctgttgttggggggctcgtaatgggggttatgaacaacggaatgtcattacttgggattagtatagactggcaacaagccattaaaggactcgttctgctagccgcggtcggttttgacatttataatcgaaacaaagcaaaatga

SEQ ID NO: 40302 - protein, 388 aa, Bacillus halodurans C-125
MKLAELLKNNMRSYGMIVALMFIILLFSVLSDGILLRPLNVTNLILQNSYILVLAIGMVMVIIAGHIDLSVGSVCAFVGAIAAILMIDMQLPTALAVLICLLLGALIGAWHGFFIAYLKMPSFIVTLAGMLLFRGLTMVVLGGQSKSPYPPEFILISSGFLPDIPFLGLASYHTLTMLIGVVLSLFVIFSELKERRVQINNQFMVLPKGFFIAKLIGMVAIINIFTFVLASYRGIPNILVILFVLIVLFSFVMNKTVIGRHIYATGGNQKAAELSGVKTKRVTFWVFVNMGFLSAMAGLIYAARLNSATPRAGTMFELDAIAAAFIGGASMAGGVGTIVGAVVGGLVMGVMNNGMSLLGISIDWQQAIKGLVLLAAVGFDIYNRNKAK

SEQ ID NO: 40303 - DNA, 945 bp, Bacillus halodurans C-125
  CDS (1)..(945): transl_table=11
atgtccgacaataaacaaataaagtcgctgcttactactattggaccgtttataggattgttttttatcgttttgatcattagtttcttaaaccctgatttcctctcattatcaaatattatgaacgtcttacggcaagtgtcgatcaacgccttaattgccttcgggatgacctttgttattttaacaggcgggattgatttatccgttggggccattctcgctctgtccagtgctgtcacagcatggttaatggtcaacagcgtcgatccgatcttagccgttctgatcggtctattggccggtactctctttggtgcgattaacggattggtgatttccaaagggaaggtagccccttttattgccacattggcgacgatgacgatttatcgaggactcacactcgtgtttaccgatggtcgtccgatttcaggatttgagtcgtcgacgatgtttgaaatgctcggcagaggatatttcttcggaattccggttcctgccgtgacaatgatcattagcttcatcattctttacctcattttaaagaaaacgacgttcggtcgtcgcgtgtatgctgttggtggtaaccaagaagcggcgatcttatcagggattaaagtagaccgaatcaaaatttatgtctactcattaaccggttttttatcggcccttgccggtatgattttaacctcccgtttatattcggctcagcctactgctggaagcatgtatgagcttgatgcgattgctgccgttgtccttggtgggacgagcttaacgggaggccgaggttggatcgtcggtaccttaatcggtgccttgatcataggagtcctaaacaatggactgaacttgttgggcgtaagctcatttttccagcaagttgtcaaagggagtgtcattttactcgcggtcttattggatcgtagaaaatcagcgtaa

SEQ ID NO: 40304 - protein, 314 aa, Bacillus halodurans C-125
MSDNKQIKSLLTTIGPFIGLFFIVLIISFLNPDFLSLSNIMNVLRQVSINALIAFGMTFVILTGGIDLSVGAILALSSAVTAWLMVNSVDPILAVLIGLLAGTLFGAINGLVISKGKVAPFIATLATMTIYRGLTLVFTDGRPISGFESSTMFEMLGRGYFFGIPVPAVTMIISFIILYLILKKTTFGRRVYAVGGNQEAAILSGIKVDRIKIYVYSLTGFLSALAGMILTSRLYSAQPTAGSMYELDAIAAVVLGGTSLTGGRGWIVGTLIGALIIGVLNNGLNLLGVSSFFQQVVKGSVILLAVLLDRRKSA

SEQ ID NO: 40305 - DNA, 969 bp, Pasteurella multocida subsp. multocida str. Pm70
  CDS (1)..(969): transl_table=11
atgacaactcaagcaaaaccattccaattcggtaaattcttaattgaacaacgttccatcattgccttactggtgctgattgcgatcgtctcaatgatcaatcctgactttttcagtgtggataatattctcaatattttacgccaaacttcagtcaacgcaattattgccgtcgggatgacatttgtgatcttgattgccgggatcgatctttcggtcggttcggtacttgcattaacgggggctattgccgcctcgatggtcagtactgagttaccaatactgctcgtcattccagtcacactcttgattggtacattactgggcgggatcagcggtgttattgtcgcgaaagggaaagtacaagccttcattgctactctcgtaaccatgaccttattacgtggtgtgaccatggtttataccgatggacgcccaattagtacaggcttttcggaaggtgcggatacgttttcgctgttaggcacgggttatgtattcggtatccctgtcccaatttggattatggcatttgtctttgctgcctcttggtatgtattaaaacatacacgtattgggcgttatatttatgcacttggggggaatgaagccgccacccaattatctggcattaacgtcaataaaattaaaatctttgtttttgccgtcagtggcttcttatctgcccttgccggtctgattgtcacttcacgtttatcctctgctcaaccgactgccggtgtgtcatatgagcttgatgcgattgccgcggttgtagtcggcggaacaagcttaatgggcggaaaaggacgcgtcatgggcactttaattggcgcattgattattggtttcttaaataacgcgctgaatttactggatatttcctcttactatcaaatgattgcaaaagcattagttatcttagtcgcggttttagcggataactatttaggcaccaaaaaagtttaa

SEQ ID NO: 40306 - protein, 322 aa, Pasteurella multocida subsp. multocida str. Pm70
MTTQAKPFQFGKFLIEQRSIIALLVLIAIVSMINPDFFSVDNILNILRQTSVNAIIAVGMTFVILIAGIDLSVGSVLALTGAIAASMVSTELPILLVIPVTLLIGTLLGGISGVIVAKGKVQAFIATLVTMTLLRGVTMVYTDGRPISTGFSEGADTFSLLGTGYVFGIPVPIWIMAFVFAASWYVLKHTRIGRYIYALGGNEAATQLSGINVNKIKIFVFAVSGFLSALAGLIVTSRLSSAQPTAGVSYELDAIAAVVVGGTSLMGGKGRVMGTLIGALIIGFLNNALNLLDISSYYQMIAKALVILVAVLADNYLGTKKV

SEQ ID NO: 40307 - DNA, 1011 bp, Pasteurella multocida subsp. multocida str. Pm70
  CDS (1)..(1011): transl_table=11
atggctgcattaaaacaaaataaatcccttgatttctttaaacaaaatgcaatctactttgtattattaattttactcgggatcatcattgttcaagacccaacattcttgaacttacgaaacttcagtaacattttaacgcaatcttccgtacgcttaatcatcgcgctgggtgtagccggcttacttgtcacacaagggacagacttatctgccggtcgccaagtcggtttagcggcggttatttcagcgaccttgttacaagccatggacaactttaaccgcgttttcccggatttacctgagctcccaattccggttgtaattttaactgtttgtgcgattggtgcagtcatcggtttagtaaatggtttagttattgcttacttaaacgtaacaccatttattgccaccatggggaccatgattatcgtttatgggattaactcactttactatgatgcggtaggaggatcgccaattgcaggctttaacgaaaccttctcaacgtttgcacaaggtttctttaaattcggttccttcaaactgtcctatatcacgatttatgctgctgttgcgaccttcttagtgtgggtattgtggaataaaacgcgctttggtaaaaatatctttgctatcggtggtaacccagaagcggctcgtgtatctggcgttaacgtcgcacgtaacttagtggttatctatatgatcgcggggatgttctacggttttggtgggatgttagaagccggtcgtatcggttctgccactaataacttaggtttcatgtatgaattagatgcgattgctgcctgtgtagtagggggcgtctcattcgccggtggtgtgggtacggttattggtgtggtaactggggtaattatctttaccgtcatcaactacggcttaacctatatcggtgttaacccatattggcaatatatcatcaaaggtagcatcatcattcttgcggtggctatcgactcactcaaatacgcgaagaaaaaataa

SEQ ID NO: 40308 - protein, 336 aa, Pasteurella multocida subsp. multocida str. Pm70
MAALKQNKSLDFFKQNAIYFVLLILLGIIIVQDPTFLNLRNFSNILTQSSVRLIIALGVAGLLVTQGTDLSAGRQVGLAAVISATLLQAMDNFNRVFPDLPELPIPVVILTVCAIGAVIGLVNGLVIAYLNVTPFIATMGTMIIVYGINSLYYDAVGGSPIAGFNETFSTFAQGFFKFGSFKLSYITIYAAVATFLVWVLWNKTRFGKNIFAIGGNPEAARVSGVNVARNLVVIYMIAGMFYGFGGMLEAGRIGSATNNLGFMYELDAIAACVVGGVSFAGGVGTVIGVVTGVIIFTVINYGLTYIGVNPYWQYIIKGSIIILAVAIDSLKYAKKK

SEQ ID NO: 40309 - DNA, 993 bp, Pasteurella multocida subsp. multocida str. Pm70
  CDS (1)..(993): transl_table=11
atgtggaaatttatacaagataaccgtgaattaaccattgtctttgcgatcggattgctgtttaccttactcagtcttggaggcagcggctttcatttacaaacgttggcaatgatttttaactcggcacaaattgtgattttgctggcgattggtgccacgtttgtcattttgacacgcaatattgatgtgtcggtgggttcaacgatgggcttatgtgccgtcattgctggtagtttacttaatgccggatttggtgcgagcgcttttgtgattactctatgttgtgggctgttggctggtttatttaatggcattttagtcacactactacgtatccctgccattgtggcgaccttaggaacacttggcttgtataaaggtattatgttgctaattacaggtggtaaatggattgagggcttaccacaggatttaaaaaccttgtctgcgccagcatttttgcacatttcgccgatcggttggctacttttaggcttgattggcttaacgtatttctttttaaccaaaatgaaagcagggcgtgacttttacgcggtgggtgacaatttgcaaggggcattacaactgggagtgcgcgtgaatcaagttcgcatcgctgcatttgcgattaacggtacgatggcggcattagccggtattgtgtttgcctcacaaatcggctttgtgcctaactcaacggggaatggattagaaatgaaagcgattgccgcttgtgtattaggtgggattagcttacttggtggggcggggaacattattggtgctgttttaggtgcctatttcctgatccaaattgactctattttggtgttgttaaaagtgcctgcttattggaataactttgtagcaggtttagtgctcttagcggtcttggtgtttgatggacgtattcgcgtgatgattaacaataatattaaacttcagcgttatgcccgtttcttaaaagacgatcaagatgcggtgaaataa

SEQ ID NO: 40310 - protein, 330 aa, Pasteurella multocida subsp. multocida str. Pm70
MWKFIQDNRELTIVFAIGLLFTLLSLGGSGFHLQTLAMIFNSAQIVILLAIGATFVILTRNIDVSVGSTMGLCAVIAGSLLNAGFGASAFVITLCCGLLAGLFNGILVTLLRIPAIVATLGTLGLYKGIMLLITGGKWIEGLPQDLKTLSAPAFLHISPIGWLLLGLIGLTYFFLTKMKAGRDFYAVGDNLQGALQLGVRVNQVRIAAFAINGTMAALAGIVFASQIGFVPNSTGNGLEMKAIAACVLGGISLLGGAGNIIGAVLGAYFLIQIDSILVLLKVPAYWNNFVAGLVLLAVLVFDGRIRVMINNNIKLQRYARFLKDDQDAVK

SEQ ID NO: 40311 - DNA, 1044 bp, Pasteurella multocida subsp. multocida str. Pm70
  CDS (1)..(1044): transl_table=11
atgaataggtattgtatgacaaatttaagaaaaattttctcaaaattaggcatcggtatcattttactgttaatgattattggtatgtcgttaagttccgatgtgtttttgtccacgaataatattatcaatatcttattacaggtttcgattatttgtgtcatttctgtgggtatgacctatgtcattttaaccggtggcattgatctgtcagttggctctattgtcgcactcagtgccgtttgtttaggggtttttacacattggggaatggattggttaggtgaaaatccttccagcttttctgtcttaatgattgtcattagcgcgattatcgcaacaatttttgttggtatcctttgtggttatgttaatggattagtgattgtgtatggtaaagtgacgccctttatcacaacattgggtatgatggggattgcgagaggacttgcgttaaccatttcagatggcaaaactatctataattttccagatacattgcgttttttaggaaatgggcgtattgcactgacggaaacatttgcgctcccggtacccgttattattgcgttacttgtcgtgttagtgagtttttacgtgctaacacaaacgatgtttggtcgacagatttatgcgttaggcggaaaccgtgaagcagttcgattgtccggtattaatattgagaaacttgaaattaaagcttatgtgattaatggcgcattagcggcaattggtgccatcattttagttggacgtttaaatgcggcacagcctatcgctggaaacggttatgaattagatgctatcgctgcaaccgtgataggcgggacaagtttgatgggcggcgtgggatcggtggtcagtacttctattggggcgcttattatgggggtgttacaaaatgggctgacgttattgaacgtcacctcgtatttgcagcgcttgattattggtttagtgattattttagcggtatttttagatcaattacgtcgtggcgaagtatcaacacgccgtttgaaacggttattttttagagaataa

SEQ ID NO: 40312 - protein, 347 aa, Pasteurella multocida subsp. multocida str. Pm70
MNRYCMTNLRKIFSKLGIGIILLLMIIGMSLSSDVFLSTNNIINILLQVSIICVISVGMTYVILTGGIDLSVGSIVALSAVCLGVFTHWGMDWLGENPSSFSVLMIVISAIIATIFVGILCGYVNGLVIVYGKVTPFITTLGMMGIARGLALTISDGKTIYNFPDTLRFLGNGRIALTETFALPVPVIIALLVVLVSFYVLTQTMFGRQIYALGGNREAVRLSGINIEKLEIKAYVINGALAAIGAIILVGRLNAAQPIAGNGYELDAIAATVIGGTSLMGGVGSVVSTSIGALIMGVLQNGLTLLNVTSYLQRLIIGLVIILAVFLDQLRRGEVSTRRLKRLFFRE

SEQ ID NO: 40313 - DNA, 972 bp, Pasteurella multocida subsp. multocida str. Pm70
  CDS (1)..(972): transl_table=11
atgggaacaacacaaccggttaaaccgggttttaaaaaactggcaattgcagatgcgatgcaggcaatggggattttacccatcttgattttaattgtgatcgtgttttcttttgtggcaccaaactttatgacagaagctaatatgatgaatattactcgtcaagcatcaattaatattgtgttagccgcagggatgacatttgtgattttaacgggcgggattgacctttcagttggttcgattttaggggtgacggcggtgattggactggttacctcgctcaatcccgcattggcagaatttgcggtcccgttagcgttactcgcgggtttaggtatgggggtatttaatggtttattggttgcgtatgcaggtctacctccatttattgtcacgctaggtacatatactgcattacgtggcgcagcctatttagtagcagatgggacaacggtgatcaactctaaaatctcattcagttggataggaaatggttatcttggctcggtaccttggctagtgattatcgcctttgccgtgattgccgtgtgctggtttattttacgtcgcacgacgttaggcacccatatttatgcggtcgggggtaacttgcaagccgcacgtttaacaggtatcaaagtctctttagtcttaatcttcgtttacgctgccagcggattattatctggcttaggcggcgtaatgagtgcatctcgtttgtatagcgccaatggtaatcttggtgtaggctatgaacttgatgcaattgcagccgttattttaggtggcacgagtttcgtgggcggtatcggaaccattacggggacgctcatcggtgcattaattattgcgactttaaataatggtatgactttaatgggagtgtcatatttctggcagctcgttattaaaggtggggtaatcatcgtggcagtattgatcgacaagtaccgtacccgttcagcttaa

SEQ ID NO: 40314 - protein, 323 aa, Pasteurella multocida subsp. multocida str. Pm70
MGTTQPVKPGFKKLAIADAMQAMGILPILILIVIVFSFVAPNFMTEANMMNITRQASINIVLAAGMTFVILTGGIDLSVGSILGVTAVIGLVTSLNPALAEFAVPLALLAGLGMGVFNGLLVAYAGLPPFIVTLGTYTALRGAAYLVADGTTVINSKISFSWIGNGYLGSVPWLVIIAFAVIAVCWFILRRTTLGTHIYAVGGNLQAARLTGIKVSLVLIFVYAASGLLSGLGGVMSASRLYSANGNLGVGYELDAIAAVILGGTSFVGGIGTITGTLIGALIIATLNNGMTLMGVSYFWQLVIKGGVIIVAVLIDKYRTRSA

SEQ ID NO: 40315 - DNA, 999 bp, Pseudomonas aeruginosa PAO1
  CDS (1)..(999): transl_table=11
atgagcgacccgacgtcttccgctaccgccgccgcagcgccaaccctgcgacgcggcaactatttcggcctgggcacctacctcggcctggccggcgcgctgctggcgatgatcgcgctgttctcggcgctgagcagccacttcctcagctatggcaccttcctcgccatcgccaaccagatccccgacctggtggtgctggcggtgggcatgaccttcattctgatcgtcggcggcatcgatctctcggtaggttcggtgctggccctggcggcctcggcggtaagcctggcgacgctcggctggggctggggcgtgctgccggcggcgatgctcgggatggcctgcgcgaccctggccggctgcgtcaccggttcgatcacggtggcctggcggattccctcgttcatcgtgtccctcggggtgctggagatggcccgtgggctggcctaccagatgaccgactcgcgcacggcctatatcggcgacgcctatgcctggctgtccaatccgctggcgttcggcatttcgccggccttcgtgatcgccctgctggtgatgttcgccgcccaggcggtgctcacccgcacggtgttcggccgctacctgatcggcatcggcaccaacgaagaagcggtgcgattggccggtgtgaacccgaaaccctataagattgcagtattcgccctgatggggctgctcgccgggttggccgcgctgttccagatctcgcgtctggaagcggccgatcccaacgccggggtcggcctggaactccaggtcatcgccgcggtggtgatcggcggcaccagcctgatgggcgggcgaggttcggtggtcagcaccttcttcggcgtgctgatcatttccgtattggcggcggggctggcgcagatcggtgcgtcggagccgaccaaacgaatcattaccggggcggtgatcgtggtagcggtggtgctggatacctatcgcagccatcgcgcccgcagacagggctga

SEQ ID NO: 40316 - protein, 332 aa, Pseudomonas aeruginosa PAO1
MSDPTSSATAAAAPTLRRGNYFGLGTYLGLAGALLAMIALFSALSSHFLSYGTFLAIANQIPDLVVLAVGMTFILIVGGIDLSVGSVLALAASAVSLATLGWGWGVLPAAMLGMACATLAGCVTGSITVAWRIPSFIVSLGVLEMARGLAYQMTDSRTAYIGDAYAWLSNPLAFGISPAFVIALLVMFAAQAVLTRTVFGRYLIGIGTNEEAVRLAGVNPKPYKIAVFALMGLLAGLAALFQISRLEAADPNAGVGLELQVIAAVVIGGTSLMGGRGSVVSTFFGVLIISVLAAGLAQIGASEPTKRIITGAVIVVAVVLDTYRSHRARRQG

SEQ ID NO: 40317 - DNA, 942 bp, Lactococcus lactis subsp. lactis Il1403
  CDS (1)..(942): transl_table=11
gtgaaagctctatctcaaaaattcagttctttaacgacaatgattgctctgattgttttgatgattatcattacatgtatcaatcccaactttatgacggcaaataatttgctaaatttactcttacaagtcacggctaatggatttattgcctttgggatgaccttcgtaattctaacttcaggaattgacctgtcagttggcgcaattttagccctttcaagtgcagtgtccgcaggttttatagcccaaggaatgcctttaccgctagcagtagtctgtgcgttaatcattggtgcttttcttggagcgatcaatggtgcacttattgcctatgggaaattggcccctttcattgtaactttagctactcaaatggtttaccgcggagcaacccttgtttttactgatggtaatccaattactaaacacatggatggctatttcttagcctatattggacaaggttatttactgggtattcctttccctgttattttaatgattcttgttttcattgttttatggattttacttcataaaacagcctttggtaaatcagtttatgctttgggtggtaatgaaaaagctgcttatatttcaggaattaaactaaataaagtaaaaattgccatttacactttatctggagcaatgtccgcaatttctggtttaatcatcagttctcgtttgtcatcagcaacgccacaagcaggttctggctacgaaatgtatgcaatcgctgccgttgtccttgggggaacctctctaatgggaggaaaagggcgtatgtttggaactatgattggggtattaatcattggtgttctaaataatggtttaaatataattggtgtgtcagccttttggcaacaagtcatccaaggattagttattctcgttgcagttcttatcgatgtcattcgtagcaaacggaaatag

SEQ ID NO: 40318 - protein, 313 aa, Lactococcus lactis subsp. lactis Il1403
MKALSQKFSSLTTMIALIVLMIIITCINPNFMTANNLLNLLLQVTANGFIAFGMTFVILTSGIDLSVGAILALSSAVSAGFIAQGMPLPLAVVCALIIGAFLGAINGALIAYGKLAPFIVTLATQMVYRGATLVFTDGNPITKHMDGYFLAYIGQGYLLGIPFPVILMILVFIVLWILLHKTAFGKSVYALGGNEKAAYISGIKLNKVKIAIYTLSGAMSAISGLIISSRLSSATPQAGSGYEMYAIAAVVLGGTSLMGGKGRMFGTMIGVLIIGVLNNGLNIIGVSAFWQQVIQGLVILVAVLIDVIRSKRK

SEQ ID NO: 40319 - DNA, 1011 bp, Escherichia coli O157:H7 EDL933
  CDS (1)..(1011): n means a or g or c or t/u, s means g or c
atgagtgcgttaaataagaaaagttttcttacttacctgaaagagggcggtatttacgtcgttcttttagttttgcttgcgattattattttccaggccccaacatttttaagtctgttgaacttaagtaatattctcacccagtcatcggtgcgtattattatcgcgctcggtgtggcagggttaattgtcacccaggggaccgacctttctgcggggcgtcaagtagggctggcggcagtggtggcagcgacattattgcagtccatggataacgccaacaaagtgttcccggaaatggcgacgatgccgattgcgctggttattctgattgtctgtgccattggtgcggtgatcggtttgatcaacggtctgattatcgcttatctcaacgtgacgccgttcattaccacgctcggcacgatgatcatcgtctatggcatcaactcgctttattacgactttgtcggggcgtcgccaatttctggttttgacagtggcttctctacctttgctcagggctttgtcgcgctggggagtttccgtctctcttacatcaccttctacgcgttgattgcggtggcgttcgtctgggtgttgtggaacaaaacccgcttcggtaagaacatttttgccattggcggtaacccggaagcggcaaaagtatctggtgtcaacgtcggcctgaacctgctgatgatctacgcgttgtctggcgtgttctatgcctttggcgggatgttagaagccggacgtatcggctctgccaccaacaacctcggctttatgtatgaactggatgctatcgcggcgtgcgtggtaggcggtgtatcgttcagcggcggtgtggggacggtgattggcgtggtgaccggggtaattatttttaccgtcatcaastatggcctgacgtacatcggcgtaaacccatactggcagtacatcatcaaaggggcgattattatcttcgccgtagcgctggattcactgaagtacgcgcgtaagaagtga

SEQ ID NO: 40320 - protein, 336 aa, Escherichia coli O157:H7 EDL933
  Xaa in position 300 is unknown
MSALNKKSFLTYLKEGGIYVVLLVLLAIIIFQAPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFVALGSFRLSYITFYALIAVAFVWVLWNKTRFGKNIFAIGGNPEAAKVSGVNVGLNLLMIYALSGVFYAFGGMLEAGRIGSATNNLGFMYELDAIAACVVGGVSFSGGVGTVIGVVTGVIIFTVIXYGLTYIGVNPYWQYIIKGAIIIFAVALDSLKYARKK

SEQ ID NO: 40321 - DNA, 966 bp, Escherichia coli O157:H7 EDL933
  CDS (1)..(966): n means a or g or c or t/u, s means g or c
atgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattctccagcaaacctcagtgaacgccattatggcggtcgggatgacgctggtgatcctgacgtcgggcatcgacttgtcggtaggttctctgttggcgctaaccggcgcagttgctgcatctatcgtcggcattgaagtcaatgcgctggtggctgtcgctgccgctctcgcgttaggtgccgcaattggtgcggtaaccggagtgattgtagcgaaaggtcgcgtccaggcgtttatcgctacgctggttatgatgcttttactgcgcggcgtgaccatggtttataccaacggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacscgctgggcggcaacgaagcggcaacgcgtctttctggtatcaacgtcaataaaatcaaaatcatcgtctattctctttgtggtctgctggcatcactggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaa

SEQ ID NO: 40322 - protein, 321 aa, Escherichia coli O157:H7 EDL933
  Xaa in position 201 is unknown
MTTQTVSGRRYFTKAWLMEQKSLIALLVLIAIVSTLSPNFFTINNLFNILQQTSVNAIMAVGMTLVILTSGIDLSVGSLLALTGAVAASIVGIEVNALVAVAAALALGAAIGAVTGVIVAKGRVQAFIATLVMMLLLRGVTMVYTNGSPVNTGFTENADLFGWFGIGRPLGVPTPVWIMGIVFLAAWYMLHHTRLGRYIYXLGGNEAATRLSGINVNKIKIIVYSLCGLLASLAGIIEVARLSSAQPTAGTGYELDAIAAVVLGGTSLAGGKGRIVGTLIGALILGFLNNGLNLLGVSSYYQMIVKAVVILLAVLVDNKKQ

SEQ ID NO: 40323 - DNA, 1809 bp, Mycobacterium leprae TN
  CDS (1)..(1809): transl_table=11
gtggatcacacgacgaagtgtgacgccgaacaatacttccaagcgattgtcacatcaatggccgacggagtcattgtggtagacatcgacggacggattgagtccattaatcccgccgctactcggatattgggcttacgagcccacgatgtcgttgacatgaagcatggccatccattctgcttctacgatacagacaatcagcgggttgatcttgagcgtgaggtcatgcgcgtcgtacgacgcgaagtaacaacggtaagcaaagtcgtcggcattgaccaacacagtggccagcggttatggctatcggtaaacgtgagcctgcttgcgtacaaggctcccccacactctgcactggtagtctcgttttctgacatttctgcccaccacctttcgatcgaacggctcacctacgaggcaacccacgactgtctcaccggtcttgccaatcgcaggtttgcggaagaccagatcaccaaatcactgcagcatgacgaacgctctcgattagctgctgtactgcttcttgacctcgacgatttcaaagtgatcaacgactcactaggccacgacgtaggtgacgcggtgttgcagactgtagcgcagcgactacgctcggctgtgcggcccgacgatgtcgtcgcgcggctgggcggagacgagttcatcgtactactccggggtcccctttcggacatgaatgctaacgacgtcgcaaaaagactgcacacaacactgtccgagtcactcgtggtcgaccagctcacggtgcctatcggagcgagtgttggcatccttgaggtgagacctgacgatcgacggcgggccgccgacattttgcgtgatgccgactccgcgatgtatgcagccaagaacaagaaacaatgtgccgtcacgccgcagcagctggtaccgttcgtcgcgctgatcgcactgtttgtgttttttacagctgcggccggagctaagttctatgcaccatcaaatctgctggtcattctccaacaaaccgtggtgctggcgatcgtcggatacggcatgactttcgttatcatggcaggctccgttgaactatcggtgggctcgatcgtcgcattgactggagtcaccgcggcactcgtggctgcacagaatcaattcgctgcgatcgtcaccgccctgctggtggggttggctgctgggatggtaaacggcatcgtttttgcctacgggaagattccgtcattcgttagcaccctcggcatgcttcaagtctgccgtggtatcaccctgatgatcagcgacagttctgccaaaccgatgccgtttcacggaatactgggtgcaatgggagccatgccgtggatcctcatcgtctgtcttttcgtcacaatcctggcagggatcttattccaattcaccatgtttggtcggtgggtcaaagccatcggtggcaacgaacgtgtcgcaacgttagccggggtacctacccgcgggatcaaagtcgcgatcttcgcgatctgcggactgacagcaggcctcggcggtatcgtgcttgcttcccgcctcggagccgggacacccaccgcagcaacaggtttcgagatcgatgtcatcgccgcagtcgtcatcggcggcacgcccttaaccggcggattgggacgactcagcggaacgctgatcggtgcaataatcatctcgatgctctccaacggcatggtgtttatgggtgttgggaatgccgcctcgcagatcatcaagggaattatgctcgccgctgcggtttttgtcttcctacaacgccgcaagatcggcattatcaaatga

SEQ ID NO: 40324 - protein, 602 aa, Mycobacterium leprae TN
MDHTTKCDAEQYFQAIVTSMADGVIVVDIDGRIESINPAATRILGLRAHDVVDMKHGHPFCFYDTDNQRVDLEREVMRVVRREVTTVSKVVGIDQHSGQRLWLSVNVSLLAYKAPPHSALVVSFSDISAHHLSIERLTYEATHDCLTGLANRRFAEDQITKSLQHDERSRLAAVLLLDLDDFKVINDSLGHDVGDAVLQTVAQRLRSAVRPDDVVARLGGDEFIVLLRGPLSDMNANDVAKRLHTTLSESLVVDQLTVPIGASVGILEVRPDDRRRAADILRDADSAMYAAKNKKQCAVTPQQLVPFVALIALFVFFTAAAGAKFYAPSNLLVILQQTVVLAIVGYGMTFVIMAGSVELSVGSIVALTGVTAALVAAQNQFAAIVTALLVGLAAGMVNGIVFAYGKIPSFVSTLGMLQVCRGITLMISDSSAKPMPFHGILGAMGAMPWILIVCLFVTILAGILFQFTMFGRWVKAIGGNERVATLAGVPTRGIKVAIFAICGLTAGLGGIVLASRLGAGTPTAATGFEIDVIAAVVIGGTPLTGGLGRLSGTLIGAIIISMLSNGMVFMGVGNAASQIIKGIMLAAAVFVFLQRRKIGIIK

SEQ ID NO: 40325 - DNA, 1029 bp, Escherichia coli O157:H7
  CDS (1)..(1029): transl_table=11
atgctgaagtttattcagaacaaccgtgaaatcacggcactgctggcggtgctgctgctgtttgtattacccggttttctcgaccgccagtatttaagtgtgcaaacgctgaccatggtttatagcagcgcgcaaatcctgatcctgctggcaatgggcgcgacgctggtaatgcttacgcgcaatattgatgtttcagtgggttcgattaccggaatgtgcgcggtgctgttggggatgttactgaacgcaggatattcactacctgttgcctgtgtcgcgactttactgcttggtttgctcgcgggatttttcaacggtgtcctggtcgcgtggctaaagatccctgccattgttgccacccttggcacgttagggttgtacagaggcatcatgttgctgtggactggcggtaaatggattgaagggttacccgccgaactgaaacagctctccgccccgctgctgcttggcgtttcagcaattggttggttaacgataattctggtggcatttatggcctggctgctggcgaagacagcgtttggacgcagtttttatgccacgggcgataatttacagggcgctcgtcaactgggcgttcgtacggaagccattcgcattgtggcattttcgttgaacggctgcatggcggcactggcgggaattgtgtttgcttcgcagattggttttatccccaaccagaccggtaccgggctggagatgaaagcaattgcagcctgcgtgctgggcggcattagtttgctcggcggttccggtgcgatcatcggtgcggtactcggcgcatggttcctgacgcagatcgatagcgtactggtgctgttgcgcattccggcatggtggaatgattttatcgcgggtctggttctgctggcggtgctggtgtttgatggacgcctgcgttgtgcgctggaacttaatctgcggcggcaaaaatatgcccgctttatgacgccaccgccatccgttaaacccgcttcgtcaggtaaaaaacgggaggctgcataa

SEQ ID NO: 40326 - protein, 342 aa, Escherichia coli O157:H7
MLKFIQNNREITALLAVLLLFVLPGFLDRQYLSVQTLTMVYSSAQILILLAMGATLVMLTRNIDVSVGSITGMCAVLLGMLLNAGYSLPVACVATLLLGLLAGFFNGVLVAWLKIPAIVATLGTLGLYRGIMLLWTGGKWIEGLPAELKQLSAPLLLGVSAIGWLTIILVAFMAWLLAKTAFGRSFYATGDNLQGARQLGVRTEAIRIVAFSLNGCMAALAGIVFASQIGFIPNQTGTGLEMKAIAACVLGGISLLGGSGAIIGAVLGAWFLTQIDSVLVLLRIPAWWNDFIAGLVLLAVLVFDGRLRCALELNLRRQKYARFMTPPPSVKPASSGKKREAA

SEQ ID NO: 40327 - DNA, 1011 bp, Escherichia coli O157:H7
  CDS (1)..(1011): transl_table=11
atgagtgcgttaaataagaaaagttttcttacttacctgaaagagggcggtatttacgtcgttcttttagttttgcttgcgattattattttccaggccccaacatttttaagtctgttgaacttaagtaatattctcacccagtcatcggtgcgtattattatcgcgctcggtgtggcagggttaattgtcacccaggggaccgacctttctgcggggcgtcaagtagggctggcggcagtggtggcagcgacattattgcagtccatggataacgccaacaaagtgttcccggaaatggcgacgatgccgattgcgctggttattctgattgtctgtgccattggtgcggtgatcggtttgatcaacggtctgattatcgcttatctcaacgtgacgccgttcattaccacgctcggcacgatgatcatcgtctatggcatcaactcgctttattacgactttgtcggggcgtcgccaatttctggttttgacagtggcttctctacctttgctcagggctttgtcgcgctggggagtttccgtctctcttacatcaccttctacgcgttgattgcggtggcgttcgtctgggtgttgtggaacaaaacccgcttcggtaagaacatttttgccattggcggtaacccggaagcggcaaaagtatctggtgtcaacgtcggcctgaacctgctgatgatctacgcgttgtctggcgtgttctatgcctttggcgggatgttagaagccggacgtatcggctctgccaccaacaacctcggctttatgtatgaactggatgctatcgcggcgtgcgtggtaggcggtgtatcgttcagcggcggtgtggggacggtgattggcgtggtgaccggggtaattatttttaccgtcatcaactatggcctgacgtacatcggcgtaaacccatactggcagtacatcatcaaaggggcgattattatcttcgccgtagcgctggattcactgaagtacgcgcgtaagaagtga

SEQ ID NO: 40328 - protein, 336 aa, Escherichia coli O157:H7
MSALNKKSFLTYLKEGGIYVVLLVLLAIIIFQAPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFVALGSFRLSYITFYALIAVAFVWVLWNKTRFGKNIFAIGGNPEAAKVSGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 40329 - DNA, 999 bp, Escherichia coli O157:H7
  CDS (1)..(999): transl_table=11
atgtctgcttcgtcattaccattgccgcagggcaagagcgtctcgctcaaacaatttgtcagtcaccatattaatgagatcggtttgctggtggtgattgccattctttatctggtcttctccctgaacgcgcctggctttatctcattgaataaccagatgaacgtgctgcgcgatgccgccaccattgggattgccgcctgggcgatgacgctgattattatctccggtgaaattgatgtcagcgttgggccgatggtggcttttgtctcggtatgcctggcatttttgctgcaatttgaagttccgttggcgattgcttgtctgctggtgttgctgttaggcgcgctgatgggaacgctcgccggggtgctgcgtggcgtgtttaacgtgccaagtttcgtggccacgctggggctgtggagcgccctgcgcggaatgggcttgtttatgaccaacgctctgccagtgccgattgacgaaaacgaggtgctggactggctgggcggacaatttctcggtgtgccggtatccgcgctgatcatgatggtgctgtttgcgctgtttgtgttcattagccgcaaaaccgccttcgggcgctcggtttttgccgttggcggtaatgccacggcggcgcagttgtgcggtattaacgttcgtcgggtacgcattcttatctttaccctttcgggattattagcggcggtgaccggcattttgttggcggcgcgcctcggttccggtaacgcaggtgccgcaaacggtctggagtttgacgtcatcgccgcggtcgtggtcggcggtacggcgctttccggtggtcgcggctcgttgttcggtacgctgcttggcgtactggtgattacgctaatcggtaacggtctggtgctgctcgggattaactcctttttccagcaggtggtgcgcggcgtcatcatcgtggtggcggtgctggcgaatatcttgctgacccagcgtagcagtaaagcgaaacgctaa

SEQ ID NO: 40330 - protein, 332 aa, Escherichia coli O157:H7
MSASSLPLPQGKSVSLKQFVSHHINEIGLLVVIAILYLVFSLNAPGFISLNNQMNVLRDAATIGIAAWAMTLIIISGEIDVSVGPMVAFVSVCLAFLLQFEVPLAIACLLVLLLGALMGTLAGVLRGVFNVPSFVATLGLWSALRGMGLFMTNALPVPIDENEVLDWLGGQFLGVPVSALIMMVLFALFVFISRKTAFGRSVFAVGGNATAAQLCGINVRRVRILIFTLSGLLAAVTGILLAARLGSGNAGAANGLEFDVIAAVVVGGTALSGGRGSLFGTLLGVLVITLIGNGLVLLGINSFFQQVVRGVIIVVAVLANILLTQRSSKAKR

SEQ ID NO: 40331 - DNA, 975 bp, Escherichia coli O157:H7
  CDS (1)..(975): transl_table=11
atgacgacctctgcaaaaacctctgccaaaaaaatgctgatgagcgatctgatgcaaacggtcggcatcttgcccattttgattctgatcgtggcggtatttggctttatcacgccaaacttttttaccgaaagcaacctgctgaatattacccgccaggcatcgatcaacattgttctggcggcggggatgaccttcatcattttgaccggcgggatcgatctttccgtgggttcgatcctcggcaccacagcggtggcggcgatggtcgtctcccttagccctgagttcgccatgctgtcgatcccggcagcgctgatgctcggcctgctgctggggctgttcaacggcgcgctggtggcctttgccggattgccaccgtttatcgttacgcttggcacctatacggcgctgcgcggggcggcgtatctgctggcggacggcaccacggttatcaactccaacattaatttcgagtggataggcaacaactatctcgggccggtcccatggctggtggtgattgcgctggcggtgatcgtggtgtgctggtttattctgcgccgcaccacgcttggcgttcatatctacgccgtcggcggcaatatgcaggcggcgcgtcttaccggcattaaggtctggctggtgctgctgtttgtttatggcatgagcggcctgctttctgggcttggtgggattatgagcgcctcacggctgtacagcgccaacggcaacttaggcatgggttacgaactggatgccattgcagcggtgatcctcggcggcaccagttttgtcggcggcatcggcaccatcaccggcacgctggtcggcgcgctaattatcgccacgctcaacaatggcatgaccttaatgggcgtctcttacttctggcaactggtgatcaaaggggcgatgatcatcattgcggtgctgatcgacaaataccgtacccgacaccatcaaagtgcataa

SEQ ID NO: 40332 - protein, 324 aa, Escherichia coli O157:H7
MTTSAKTSAKKMLMSDLMQTVGILPILILIVAVFGFITPNFFTESNLLNITRQASINIVLAAGMTFIILTGGIDLSVGSILGTTAVAAMVVSLSPEFAMLSIPAALMLGLLLGLFNGALVAFAGLPPFIVTLGTYTALRGAAYLLADGTTVINSNINFEWIGNNYLGPVPWLVVIALAVIVVCWFILRRTTLGVHIYAVGGNMQAARLTGIKVWLVLLFVYGMSGLLSGLGGIMSASRLYSANGNLGMGYELDAIAAVILGGTSFVGGIGTITGTLVGALIIATLNNGMTLMGVSYFWQLVIKGAMIIIAVLIDKYRTRHHQSA

SEQ ID NO: 40333 - DNA, 1917 bp, Mycoplasma pulmonis UAB CTIP
  CDS (1)..(1917): transl_table=4
ttgccattggaacaaaacaaaatgaaaggagtcaagcaaatgtccaataactatagtcaaagtgaaattcaaaaaattaatgaacttaggaaaataaaccttgaaaaacgcaaagttcgtgatcaaaaagaaaaagctaagttagattctaaaaacaaaaaaaacgaagcaaaatttcaaaaattaaaaacaaattttgactcttttgctaagtcaaaaaatcaaagactaaacaaagtagttaaatctattgaaactaaatttgatcaaaaaattagcactttaaaacaaagtctttcaacaactaaaacaaatgaacaagagctaaaagactcaaaagctctttataacaaaaagaaaaaatactacgaaagtagaattgcaaaaaatgaagctaaatatgaaaatttaatcaaaaagcttcaatataaaattgacacttatgcccttgataaacaagaaggtcaacaaaaaattgatcagctttatcttgatcttggccaaataaacaaaagatggtcattaaaaatagcttctttaaatatcgaagatacaaaaatcaaacttgaaaagcaaattaaaaaactagaagaaaaaaaacaacttcaaattaaaacaattgaaaaaagaagagaagtttcacccggatcttcttttgtttcgaatctaagaaacagaatagcagatgaaaaatctcgttacattggaaattattcaattgactatattttcaaaaaaatatcagccaacattagaaaatactcaatgttctacattttggcccttattcttttgatctttggatctttaactaaattccaaaatataactccttctaatattgaagttatctttagaaataatacatatgttctaatcattggaatgggaatgctccttgtaattgttggtggaaacattgacctttctgttggccagctccttagtttactcggggccatatcggttattatttataatggagtaagtagaacattttcaaataatagctctcttggtggactttatttaattattaccttaattggtactgcatttataggtgctttaattggtatttctcaaggatttttaattggatatttcaaaataccttcatttatcgttactttagggggaatgttaatttttaaagggctagctctttttgcagttcctctaaacaacataacccctgaaggaggatcccaatcagcttatgttagggctattattagaacaatctttgatgttcaagttggtggtttttacattatttcatttttaatttttattgtctcacttgctttaatagttctttttctagtttatggtagaaacaagaaaataaaatttggtttactagttgactctggttttgtattttgactaaaaatagttgttatatcagtgtttatgattttactaggttatgcttttggaaaaattggagttaaatgatacttgctttacattatgatcttgcttgttatctttgtatttttaactcaaaacacagtttttggaagaaaagtttatgccattggtggtaataaaaaatcagcagagctctcaggtatcgatgttagaaaaactactactttaatctttatgattaatggaataatggttgcaattgcctcaataatctttactggtattgtaacttcagctacagctaccgctggtgaaggatttgaattagacgttatttcatctgtctttgttggtggagcttctatggctggaggaataggaacaactattggaactctaattggtggatttatccttggatttattaacaatggaatcttgcttttagcccttaatgttggaactcaacgtgttgttaaaggtgttgttcttgtcttagctgttgcctatgatatttatgcaaacagaaaaattagttaa

SEQ ID NO: 40334 - protein, 638 aa, Mycoplasma pulmonis UAB CTIP
MPLEQNKMKGVKQMSNNYSQSEIQKINELRKINLEKRKVRDQKEKAKLDSKNKKNEAKFQKLKTNFDSFAKSKNQRLNKVVKSIETKFDQKISTLKQSLSTTKTNEQELKDSKALYNKKKKYYESRIAKNEAKYENLIKKLQYKIDTYALDKQEGQQKIDQLYLDLGQINKRWSLKIASLNIEDTKIKLEKQIKKLEEKKQLQIKTIEKRREVSPGSSFVSNLRNRIADEKSRYIGNYSIDYIFKKISANIRKYSMFYILALILLIFGSLTKFQNITPSNIEVIFRNNTYVLIIGMGMLLVIVGGNIDLSVGQLLSLLGAISVIIYNGVSRTFSNNSSLGGLYLIITLIGTAFIGALIGISQGFLIGYFKIPSFIVTLGGMLIFKGLALFAVPLNNITPEGGSQSAYVRAIIRTIFDVQVGGFYIISFLIFIVSLALIVLFLVYGRNKKIKFGLLVDSGFVFWLKIVVISVFMILLGYAFGKIGVKWYLLYIMILLVIFVFLTQNTVFGRKVYAIGGNKKSAELSGIDVRKTTTLIFMINGIMVAIASIIFTGIVTSATATAGEGFELDVISSVFVGGASMAGGIGTTIGTLIGGFILGFINNGILLLALNVGTQRVVKGVVLVLAVAYDIYANRKIS

SEQ ID NO: 40335 - DNA, 1035 bp, Agrobacterium tumefaciens str. C58
  CDS (1)..(1035): transl_table=11
gtgaggaacgacatggccaatattgcagaacccaagaagggcttcgccgtcagcgatcgtcagaaggacatcatccagaaatttgcggcgctcggcagcctctttgcgctggtcgcggtcttctccgcgaccagtaacgccttcttcaccgtcaataatggcatgacgatcgcgctgcaggtgacttctattgcgctgctcggcattggtgccacctgtgtcatcatcaccggcggcatcgatctttccgtcggttcggtgcttgcgcttgccggcgtcgttgccgcccttgcggtgaaggaactcggcatgccggtgcccatcggcatgttgctcggcattctgacggggtcgctttgtggcctcatcaacggtcttctggtgacgcgcttcaagctgccgcccttcatcgccactcttggcatgatgctgattgcccgcggtgtggccctgcagatcaccggtgcgcgcgccgtatccggccttggcgaatccttcggtgaactcggcaatggcgcactcttccgtatcgtcactatcggtgacgatggctttccgaatgtcgtgtttcccggcattccctatccggtcatcctgatggtggtgattgcgcttgcggtttccttcatgcttaaccgctccatcctcggccgccacatctatgccgtgggttccaatgcggatgctgcccgcctttccggcgtcaacgtcgctcgcgtcaccaatttcacctacatcctgtccggcacgctcgccgggctgacgggctgcgtgctgatgtcgcgtctcgttaccgcccagccgaacgaaggcgtgatgtatgagctggatgccattgccagtgcggtcatcggcggcacatcgctgatcggcggcgtgggcacgatttccggcacggccatcggcgcctttgtcatcggcattttgcgtaacggtctcaatatgaacggcgtttccgccttcacgcaacagatcatcattggccttgtcattctggtcaccgtctggatcgaccagctgcgcaaccgccgctga

SEQ ID NO: 40336 - protein, 344 aa, Agrobacterium tumefaciens str. C58
MRNDMANIAEPKKGFAVSDRQKDIIQKFAALGSLFALVAVFSATSNAFFTVNNGMTIALQVTSIALLGIGATCVIITGGIDLSVGSVLALAGVVAALAVKELGMPVPIGMLLGILTGSLCGLINGLLVTRFKLPPFIATLGMMLIARGVALQITGARAVSGLGESFGELGNGALFRIVTIGDDGFPNVVFPGIPYPVILMVVIALAVSFMLNRSILGRHIYAVGSNADAARLSGVNVARVTNFTYILSGTLAGLTGCVLMSRLVTAQPNEGVMYELDAIASAVIGGTSLIGGVGTISGTAIGAFVIGILRNGLNMNGVSAFTQQIIIGLVILVTVWIDQLRNRR

SEQ ID NO: 40337 - DNA, 1377 bp, Agrobacterium tumefaciens str. C58
  CDS (1)..(1377): transl_table=11
ttgggcgccgcgtcacgaacaggtggcgcggcgcctttcagatgtaaggaggaccggcagtccatggccgacatgacacaatccaattccacgacgtcccccaagacggaaaagaccggctcgatttcgcgtttcatcagtgccacggagctcgatacgcggctgcttggcatggtcggcgcgcttcttctgatctggatcggtttccatattctttcgggtggactgttcctgacgccgagaaacctctggaacctctccgtccagaccgcttcggtcgcggtgatggcgacgggcatggtgcttgttatcgttacccgcaacatcgatctgtcggtcgggtcgatcctcggcttttccggcatgatcatgggtgtcatgcaggcggaaatcctgccgcaaatcctcggcttcgaacattgggcgacatggatcgtcacgcttctggtcggtattctcgtcggcggcgcaatcggcatgctgcagggctcgatcatcgccttcctcaacgtgccgtccttcatcgtaacacttggtggcctgctcgtctggcgcggcggcacctggttcgtcaccagcggccgcaccgtggcaccgatggattccaccttccgcctgatgggcggcggcaccagcggctcgatcggcgcgacatggagctggatcgcagcgatcgtcgcctgcgtcgctattgtcgcggcgatcctcaattcccgtcaccagcgccgccgtttcggctttccgctgcggcccgtctgggcggaatatttcctggtggcgcttggctgcttcgtcgtcgtcggtttcgtggctgtcgtcaacagctatccctggccgatcaacattgcccgcaactatgccgatgccaatggcatagcctggccggatggcggcctgttcattccgcacggcattgccattcctgtgctgatggcgctcgcagtcggtgccgtcatgaccttcatcgcgacgaggctgcgcttcggacgttatgttttcgccatcggcggcaacccggaagcggcggaactggccggcatcaagacccgctgggtcacggtgaagatattcacgctgatgggcgttctgtgcgccatcgccgcggcaatttccactgcccgcctcaacgctgccaccaatgcccagggtgaactcgacgaactttatacgatcgcggccgcggtcatcggcggcacctcgcttgccggcggcgtcggcaccatagcgggcgcgatgctcggcgcgctcgtcatgcaatcgctgcaatccggcatggtgctggtgggcatcgatacgcccttccagcgcatcgtcgtcggtgtggtcctggtcgtcgccgtctggctcgacaccatctaccgcgcccgcgccaagtaa

SEQ ID NO: 40338 - protein, 458 aa, Agrobacterium tumefaciens str. C58
MGAASRTGGAAPFRCKEDRQSMADMTQSNSTTSPKTEKTGSISRFISATELDTRLLGMVGALLLIWIGFHILSGGLFLTPRNLWNLSVQTASVAVMATGMVLVIVTRNIDLSVGSILGFSGMIMGVMQAEILPQILGFEHWATWIVTLLVGILVGGAIGMLQGSIIAFLNVPSFIVTLGGLLVWRGGTWFVTSGRTVAPMDSTFRLMGGGTSGSIGATWSWIAAIVACVAIVAAILNSRHQRRRFGFPLRPVWAEYFLVALGCFVVVGFVAVVNSYPWPINIARNYADANGIAWPDGGLFIPHGIAIPVLMALAVGAVMTFIATRLRFGRYVFAIGGNPEAAELAGIKTRWVTVKIFTLMGVLCAIAAAISTARLNAATNAQGELDELYTIAAAVIGGTSLAGGVGTIAGAMLGALVMQSLQSGMVLVGIDTPFQRIVVGVVLVVAVWLDTIYRARAK

SEQ ID NO: 40339 - DNA, 975 bp, Sinorhizobium meliloti 1021
  CDS (1)..(975): transl_table=11
atgagtgtggaaacggttgaaagcgcgggaccgacgccgaagaaaggcgtcagcatcctgttcggtctgacgctcgtgggattgctggtcgtcctgtggctgctcctcggcctggcgaccaacgccttctggacgccgaacaacatcagcaacctcctgcgtcagggggcgatgaccgcgattctcgccgtcggccagaccttcgtcatcatcacggccggcatcgacctttcggtcggcgccgtcgtcggtttcaccagcgtcatcgtcgcctggctgctcgcggcgggggttccgctctggctcgcgatcatcgcgacgctggcgatcggcgtgctgatcggcgccttccatgccttcggcatcgtccgcatggggctgccgcccttcatcatcacgcttgcgacgctgacctcgcttcgcggcatcggtctcctgatcaccaacggctcgaccatctcgatcaccaacgacgccttcaccacgttctcacgggccgacttcctcggaattcccagtctcttctggatggtgatcgtcgttgcgattccggcttacgtcttcctgcatcttagccgcttcggccgttatctcttcgccgtcggctccaacagcgaggcggcgcgcctttccggcgtcaacgtcaaccgcacgatctatctggcctatatcctgtcatcgacgtgcgccgccttcgtcgggctgctgctcgcctcgcgcatcggcatcggcaacgccacgcaggccgaaggctgggagctgcaggcgatcgcttcgtcggtcatcggcggcacgagccttttcggcgccgtcggctcggtccacggtcccctgctcggcgccttcatccttgcgacgatcaacaacggcgccaatctcctgaacgtaaattccttctggcagcgcatcatcaccgggctgctgatcatcgtgatcgtctatttcgaccagttgcggcggcggggggcgcggtga

SEQ ID NO: 40340 - protein, 324 aa, Sinorhizobium meliloti 1021
MSVETVESAGPTPKKGVSILFGLTLVGLLVVLWLLLGLATNAFWTPNNISNLLRQGAMTAILAVGQTFVIITAGIDLSVGAVVGFTSVIVAWLLAAGVPLWLAIIATLAIGVLIGAFHAFGIVRMGLPPFIITLATLTSLRGIGLLITNGSTISITNDAFTTFSRADFLGIPSLFWMVIVVAIPAYVFLHLSRFGRYLFAVGSNSEAARLSGVNVNRTIYLAYILSSTCAAFVGLLLASRIGIGNATQAEGWELQAIASSVIGGTSLFGAVGSVHGPLLGAFILATINNGANLLNVNSFWQRIITGLLIIVIVYFDQLRRRGAR

SEQ ID NO: 40341 - DNA, 1083 bp, Sinorhizobium meliloti 1021
  CDS (1)..(1083): transl_table=11
atgggcgaaacaaacacagccgcacagccatcccaggaattcgaaaaggtcctggccgacagttcgacggacgtagcgtcattcgacgcgcatgataagacgctgcttcagaagctgcagcacttcctgcattcgagcccggccgcggtgccgctgatcgtgctggtcctgtcgctgatcgccttcggggtcattctcggcggcaagttcttttccgccttcaccatgacgctgatcctgcagcaggtggcgatcgtcggtatcgtcggtgccgctcagacgctcgtgatcctgaccgccggtatcgatctttcggtcggcgccatcatggtgctctcgtccgtcatcatggggcagttcaccttccgctacggcttcccgccggcgctctccgtcatctgcggccttggggtgggggcgctttgcggctacatcaacggaacgctcgtcgcgcgcatgaagctgccgccctttatcgtcacgctcggcatgtggcagatcgtgctcgcctcgaacttcctctattccgccaatgagacgatccgggctcaggacatttccgcgaatgcctcgatcctgcagttcttcggccagaacttccgcatcggcaatgccgtcttcacctacggcgtcgtggtgatggtgctcctcgtctgccttctttggtatgtcctgaaccgcaccgcctgggggcgctatgtctatgccgtcggcgacgaccccgaggctgccaagctcgccggcgtcaacgtcacgcgcatgctcatctccatctatacgctctccggcctcatctgcgcccttgccggctgggccctcatcggccgcatcggctcagtctccccgacagcgggccagtttgcgaatatcgaatcgatcactgccgtggtgatcggcggcatctcgctcttcggcggccgcggctccatcatgggcatgctcttcggcgcgctgatcgtcggcgtcttctcgctcggcctgcgcctcatgggcaccgacccgcaatggacctatctcctgatcggcttgctgatcatcatcgccgttgcaatcgaccagtggatcagaaaggtagcagcctga

SEQ ID NO: 40342 - protein, 360 aa, Sinorhizobium meliloti 1021
MGETNTAAQPSQEFEKVLADSSTDVASFDAHDKTLLQKLQHFLHSSPAAVPLIVLVLSLIAFGVILGGKFFSAFTMTLILQQVAIVGIVGAAQTLVILTAGIDLSVGAIMVLSSVIMGQFTFRYGFPPALSVICGLGVGALCGYINGTLVARMKLPPFIVTLGMWQIVLASNFLYSANETIRAQDISANASILQFFGQNFRIGNAVFTYGVVVMVLLVCLLWYVLNRTAWGRYVYAVGDDPEAAKLAGVNVTRMLISIYTLSGLICALAGWALIGRIGSVSPTAGQFANIESITAVVIGGISLFGGRGSIMGMLFGALIVGVFSLGLRLMGTDPQWTYLLIGLLIIIAVAIDQWIRKVAA

SEQ ID NO: 40343 - DNA, 1005 bp, Sinorhizobium meliloti 1021
  CDS (1)..(1005): transl_table=11
atgagcgaggcgaatgtgactatggcagcatccaccccgcaagccgcgctcggcaggaagctcgtggccgcagcggcaaattcccgcgaattgtccgtcatcctggctgcgctcgccatgttcgtcgcgctttcactttcgacggacacgttctttaccgaactaaatctgctgaaccttctgaggcagatatccgtcatcggcattcttgccgtcggcagcaccttcatctttatctccggcgagattgatttgtcggtcggcgcattgcttgggctgctggcgatgatctgcgccgccttggcgatcaagatggagggcaacatctacggtgccgcgctcgtcgtggtggctctgggcgcgatattgtcgggcatcaacggtgtcatcacgacgaaactgcgcattccctccttcatcaccacgctcggcatgctcagcatctacagcggcgcgacactggtgctctccaagggcatgccgatctccggcctgcaaaacgaccttttccgctccctcgtcgccggccggctcttcggggtcgttccagcgcaggtgatctggatggtggccgcgggcatattcggcacctacctcctgctgtttacccgcttcggctataacgtctttgccacaggcggcaacaagaacgcggccaaggccgtcggcatcaacaccgaccgggtgaagattctcgccttcgtggtcagcggtatcatggtcggcgtcacctccttcattctcgtcggctggttccgtggcgtggacccgcagaccggcaacggcctggaactcagcgtcatcgcggcggtcatcatcggcggcaccggcctgttcggggggcagggaagtgtcctcggcacgctggtgggcgcgctgatcatcggcatgatatcgaacggcaccgtcctgctgggcgtggattcctattatgagcctgtggcgcatggaacggtcatcctgcttgccgtcatcatcgatatctgggtgcgcaggcagcggtga

SEQ ID NO: 40344 - protein, 334 aa, Sinorhizobium meliloti 1021
MSEANVTMAASTPQAALGRKLVAAAANSRELSVILAALAMFVALSLSTDTFFTELNLLNLLRQISVIGILAVGSTFIFISGEIDLSVGALLGLLAMICAALAIKMEGNIYGAALVVVALGAILSGINGVITTKLRIPSFITTLGMLSIYSGATLVLSKGMPISGLQNDLFRSLVAGRLFGVVPAQVIWMVAAGIFGTYLLLFTRFGYNVFATGGNKNAAKAVGINTDRVKILAFVVSGIMVGVTSFILVGWFRGVDPQTGNGLELSVIAAVIIGGTGLFGGQGSVLGTLVGALIIGMISNGTVLLGVDSYYEPVAHGTVILLAVIIDIWVRRQR

SEQ ID NO: 40345 - DNA, 1050 bp, Sinorhizobium meliloti 1021
  CDS (1)..(1050): transl_table=11
atggatatgcgtgcggaaaagaacccggacatcccggccggtggggctggtgcccgcaagacgaagttgaaggcggtcgtctttcaggctggtccgctgatcgccctggtcctgctcatggcctatctcgcctttgccacatccaacttcctgacgctcgacaacctttccaacgtggcgcggcagtccgcattcgtcgccattctcgcggtcgggcagacattcgtcatcctgacgggcggcatagatctttcggtcgcggccatcgcggcgctttccgcctcgataaccgccgtcctactcacgcagccgctcgtgctgttcggtatcgatttcggcttcgtgccgccgccggtggcgatcctcatcgggattctcatcggcatggccgccggtgcgctcaacggctggctcatctccaagttcaagatcccggacttcatcgcgacgctcggcacgatgacggcgttccgcggcgcggcgctgctggtcaccgacggcctgcctgtcccctccttcaatgccggccggcaacttcccgaaagcctgatctgggtcggcggcggccagctcttcggggtgccggtgagcgcgctcatcgctctgctctgcgcggctgccggctggtacgtgctccgctacaccgcgctcgggcgagcgatctacgctgtcggcggcaaccgtgcggccgcccattcgtccggcatcagcatttcgcgcaccaagatcatgacctatgccatttccggccttctggccgcgatcgcgggcatcatcctggtcgggcgcctcaactccgccaatgcgcttatggcggatggcgaggagctgcgttccatcgcctccgtcgtcatcggcggcaccaatctcttcggcggcgaaggcggtgtatggggatcgatcatcggcgcggccatcatcggcgtgctcggcaacggcctcaacctgctcgatgtcagcccgttctggcagcgcatcgcgcagggcgtcgtcatcgtggtcgtcgtgatcttcgaccaatggcgccgtcgcagcatgacgcgcgtttga

SEQ ID NO: 40346 - protein, 349 aa, Sinorhizobium meliloti 1021
MDMRAEKNPDIPAGGAGARKTKLKAVVFQAGPLIALVLLMAYLAFATSNFLTLDNLSNVARQSAFVAILAVGQTFVILTGGIDLSVAAIAALSASITAVLLTQPLVLFGIDFGFVPPPVAILIGILIGMAAGALNGWLISKFKIPDFIATLGTMTAFRGAALLVTDGLPVPSFNAGRQLPESLIWVGGGQLFGVPVSALIALLCAAAGWYVLRYTALGRAIYAVGGNRAAAHSSGISISRTKIMTYAISGLLAAIAGIILVGRLNSANALMADGEELRSIASVVIGGTNLFGGEGGVWGSIIGAAIIGVLGNGLNLLDVSPFWQRIAQGVVIVVVVIFDQWRRRSMTRV

SEQ ID NO: 40347 - DNA, 1008 bp, Sinorhizobium meliloti 1021
  CDS (1)..(1008): transl_table=11
atgagtgctcccgaggaagttccccacatggacgtcgatctcctgaagggctccgaccgccccctctggagccgcgtattccttgcgcaggaaacgtggatagcactggctatcctggtgatcggcctcgtcgtatcggtcatctcggcgaagttcgcgacttccggaaacctcctcaacattttccagaatgcctgcttcatcgggattatggcgctcggcatgacgccggtgctcatcagcggcggcatcgatatctctgtcggatcgatccttggcatgtgcggagtgacgcttggcatcgtgctcaattcggacatgccgctcgccgtcggcatcctcgcgactctcgcgatgggtgtcgcctgcggtatggtcaacggaatcatcatctcctacgtcaagctcccgccattcatcgtcactcttgccaccttgtccatcgggcgcagcctcgctttggtgctcacgaacaatgaggtgttctacgaattcggacgggccaccaacggtatcatcgcgctcggcggtggctatagtttcggattgcctaacgtggtctatgctctcgtcgcgggcgtgatcatcctgcatttcctgctgaccatgacgcggtggggccgctacctgttcgcgatcggcggcaacgaggctgcggcgcgactggccggtatccctgtggacctcatcaaggtctcggcctacgccttcaacggcctgatggttgccataacggccgtgttcctggtcggctggcttggcgccgtcaccaacgcgatcggaaccggatacgagttgcaggtcatcgcgtcgacggtaatcggcggagcgtcgctgacaggcgggttcggcacggcgctcggcgcagccatcggcgcgatcctcgtagaggttatccgcaacgccctgctcatcgcaggggtcaacccgttctggcagggaatgttcgtgggaagtttcattctagccgcggtcctgctcgaaagaatccgctcgctgcgtcggtga

SEQ ID NO: 40348 - protein, 335 aa, Sinorhizobium meliloti 1021
MSAPEEVPHMDVDLLKGSDRPLWSRVFLAQETWIALAILVIGLVVSVISAKFATSGNLLNIFQNACFIGIMALGMTPVLISGGIDISVGSILGMCGVTLGIVLNSDMPLAVGILATLAMGVACGMVNGIIISYVKLPPFIVTLATLSIGRSLALVLTNNEVFYEFGRATNGIIALGGGYSFGLPNVVYALVAGVIILHFLLTMTRWGRYLFAIGGNEAAARLAGIPVDLIKVSAYAFNGLMVAITAVFLVGWLGAVTNAIGTGYELQVIASTVIGGASLTGGFGTALGAAIGAILVEVIRNALLIAGVNPFWQGMFVGSFILAAVLLERIRSLRR

SEQ ID NO: 40349 - DNA, 1050 bp, Yersinia pestis CO92
  CDS (1)..(1050): transl_table=11
atgtctagcgttactttgagttcggataaaaagaacccggtatcaactgaatcaaacggtgggatcccacaacctcagcaaccacagaatgcgccgactaaaagtggcttaggattatcccgtatctgggacagctacggcatgctggtggtcttcgccgtggtctttattggttgcgtgatttttgtgcctaattttggctcctttatcaatatgaaagggttggggctggctatctcaatgtctgggatggtggcgtgcggtatgcttttttgtttggcatccggcgattttgacctctctgtggcctcggtcattgcctgcgcgggtgttaccaccgcggtggtgatcaatatgacagagagcctatggataggggtgggcgcaggtttgttattaggggcggcatgtgggctaattaatggttttgtgattgcccggctaaaaatcaatgcgctgatcaccacattggcgacgatgcaaattgttcgtggcctggcgtatatcatttctgatggtaaagccgtgggtatcgaagatgagcgcttcttcgccttgggttataccaactggtttggtctgccagcacccatctggatcaccgttgcctgtttggtgctgtttggtttcttactgaataaaaccacctttggccgtaacacgttggcgattggggggaatgaagatgctgcgcgtctggccggtgtgccggtcgtgcggaccaaaatcattatttttgtgctgtcaggtttggtgtctgccgccgcagggattattttggcttcacgcatgacgagcggccagccaatgacctcgattggttatgagctcattgttatctctgcttgcatattaggcggggtatcactaaaaggcggcattggtaaaatttcttacgtcattgcggggatcttgattctgggaacagtagaaaatgccatgaacctattaaatatctccccgttctcacaatatgtggttcgtggtttgatcctgctggcggcggttatcttcgaccgttacaaacagttagctaaacggacgatataa

SEQ ID NO: 40350 - protein, 349 aa, Yersinia pestis CO92
MSSVTLSSDKKNPVSTESNGGIPQPQQPQNAPTKSGLGLSRIWDSYGMLVVFAVVFIGCVIFVPNFGSFINMKGLGLAISMSGMVACGMLFCLASGDFDLSVASVIACAGVTTAVVINMTESLWIGVGAGLLLGAACGLINGFVIARLKINALITTLATMQIVRGLAYIISDGKAVGIEDERFFALGYTNWFGLPAPIWITVACLVLFGFLLNKTTFGRNTLAIGGNEDAARLAGVPVVRTKIIIFVLSGLVSAAAGIILASRMTSGQPMTSIGYELIVISACILGGVSLKGGIGKISYVIAGILILGTVENAMNLLNISPFSQYVVRGLILLAAVIFDRYKQLAKRTI

SEQ ID NO: 40351 - DNA, 999 bp, Caulobacter crescentus CB15
  CDS (1)..(999): transl_table=11
atgaccgccccgtcgtctcccgccccgctcgcgaccgacaagccccgcttcgacctgttggccttcgcccgcaagcaccggacgatcctgttcctgctgcttctggtggcggtgttcggcgcggccaacgagcgcttcctgacggcgcgcaacgccctgaacatcctgtcggaggtgtcgatctacgggatcatcgccgtgggcatgaccttcgtgatcctgatcggcggcatcgacgtggccgtgggatcgctgctggccttcgcctcgatcgccgcagcctatgtggtcaccgccgtcgtcggcgacggccccgccacctggctgatcgctctgttggtctcgaccctgatcggcctggccgggggctatgtgcagggcaaggccgtgacctggctgcatgtgcccgccttcatcgtcaccctgggcggcatgaccgtctggcgcggcgccaccctgctgctgaacgacggcgggccgatctcgggcttcaacgacgcctaccgctggtggggctcgggcgagatcctgttcctgcccgtgccggtggtgatcttcgccctggtcgcagcggccggccacgtggcgctgcgctacacccgctatggccggcaggtctatgcggtgggcggcaacgccgaggctgcgcgcctgtcgggcgtcaatgtcgatttcatcaccaccagcgtctacgcgatcatcggcgccctggcggggctgtcgggctttctgctgtcggcccgcctgggctcggccgaggcggtcgccgggacgggctatgagctgcgggtcatcgcctcggtggtgatcggcggcgccagcctgaccggcggctcgggcggcgtcggcggcaccgtgctgggggccctgctgatcggcgtgctctcgaacggcctggtgatgctgcacgtcacctcctacgtccagcaggtggtgatcggcctgatcatcgtcgccgccgtggccttcgaccactatgcgcgcacccacaaggcgtag

SEQ ID NO: 40352 - protein, 332 aa, Caulobacter crescentus CB15
MTAPSSPAPLATDKPRFDLLAFARKHRTILFLLLLVAVFGAANERFLTARNALNILSEVSIYGIIAVGMTFVILIGGIDVAVGSLLAFASIAAAYVVTAVVGDGPATWLIALLVSTLIGLAGGYVQGKAVTWLHVPAFIVTLGGMTVWRGATLLLNDGGPISGFNDAYRWWGSGEILFLPVPVVIFALVAAAGHVALRYTRYGRQVYAVGGNAEAARLSGVNVDFITTSVYAIIGALAGLSGFLLSARLGSAEAVAGTGYELRVIASVVIGGASLTGGSGGVGGTVLGALLIGVLSNGLVMLHVTSYVQQVVIGLIIVAAVAFDHYARTHKA

SEQ ID NO: 40353 - DNA, 996 bp, Sinorhizobium meliloti 1021
  CDS (1)..(996): transl_table=11
atgaccgtagcgacagcaacactcgcaccaactaacgaaggcgcgcgcatccgttgggccgatctggcgcctttcatcgcccttgcggtgatcgtactgttcggggcgctggtgaatcccaatttcgtgtcgtcggccaatctgatcaacgtcatcacgcggagcgccttcattgcgattatcgccgtcggggcgaccttcgtgatctcgtccggcgggctcgacctgtcggtgggttcgatgatggccttcgtcaccggtatcatgatcatggcgatgaaccatctcgccccggcctttggagcctgggcgattccgatgggagcgggcgtggcgctgctggtcggagcgctatgcggcctcttcaacgggcttatcgtgaccgtcgggcgaatagagcccttcatcgtcacgctgggcacgatgggcattttccgcgccttcatcaccttcatgaccgacggcggctcgctgcccatcgatcgcagcctccgggaagcctatagaccggtctatttcggcagcttcttcggtattccatatccggtgctcatcaccttcgtggtggtcatggctggcgccttcctgctctacaagaccaagtatggccgccgcttgaagtcggcaggatccaatgtcgaggtcgcgcgcttttcgggcgtcaacgtcgccggcgtgcgcaccggcgcctacgtgatccagggcttctgcgtcgccgtcgctgcgatttgctatgtgccccgcctcggcgcggcgacgccaacgaccggccagctctgggagctgcaggtcatcaccgcggtcgtgatcgggggcacgctgctccgcggcgggcgcggacgcattggcggcacggtggccggcgccctcatcctcgaggtgatcgccaacgtcatggttctgtcggacttggtctcggaatacctcgtcgccgccgttcagggagcgatcatcatcatcgccatgctggcgcaccgctttactgccaaccgctga

SEQ ID NO: 40354 - protein, 331 aa, Sinorhizobium meliloti 1021
MTVATATLAPTNEGARIRWADLAPFIALAVIVLFGALVNPNFVSSANLINVITRSAFIAIIAVGATFVISSGGLDLSVGSMMAFVTGIMIMAMNHLAPAFGAWAIPMGAGVALLVGALCGLFNGLIVTVGRIEPFIVTLGTMGIFRAFITFMTDGGSLPIDRSLREAYRPVYFGSFFGIPYPVLITFVVVMAGAFLLYKTKYGRRLKSAGSNVEVARFSGVNVAGVRTGAYVIQGFCVAVAAICYVPRLGAATPTTGQLWELQVITAVVIGGTLLRGGRGRIGGTVAGALILEVIANVMVLSDLVSEYLVAAVQGAIIIIAMLAHRFTANR

SEQ ID NO: 40355 - DNA, 1065 bp, Sinorhizobium meliloti 1021
  CDS (1)..(1065): transl_table=11
atgacgacggcaacgaccaccaccaacgcaactgacgcgacgagcggctcggtactgctcaccttgatgaagctcaggacgttcatcgccctcttcgcggttgtcgccttcttctcgatcttcgcgccgaactttctttcgaccgccaatctaatcctgatgtcaaagcatgtggcgctcaacgccttcctcgccatgggcatgaccttcgtcatcatcaccggcggcatcgacctttccgtcggttcgatcgtcgggctctgcggcatggtggccggcgggctcatcctcaacggcatcgatctgcagttcggctacacggtctatttcaacgtcgtcgaggtctgcctcatcacgctcgccgtcgggatcgtcatcggcgcggtcaacgggctgctgattaccaagctcaacgtcgcacccttcatcgccacgctcggcacgctctatgtcgcgcgtggctttgcgctgctttcatcgggcggccagacattccccaacctcgtcggcaagccggaactcgcgacgacgggcttcgccttcctcggttcgggccggcttctcggcctgccggtttcgatctgggtcctcatcgtcgtggcgctcgccgccgcatacgttgccaggtatacgccgatcggccggcacatcttcgccgtcggcggcaacgagcgtgccgcccgcatgtccggcatccgggtcgaccgggtgaagatgttcgtctacatgttctccggcttctgcgcggcgatcgtcggactggtcatctcgtcggaactgatggcgtcgcacccggcgacgggcaattccttcgaactcaatgccatcgccgcagcggttctcggaggcacgtcgatgtccggcggccgcgggacgatcggtggcaccatcatcggcgccttcgtcatcggcattctttccgacggtctcgtgatgatgggcatctcgtccttctggcaaatggtcatcaaggggatcgtgatcatcgtcgccgtcgtggtggatcaggcgcaacgccggctgcagcaacaggtcacgctgatgcagcttgcgaaaaaggggtga

SEQ ID NO: 40356 - protein, 354 aa, Sinorhizobium meliloti 1021
MTTATTTTNATDATSGSVLLTLMKLRTFIALFAVVAFFSIFAPNFLSTANLILMSKHVALNAFLAMGMTFVIITGGIDLSVGSIVGLCGMVAGGLILNGIDLQFGYTVYFNVVEVCLITLAVGIVIGAVNGLLITKLNVAPFIATLGTLYVARGFALLSSGGQTFPNLVGKPELATTGFAFLGSGRLLGLPVSIWVLIVVALAAAYVARYTPIGRHIFAVGGNERAARMSGIRVDRVKMFVYMFSGFCAAIVGLVISSELMASHPATGNSFELNAIAAAVLGGTSMSGGRGTIGGTIIGAFVIGILSDGLVMMGISSFWQMVIKGIVIIVAVVVDQAQRRLQQQVTLMQLAKKG

SEQ ID NO: 40357 - DNA, 954 bp, Sinorhizobium meliloti 1021
  CDS (1)..(954): transl_table=11
atgacgacttccttgaaaaaacttcttctcggcgaacagggcctgctggtgatctttgccgccgccttcgtggtggtggcgctgacggttccgaatttcctcaccgaacgcaacatgctcggcctgctgcagtcagtggtgaccatcggcgtcgtcgcctgcaccatgatgttctgcctggcgtcgcgcgacttcgatctttcagtcggctccaccgtagccttctcgggaatggttgccgtcatggcgtcgaacgcgacgggctcgatagtgctcggtcttctggcggctcttgcctgcggtgggatcgtcggcctcgcgaacggcatcgtgatcgcccgtttccgcatcaatgcgctcataacgacgctggcgacgatgcagatcgtacgcggcttcgccttgatcgcgtcggacggccgcgcggtcggaatcaacgatccggtattttatcagctctccctgtcgaagttcctgaccgtgcccacgccgatctgggtgatggctctcttcttcatcgtgtttggcttcctgctcaaccgtaccgtcttcggcaagaacacgcttgcgatcggcggcaacccggaagcctcccggcttgccggcgtggacgtcgcgcggatgcgcatctggattttcgccctccaggggctggtatgcgcggtggcaggggtgctgctcgcctcgcgcatcacctcgggtcagccgaatgcggccaccggtctcgaactctcggtgatttccgcctgcgttctcggcggtgtttctcttgccggcggcagggcgaccatgaccggcgtcgtcgtaggcgttctgatcatgggaattgccgagaatgtcatgaacctgctcaacatccaggccttctatcagtacgtggtgcgtggcctcatcctgctgattgcggtcctcctcgacaatatgcgctctgtcgccggcaggccgcgagcctga

SEQ ID NO: 40358 - protein, 317 aa, Sinorhizobium meliloti 1021
MTTSLKKLLLGEQGLLVIFAAAFVVVALTVPNFLTERNMLGLLQSVVTIGVVACTMMFCLASRDFDLSVGSTVAFSGMVAVMASNATGSIVLGLLAALACGGIVGLANGIVIARFRINALITTLATMQIVRGFALIASDGRAVGINDPVFYQLSLSKFLTVPTPIWVMALFFIVFGFLLNRTVFGKNTLAIGGNPEASRLAGVDVARMRIWIFALQGLVCAVAGVLLASRITSGQPNAATGLELSVISACVLGGVSLAGGRATMTGVVVGVLIMGIAENVMNLLNIQAFYQYVVRGLILLIAVLLDNMRSVAGRPRA

SEQ ID NO: 40359 - DNA, 1032 bp, Sinorhizobium meliloti 1021
  CDS (1)..(1032): transl_table=11
atgcttgatctcttttcccgcaatcgcgtcgcaacgctcatcctagtgcttgccgtcgcctacgccgcgatcggcacggccgcgcccggctatctgtccggcgccactgcctcggtggttgtctccaacagcctcgtcctgatgctgatctcgctcgggactatgatggtcatcctgacgcgcaatatcgatgtgtcgagcggttcggtgcttggcctcagcgccgcggtgctcggcctttcgctcacagccggcgtgagcctgccgctcgccatcgccttctgccttgcaaccggtgctgtcgccggggccttcaacggtctgatggttgcctatctcggcattccatccatcgtcgccacccttggcacgcttggactttatcgcggcatcatgctcgtcctcacgggcgggcgctggatcgaggacctgccgcagggtctgaaggcgctcgccgccaatctcggcttcggcttctccgtcctcacgattgttgtgctggcacttgttgcgctcgcctggatcgtactgcgaaggacgcgcttcggccgcaatttctacgcagtcggcgataaccgcgcggctgcccaccatctcggtgtaccggttaagctggtgcagttttccgctttcgttgcaacgggcgtctgcgccgccctcgccggcctcgtcttcgccgcccagatcggcttcatcccaaatcaggccggtaacggcatcgaactgaaggccatcgccgtcaatgtgctaggaggcgtgagccttctcggaggcaccggttcggtcgctggcgtcttcaccgccgtcatctttatcacttcgatagacagtgccctcgttttcttgaagatcccggcctattggaatgacttcattgcaggcgcgatcctgctctcggtcctgctcctcgacggccgcatccgccagattatcgaccggcgcatccgtgcccgccgctatggggtgcacgagcgcggcccaacacaatcccgtgagacgacgacggcgcgcaatgtggaggcaagccgatga

SEQ ID NO: 40360 - protein, 343 aa, Sinorhizobium meliloti 1021
MLDLFSRNRVATLILVLAVAYAAIGTAAPGYLSGATASVVVSNSLVLMLISLGTMMVILTRNIDVSSGSVLGLSAAVLGLSLTAGVSLPLAIAFCLATGAVAGAFNGLMVAYLGIPSIVATLGTLGLYRGIMLVLTGGRWIEDLPQGLKALAANLGFGFSVLTIVVLALVALAWIVLRRTRFGRNFYAVGDNRAAAHHLGVPVKLVQFSAFVATGVCAALAGLVFAAQIGFIPNQAGNGIELKAIAVNVLGGVSLLGGTGSVAGVFTAVIFITSIDSALVFLKIPAYWNDFIAGAILLSVLLLDGRIRQIIDRRIRARRYGVHERGPTQSRETTTARNVEASR

SEQ ID NO: 40361 - DNA, 963 bp, Sinorhizobium meliloti 1021
  CDS (1)..(963): transl_table=11
atgacacagaacacagcagccaaagccgccctggttcgggctctcaagcaatatggcggcatcttcctttcgctggtgatgctctgcatcgtcttttccttcttcaacccgcgcttcatgacggttgtaaacttcatgaacatcctgcagcaggtcgccgttgttgcgatcgcggccttcgggatgacatgggtgatcctgctcggcgagatcgatctttccgtcggctcgatcatcgcggtggcaggaatggtcggggcgcaatgctttgccttcggaatgggtttcgcgccggcaatcgcgctgacgctcgccgccggcgccctgatgggaatgttgaacggggtgctgacggccaaactgctcttgccgtccttcatcgtcacggtcgcgaccatgggtatctatcgcggcatggtcagcctgccgaccaacggagcaccggccatgatcgagaacgaaacctggaccgcaatcggtaccgagagcttcctgggactgccgatcatcatctgggtcgtcgccgttctcttcgtcatcaatcagatcgtgctcagcaagacgagcttcggccggcgcgcctatctgaccggcggcaaccgtgaggcggccgtctactccggtatcaaggtcgaccggctgaagatcctgatcttcatgatctccggcgtgatggcggccatcagcggcgtgctgctttcctcccgcctgttctccgcacagaccaatgcgggcatgagctacgagcttgacgccatcgccgcggccgttctcggcggcaccagccttgcgggcggcgtcggaaccatggtcggcacgctgatcggcgcgctcatcatcggcgtcatgaacaacggcatgaacatgctctccgtcccctacttctaccagctgatcgtcaagggactggtgatcctcgtcgccgtctggctcgacgtccgtgccaagcaggcaaagcgctga

SEQ ID NO: 40362 - protein, 320 aa, Sinorhizobium meliloti 1021
MTQNTAAKAALVRALKQYGGIFLSLVMLCIVFSFFNPRFMTVVNFMNILQQVAVVAIAAFGMTWVILLGEIDLSVGSIIAVAGMVGAQCFAFGMGFAPAIALTLAAGALMGMLNGVLTAKLLLPSFIVTVATMGIYRGMVSLPTNGAPAMIENETWTAIGTESFLGLPIIIWVVAVLFVINQIVLSKTSFGRRAYLTGGNREAAVYSGIKVDRLKILIFMISGVMAAISGVLLSSRLFSAQTNAGMSYELDAIAAAVLGGTSLAGGVGTMVGTLIGALIIGVMNNGMNMLSVPYFYQLIVKGLVILVAVWLDVRAKQAKR

SEQ ID NO: 40363 - DNA, 999 bp, Sinorhizobium meliloti 1021
  CDS (1)..(999): transl_table=11
atggcaattacgctcgatcgggcagtcggacagagagaccggggatggctctcgttcctgttggccagccaggcattctgggtcctggtggcggtcatcctcgcctgcctcttcctgtcgattgccaccgactccttcgcaacggcaaaaaacctctacaacatcacgcgcaatttcaccttcgtcgcgatcatcgctctcggaatgacgctggtcatcattaccggcggcatcgatctttcggtgggttcggtcctttgcctgtgcagcatggtgctggcagtggtcatgcatgccggttacggcatcgaggtgggtattgccgcctcgatcggcacggcgctggtcgccggcgcattcaacggcgtcatgatcgcctatctaggctttccgcctttcgtgatcaccctcggaatgctctcgatcgcgcgaagcctggcgatggtcgcttccaacaatacggtcgtattcgagttcggcccggaccacgacacgctcctggctcttggcggcggcgcctggttcctcggcatcgccaatccggtgctctacatgatcgtcctggcactcctcaccggcttcgttctgcgctggacgaagttcggccgctacgtcttcgccatcggcggcaacgagcatgccgcgacgctcaccggcgttccggtgagaaggatcaaggttgccgtatacatgatctccgcgctcgcagccggcatcgcaggcatcatccagaccggctggctcggggccgtgacgaccaatatcggcgcaggaatggagcttcaggtcatcgccgctgccgtcatcggcggcgccaatcttgccggcggcgccggcacggcctccggcgctctgatcggagctgcgctgatcgaggtgatccgcaacagcctcggcctgctcgggatcaacgcattctggcagggcgccttcatcggcggcgccatcgtgctcgcggtgctttttgaccggatccgaaacttccggcaaagcgaatag

SEQ ID NO: 40364 - protein, 332 aa, Sinorhizobium meliloti 1021
MAITLDRAVGQRDRGWLSFLLASQAFWVLVAVILACLFLSIATDSFATAKNLYNITRNFTFVAIIALGMTLVIITGGIDLSVGSVLCLCSMVLAVVMHAGYGIEVGIAASIGTALVAGAFNGVMIAYLGFPPFVITLGMLSIARSLAMVASNNTVVFEFGPDHDTLLALGGGAWFLGIANPVLYMIVLALLTGFVLRWTKFGRYVFAIGGNEHAATLTGVPVRRIKVAVYMISALAAGIAGIIQTGWLGAVTTNIGAGMELQVIAAAVIGGANLAGGAGTASGALIGAALIEVIRNSLGLLGINAFWQGAFIGGAIVLAVLFDRIRNFRQSE

SEQ ID NO: 40365 - DNA, 996 bp, Sinorhizobium meliloti 1021
  CDS (1)..(996): transl_table=11
atgacccacacaacagacacagtgatgccgcaggaacagaagggttttgtcgactatcactccatcgttcagcgtttcgggaccctggcgatctttctcgtgctcgtcgccgtagcgacctggtggtcggacagttttctcactcgcggcaacctcctcaacgtattgcggcaggttgcctcgacagccggcatcatggccgtcggcatgctgttcgtcatcctgacgcgcggcattgacctttcggttggatcggtcatggccctgggttccgtactcacgggctacttctgcgcgatgttaggctatggcaccggggccaccatttttcttgtcttgttgtgcggcgctgcctgcggcctggtaacgggcggtttcatcgcgtatctcaggctgccgtcctttgtcatgtcgcttgccatgatggcagtcgcgcgcggcctttccctgatcatttccgaggggcgaccaattccgctcagcgatgcgggcgcagctttcagcagtttcggttccggcttcgtgctgggcattccccaaccagtcattttgatgttcgcaatctatatcgccggcggtgtcgtcctcaacttcacccggttcggacgcgtcattacggcaatcggttccaacgaggaggctgtccgactctccggtatcgccgtcccgcgctatatcgtcgccgtctatgtgatctccggtttgctcgccggtttggcaggtatcatcgccgcgagccgcacaggcgtcggctctgctcaggtcggcatcggggccgaactcaatgtgatcgccgccgtcgttatcggcggggcgagcctgatgggcgggaagggcggcgtcatcaacacgctgcttggcgctttggtcatgggaattatcaccaacatcatgaaccttgcgggcgtgcccgggtatcaccagcaggtttatatgggagcgatcatcgtcgttgccatgctgttgcagtacagcaccggctctctgaagcgatga

SEQ ID NO: 40366 - protein, 331 aa, Sinorhizobium meliloti 1021
MTHTTDTVMPQEQKGFVDYHSIVQRFGTLAIFLVLVAVATWWSDSFLTRGNLLNVLRQVASTAGIMAVGMLFVILTRGIDLSVGSVMALGSVLTGYFCAMLGYGTGATIFLVLLCGAACGLVTGGFIAYLRLPSFVMSLAMMAVARGLSLIISEGRPIPLSDAGAAFSSFGSGFVLGIPQPVILMFAIYIAGGVVLNFTRFGRVITAIGSNEEAVRLSGIAVPRYIVAVYVISGLLAGLAGIIAASRTGVGSAQVGIGAELNVIAAVVIGGASLMGGKGGVINTLLGALVMGIITNIMNLAGVPGYHQQVYMGAIIVVAMLLQYSTGSLKR

SEQ ID NO: 40367 - DNA, 1215 bp, Sinorhizobium meliloti 1021
  CDS (1)..(1215): transl_table=11
atggtcgccgatacgagcaccgaaaccaccaaaccgtcgatcggtgactacctcaggaacaacattcgcgaatacggcctgctggtcgcgctcgtcatcatcatgctgttcttccagttcgtcaccaacggcgtcctcttcaggcccgtcaacatcacgaacctggtgctgcagaactcgttcatcgtcatcatggcgctgggcatgctgctgatcatcgttgccgggcacatcgatctgtcggtcggctccatcgtggccttcatcggcgcgatttcggcgatcatgctcgtcaaatggggcttgcctgcctttgtggtcattcccgcctgcctgatcgtgggcggtatcatgggcgcggcgcagggctactgggtcgcctatcagaagatcccttccttcatcgtcacgctcgccggcatgctggtgttccggggaatgacctatgtggtcctcggcggccgtccgatcggaccgtttccgaaggacttccagatactgtcgaccggattcgttcccgactttctttacttcctcagcccgagcccggagacgatcaagaacatggtcgccctggtcgccgtgctgttgctcgtcggctatgcgatctttgccggggttcgcaatcgccggatcaacgagcagcacggcacggagaacgagccgttcgtcttcttcgcgatccagatggcggtcatcagcctggtggcactgttcctcggcttccagctttcgacctatcggggcctgcccaacgtcctagtcgtcatgggcgtgctgatcgccgtctacaccttcgtcaccacgcgttcgacgatcggccgccggatatacgcgatgggcggcaacgagaaggcgaccaagctctccggcatcaataccgaacggctgaccttctacgccttcgtgaacatgggcgcgctcgcggcgcttgccggcatgatcatcacggcccgtctgaactcggcgaccccgaaagccggcgtcggcttcgagctcgacgtgatcgcggcctgcttcatcggcggtgcgtccgcctcgggtggcgtcggcaagattaccggcgcggtgatcggcgctttcatcatgggcgtcatgaacaacggcatgtccatcatgggcatcggcatcgactaccagcaattgatcaagggcctcgtgctgctcgcagccgtgttcttcgacgtctacaacaagaacaagggcaagggctga

SEQ ID NO: 40368 - protein, 404 aa, Sinorhizobium meliloti 1021
MVADTSTETTKPSIGDYLRNNIREYGLLVALVIIMLFFQFVTNGVLFRPVNITNLVLQNSFIVIMALGMLLIIVAGHIDLSVGSIVAFIGAISAIMLVKWGLPAFVVIPACLIVGGIMGAAQGYWVAYQKIPSFIVTLAGMLVFRGMTYVVLGGRPIGPFPKDFQILSTGFVPDFLYFLSPSPETIKNMVALVAVLLLVGYAIFAGVRNRRINEQHGTENEPFVFFAIQMAVISLVALFLGFQLSTYRGLPNVLVVMGVLIAVYTFVTTRSTIGRRIYAMGGNEKATKLSGINTERLTFYAFVNMGALAALAGMIITARLNSATPKAGVGFELDVIAACFIGGASASGGVGKITGAVIGAFIMGVMNNGMSIMGIGIDYQQLIKGLVLLAAVFFDVYNKNKGKG

SEQ ID NO: 40369 - DNA, 1362 bp, Sinorhizobium meliloti 1021
  CDS (1)..(1362): transl_table=11
atggccatggccgacatcacaaaagccaaccagacacgggccgatcagaaaccgggcgcgcaggccggccgcgcccgcacgacggacgaaaacccggtgaaacgcttcttccgtgccaccgaaatcgatacccggctgctcggcatggtcggcgcgctgatcatcatatggctcggtttccaggtgatgaccggcggactgttcgacggcctgttcctgaaaccgcgcaacctgtggaacctgaccgtccagacctcatccgtcgccgtcatggcgaccggcatggtgctggtcatcgtcacccgcaacatcgacctctcggttggctccgtgctcggcttctgcggcatgatcatgggcgtcctgcaggcgcaggtcctgccgcaatatctcggcctcggccatcccgccacctgggcgatcacccttgcctgcggcatcgccgtcggcggcgccatcggcgcgcttcacggatcgatcatcgccttcctcaacgttcccgctttcatcgtgacgctcggcggcctgctggtctggcgcggcgcaacctggttcgtgacgagcggccagacggttgcgccgatggacgccaccttccgtctcatgggcggcggcaccgagggttccatcggcgcgacggcaagctggatcgtcggctccctcgcctgtatcgccatcgtcggcgccattttgaattcgcgcaagcagcgcaagcgctttggcttcccgctacgccctgtctgggccgagtatttcctgtcgatcctcggctgcgccctggtgcttggcgcagtcgccgtggccaaccattattactggccggtcaatatcgcccgcagatatgccgatgcgaacggcatcgcctggccggacggaggcctgcagatctcgcacggcattgccattcctgtcctggtcgcgattgtcgtcggcatcgtcatgaccttcatcgccacccgccttcgcttcggccgctacgtcttcgcactcggcggcaaccccgaagcggccgagctcgccggcatcaagacgcgctgggtcaccgtcaagatcttcacgctgatgggcgtgctctgcgccatcgcagcggccatctcgacggcgcgcctcaacgcggcgaccaatgcccagggcgagctcgacgagctctacacgatcgcggccgcagtcatcggcgggacctcgcttgccggcggcgtcggcaccattgccggcgcgatgatcggcgcgctcgtcatgcaatccctgcagtcgggcatggtccttctggggatcgatacgcccttccagcggatcgtcgtcggcgtcgtgctcgtcaccgccgtctggctcgacaccgtctaccgcgcccgtgcaaaataa

SEQ ID NO: 40370 - protein, 453 aa, Sinorhizobium meliloti 1021
MAMADITKANQTRADQKPGAQAGRARTTDENPVKRFFRATEIDTRLLGMVGALIIIWLGFQVMTGGLFDGLFLKPRNLWNLTVQTSSVAVMATGMVLVIVTRNIDLSVGSVLGFCGMIMGVLQAQVLPQYLGLGHPATWAITLACGIAVGGAIGALHGSIIAFLNVPAFIVTLGGLLVWRGATWFVTSGQTVAPMDATFRLMGGGTEGSIGATASWIVGSLACIAIVGAILNSRKQRKRFGFPLRPVWAEYFLSILGCALVLGAVAVANHYYWPVNIARRYADANGIAWPDGGLQISHGIAIPVLVAIVVGIVMTFIATRLRFGRYVFALGGNPEAAELAGIKTRWVTVKIFTLMGVLCAIAAAISTARLNAATNAQGELDELYTIAAAVIGGTSLAGGVGTIAGAMIGALVMQSLQSGMVLLGIDTPFQRIVVGVVLVTAVWLDTVYRARAK

SEQ ID NO: 40371 - DNA, 1323 bp, Sinorhizobium meliloti 1021
  CDS (1)..(1323): transl_table=11
atgaatttcctgaaggctctctcgcgcacgaaactctattgggggctgatcgccattttcctgatcggagtcctgtcctcaccgctgacgtcatcgggcaggaacatctttctctcctccggcaatctcctcgacgtgttgcggcaggtatcggccaccgggctgatcgccaccggcatgacggccgtcattctgaccggcggcatagacctttctgtcggctcgctgatggcgatctgcaccgtcgtctgcgcgatgctcttgaccgttccgggggacacggccgccctctatctggggctgccggccgtcggacttgccgtcctggtcgtcggtgcggcggccgtacgcttcgtcttcctgaatatcgagaaatcccgtgcgggcgtgacgcatatccgcgacatccagcttgaccggacacgcggtaccgttctgcctgccgcagccggcatcgttctctgtgccctggttctgagcttcctcttgcctcagatgcagacgaaattcggcgtgctcggcgttctgctcgttgcgccggcggtcggcctcatgttcggcgcagtcaacggcgtgatcatcgtggtcggacggttgcagccattcatcgtcacgcttgccatgatggtcacggcgctcggcatcgcccggctcaccgccgggcagaacaacgccgttctgccggtctataccggcagcaatgccaccgccgacttcgatatgctgcggcagctagtcttcggcatcgtgccgatgcccggcatattcttcatcgtcgcgattcttctctacggtgcggtgctgcgcttcacgcctttcggccgctatgtctacgccatcggcggaaacgaggaggcggcgcgcctttccggcatcaatgcgggccgggtgaagatcgtcacctatgcggtatcgggtctcctcgcgggcatcgccgcggtgctctatgtggcgcagtaccgccagggcaagccggacgccggcgcgggcctcgaactggatgcgatcgcggcagtggtcatcggcgggacgagcctgatgggaggacgcgggagccttgccgggacgttctgcggcgtcctgatcttcggcctgctctccaacatcctgcagctccacaacatcaattccaatcttcagctggtgctgaagggcgtgatcatcatcggcaccgtgctcgttcaggagcgcaatgcctacgatcttctcgcgcagttgcggctgccgggcgcaggccggcgcccggctcaaggagacacgtccgtggaggagcggacgtcgagagagacgttgtccataacaatgggaggaaagaagaaatga

SEQ ID NO: 40372 - protein, 440 aa, Sinorhizobium meliloti 1021
MNFLKALSRTKLYWGLIAIFLIGVLSSPLTSSGRNIFLSSGNLLDVLRQVSATGLIATGMTAVILTGGIDLSVGSLMAICTVVCAMLLTVPGDTAALYLGLPAVGLAVLVVGAAAVRFVFLNIEKSRAGVTHIRDIQLDRTRGTVLPAAAGIVLCALVLSFLLPQMQTKFGVLGVLLVAPAVGLMFGAVNGVIIVVGRLQPFIVTLAMMVTALGIARLTAGQNNAVLPVYTGSNATADFDMLRQLVFGIVPMPGIFFIVAILLYGAVLRFTPFGRYVYAIGGNEEAARLSGINAGRVKIVTYAVSGLLAGIAAVLYVAQYRQGKPDAGAGLELDAIAAVVIGGTSLMGGRGSLAGTFCGVLIFGLLSNILQLHNINSNLQLVLKGVIIIGTVLVQERNAYDLLAQLRLPGAGRRPAQGDTSVEERTSRETLSITMGGKKK

SEQ ID NO: 40373 - DNA, 1026 bp, Sinorhizobium meliloti 1021
  CDS (1)..(1026): transl_table=11
atgaataccaatgtcgcagcacagggcacgggctcgtccctcgcccgctcgagacggcgcatgccgcccgagctcaacatctttctggtgctgatcggtatcgcgctcgtctacgaggttctcggctggctcttcgtcggccagagctttctgatgaattcgcagcgcctgacgatcatgatcctgcaggtgtcggtgatcggcatcatcgccgtcggcgtcacgcaggtcatcatcacgggcggcatcgacctctcgtcaggctcggtcgtcggcatgaccgcgatgatctcggcgagcgtcgcgcaggcctccacctggccgcgggcgctctatccgtcactgaccgaccttccggccatcgtaccgatcggccttggtgtcgggatcggtctgctcgccggcttcatcaacggccagctcatcgccaggaccaagatcccgcccttcatcgccacgctcggcatgatggtgtcggcccgcggtgtctccaagtggtacacgaagggtcagccggtctcgggtctcaccgagcaattcaacttcatcggcacgggcatctggccggtgatcgtcttcctcgtcgtggcgctgatattccacatcgcgctgcgctacacccgctacggcaaattcacctacgcgatcggcgccaatgtccaggccgcgcgcgtctccggcatcaatgtcgaagcccatctggtgaaggtctatgcgatcgccggcatgcttgcgggcctcgcaggcgtggtcaccgccgcccgcgcccagacggcgcaggccggcatgggcgtcatgtacgaactcgacgcgatcgccgcgaccgtcatcggcggcacgtcgctcacaggcggcgtcggccgtgtcaccggtacggtgatcggcacggtgatccttggcgtgatgacgtcaggcttcaccttcctccgggtcgacgcctactaccaggagatcgtcaagggcatcatcatcgtcgctgctgtcgttgtcgacgtctatcgccagaaaggccggaaaaagacgtaa

SEQ ID NO: 40374 - protein, 341 aa, Sinorhizobium meliloti 1021
MNTNVAAQGTGSSLARSRRRMPPELNIFLVLIGIALVYEVLGWLFVGQSFLMNSQRLTIMILQVSVIGIIAVGVTQVIITGGIDLSSGSVVGMTAMISASVAQASTWPRALYPSLTDLPAIVPIGLGVGIGLLAGFINGQLIARTKIPPFIATLGMMVSARGVSKWYTKGQPVSGLTEQFNFIGTGIWPVIVFLVVALIFHIALRYTRYGKFTYAIGANVQAARVSGINVEAHLVKVYAIAGMLAGLAGVVTAARAQTAQAGMGVMYELDAIAATVIGGTSLTGGVGRVTGTVIGTVILGVMTSGFTFLRVDAYYQEIVKGIIIVAAVVVDVYRQKGRKKT

SEQ ID NO: 40375 - DNA, 957 bp, Sinorhizobium meliloti 1021
  CDS (1)..(957): transl_table=11
atgctgctcgccggcatggttctttatttctcgctcgtaaccggaggttttgcctcccctcaaagcgcagtcttcattctgcaatccgtgtcgatcaccggcattctcgccctcggcgtgacggcgacgcttgtcgtcggggggttcgacctctcgattggctcggtcgccaccacggcgatgatggcttcctcctatgtcatggtggtgatgggaggcggcgcgcttacggcggcgctcgtatgcctcgccgtcggcgcgctcgtcggcctgatcaacggcttcatcatcgtctacatgcgcgttccggaccttctggctaccctcggcatgatgttcctgctgctcggccttcagcgcatcccgaccgagggccgctcgattgccgcgggcatgacgctgcccgacggttcggtcgcgaccggcactttcagtccggctttcctggcgctcgggcgccaccgcttcgatctcgtcctgcccaacctcgtgccggtctcggtcgtggtgctcgtggtgctcgccatagcgatctggttcttcctcgaatacacccgcttcggccgcataatgtatgcggtcgggtccaacgagcgcgcggccgcgctcgcaggggcgccggtcaatgcctacaagatttcggcctacgtcatttccggcgtcttcgcctctatcggcggcattctgctcgcagcacgcctcggccgcggcgatatcgcctccggaaacaacctgctgctcgacgccgtcgccgccgcgctgatcggttttgccgtgctgggtgcggccaagccgaacgctttcggaacggccgtcggcgcgcttttcgtcgggatcctactgcaggggctgacgatgatgaatgcgccttactacacgcaggatttcatcaagggcgccgtgctcgtcgtcgccctgatctttacctttgcgctctcgaaaagaggcaaacgctga

SEQ ID NO: 40376 - protein, 318 aa, Sinorhizobium meliloti 1021
MLLAGMVLYFSLVTGGFASPQSAVFILQSVSITGILALGVTATLVVGGFDLSIGSVATTAMMASSYVMVVMGGGALTAALVCLAVGALVGLINGFIIVYMRVPDLLATLGMMFLLLGLQRIPTEGRSIAAGMTLPDGSVATGTFSPAFLALGRHRFDLVLPNLVPVSVVVLVVLAIAIWFFLEYTRFGRIMYAVGSNERAAALAGAPVNAYKISAYVISGVFASIGGILLAARLGRGDIASGNNLLLDAVAAALIGFAVLGAAKPNAFGTAVGALFVGILLQGLTMMNAPYYTQDFIKGAVLVVALIFTFALSKRGKR

SEQ ID NO: 40377 - DNA, 966 bp, Salmonella typhimurium LT2
  CDS (1)..(966): transl_table=11
atgacaacccaggctgtttctggtcgccgttatttcactaaagcgtggcttcttgagcagaagtcgctcattgccctgctggtgttgatcgcgattgtttcgacgttgagccccaacttttttaccgttaataatctgttcaatattcttcaacagacctccgttaacgccattatggcggtggggatgacgttggtgattctgacatcggggatcgatctgtccgtcggttccctgctggcgctcaccggtgcggttgccgcttcaatcgtcggcgttgaagtgaatgcgctggtcgcggttgccgccgcgctggcgctgggcgctgcgattggcgccgtcactggcgttatcgtcgcgaagggccgcgtacaggcgtttatcgctacgctggtgatgatgctgctactgcgtggcgtgacgatggtttacaccgacggtagcccggtcaacaccggctttaccgataacgccgatctgtttggctggttcggtatcggtcgtccgctgggcgttcctacgccggtctggatcatggctatcgtctttatcgccgcctggtatatgctgcatcacactcgtctgggacgctatatctacgcgctgggcggtaacgaagcggcgacgcgtctgtctggcattagcgtgagcaaagtgaaaattatcgtctattcactttgcggcctgacagcatcgctggcgggcatcattgaagtggcgcgcctctcttccgcgcagccgacggcgggtaccggctatgagctggatgctattgccgccgtggtgctgggcggcaccagccttgcaggtggtaaagggcgcattgttgggacattgatcggcgcattgattctcggcttccttaataatggtttgaatttgttaggtgtttcctcctattaccagatgatcgtcaaagcggtggtgattttgctggcggtactggtagacaacaaaaagcagtaa

SEQ ID NO: 40378 - protein, 321 aa, Salmonella typhimurium LT2
MTTQAVSGRRYFTKAWLLEQKSLIALLVLIAIVSTLSPNFFTVNNLFNILQQTSVNAIMAVGMTLVILTSGIDLSVGSLLALTGAVAASIVGVEVNALVAVAAALALGAAIGAVTGVIVAKGRVQAFIATLVMMLLLRGVTMVYTDGSPVNTGFTDNADLFGWFGIGRPLGVPTPVWIMAIVFIAAWYMLHHTRLGRYIYALGGNEAATRLSGISVSKVKIIVYSLCGLTASLAGIIEVARLSSAQPTAGTGYELDAIAAVVLGGTSLAGGKGRIVGTLIGALILGFLNNGLNLLGVSSYYQMIVKAVVILLAVLVDNKKQ

SEQ ID NO: 40379 - DNA, 1047 bp, Ralstonia solanacearum GMI1000
  CDS (1)..(1047): transl_table=11
atgcgttctgattccgccctgccccccgccggctcgcccggcccgtccgagcccccggaggcggcagccggggccgccacgcgcgccggccgcggcgcgctgggcatgtcgctcggggccatcggcggcctgctggcggcgctggccgcgatgctggtcctgttcagcctgctgtcggacaccttcttcacggtgtcgaccttcaccaccatcgccaacgagatccccgacctgctcgtgatggcggtgggcatgaccttcgtgctgatgatcggcggcatcgacctgtcggtgggctcggtgctggcgctgtcggcgtcgatgctgtccatcgccatgacccggttcggctggggcctggcgccggcggccctgctgggcgtgctggcggccaccgcggccggcgccctgaccggcacggtgacggtgcgctggggcattccgtcgttcatcgtctcgctgggcgtgctggaaatggcgcgcggcctggcctacagcctgaccgattcgcgcaccgtctacctcggtgccgcggtggactggctggccaccccgatcgcgctgggcatcgcgccgtcgttcctgatcgcgatcgccatcaccgtgatcggccaggtcgtgctggtgcgcaccgtgttcggccgctacctggtcgccatcggcaccaacgaggaggcggtgcggctggcgggcgtcaatccgcatccgtacaagatcgccgtgtttgcgctgatgggatggctgtcggggctggcggcgctgttccaggtgtcgcggctggaagcggccgaccccaacgcggggggcggcatggagctgcaggtgatcgccgccgtggtgatcggcggcaccagcctcatgggcggacgcgggtcggtggcccgcacgctgttcggcgtcctcatcatttctgtgctcgaagccggcctcgcgcagatcggcgcttcggagccgaccaaacggatcatcacgggcgcggtcatcgtcgcggccgtggtcatggatacctatcgaacccggaccaaccgggtcactacacgccaataa

SEQ ID NO: 40380 - protein, 348 aa, Ralstonia solanacearum GMI1000
MRSDSALPPAGSPGPSEPPEAAAGAATRAGRGALGMSLGAIGGLLAALAAMLVLFSLLSDTFFTVSTFTTIANEIPDLLVMAVGMTFVLMIGGIDLSVGSVLALSASMLSIAMTRFGWGLAPAALLGVLAATAAGALTGTVTVRWGIPSFIVSLGVLEMARGLAYSLTDSRTVYLGAAVDWLATPIALGIAPSFLIAIAITVIGQVVLVRTVFGRYLVAIGTNEEAVRLAGVNPHPYKIAVFALMGWLSGLAALFQVSRLEAADPNAGGGMELQVIAAVVIGGTSLMGGRGSVARTLFGVLIISVLEAGLAQIGASEPTKRIITGAVIVAAVVMDTYRTRTNRVTTRQ

SEQ ID NO: 40381 - DNA, 1008 bp, Ralstonia solanacearum GMI1000
  CDS (1)..(1008): transl_table=11
atgtcccagtcccaacccctgcaacgcgccgacgggtttgccgcgtcggcccgctcggccatgaacaacacgcgcctgctgaggcggctggacgatttcagcctgccgctgatcttcgccatcctgtttgccgcgctgtcgctgtcggtcgagtacttcttctcgtggcagaacatggtcggcctggcgctgtccgtctcgcagatcggcatggtggcctgcaccatgatgttctgcctggcctcgcgcgacttcgacctgtcgatcggctccacggtggcgttcgccggcgtgctgtgcgcgacggtcatcaacgccaccggcagcatcgcgctgggcatcggcgcgagcctgctggccggcgcggtgatcggcggcatcaatggcttcgtgatcgcccggctgaagatcaacgcgctgatcaccacgctcgccaccatggagatcgtgcgcggcctggccttcatcgcctcgcacgggcaggcggtgggcgtctcggagatggcgttcttcgacctgggcaacaccatcgtgctgggcgtgccgacgccggtgtgggtggcggcgctgtgcttcgtggcgttcggcgtgctgctcaacaagacggtgtacgggcgcaacacgctcgccatcggcggcaacccagaggcggcgcggctggcgggcgtgaacgtcaacctgacgcgcatcgtgatcttcctggtccagggcgtgattgccgcgctggccggcgtgatcctggccgcgcgcatcaccagcggccagccgaacgcggcgcagggcttcgagctgaacgtgatttcggcgtgcgtgctgggcggcgtgtcgctgatgggcggccgcgccagcatcagcggggtgctggtcggcgtgctgatcatgggcacggtgcagaacgcgatgaacctgctcaatatcgatgcgttctatcagtacctggtgcgcggcggcatcctgctggcggcggtgctggtggaccagatcaagcatcgcggcggccgcgattga

SEQ ID NO: 40382 - protein, 335 aa, Ralstonia solanacearum GMI1000
MSQSQPLQRADGFAASARSAMNNTRLLRRLDDFSLPLIFAILFAALSLSVEYFFSWQNMVGLALSVSQIGMVACTMMFCLASRDFDLSIGSTVAFAGVLCATVINATGSIALGIGASLLAGAVIGGINGFVIARLKINALITTLATMEIVRGLAFIASHGQAVGVSEMAFFDLGNTIVLGVPTPVWVAALCFVAFGVLLNKTVYGRNTLAIGGNPEAARLAGVNVNLTRIVIFLVQGVIAALAGVILAARITSGQPNAAQGFELNVISACVLGGVSLMGGRASISGVLVGVLIMGTVQNAMNLLNIDAFYQYLVRGGILLAAVLVDQIKHRGGRD

SEQ ID NO: 40383 - DNA, 1197 bp, Ralstonia solanacearum GMI1000
  CDS (1)..(1197): transl_table=11
atgtcgaaccttctgcataccgaactcgcccgcaacggcggcagcggcccgcgcctcgatggccgcaccatccagcaactcttcgtgcgctacaaggtgctggccttgctgctggccgtggcgctgatctggatcttcttctggagccagaccaacggcaccttcctgcggccgaacagcatttccaacctgttcctgcagatgtccgtcacgggcatgctggcctgcggcatggtgttcgtcatcatcgccggggagatcgacctgtcggtcggctcgctgctcggcctgctgggcgggctggtcgccatcctgacggtcaaccacggctggaacacctgggtctcggtgggcgtggtgctggcggcgggcgcggccatcggcgcggccaacggcttcatcaccaccaagctgcgcgtgccctcgttcatcgtcggcctgggcggcatgctggccttccgcggcctgctgcaatggagcaccgacagcgtgacgatcgcaccggtgcccgacgacctgggcaacatcgcgcagagcttcgtgccggcctggctcgcgtggagcctggccaccgccatcgtcgcgctgtcggtggtgctgacgctgcgccggcgtgccgagcgcgcgcgcctgtcgctgtcgctgccgccgatgtgggccgacgcgctcaagctgctggccatcgcggccgcctcgttcggcttcgttgcggtgctcaatcaggccaacggcgtgccgctgccggtgctgatcctgctggtgatgctgggcgtgttctcctacgtcgccacgcagaccgtgttcggccgccacgtctacgcggtgggcggcaacatggaagcgacccgcctgtcgggcgtgaacgtggcgcgcgtcaagctgctggtgttcgtcctgatgggcctgatgtgcgccttcgcgggcatcgtcaccacggcgcgctcggcggctggctcgccctccgcgggcgtgggcggcgagctcgatgccatctccgcctgcttcatcggcggcacctcgatgcgcggcggctcgggcacggtctacggtgcgctgatcggcgcgctggtgatggccagcctcgacaacggcatgcagcagatgaacgtcgatgcctcgtggcagatgatcgtcaagggcgtcgtgctggtgctggcggtgtggatcgacgtgctgtccggctccaaccgcggctga

SEQ ID NO: 40384 - protein, 398 aa, Ralstonia solanacearum GMI1000
MSNLLHTELARNGGSGPRLDGRTIQQLFVRYKVLALLLAVALIWIFFWSQTNGTFLRPNSISNLFLQMSVTGMLACGMVFVIIAGEIDLSVGSLLGLLGGLVAILTVNHGWNTWVSVGVVLAAGAAIGAANGFITTKLRVPSFIVGLGGMLAFRGLLQWSTDSVTIAPVPDDLGNIAQSFVPAWLAWSLATAIVALSVVLTLRRRAERARLSLSLPPMWADALKLLAIAAASFGFVAVLNQANGVPLPVLILLVMLGVFSYVATQTVFGRHVYAVGGNMEATRLSGVNVARVKLLVFVLMGLMCAFAGIVTTARSAAGSPSAGVGGELDAISACFIGGTSMRGGSGTVYGALIGALVMASLDNGMQQMNVDASWQMIVKGVVLVLAVWIDVLSGSNRG

SEQ ID NO: 40385 - DNA, 1107 bp, Agrobacterium tumefaciens str. C58
  CDS (1)..(1107): transl_table=11
atggagcgatcgggaggaaaatccatgagcgatcagccagtgcgggcgcaaccgcacaatgaatttgaaaaagtgctgtcaggaagttcgacccaggtcgctgcttttgatacgcacaacaagagtttgctggaaaaattccagcactttctgcattccagccctgcggctgttcccctgatcgttctggtgctgtcacttgccatcttcggcatgacgctgggcggcaagttcttttcggctttctcgctgacgcttattcttcagcaggtggcaatcgtcggcattgtcggcgcggcgcagtcgctggtcattctgaccgcgggtatcgatctttcggtcggtgccatcatggttctctcctccgtcgtcatgggccagttcaccttccgttatggtctgcctgcggaactttccattatctgcggtctcgcagtcggcgcgttttgtggtttcatcaacggcgtgctggtatcgcgcatgcggctgccgcccttcatcgtcacgctcggcatgtggcagatcgtgctggccaccaatttcctctattcggctaacgagacgatccgcgctcaggacattgtccagcaagcgcccattcttcagtttttcggcaataatattcgtatcggcaatgccgtcttcacctacggcgttctcgcgatggttctgctcgtcgctttgctctggtatgtgctcaaccgcaccgcttgggggcgccatctttatgcggtcggtgacgatccagacgcggctgaacttgctggcgttaacgtcaagcgcatgctgacgaccgtctataccctgtccggccttatctgcgccttcgcgggttgggctctcatcggtcgcatcggctcggtgtcgccgactgccggtcagttcgccaacattgaatccatcactgcagtggtcatcggcggcatctcgctgttcggcggacgcggttccatcatgggcatgatcttcggtgcgctgatcgtcggcgtcttttcgctgggcctcaggctcatcgggacagatccgcaatggacctatctgttgattggcgtcctcatcatcttggccgtggcaatcgaccagtggattagaaaggtagcaggctga

SEQ ID NO: 40386 - protein, 368 aa, Agrobacterium tumefaciens str. C58
MERSGGKSMSDQPVRAQPHNEFEKVLSGSSTQVAAFDTHNKSLLEKFQHFLHSSPAAVPLIVLVLSLAIFGMTLGGKFFSAFSLTLILQQVAIVGIVGAAQSLVILTAGIDLSVGAIMVLSSVVMGQFTFRYGLPAELSIICGLAVGAFCGFINGVLVSRMRLPPFIVTLGMWQIVLATNFLYSANETIRAQDIVQQAPILQFFGNNIRIGNAVFTYGVLAMVLLVALLWYVLNRTAWGRHLYAVGDDPDAAELAGVNVKRMLTTVYTLSGLICAFAGWALIGRIGSVSPTAGQFANIESITAVVIGGISLFGGRGSIMGMIFGALIVGVFSLGLRLIGTDPQWTYLLIGVLIILAVAIDQWIRKVAG

SEQ ID NO: 40387 - DNA, 981 bp, Agrobacterium tumefaciens str. C58
  CDS (1)..(981): transl_table=11
atgtccgcgcttgaacgcaatgagggggtcacgcacaccaggagcccgcttgcctggctgagcggtgccaccggaccacttttgggcctgctgatgctctgtgtgttcctgactttcgccagcgagaatttcctgtcgctgcgaaacggcctgaacatcctcgaccagatcaccgttctcggcatcatggccgttggcatgaccttcgtcatcctgcttggcggcatcgatctgtctgtcggctcggtgttggcactgtcgatgatgatcatgggctggacagccaatgtcgcgggcatgccgatgggcatggcgatcgtgctcgcgcttgtcgcgtccgcagcctgcggccttgtggtcggtattctggtaacggccttccgtgtgcccgccttcattgccacacttgcaatgatgtcggttgcgcgcggccttgcaaacatgatcaccgatggccagcagatcgtcggctttcctgactggttcatgatgctggcgattgagcgccatttcggcgtgctgaccgcgaccgtgctgctaatgctggtcgtggtgctggtgtcctgggctttcctgcgcttccgctcggaaggccgcaccgtctatgcggtgggcggcaatcctgaggtggcgcgtcttgccggcatcaacgtgccgctggtgacgatctgcgtttatgtcgtctgcgcggttctggccggtctggcgggcatcgttcttgccgcacgtctcgactcagtacagccctccagcggtttcggctacgagctggatacgattgcggccgttgtgatcggcggaacctcgctttcgggcggtgctggcggcatcggcggaacgctgatcggcgtgctgatcatcggcgtgctgcgcaacggcctcaacctgctcaacgtctctccctttcttcagcaggtcatcatcggtgtcgtcatcgtgctggctgtgggtgctgaaacgctgcgccgtcgcagaagctga

SEQ ID NO: 40388 - protein, 326 aa, Agrobacterium tumefaciens str. C58
MSALERNEGVTHTRSPLAWLSGATGPLLGLLMLCVFLTFASENFLSLRNGLNILDQITVLGIMAVGMTFVILLGGIDLSVGSVLALSMMIMGWTANVAGMPMGMAIVLALVASAACGLVVGILVTAFRVPAFIATLAMMSVARGLANMITDGQQIVGFPDWFMMLAIERHFGVLTATVLLMLVVVLVSWAFLRFRSEGRTVYAVGGNPEVARLAGINVPLVTICVYVVCAVLAGLAGIVLAARLDSVQPSSGFGYELDTIAAVVIGGTSLSGGAGGIGGTLIGVLIIGVLRNGLNLLNVSPFLQQVIIGVVIVLAVGAETLRRRRS

SEQ ID NO: 40389 - DNA, 1197 bp, Agrobacterium tumefaciens str. C58
  CDS (1)..(1197): transl_table=11
atgagttcggcaaacaccacaaacgaagaaagcaacgtcatctcggtcgggtcgtatattcgatccaatatccgcgaatacggcatgctgatcgcgctcgtcgccatcatggttttcttccagttctacaccggcggcatcctgttccgccctgtgaacctgaccaacctcatcctgcagaactcgttcatcgtcatcatggcgcttggcatgctgctcgtcatcgtggccgggcatatcgacctttcggtcggttccatcgtcgccttcgtcggcgcgatcgcggccatattgaccgtgcaatggggcatgaacccgtttctggcggcgctgatttgtctcgtcatcggcggcatcatcggtgctgcccagggttactggatcgcctatcaccgcattccgtcgttcatcgtgacgctggcgggcatgctggtgttccgcggcctgacgcttttcgtgctcggcggcaagaatatcggtcctttcccgaccgatttccaggtcatcagcaccggcttcctgcctgatatcggcggcatcgaaggtctgaacaccacgtcgatgatcctgaccgtgctgattacggtcgcgctgttctatctggcgtggcgccgtcgcgtggtgaacgtgaagcatggcatcgacgtggagccgttcggtttcttcatcgtgcagaatctgctgatctccggcgctatcctgttcctgggttaccagctgtcgacctatcgtggcctgccgaacgttctgatcgtgatgctggttctgatcgcgctttacagcttcgtgacgcgccgcacgaccatcggccgtcgcgtttacgccatgggcggcaatgagaaggcgaccaagctttccggtatcaacaccgaacgcctgagcttcctcaccttcgtcaacatgggcgtgctggccggtcttgccggcatgatcatcgcgacccgcctcaactcggcgacgccgaaggcaggcgtgggcttcgagcttgacgtgatcgcggcctgcttcatcggcggtgcttcggcctccggcggcgttggcaagatcaccggggccgttatcggcgccttcatcatgggtgtgatgaataacggcatgtcgatcgtcggtctcggcatcgatttccagcagatggtcaagggcctcgtgctgctcgccgctgtgttcttcgacgtctacaacaagaacaagggctga

SEQ ID NO: 40390 - protein, 398 aa, Agrobacterium tumefaciens str. C58
MSSANTTNEESNVISVGSYIRSNIREYGMLIALVAIMVFFQFYTGGILFRPVNLTNLILQNSFIVIMALGMLLVIVAGHIDLSVGSIVAFVGAIAAILTVQWGMNPFLAALICLVIGGIIGAAQGYWIAYHRIPSFIVTLAGMLVFRGLTLFVLGGKNIGPFPTDFQVISTGFLPDIGGIEGLNTTSMILTVLITVALFYLAWRRRVVNVKHGIDVEPFGFFIVQNLLISGAILFLGYQLSTYRGLPNVLIVMLVLIALYSFVTRRTTIGRRVYAMGGNEKATKLSGINTERLSFLTFVNMGVLAGLAGMIIATRLNSATPKAGVGFELDVIAACFIGGASASGGVGKITGAVIGAFIMGVMNNGMSIVGLGIDFQQMVKGLVLLAAVFFDVYNKNKG

SEQ ID NO: 40391 - DNA, 1023 bp, Agrobacterium tumefaciens str. C58
  CDS (1)..(1023): transl_table=11
atggccaatattgcagaacccaagaagggcttcgccgtcagcgatcgtcagaaggacatcatccagaaatttgcggcgctcggcagcctctttgcgctggtcgcggtcttctccgcgaccagtaacgccttcttcaccgtcaataatggcatgacgatcgcgctgcaggtgacttctattgcgctgctcggcattggtgccacctgtgtcatcatcaccggcggcatcgatctttccgtcggttcggtgcttgcgcttgccggcgtcgttgccgcccttgcggtgaaggaactcggcatgccggtgcccatcggcatgttgctcggcattctgacggggtcgctttgtggcctcatcaacggtcttctggtgacgcgcttcaagctgccgcccttcatcgccactcttggcatgatgctgattgcccgcggtgtggccctgcagatcaccggtgcgcgcgccgtatccggccttggcgaatccttcggtgaactcggcaatggcgcactcttccgtatcgtcactatcggtgacgatggctttccgaatgtcgtgtttcccggcattccctatccggtcatcctgatggtggtgattgcgcttgcggtttccttcatgcttaaccgctccatcctcggccgccacatctatgccgtgggttccaatgcggatgctgcccgcctttccggcgtcaacgtcgctcgcgtcaccaatttcacctacatcctgtccggcacgctcgccgggctgacgggctgcgtgctgatgtcgcgtctcgttaccgcccagccgaacgaaggcgtgatgtatgagctggatgccattgccagtgcggtcatcggcggcacatcgctgatcggcggcgtgggcacgatttccggcacggccatcggcgcctttgtcatcggcattttgcgtaacggtctcaatatgaacggcgtttccgccttcacgcaacagatcatcattggccttgtcattctggtcaccgtctggatcgaccagctgcgcaaccgccgctga

SEQ ID NO: 40392 - protein, 340 aa, Agrobacterium tumefaciens str. C58
MANIAEPKKGFAVSDRQKDIIQKFAALGSLFALVAVFSATSNAFFTVNNGMTIALQVTSIALLGIGATCVIITGGIDLSVGSVLALAGVVAALAVKELGMPVPIGMLLGILTGSLCGLINGLLVTRFKLPPFIATLGMMLIARGVALQITGARAVSGLGESFGELGNGALFRIVTIGDDGFPNVVFPGIPYPVILMVVIALAVSFMLNRSILGRHIYAVGSNADAARLSGVNVARVTNFTYILSGTLAGLTGCVLMSRLVTAQPNEGVMYELDAIASAVIGGTSLIGGVGTISGTAIGAFVIGILRNGLNMNGVSAFTQQIIIGLVILVTVWIDQLRNRR

SEQ ID NO: 40393 - DNA, 1005 bp, Agrobacterium tumefaciens str. C58
  CDS (1)..(1005): transl_table=11
ttgaccgtctataccgaacgcgccaaaggctcgccgctctcggatttcttcgccgagaatgcacaggtgctttccatcgcagccttttttgccctctgcatggtgttcttctccgtgaccacggatacgtttctgacggccggcaatcttctgaacgtcgtccgtcaggccgcaccgatcctgatcgtctccgtcgcgatgacattcgtcatcatcacgggcggtatcgatctgtctgtcggctcgatggtcgccctgatcaacgccgttggcgccatcctgctcgcggccggttacccctggccgctggttgtcgttgccatgctggtgctcggcggcgggcttggcctggtgcagggctggttcattgcctatcaaggtattccggccttcatcgtcacgcttgccggtctctccatcctgcgcggtgtcgccctctacatcacacagggatattccgttccgataccggatgcgccggggttcttttacctcggcaggggtgattttctcggtatgcccgtccctgccctgatcggcgtcgtcgttaccgtgatcgcctatatcgttctttcgagcacccgctatggtcgtcgtgtcgtcgcggtcggctccaatccggaagcggcgcgccgcgtgggaatgcccgccaaatggattctcgcctcggtctatctggccgcaggcgtggcttcagccattgccgggctcatgattgcggcgcggctggggtcaggatcgtcgaatgcggcagtcgggttcgagcttcaggtggtggcggccgtggttctgggcggcacgtcgctgatgggcggacgcggcaccattcttggcacggtactgggcaccatgaccatcgccgttatcggcaacggtcttatcctcatgcacatctctcccttcttcacccagatcgtgacgggcgccatcatccttgccgcaatctggctcaacacacgcatcttcaccgcgaacttccgccttggcgtgaagagaaagggctga

SEQ ID NO: 40394 - protein, 334 aa, Agrobacterium tumefaciens str. C58
MTVYTERAKGSPLSDFFAENAQVLSIAAFFALCMVFFSVTTDTFLTAGNLLNVVRQAAPILIVSVAMTFVIITGGIDLSVGSMVALINAVGAILLAAGYPWPLVVVAMLVLGGGLGLVQGWFIAYQGIPAFIVTLAGLSILRGVALYITQGYSVPIPDAPGFFYLGRGDFLGMPVPALIGVVVTVIAYIVLSSTRYGRRVVAVGSNPEAARRVGMPAKWILASVYLAAGVASAIAGLMIAARLGSGSSNAAVGFELQVVAAVVLGGTSLMGGRGTILGTVLGTMTIAVIGNGLILMHISPFFTQIVTGAIILAAIWLNTRIFTANFRLGVKRKG

SEQ ID NO: 40395 - DNA, 981 bp, Agrobacterium tumefaciens str. C58
  CDS (1)..(981): transl_table=11
atgatccacagccgcaacctgcccttcctcaccacgctgatgatcttcgtgatcgcctatctgctgtgcgtgctgcaatatccggctatcctgtcgacacgggtgataggcaatcttctgaccgacaatgcctttctcggcattgccgccgtcggcatgaccttcgtcatcctgtcgggcggcatcgatctgtccatcggctcggtcatcgccttcaccagtgttttcgtggccgtgatggtcggcacctataatattcacccgcttctggccttcgccatcgtgctcgtggtctccacgctgttcggctgcctgatgggagcgatgatccgcttcctgtcgatcccgcctttcgtggtgacgctggcgggcatgtttctggcgcgcggtgcagcctatctgatctccacgcaatcggtgccgatttcgcaccccttcatcgacgagatccaaggcttttatttccgctttccgggcggtggcaggctgacggcgctcgccatgctgatgctcatcgtctttgccgccggcatgctgattgccagccgcacccgcttcggcgccaatgtctatgcgctgggcggcaacccgcaatcggccgaactgatgggcgttccgatcgggcgcacgacgatcggcatctatgcgctttccggtttcctttccggcctcgctggcatcgtctacacgctctacacctcgtcggggtattcgctggcgacggttggcgtggagctggatgccatcgccgcagtcgtcatcggcggcacgcttctcacaggcggcacgggacttgtggcgggaacctttgtcggcctgctgatccaggggctgatccagacctacatcgtttttgacggaacgctgtcatcctggtggacgaaaatcgtcattggcgtgctgcttttcgtcttcatcgtgttgcagcgcgcaatcatctggtattcaaacaggagactggccggaccacatccggcataa

SEQ ID NO: 40396 - protein, 326 aa, Agrobacterium tumefaciens str. C58
MIHSRNLPFLTTLMIFVIAYLLCVLQYPAILSTRVIGNLLTDNAFLGIAAVGMTFVILSGGIDLSIGSVIAFTSVFVAVMVGTYNIHPLLAFAIVLVVSTLFGCLMGAMIRFLSIPPFVVTLAGMFLARGAAYLISTQSVPISHPFIDEIQGFYFRFPGGGRLTALAMLMLIVFAAGMLIASRTRFGANVYALGGNPQSAELMGVPIGRTTIGIYALSGFLSGLAGIVYTLYTSSGYSLATVGVELDAIAAVVIGGTLLTGGTGLVAGTFVGLLIQGLIQTYIVFDGTLSSWWTKIVIGVLLFVFIVLQRAIIWYSNRRLAGPHPA

SEQ ID NO: 40397 - DNA, 1065 bp, Agrobacterium tumefaciens str. C58
  CDS (1)..(1065): transl_table=11
gtgaggcgcgccgggatttctcgaggaggaacgattatgactacgaacgccgccaacgcacagttggacgcaaaatccggacgcaagccgcaccggcgcatcccgcccgaggccaatatctttttcgtgctgatcggcattgcgctagtttatgaaattctcggctggattttcatcggccagagctttttgcttaaccagcagcgcctgacgatcatgatcctgcaggtatcggtgatcggcataatcgccgttggcgtgacccaggtcatcatcaccggcggtatcgatctttcctccggctccgtcgtcggcctgacggcgatgttggccgccagcgtggggcaatcatccacatggccgcgggcgctttatccggggctgactgatctgcccttcttcattccgctggctgtcggcattctggctggcgcattggccggctttatcaacgggcaacttatagcgcgcacgaaaatcccgcccttcatcgcaaccctcggtatgatggtgacggcgcgtggcctttccaaatggtacaccaagggccagccgatttccggtctgactgacggtttcaccttcatcggtacaggtgtctggccggtcgtggtgttcctcgtcgtcgccatcattttccacgtcgcgctgcgttatacgcgttatggcaagttcacctacgccatcggcgccaaccagcaggcggcccgcgtttccggtatcaatatcgaagcgcatctgatcaaggtctatgccattgccggtctgctggccggtctcgccggcgtcgtcaccgccgcccgtgcacagacagcgcaggccggcatgggtgtgatgtatgaacttgacgccatcgctgcggccgtcatcggaggcacatcgctcgccggcggcgctggccggattaccggaactgtcatcggcaccatcattcttggcgtcatgacttcaggcttcacgttcctcagggtcgacgcctattaccaggagatcgtcaagggcctgatcatcgtggccgccgttgttgccgacgtttaccgccagaagaaacgcgcaaagcgctga

SEQ ID NO: 40398 - protein, 354 aa, Agrobacterium tumefaciens str. C58
MRRAGISRGGTIMTTNAANAQLDAKSGRKPHRRIPPEANIFFVLIGIALVYEILGWIFIGQSFLLNQQRLTIMILQVSVIGIIAVGVTQVIITGGIDLSSGSVVGLTAMLAASVGQSSTWPRALYPGLTDLPFFIPLAVGILAGALAGFINGQLIARTKIPPFIATLGMMVTARGLSKWYTKGQPISGLTDGFTFIGTGVWPVVVFLVVAIIFHVALRYTRYGKFTYAIGANQQAARVSGINIEAHLIKVYAIAGLLAGLAGVVTAARAQTAQAGMGVMYELDAIAAAVIGGTSLAGGAGRITGTVIGTIILGVMTSGFTFLRVDAYYQEIVKGLIIVAAVVADVYRQKKRAKR

SEQ ID NO: 40399 - DNA, 1002 bp, Agrobacterium tumefaciens str. C58
  CDS (1)..(1002): transl_table=11
atgcaacgtctactcaaaaatcgcgaatggctgctggcgggtatcatcatcatcatgattgccggctttgccctgcgcgcgcccggcttcggccggcccggcaatctcgtcaatatcttcaatgacacgtccatcctcatcatcctggcgcttggccagatggcggtcattctcaccaaatccatcgacctctcagtcgccgccaatctcgcctttaccggcatggcggtggcgatgaccaatgccgcctttccgggcgtacccctgccgctgctcatcgtcatggcggtcggcatcggcgcgtttctgggctcgctcaacggtatcctcgtctggtggctcggcattccgcccattgtcgtgacgctcggcacgctcaccatctatcgcggcatggctttcgtgctctcgggcggcggttgggtgaatgcgcatcagttttcgccgaccttcctcaacgtgccgcgcacgatgatccttggcatgccggttctgtcttgggtcgccattctcatcatcgcgggagcctggctggtgctcacccgtacctctttcggccgctcagcctatgcgtccggcggcaacccgggtgcggcggtctatgcgggcatcgatgtcggccgcacgcgcttcttcgccttcgtgctctcaggcgctctggctggcctcgccagctatctctgggtgtcgcgttacgccgtcgcctatgtagatatcgccgccggtttcgagctggacagcgtggcggccaatgtaatcggcggcatttcgattgccggcggtatcggctcggtggccggtgcggtgctcggcgcgctgttcctcggcgtcatcaagaacgcgctgcccgtcatcggcatctcgcccttcgcgcagatggcgatatcaggcgtggtcatcgtgctcgccgttgtcttcaacgcccgcgccgaagccagaaaaggccgtatcatcctgcgtgaccgggccgcggcagaccatgggaaggaagcatctgcatga

SEQ ID NO: 40400 - protein, 333 aa, Agrobacterium tumefaciens str. C58
MQRLLKNREWLLAGIIIIMIAGFALRAPGFGRPGNLVNIFNDTSILIILALGQMAVILTKSIDLSVAANLAFTGMAVAMTNAAFPGVPLPLLIVMAVGIGAFLGSLNGILVWWLGIPPIVVTLGTLTIYRGMAFVLSGGGWVNAHQFSPTFLNVPRTMILGMPVLSWVAILIIAGAWLVLTRTSFGRSAYASGGNPGAAVYAGIDVGRTRFFAFVLSGALAGLASYLWVSRYAVAYVDIAAGFELDSVAANVIGGISIAGGIGSVAGAVLGALFLGVIKNALPVIGISPFAQMAISGVVIVLAVVFNARAEARKGRIILRDRAAADHGKEASA

SEQ ID NO: 40401 - DNA, 1314 bp, Agrobacterium tumefaciens str. C58
  CDS (1)..(1314): transl_table=11
atggccgacatgacacaatccaattccacgacgtcccccaagacggaaaagaccggctcgatttcgcgtttcatcagtgccacggagctcgatacgcggctgcttggcatggtcggcgcgcttcttctgatctggatcggtttccatattctttcgggtggactgttcctgacgccgagaaacctctggaacctctccgtccagaccgcttcggtcgcggtgatggcgacgggcatggtgcttgttatcgttacccgcaacatcgatctgtcggtcgggtcgatcctcggcttttccggcatgatcatgggtgtcatgcaggcggaaatcctgccgcaaatcctcggcttcgaacattgggcgacatggatcgtcacgcttctggtcggtattctcgtcggcggcgcaatcggcatgctgcagggctcgatcatcgccttcctcaacgtgccgtccttcatcgtaacacttggtggcctgctcgtctggcgcggcggcacctggttcgtcaccagcggccgcaccgtggcaccgatggattccaccttccgcctgatgggcggcggcaccagcggctcgatcggcgcgacatggagctggatcgcagcgatcgtcgcctgcgtcgctattgtcgcggcgatcctcaattcccgtcaccagcgccgccgtttcggctttccgctgcggcccgtctgggcggaatatttcctggtggcgcttggctgcttcgtcgtcgtcggtttcgtggctgtcgtcaacagctatccctggccgatcaacattgcccgcaactatgccgatgccaatggcatagcctggccggatggcggcctgttcattccgcacggcattgccattcctgtgctgatggcgctcgcagtcggtgccgtcatgaccttcatcgcgacgaggctgcgcttcggacgttatgttttcgccatcggcggcaacccggaagcggcggaactggccggcatcaagacccgctgggtcacggtgaagatattcacgctgatgggcgttctgtgcgccatcgccgcggcaatttccactgcccgcctcaacgctgccaccaatgcccagggtgaactcgacgaactttatacgatcgcggccgcggtcatcggcggcacctcgcttgccggcggcgtcggcaccatagcgggcgcgatgctcggcgcgctcgtcatgcaatcgctgcaatccggcatggtgctggtgggcatcgatacgcccttccagcgcatcgtcgtcggtgtggtcctggtcgtcgccgtctggctcgacaccatctaccgcgcccgcgccaagtaa

SEQ ID NO: 40402 - protein, 437 aa, Agrobacterium tumefaciens str. C58
MADMTQSNSTTSPKTEKTGSISRFISATELDTRLLGMVGALLLIWIGFHILSGGLFLTPRNLWNLSVQTASVAVMATGMVLVIVTRNIDLSVGSILGFSGMIMGVMQAEILPQILGFEHWATWIVTLLVGILVGGAIGMLQGSIIAFLNVPSFIVTLGGLLVWRGGTWFVTSGRTVAPMDSTFRLMGGGTSGSIGATWSWIAAIVACVAIVAAILNSRHQRRRFGFPLRPVWAEYFLVALGCFVVVGFVAVVNSYPWPINIARNYADANGIAWPDGGLFIPHGIAIPVLMALAVGAVMTFIATRLRFGRYVFAIGGNPEAAELAGIKTRWVTVKIFTLMGVLCAIAAAISTARLNAATNAQGELDELYTIAAAVIGGTSLAGGVGTIAGAMLGALVMQSLQSGMVLVGIDTPFQRIVVGVVLVVAVWLDTIYRARAK

SEQ ID NO: 40403 - DNA, 984 bp, Agrobacterium tumefaciens str. C58
  CDS (1)..(984): transl_table=11
ttgaacatgtcgcttgatgcaaacaccggcgttgccgcgaaaacgggcggtttcagtttcagtgccatgctgcgctcgccgctcgccctgccgctggcgggtctcatcgtcgtatccatcctcatgggtcttgcgagcgacaatttcttcagcgtcaacaacatcatgaacgtgctgcggcaggtttccgtcgttggcattctcgctgttggcatgaccttcgtcatcctgaccggcggcatcgatctttcggtcggtgcggtcatggcgctggtcggcacgctgtcggccggcctgatggtgaatacgggcctgtctcccgcgattgccctgccggccggcctcttcatcgggctcggcattggcatcttcaacggggcgctggtcgcttggggcaggatgccggccatcatcgtcacgctcgccaccatgggcatggcccgtggcctcggcctcatctattccggcggctacccggtcagcggcattccgagctggatttcctggttcggcgttggccgcgtcggcatcgttccggtgcccgtcatcatcatggtggtgatctatgcggtggcctgggtgctgttgcagcgcacagccttcggccgccacgtctatgcgcttggcggtaacgaactggcggcccgtctttcgggtgtgaagacccggcgcgtcaagcttgccgtctatggcatctcgggtgtcacggcagctttcgccgccctcatactgaccggtcgcctgatgagcggccagcccaatgccggcgtcggcttcgaactggacgccattgcggcggtcgttctgggcggcacggcgattgccggcggcaggggcctcatcctcggcacgctcatcggcgcggtgctgcttggcatcctcaataacggcctcaacctgatgggcatcaacccctatcttcaggatgtcatcaagggcggcatcattctgttggccatctatatcgggcgcgaatggcgctga

SEQ ID NO: 40404 - protein, 327 aa, Agrobacterium tumefaciens str. C58
MNMSLDANTGVAAKTGGFSFSAMLRSPLALPLAGLIVVSILMGLASDNFFSVNNIMNVLRQVSVVGILAVGMTFVILTGGIDLSVGAVMALVGTLSAGLMVNTGLSPAIALPAGLFIGLGIGIFNGALVAWGRMPAIIVTLATMGMARGLGLIYSGGYPVSGIPSWISWFGVGRVGIVPVPVIIMVVIYAVAWVLLQRTAFGRHVYALGGNELAARLSGVKTRRVKLAVYGISGVTAAFAALILTGRLMSGQPNAGVGFELDAIAAVVLGGTAIAGGRGLILGTLIGAVLLGILNNGLNLMGINPYLQDVIKGGIILLAIYIGREWR

SEQ ID NO: 40405 - DNA, 1164 bp, Brucella melitensis 16M
  CDS (1)..(1164): transl_table=11
gtgatcgtggctgcaagaatgcctgaggaaaagatgatgagcgaacccaattccgaaacgaaggccgcagcggcggcacccgccgatgagcggctgaaatcggccagcaccttgcagcgcctgttgagcaggccggaactgggcgcggtgtccggtctggttctcatcacgatcttctttgtttcaaccgccaattcggccatgtttaccgcagccgggatcatgaatttcatggccccggcctcgcagctcggtattcttgctgtcgcagcggcgctgttgatgatcggcggcgagttcgatctttccattgggtctatggtggcctttgccggcctgatttttgccgcagcccttgtcgtctggcaggtgccgcttgccgttgccattatcgttaccttgctgtttgcggcgctggtgggggcggtgaatgcgcagatcgtcatcagaacgggtctgccgtcctttatcgtcacgctggcctttctcttcatattgcgcggcctttcgcttgtcgggctgaagtgggcaaccggcggtgcgacgcagctgcgcggtgtgaaggaagcggtcagcggcagctatctggccggcctcttttccggcgatgcatttccggggcttttcgcatggctggcggaaaaggatttgattgcgaaatttccaaatggcgagccggcagtgaaaggtgtgccggtcgaggtgctgtggtttgtcgtgattgcccttgtcgcgacctatattctggtgcgcacccgcttcggcaactggatttttgcggcgggcggcgatgcgcttgccgcgcgcaattccggtgttccggtgcgccgcgtcaaaaccacgctcttcatgtgcacggccatggaggcagcacttgtggctatcctgactgttctcgatgccgggtccaccgatgcacggcgcggtttccagaaagaattcgaggcaatcatcgcggccgtgatcggcgggtgcctgctgaccggcggttatggctcggccatcggcgctttcttcggcgcgatcattttcggcatggtgctgatcgggctgacctatacgcagatcgaccaggactggtatcttgtgtttctcgggggaatgcttctgatcgctgtgctcttcaataatttcatccgcaagcacgccacgggcgagcgttga

SEQ ID NO: 40406 - protein, 387 aa, Brucella melitensis 16M
MIVAARMPEEKMMSEPNSETKAAAAAPADERLKSASTLQRLLSRPELGAVSGLVLITIFFVSTANSAMFTAAGIMNFMAPASQLGILAVAAALLMIGGEFDLSIGSMVAFAGLIFAAALVVWQVPLAVAIIVTLLFAALVGAVNAQIVIRTGLPSFIVTLAFLFILRGLSLVGLKWATGGATQLRGVKEAVSGSYLAGLFSGDAFPGLFAWLAEKDLIAKFPNGEPAVKGVPVEVLWFVVIALVATYILVRTRFGNWIFAAGGDALAARNSGVPVRRVKTTLFMCTAMEAALVAILTVLDAGSTDARRGFQKEFEAIIAAVIGGCLLTGGYGSAIGAFFGAIIFGMVLIGLTYTQIDQDWYLVFLGGMLLIAVLFNNFIRKHATGER

SEQ ID NO: 40407 - DNA, 1170 bp, Brucella melitensis 16M
  CDS (1)..(1170): transl_table=11
atgacgttgacaggcaaaagcctcagaaaatttctctcagaatacaaaatcgtggcactgctgattgttgtcgccctgatctgggcattcttcgccatcatgacctacgatcccgagatgggccggtcgcagtttctcaccgcgcgcaatttctccaatcttttgcgccagatggcaatcaccggcatgctggcttcagccatggtgtttgtcatcgtggcgggtgaaatcgatctgtcggtgggggctttgctcggcctgttaggcggtgtcgcggcggtgctcgatgtggtttacggctggccgttatgggccactatcgctacggttctggtgctgggtggagtgcttggcggtttcaacggctggctcaccgcctatctcggcattccgtccttcatcgttacgctgggcgggcaattggtgtttcgcggtattgtgctgggtatcatgggcggtgtcaccattgcgccgatttcgcccgagttcaaatatatcgggcaaggctatttgcccggctggcttggcaatgtctgtgccatggcgctgtttacagtgcttgtcctgattacgctcagaacccgttccagcaagcgcaaacacaatttgcaaacgctttcaccggcgatggaaaccgctcgccttctgggcacgggtatcctgatccttggttttatcctggtcctcaacagctatcagggcgtaccggttccggttcttgtgctgctggttattcttggcgtcttcaccgttatttcccgccagactgttttcggccggcatatttatgcggtcggttccaatcctgaagccacgcgcttttccggtgtcaacgtgaatttcgtcaaaatggccgtgtttgcgctgatgggacttatggcggcagtggcgggcctcaccacgactgcgcgccttgcggccggtacgccatcggcaggtttgggcggcgaacttgatgccatcgcatcatgctttatcggcggcacatccatgcgcggcggcgtgggatccgtgattgctgcgctggtcggtgcgcttatcatgtcaagcctcgataatggtatgtcgatgctgggcgtcgatacattctggcagcaaatcatcaagggcagtattcttgtgctggccgtttatctcgatatcgtatcatcaggcacacgtcgcgcctga

SEQ ID NO: 40408 - protein, 389 aa, Brucella melitensis 16M
MTLTGKSLRKFLSEYKIVALLIVVALIWAFFAIMTYDPEMGRSQFLTARNFSNLLRQMAITGMLASAMVFVIVAGEIDLSVGALLGLLGGVAAVLDVVYGWPLWATIATVLVLGGVLGGFNGWLTAYLGIPSFIVTLGGQLVFRGIVLGIMGGVTIAPISPEFKYIGQGYLPGWLGNVCAMALFTVLVLITLRTRSSKRKHNLQTLSPAMETARLLGTGILILGFILVLNSYQGVPVPVLVLLVILGVFTVISRQTVFGRHIYAVGSNPEATRFSGVNVNFVKMAVFALMGLMAAVAGLTTTARLAAGTPSAGLGGELDAIASCFIGGTSMRGGVGSVIAALVGALIMSSLDNGMSMLGVDTFWQQIIKGSILVLAVYLDIVSSGTRRA

SEQ ID NO: 40409 - DNA, 1191 bp, Brucella melitensis 16M
  CDS (1)..(1191): transl_table=11
atgagcgagaatgtaatccagagcggccagcagagcagcgtggggcgctatctcaagaacaatctgcgtgaatccgggatgctgctttcgctcgttgcaatcatgatcttcttccatatcgtgaccggcggcgttctcatgaagccgctgaacctcaccaatctcgttttgcagaacagctatatcgtcatcatggcgcttggaatgctgctcatcatcgtcacgggccatatcgatctttcggtcggttcggtctgcggctttatcggggcgctcgctgccgtcatgatggtaaagctcggcattccctttcccattgcggccattctctgcctcattgtcggcgggttgatcggcgcgatccagggtttttgggtcgcctatttcaatatcccctccttcattgtgacattggccggtatgctcgtgttcaaggggctgatgcttgccgttctgggcggacagtcggtcggaccttttccggtcgtgttccagaagctctcgtcgggcttcattccagaggtgatcggcacgtttgacggcgtttatctcacctcgctcatcatcggcgttctgcttgcggttttcctcatctggcagagcatgcggtcgcgcgcgcgccatattgcccatgaggtggagaccgagcccttcggccttttcgtggtcaagtgcatcctctatttcgtcgcaattgcctatctttcgctgctcatttcctcacatcgcggtatgccgaacgtactcatcatcatggcggtgctgattgccgcctatgcgtttctcaccaatcgcaccgtgatcggccgccagatctatgcggtgggcggcaatcgtcacgccgccaagctttccggcgtgaaaaccgagcggctgacgtttctcaccttcgtcaatatgggtgtgctggcagcacttgcgggtctcgtcttcgccgcccgtctcaatacggcgacgccgaaagctggcatcggctttgaactggacgtcatcgcggcctgcttcatcggtggcgcttcggcctatggcggtgtggggcgggttacgggtgccgtgatcggcgcgctcatcatgggcgtgatgaacaacggcatgtcgatcctcggcatcggtatcgactatcagcaggtcatcaagggtatcgtgctgctgggggcggtttgtatcgacgtctataaccagaaacgctga

SEQ ID NO: 40410 - protein, 396 aa, Brucella melitensis 16M
MSENVIQSGQQSSVGRYLKNNLRESGMLLSLVAIMIFFHIVTGGVLMKPLNLTNLVLQNSYIVIMALGMLLIIVTGHIDLSVGSVCGFIGALAAVMMVKLGIPFPIAAILCLIVGGLIGAIQGFWVAYFNIPSFIVTLAGMLVFKGLMLAVLGGQSVGPFPVVFQKLSSGFIPEVIGTFDGVYLTSLIIGVLLAVFLIWQSMRSRARHIAHEVETEPFGLFVVKCILYFVAIAYLSLLISSHRGMPNVLIIMAVLIAAYAFLTNRTVIGRQIYAVGGNRHAAKLSGVKTERLTFLTFVNMGVLAALAGLVFAARLNTATPKAGIGFELDVIAACFIGGASAYGGVGRVTGAVIGALIMGVMNNGMSILGIGIDYQQVIKGIVLLGAVCIDVYNQKR

SEQ ID NO: 40411 - DNA, 1197 bp, Brucella melitensis 16M
  CDS (1)..(1197): transl_table=11
gtgcgccacgataaaggcgtttctggcgccatccgcacctttatcgaccgggtcaagtcgggcgatctcggttcattgccggtcattattggccttctcatcatctggacagttttccagacgttgaacccggttttcctttccagcaacaacctcgtgaacctgctattcgattgctcgaccatcggcgtcatttcgctcggcatcgtctgcgtattgatgctgggtgagatcgacctttcggtcggttccattagtgggctttcttcggctatcatcggtgtattatgggtcaataatggctggccggtgggcgtcgccatcattgcagcactttgcgcaggcgcactggctggcttcctctacgcgctcctctataaccgcttcagcatgccaagcttcgtttccacactggctgggctgctcgcagcccttgggcttcagctttacctcctcggcaatacaggctccatcaatctgccttacggttcgtggctggtcagcttcggccagcttctggtaatgccgcgtccgctttcttatgcgctggcgctggtcgcgggacttgcgatctttttcacgggttttcgcgccgcgcagcgccgccgcacggcagggctttccgctccctcggctgcgggcattgcgctcaaagctttggtcatcacgctcattatcggctgtggggtattttatctcaaccagtcgcgcggcgtgccatggatgtttgccctgttcgtggcgctggtgatcgcgatgaactatgcgcttacgcgcaccagatggggccgctgcgtgcaggcggttggcggcaatcgcgaggctgcgcgtcgtgccggcatcaatgtgaatttcatctatgtctcggccttcatggcctgctccacactcgcggctgccggtggtatcatggcggcggcgcgtctggcctcatccagccagcaggcaggcaccggtgacgtcaacctcaatgctatcgcggcagcggttatcggcggtaccagcctattcggcgggcgcggcagcgcgtggtcggccctgctcggtattatcgtcatccagtcgattgcgagcggtttgacgcttctcgatctgtcgtcttcgcttcgctacatgattacgggtgcagtgcttgccatcgccgtgattgtcgattcccttgcccgccgttcgcgccagtcgcacggccgcgcctag

SEQ ID NO: 40412 - protein, 398 aa, Brucella melitensis 16M
MRHDKGVSGAIRTFIDRVKSGDLGSLPVIIGLLIIWTVFQTLNPVFLSSNNLVNLLFDCSTIGVISLGIVCVLMLGEIDLSVGSISGLSSAIIGVLWVNNGWPVGVAIIAALCAGALAGFLYALLYNRFSMPSFVSTLAGLLAALGLQLYLLGNTGSINLPYGSWLVSFGQLLVMPRPLSYALALVAGLAIFFTGFRAAQRRRTAGLSAPSAAGIALKALVITLIIGCGVFYLNQSRGVPWMFALFVALVIAMNYALTRTRWGRCVQAVGGNREAARRAGINVNFIYVSAFMACSTLAAAGGIMAAARLASSSQQAGTGDVNLNAIAAAVIGGTSLFGGRGSAWSALLGIIVIQSIASGLTLLDLSSSLRYMITGAVLAIAVIVDSLARRSRQSHGRA

SEQ ID NO: 40413 - DNA, 1029 bp, Clostridium perfringens str. 13
  CDS (1)..(1029): transl_table=11
atgcaaaccaaatcaaagaaaaagtttaatttaaatagccaatggttaatgaataatgctatttatatagttttagtggccttattaataggaatttgtattatttcaccagattttttatcattaaaaaactttattaatatattaagccaatcctcttctcgtataataatagctcttggagttggaggaatacttttaactgaaggtactgacctttctgctggtagaacagttggacttgctgccgtagtatcagcttctttacttcaagctggagattatgcatataaaatgtatcctaatttacctgaattacctatattcattccaattttaatagcaatggctgtttgtggaatagttggtcttgtaaatggattagttgtttctaaatttaatgttcctccatttatagctactctaggaatgatgacaggaatatatggacttaactcaatatactttgatagacctccatatggagctatgccaataggtggtcttagccaatcctttagtaattttacacttggttccattcctatatatggaaatataaaaataccttatttagttatatatgcaattattgtaatagctgtaatttggactttatggaataaaactaaatttggtaaaaacctttatgccataggtggtaacagagaagctgcagtggtttcaggtgtaaatgttgttagaacacttttattagtttatatgttagctggagttctttatggttttgcaggtactctagaagctggtcgtgttggtagtgctactgctagtactggtgaaatgtatgaactagatgccatagcttcctgtgttgttggtggtgtttccactgctggtggtgttggtactgttcctggaatagtaactggtgttttaatattccaagttataaactatggtctagcttttataggtgttagcccttatttacaattcgttataaaaggtttaattatagttctagctgtagctcttgatatgagaaaatacatgaaaaagaactaa

SEQ ID NO: 40414 - protein, 342 aa, Clostridium perfringens str. 13
MQTKSKKKFNLNSQWLMNNAIYIVLVALLIGICIISPDFLSLKNFINILSQSSSRIIIALGVGGILLTEGTDLSAGRTVGLAAVVSASLLQAGDYAYKMYPNLPELPIFIPILIAMAVCGIVGLVNGLVVSKFNVPPFIATLGMMTGIYGLNSIYFDRPPYGAMPIGGLSQSFSNFTLGSIPIYGNIKIPYLVIYAIIVIAVIWTLWNKTKFGKNLYAIGGNREAAVVSGVNVVRTLLLVYMLAGVLYGFAGTLEAGRVGSATASTGEMYELDAIASCVVGGVSTAGGVGTVPGIVTGVLIFQVINYGLAFIGVSPYLQFVIKGLIIVLAVALDMRKYMKKN

SEQ ID NO: 40415 - DNA, 936 bp, Clostridium perfringens str. 13
  CDS (1)..(936): transl_table=11
atgaaagcgaatgttaaagcaaatatatctaaatataaatcccttataggactagtattattatgtatagttattactatagttactccaaactttttaagtgtatctaatataactaacgtatttacacaggtttcagttaatgcaatcatagcaataggtatgactttcgtaattttaactggtggaatagacttatcagttggatctactttagctattagtggtgccgtaggggcttctattgttaagtcgactggaaacgtattcttagcaattatagtggcagctgttattggtatagcagttggattaataaatggtttattagtatcaaaaggaaaactacaagcattcatagttactttagctacaatgacaatatttagaggagctactttagtatttacagatggtactccaatatcaaaattacctgaagcttttgttaaaataggaaatggtaaacttggatttatgccaataccagttataataacaataataatagcaatcatagcagtatatgctttatcacaaacaagatttggaagatatttatatgctttaggtggaaatgaagatgcttcaagattatcaggaataaatacagataagataaaaactttagtttatgtggtatcaggttttgcctcagctattgcaggggtaataataacaagtagaataggatctgcttcacctaatgcaggaacaggatttgaattagatgctatcgctgctgtagtaataggaggaacttctttagcagggggagaaggaacaatcacaggtactttaataggtgctcttattataggtgtacttaataatggattaaaccttatgaatgtatcaccattctatcaatcaatagtaaaaggtttagttatattaatagcagtacttttagataaaaagagcagaaaaaattaa

SEQ ID NO: 40416 - protein, 311 aa, Clostridium perfringens str. 13
MKANVKANISKYKSLIGLVLLCIVITIVTPNFLSVSNITNVFTQVSVNAIIAIGMTFVILTGGIDLSVGSTLAISGAVGASIVKSTGNVFLAIIVAAVIGIAVGLINGLLVSKGKLQAFIVTLATMTIFRGATLVFTDGTPISKLPEAFVKIGNGKLGFMPIPVIITIIIAIIAVYALSQTRFGRYLYALGGNEDASRLSGINTDKIKTLVYVVSGFASAIAGVIITSRIGSASPNAGTGFELDAIAAVVIGGTSLAGGEGTITGTLIGALIIGVLNNGLNLMNVSPFYQSIVKGLVILIAVLLDKKSRKN

SEQ ID NO: 40417 - DNA, 915 bp, Corynebacterium glutamicum ATCC 13032
  CDS (1)..(915): transl_table=11
atgctcaataacggtgcgttggtggggctgattgcactgtgtgttggactttttattgcaacaccccactttctcaccattcctaacctgatcaacatcggtatccaatcggcgacggtggcgatcctggcgttcggcatgaccttcgtcatcgttaccgcaggcattgatttgtctgtgggatcagtggctgcgttgggtgcgatgacctcggcgtatttcttcgcggaagttggtttgccgggctggatcacgctgctgattggcctgttcatcggattgttggcgggtgcgatctctggcatttctattgcttatggcaagttgcctgcgtttattgccaccttggccatgatgtcgatcgccaggggaatcaccttggtcatttcccaaggctcaccaattcccagtgcaccagctgtgaacgctttggggcgcacctactttggcatcccgatgccgattctgatgatggcactggctggcattgtgtgttggtttattttgagccgcaccgtgctgggacggtccatgtacgccattggcggaaacatggaagcagcccgactatctggtctgccagtgaagaaaatcctggtcatggtctatgcactggctggtgtgtatgcagcacttgcgggtctggtcatgacgggacgcttgtcgtccgcgcagccgcaggcaggcgtgggatacgaactcgatgcgattgccgccgtggtcattggtggtgcgtcacttgctggcggaaccggaaaagcaacgggcactttgattggtgccatcttgttggccgtgatccgcaatggcttgaacattttgaacgtgtcctcgttctggcagcagattgtcatcggttgtgtcatcgcgcttgcggtgggcttcgatgtcatccgaaacaaaacctctaagtaa

SEQ ID NO: 40418 - protein, 304 aa, Corynebacterium glutamicum ATCC 13032
MLNNGALVGLIALCVGLFIATPHFLTIPNLINIGIQSATVAILAFGMTFVIVTAGIDLSVGSVAALGAMTSAYFFAEVGLPGWITLLIGLFIGLLAGAISGISIAYGKLPAFIATLAMMSIARGITLVISQGSPIPSAPAVNALGRTYFGIPMPILMMALAGIVCWFILSRTVLGRSMYAIGGNMEAARLSGLPVKKILVMVYALAGVYAALAGLVMTGRLSSAQPQAGVGYELDAIAAVVIGGASLAGGTGKATGTLIGAILLAVIRNGLNILNVSSFWQQIVIGCVIALAVGFDVIRNKTSK

SEQ ID NO: 40419 - DNA, 1020 bp, Fusobacterium nucleatum subsp. nucleatum ATCC 25586
  CDS (1)..(1020): transl_table=11
atgattgcaagaactaatgaaggaaaaatagattataaaaaaattattatagaaagtggactgtatcttgtattattttgtatgcttgttgcaataataataaaagagcctacttttttaagtttaagaaactttaaaaatattcttacacaatcatctgtaagaacaattattgcacttggtgttgctggacttatagtaacacaaggtactgacttatcagcaggtagacaagttggactttctgctgtaatttctggaacacttttacaatcaatgacaaatgtaaataaagcatttccaaaattaggagaattttcaatatttacaactatattgattgttgttgtagttggtgtagttatagcaagtataaatggagtggttgttgctacattaaatgttcacccatttatagctactatgggaacaatgactattgtgtatggaataaactctctttactatgataaagcaggagctgctccaatttctggatttgtagaaaaatatagtaaatttgcacaaggttatataaaaataggctcatatacaataccatatttaattatctatgcagctattgcaacattaattatgtggactttatggaacaaaacaaagtttggtaagaatgtatttgcagttggaggaaatccagaagctgcaaaagtatcaggagtaaatgttgttttaactcttatgggaatttatgcattatctggagcgtattatgcttttggtggtttcttagaagctggacgtattggttctgcaactaacaacctaggatttatgtatgaaatggatgctatcgctgcctgtgtaattggtggagtttcattctatggtggtgttggtagaatttctggagttatcacaggagttataattttaacaattataaactatggacttacttatacaggtgttagcccatactggcaatatattataaaaggtataataattgttactgctgttgcatttgactctattaaatatgctaagaaaaaataa

SEQ ID NO: 40420 - protein, 339 aa, Fusobacterium nucleatum subsp. nucleatum ATCC 25586
MIARTNEGKIDYKKIIIESGLYLVLFCMLVAIIIKEPTFLSLRNFKNILTQSSVRTIIALGVAGLIVTQGTDLSAGRQVGLSAVISGTLLQSMTNVNKAFPKLGEFSIFTTILIVVVVGVVIASINGVVVATLNVHPFIATMGTMTIVYGINSLYYDKAGAAPISGFVEKYSKFAQGYIKIGSYTIPYLIIYAAIATLIMWTLWNKTKFGKNVFAVGGNPEAAKVSGVNVVLTLMGIYALSGAYYAFGGFLEAGRIGSATNNLGFMYEMDAIAACVIGGVSFYGGVGRISGVITGVIILTIINYGLTYTGVSPYWQYIIKGIIIVTAVAFDSIKYAKKK

SEQ ID NO: 40421 - DNA, 957 bp, Thermoanaerobacter tengcongensis MB4
  CDS (1)..(957): transl_table=11
ttgaagctaccgaacgaaaaagcaatgaaaataaatattggtgagttgcttttaaaagcgaaatctttaataggtttattgggattaattatcgcgttttcaatattatctccacgttttttggattactataaccttacaaatgtattaagacaaacctctctaaatgcaataatggctgtagggatgacatttgtgatattgacaggtgggatagacctatctgtgggttctatattggcgttttcaagtgcagttacagccggtatgttgaaagatggtatgcccctaatcatagctttattggcgggattgataataggtactggtttaggattgtttaatggttttgttataatcaggtggaatattcctccatttattgctacatttgctatgatgacaatagcaagagggcttacgcttgtgtatactaatggccaaccaataactggcttaggaaaagctttcggatatatcggcaatgggtatgttggttccattcctgttccaataattatcacaattctcgtttttgtaataggatactatattttaaaaaacaacagattaggaagatatgtatatgcaaccggaggaaatttacaagctgctaaactggcaggaattaatactaataaaataattctatttgtatatgctttaagtggttttttagcagcagtaagtggcttaataattacttcaagattaaactcagctgccccaacagctggacaaggtgcagagcttgatgcaatagctgctgttgtactaggaggtacaagtttatctgggggcgaaggtggaataattgggactttgataggtgctttaataataggtgtgttgaacaatggtctgaatttgcttaacgtttcacctttttatcaatatattgtaaaaggtgtagtaatattacttgctatagctttagacaaaaaagaaagtgagtaa

SEQ ID NO: 40422 - protein, 318 aa, Thermoanaerobacter tengcongensis MB4
MKLPNEKAMKINIGELLLKAKSLIGLLGLIIAFSILSPRFLDYYNLTNVLRQTSLNAIMAVGMTFVILTGGIDLSVGSILAFSSAVTAGMLKDGMPLIIALLAGLIIGTGLGLFNGFVIIRWNIPPFIATFAMMTIARGLTLVYTNGQPITGLGKAFGYIGNGYVGSIPVPIIITILVFVIGYYILKNNRLGRYVYATGGNLQAAKLAGINTNKIILFVYALSGFLAAVSGLIITSRLNSAAPTAGQGAELDAIAAVVLGGTSLSGGEGGIIGTLIGALIIGVLNNGLNLLNVSPFYQYIVKGVVILLAIALDKKESE

SEQ ID NO: 40423 - DNA, 1191 bp, Thermoanaerobacter tengcongensis MB4
  CDS (1)..(1191): transl_table=11
atgagatctttttatgggcatttaaaagagtttttaagggaaaatgtcagagactatgcaatgtttattgctttattggttataatgatagtttttgcaattctctctggcggcgattttctcctgcccgttaatataagcaacttggtggatcagacaggttatattgcggttttgtcaattggggagaccttgataatagtcatacgtcatatagacctttctgtagggtttttgtcaggatttttaggggcaattgccgccattctgatgcagtttcaccatttttcagcttttactgctatactcatagtcctgatattgggtactttagcagggcttttaaacgggtcattggtagcttatcttagaattcctgcttttgtggcaacactagcaggatggcttgcttatagaggagcacttcttcttgctacaaaagggcctggtaccataataataacaaataagacctttaatgctataggaaatgacttcataccagatttgccttttttgaagaatttcatgccaggttatcacaaactcacccttttgataggcataataggagtagtgttaattgtatatttttcgcttaagaacagaaatgagcaagcaagaaggggatttgatgtactgccatgggatatgttccttttaaaaatggtatttataagtgggctgttgttgtatttgacctttactttggctcgctacagaggtatttcctggacatttgtaatagttttgattgtaacagcagtatacagttttataacaaatagaacggtattaggaaggcatatatacgctgtagggggaaaccctgaagcagctgcgttaagtggtatagacgttaataagataactctcattgtatttgcctccatgggatttctctcagggctttctggagtactttttgcatccagacttcaatctgctacgactactgccggtaccttgtttgagctttacgctattgctggtgccttcataggaggagtgtcagcaagcggcggtgtgggtaaagttgtaaattctctcattggagcttttgtgatgagtaccttgacaaacggcatgaacttgctgggagtcgatatttcacttcagtatataattttagggctggttttagctacagctgtgatattcgatgtggcaactagaagcagaggaagataa

SEQ ID NO: 40424 - protein, 396 aa, Thermoanaerobacter tengcongensis MB4
MRSFYGHLKEFLRENVRDYAMFIALLVIMIVFAILSGGDFLLPVNISNLVDQTGYIAVLSIGETLIIVIRHIDLSVGFLSGFLGAIAAILMQFHHFSAFTAILIVLILGTLAGLLNGSLVAYLRIPAFVATLAGWLAYRGALLLATKGPGTIIITNKTFNAIGNDFIPDLPFLKNFMPGYHKLTLLIGIIGVVLIVYFSLKNRNEQARRGFDVLPWDMFLLKMVFISGLLLYLTFTLARYRGISWTFVIVLIVTAVYSFITNRTVLGRHIYAVGGNPEAAALSGIDVNKITLIVFASMGFLSGLSGVLFASRLQSATTTAGTLFELYAIAGAFIGGVSASGGVGKVVNSLIGAFVMSTLTNGMNLLGVDISLQYIILGLVLATAVIFDVATRSRGR

SEQ ID NO: 40425 - DNA, 975 bp, Thermoanaerobacter tengcongensis MB4
  CDS (1)..(975): transl_table=11
atgcaaaatttggataaaaaagtagtaacttcggaaccaaataacaaaagaaaattttctactagattacaattattttctacgtggggagcgcttgctattttggtagtatttttcagtattacttctgacaagtttttaacagtagataatttgttaacagtagctttgcaaacctctataatagcaataatagcaatgggccaaacttatgtaattattactggtggtatagatctttctattggttccaatatagcgttaggtggtgtggtagcagcgcttttaatggctaatggattttctattcctgtttctatagtgatagcattattggtaggactatttgtaggaacgttaaatggtacattgattgcatacggtaagattcctcctttcatagtaactttgggagcaatgagtataattagagggacggcatatgtgttaacaggtggtattccaataacaaacgtgccactagaattttctgcttttgggatggggagaatactcagaataccagtgcctgttataataatggtcatcttgattgcaatttttggttttatcctcgcaaaaactaaattaggtagatacatttatgcagtgggaagcaatagagaagcagctcgattagcaggaataaatattcctacagttttaattgcagtatatgcaataagtggatttttagcagtatgggctggaataattgtagctggtaggataatttcaggtcaaccggcagctggaatgggctatgaattagatgctgtagctgcttcagttataggtggggcaagtctttttggtggtgaaggaactattttaggaacaattgcaggtgcttttgtaatgggtgtgttaagaaatggtttaaacttgttaaatgtgtctgctttttggcagcaaatcataattggagctgtaattatcggagcagtgttcttagatactataagaaggcgttag

SEQ ID NO: 40426 - protein, 324 aa, Thermoanaerobacter tengcongensis MB4
MQNLDKKVVTSEPNNKRKFSTRLQLFSTWGALAILVVFFSITSDKFLTVDNLLTVALQTSIIAIIAMGQTYVIITGGIDLSIGSNIALGGVVAALLMANGFSIPVSIVIALLVGLFVGTLNGTLIAYGKIPPFIVTLGAMSIIRGTAYVLTGGIPITNVPLEFSAFGMGRILRIPVPVIIMVILIAIFGFILAKTKLGRYIYAVGSNREAARLAGINIPTVLIAVYAISGFLAVWAGIIVAGRIISGQPAAGMGYELDAVAASVIGGASLFGGEGTILGTIAGAFVMGVLRNGLNLLNVSAFWQQIIIGAVIIGAVFLDTIRRR

SEQ ID NO: 40427 - DNA, 1245 bp, Streptomyces coelicolor A3(2)
  CDS (1)..(1245): transl_table=11
atgagcacggacgtgaccgccaagaccccggcaccggcgccgcccggcagagagggctcggcctccggcggcgggctgctgcagctgatgctcgacggcatgcgccgcaacatgcgccagtacggcatgctgatggccctcggtctgatcgtggtgctgttcgcggtgtggtcggacggcgacctgctgctgccgcgcaacgtctccaacctggtgctgcagaacagctacatcctgatcctcgcgatcggcatgatgctcgtcatcatcgcgggccacatcgacctgtcggtgggttcgctgaccgccttcgtcggcgcgaccgccgccgtcctgatggtcaaccacgacctgccctggccggtggcggtgatcctctgcctggccatcggcgccgccgccggtgccgtgcagggcttcttcatcgcctatctcggcataccgtcgttcatcgtgaccctcgcgggcatgctgctcttccgcggtctgacggagatcttcctcaagggccagaccctcggcccgttccccaaggaccttcagaagatcgccaacggcttcctgcccgaggtcggcccgaacaccaactaccacaacctcaccctgctgctgggcttcgccctgatcgccttcgtggtgtaccaggaggtccgcgaccgcaagcggcagctggagttctccctcgacgtgccgccgctcaagctgttcctgctcaagctggtcgcgctggtcgccgcggtcctcgtggtcacgctgctgctggccagctacaagggcgcgccgatcgtgctgctcatcctgggcgtgctggtggtcggcttcggctatctgatgcgcaacgcgatcatcggccgccacatctacgccatcggcggcaacctgcccgcggccaagctgtcgggcgtgaaggacaagaaggtcaccttcctggtcttcctgaacatgggcatgctcgcggccctggcgggtctggtcttcgccgcccgcttcaacgcggcctcgcccaaggcgggcctcaacttcgagctggaggccatcgccgcctcgttcatcggcggcgcgtcgatgagcggcggcgtcggcacggtcctcggcgcgatcatcggcggtctggtcctgggtgtgctcaacaacggcatgaacctcgtcggcatcggcaccgactggcagcaggtcatcaagggcgcggtgctgctggcggcggtcgggttcgacgtgtggaacaagcgcagggtcggttcgtaa

SEQ ID NO: 40428 - protein, 414 aa, Streptomyces coelicolor A3(2)
MSTDVTAKTPAPAPPGREGSASGGGLLQLMLDGMRRNMRQYGMLMALGLIVVLFAVWSDGDLLLPRNVSNLVLQNSYILILAIGMMLVIIAGHIDLSVGSLTAFVGATAAVLMVNHDLPWPVAVILCLAIGAAAGAVQGFFIAYLGIPSFIVTLAGMLLFRGLTEIFLKGQTLGPFPKDLQKIANGFLPEVGPNTNYHNLTLLLGFALIAFVVYQEVRDRKRQLEFSLDVPPLKLFLLKLVALVAAVLVVTLLLASYKGAPIVLLILGVLVVGFGYLMRNAIIGRHIYAIGGNLPAAKLSGVKDKKVTFLVFLNMGMLAALAGLVFAARFNAASPKAGLNFELEAIAASFIGGASMSGGVGTVLGAIIGGLVLGVLNNGMNLVGIGTDWQQVIKGAVLLAAVGFDVWNKRRVGS

SEQ ID NO: 40429 - DNA, 1956 bp, Streptomyces coelicolor A3(2)
  CDS (1)..(1956): transl_table=11
gtggccactgacacgctcaagagcaagccgggcgcgcagggcgccacgggcggtctgcgccgcctgctgctcgacaacggcgcgctgaccgcgctgatcgtcctcgtcgtcgtcatgtcggcgctgtccggggacttcctgaccgccgacaacctcctcaacgtcggcgtccaggccgccgtcaccgcgatcctcgcgttcggcgtcaccttcgtcatcgtctcggcgggcatcgacctgtcggtcggctcggtcgccgcgctgtcggccaccgtgctggcctggagcgccaccgaggccgggatgccggtcgcgctcgcggtgctgctgtccgtcctgacgggcatcgcctgcggtctggtgaacggtttcctcatctcgtacgggaagctgccgccgttcatcgcgacgctcgccatgctgtcggtgggccgcggtctgtcgctggtcatctcgcagggctcgccgatcgccttcccggactcggtctcgcacctcggtgacacgctcggcgggtggctgccggtgccggtgctcgtgatgatcgtgatggggctgatcaccgcgttcgtcctcggccggacctacatcggccggtccatgtacgccatcggcggcaacgaggaggcggcgcggctgtccgggctgcgggtgaagcggcagaagctcgccatctacgccttctccggcctgttcgccgccgccgcgggcatcgtgctcgcctcccggctctcctccgcgcagccgcaggccgcgcagggctacgagctggacgccatcgccgccgtcgtcatcggcggcgcctcgctggcgggcggcaccggcaaggcctcgggcacactgatcggcgcgctgatcctcgcggtgctgcgcaacggcctcaacctgctgtccgtctccgcgttctggcagcaggtcgtcatcggtgtcgtcatcgcgctcgcggtgctcttcgacacgctgcgccgcaaggcgggcgcggtcactccggcggccggggcgtcgggcggcggcaaccggggcaggcaggcactcacgtacgtgatcgcggccgtcgtcgcggtggccgtggtcggcgccacctcgctgctgcacaacggctcctccggcggcaagagccagaagatagggctgtcgctgtccacgctgaacaacccgttcttcgtgcagatcaggaacggcgcggaggaggaggcgaagaagctgggcgtggacctgacggtcacggacgcccagaacgacgcctcccagcaggccaaccagctccagaacttcgtcagcggcagcctgtccgcggtcatcgtcaacccggtggactccgacgcggccggtccctcggtgcgctccgccaacaaggacgacatcccggtcatcgccgtggaccgcggcgtcaacaaggcggagacgtccgcgctggtcgcctccgacaacgtcgagggcggtgagctgggcgccaaggcgctcgccgagaagctcggcggcaagggcaccatcgtcatcctccagggccaggccggcacctccgccagccgggagcgcggggcgggcttcgcggccgggctcaaggcgtacccgggcatcaaggtcgtcgccaagcagcccgcggacttcgaccgcaccaagggcctggacgtgatgacgaacctgctccaggcgcacccggacgtcgacggcgtcttcgcggagaacgacgagatggcgctgggcgcgatcaaggcactgggttccaaggccggcaagtcggtccaggtcgtcggcttcgacggcaccccggacgggctgaaggcggtccaggacggcacgttgtacgcgtcggtggcgcagcagccgaaggaactgggcaggatcgccgtacggaacgcgctgcgggcggccgaggacaagaaggtggagcagacggtgaaggtgcccgtgaaggtcgtcacccagcagaacgtggcgggtttcgagggctga

SEQ ID NO: 40430 - protein, 651 aa, Streptomyces coelicolor A3(2)
MATDTLKSKPGAQGATGGLRRLLLDNGALTALIVLVVVMSALSGDFLTADNLLNVGVQAAVTAILAFGVTFVIVSAGIDLSVGSVAALSATVLAWSATEAGMPVALAVLLSVLTGIACGLVNGFLISYGKLPPFIATLAMLSVGRGLSLVISQGSPIAFPDSVSHLGDTLGGWLPVPVLVMIVMGLITAFVLGRTYIGRSMYAIGGNEEAARLSGLRVKRQKLAIYAFSGLFAAAAGIVLASRLSSAQPQAAQGYELDAIAAVVIGGASLAGGTGKASGTLIGALILAVLRNGLNLLSVSAFWQQVVIGVVIALAVLFDTLRRKAGAVTPAAGASGGGNRGRQALTYVIAAVVAVAVVGATSLLHNGSSGGKSQKIGLSLSTLNNPFFVQIRNGAEEEAKKLGVDLTVTDAQNDASQQANQLQNFVSGSLSAVIVNPVDSDAAGPSVRSANKDDIPVIAVDRGVNKAETSALVASDNVEGGELGAKALAEKLGGKGTIVILQGQAGTSASRERGAGFAAGLKAYPGIKVVAKQPADFDRTKGLDVMTNLLQAHPDVDGVFAENDEMALGAIKALGSKAGKSVQVVGFDGTPDGLKAVQDGTLYASVAQQPKELGRIAVRNALRAAEDKKVEQTVKVPVKVVTQQNVAGFEG

SEQ ID NO: 40431 - DNA, 1293 bp, Streptomyces coelicolor A3(2)
  CDS (1)..(1293): transl_table=11
gtgagcatcgacaagacctccaccccggccgaggaccacgcggtggagaaccccgccgcggccgccggcgccgccgccgcggtcgacccgcggctgctggtgcgcgagcagggcttcgcgggctatctgagcgagttcaagcggaagatgaaggccggtgacctcgggtccatcccggtcgtcgtcggtctgctgatcatctgggccatcttcaccagcctgaactccaacttcctcaccgccggcaacttctccgacatgtcggtcgccatggtcggcaccggcatgatcgccgtcggtatcgtcttcgtcctgctgctcggcgagatcgacctgtcggtcggctcggtcagcggtgtcgcgggcgccaccttcgcggtgctgagcgtcacgcacgggatgaacgagtggctcgccctgctgctgtccgtcctcaccggcaccgtggccggtgccatccacggcttcgtcttcgcccgcatcggcgtgccggccttcgccgtgacgctggccggactgctgttctggcagggcttcatgctgcagatcctgggcagcaacggcacgatcaacctcgactccgagggcatcgtcgtcaagatgaccagctactacttcagcgacgtggccgccgcctacggcctggcggtcgtcgtgaccgcggggtacttcctcagcgcgttcttcgacagccggcgccgcgaggccgccggggtgccctcgcggccgctgaacgagatcatcgtgcgcacggtgctgctggcgatcctggcgttcgtcgtggcgatcgtcttcaaccagtacaagggcctgccgctggccgtggtgatcttcctggcgttcctgctgctcacggacttcgtcctgcgccgcaccgcctacggtcgcaagatcttcgccctcggtggcagcgtcgaggcgtcccgccgcgccggcatcaacgtggagctgatccggatctcggtcttcgcgatcgccggcggcttcgccgcgataggcggcctcttcgtggcctcgaagatcgccgccgccaaccagggcgcgggcaccggtgagttcctgatgaacgtcatcgccgcggccgtgatcggcggcacgtccctcttcggcggccgcggccgcacctgggacgcgctgctcggtgtcatggtcatcgtctcgatccagtacggcctcgccctggagggcatcgcctcgccggtccagtacatgatcaccggtggcgtgctgctggcgaccgtcgtcatcgacgcgatcacccgcaagacgcagaagacggccggccgcgcgtag

SEQ ID NO: 40432 - protein, 430 aa, Streptomyces coelicolor A3(2)
MSIDKTSTPAEDHAVENPAAAAGAAAAVDPRLLVREQGFAGYLSEFKRKMKAGDLGSIPVVVGLLIIWAIFTSLNSNFLTAGNFSDMSVAMVGTGMIAVGIVFVLLLGEIDLSVGSVSGVAGATFAVLSVTHGMNEWLALLLSVLTGTVAGAIHGFVFARIGVPAFAVTLAGLLFWQGFMLQILGSNGTINLDSEGIVVKMTSYYFSDVAAAYGLAVVVTAGYFLSAFFDSRRREAAGVPSRPLNEIIVRTVLLAILAFVVAIVFNQYKGLPLAVVIFLAFLLLTDFVLRRTAYGRKIFALGGSVEASRRAGINVELIRISVFAIAGGFAAIGGLFVASKIAAANQGAGTGEFLMNVIAAAVIGGTSLFGGRGRTWDALLGVMVIVSIQYGLALEGIASPVQYMITGGVLLATVVIDAITRKTQKTAGRA

SEQ ID NO: 40433 - DNA, 1020 bp, Streptomyces coelicolor A3(2)
  CDS (1)..(1020): transl_table=11
atgacgcagcacgtgtccccgccacggggcagcaccgacaaggcggcacccgtggagggtccgcccgcctggcgggtccggttgggccgcgccgacgtccgcaccctcaccctgctcggcgtgctcgccgcactggtcctcatcggcggcatcacccagcccgacgcgttcctcgacacccgcaacctgcaactggtgctcacccaggcgtccgtgatcggcatcgtcaccgtcggcgtcaccttcgtgatcatctccgggggcatcgacctgtcggtcggcgccatcgtcgccctctcctcggtgtgggcgaccacggtggccacccaggagtacggcttcgccggcatcctcttcacggcgatcgtggtcggtgtcggctgcggcctggtcaacggcctgctcatctccttcggcgggatggtccccttcatcgccaccctggccatgctggcctcggcgcgcggactcgcgctccagatcaccgacggccgcacccaggtcgtcaccgtcccgagcgtcctcgacctcgccgagcgcgactcgtacgtgctcggcataccgccgctggtgctggtcttcgcggccgtcaccgtcgtcggctggctggtcctgaaccggaccaccttcggccgccgcaccgtcgccgtcggcggcaacgccgaggccgcccggctggccggcatcgacgtccgccgccagcggctctacctctacctgctgtccgggctgtgctgcggcatcgccgccttcctgctggtggccctcgccggctccggccagaacaccaacggcaacctctacgaactcgacgccatcgccgccgcgatcatcggcggaacgctgctgaccggcggccggggccacatcctcggttccgtgctcggcgtcctgatcttcaccacgatcaccaacatcttcgccctgaacaacctgcagagcgacgtccagcagatcgccaagggcgcgatcatcgtcgccgccgtgctggtccagcgccgtaccgcaagcacgcattga

SEQ ID NO: 40434 - protein, 339 aa, Streptomyces coelicolor A3(2)
MTQHVSPPRGSTDKAAPVEGPPAWRVRLGRADVRTLTLLGVLAALVLIGGITQPDAFLDTRNLQLVLTQASVIGIVTVGVTFVIISGGIDLSVGAIVALSSVWATTVATQEYGFAGILFTAIVVGVGCGLVNGLLISFGGMVPFIATLAMLASARGLALQITDGRTQVVTVPSVLDLAERDSYVLGIPPLVLVFAAVTVVGWLVLNRTTFGRRTVAVGGNAEAARLAGIDVRRQRLYLYLLSGLCCGIAAFLLVALAGSGQNTNGNLYELDAIAAAIIGGTLLTGGRGHILGSVLGVLIFTTITNIFALNNLQSDVQQIAKGAIIVAAVLVQRRTASTH

SEQ ID NO: 40435 - DNA, 1146 bp, Yersinia pestis KIM
  CDS (1)..(1146): transl_table=11
atgatgaaagcaacaactggcacggcgttggcgagtcacctgcccggtggagcgtcatggtcacgggaaaatatgctgctgcttctgttaaagatgcgcacctttattgccctgtttctgatcctgggtttcttttcaatcatggtccctgggttcttagccacggggagtttgatcatcatggtgaagcatattgcgattaatgccttcctcgcattaggcatcacctttgtcattatcaccgcaggtatcgatctctccatcggcgcgacgctggggctgtgcggcatgattgccggttggatgatcacccaaggcattgtcttgccgatgtttggcatcgctatcttccccagtgtttgggttgtggttccggtggtgttagttatcggggcactcatcggtgcggttaatggctggatcattactcgctacaacgtcgccccgtttatttgcacccttggcaccatgtatgtggtgcgaggtgcctcgatgttgatctctggtggcgaaaccttccccggcttacaaggcaatccgcaactggggaataccggttttgacctgctgggctcgggaacgctactggggttgccgatcgccatctggatcatgttcattctggcgctggtgattgcttacgttgcccgccgccttccgtttggccgccatgtttatgccatcggggataacgaacgcgctgctgaactttctggtgtcaaagtgcgtcaggtgaaagtctgggtttacaccctatccggcttctgtgccgcgatagcggggattatcgtgtctgcccaattggttgccagccacccggccaatggcagtggcttcgaaatgaatgctatcgccgctgttgttctgggcgggacatcgctggcaggcgggcgagggaccattcttggtacgctgattggcgcttttgttatcggcatcttggctgatgggctggtgatgatgggcatcagtgaattctggcaaatggtgatcaaaggcatcgtgattatcgtggccgtgattatcgatcagatgcaaaaccggatgcagcacaaggcggcgattgtgtcgcaaaaagtgaccgccatcccctctgacgtcacctctcaggcgggaatcatctctcagacggtaaaaagtgagtag

SEQ ID NO: 40436 - protein, 381 aa, Yersinia pestis KIM
MMKATTGTALASHLPGGASWSRENMLLLLLKMRTFIALFLILGFFSIMVPGFLATGSLIIMVKHIAINAFLALGITFVIITAGIDLSIGATLGLCGMIAGWMITQGIVLPMFGIAIFPSVWVVVPVVLVIGALIGAVNGWIITRYNVAPFICTLGTMYVVRGASMLISGGETFPGLQGNPQLGNTGFDLLGSGTLLGLPIAIWIMFILALVIAYVARRLPFGRHVYAIGDNERAAELSGVKVRQVKVWVYTLSGFCAAIAGIIVSAQLVASHPANGSGFEMNAIAAVVLGGTSLAGGRGTILGTLIGAFVIGILADGLVMMGISEFWQMVIKGIVIIVAVIIDQMQNRMQHKAAIVSQKVTAIPSDVTSQAGIISQTVKSE

SEQ ID NO: 40437 - DNA, 1065 bp, Yersinia pestis KIM
  CDS (1)..(1065): transl_table=11
gtgaaggagttaatcatgtctagcgttactttgagttcggataaaaagaacccggtatcaactgaatcaaacggtgggatcccacaacctcagcaaccacagaatgcgccgactaaaagtggcttaggattatcccgtatctgggacagctacggcatgctggtggtcttcgccgtggtctttattggttgcgtgatttttgtgcctaattttggctcctttatcaatatgaaagggttggggctggctatctcaatgtctgggatggtggcgtgcggtatgcttttttgtttggcatccggcgattttgacctctctgtggcctcggtcattgcctgcgcgggtgttaccaccgcggtggtgatcaatatgacagagagcctatggataggggtgggcgcaggtttgttattaggggcggcatgtgggctaattaatggttttgtgattgcccggctaaaaatcaatgcgctgatcaccacattggcgacgatgcaaattgttcgtggcctggcgtatatcatttctgatggtaaagccgtgggtatcgaagatgagcgcttcttcgccttgggttataccaactggtttggtctgccagcacccatctggatcaccgttgcctgtttggtgctgtttggtttcttactgaataaaaccacctttggccgtaacacgttggcgattggggggaatgaagatgctgcgcgtctggccggtgtgccggtcgtgcggaccaaaatcattatttttgtgctgtcaggtttggtgtctgccgccgcagggattattttggcttcacgcatgacgagcggccagccaatgacctcgattggttatgagctcattgttatctctgcttgcatattaggcggggtatcactaaaaggcggcattggtaaaatttcttacgtcattgcggggatcttgattctgggaacagtagaaaatgccatgaacctattaaatatctccccgttctcacaatatgtggttcgtggtttgatcctgctggcggcggttatcttcgaccgttacaaacagttagctaaacggacgatataa

SEQ ID NO: 40438 - protein, 354 aa, Yersinia pestis KIM
MKELIMSSVTLSSDKKNPVSTESNGGIPQPQQPQNAPTKSGLGLSRIWDSYGMLVVFAVVFIGCVIFVPNFGSFINMKGLGLAISMSGMVACGMLFCLASGDFDLSVASVIACAGVTTAVVINMTESLWIGVGAGLLLGAACGLINGFVIARLKINALITTLATMQIVRGLAYIISDGKAVGIEDERFFALGYTNWFGLPAPIWITVACLVLFGFLLNKTTFGRNTLAIGGNEDAARLAGVPVVRTKIIIFVLSGLVSAAAGIILASRMTSGQPMTSIGYELIVISACILGGVSLKGGIGKISYVIAGILILGTVENAMNLLNISPFSQYVVRGLILLAAVIFDRYKQLAKRTI

SEQ ID NO: 40439 - DNA, 996 bp, Yersinia pestis KIM
  CDS (1)..(996): transl_table=11
gtgagcaaagaattacccctaccagacgtgcagccttggcgtcaccagttgtttgattttctctacaaatggggaatgttgctcaccgttgttgcgttaatcgcgctatttggtttggcatcggataacttcctcgatccaaacaatatcatcaacattttacgttctatcgccattgtgaccgtaattgccatcggggtgtctatctcgctgtcgattggcggttttgacctgtcagtaggctccacggcctcgttggcgaatgccgtcgtggtatcattgtttgtctggtatggcttcggtaccacgggcgcaataatcctgacgctgctgatttgcacactggtcggtctgtttaatgctttcctgattgtggtgctgaaaatccccgatatgctagccaccctggccagcctgtttgtgattcagggggtcgccatgacttacagccgcggcggttcgatcactcaaagtatgttgttgcccagtggcgatatggcggaaggggttattccagaaattttttccgcactcggccaggtaccggttatcgtgctgattatgttagcggtcaccgtggtggtgcagttgtatttatcgctgaccaagcacgggcggcggatgtacgccattggcggtaacccacaagccgcgcggctggcggggatccgcacggttcgctatcgggtactggcttatgtgctctccgctcaattggcggcactcggtgggatcttgctggcttcacgcattggttcatcgcaggtgaatgctggcagtggttatttgatggacgccgtcgccgccgcctatatcggcttttcactggctggctcgggtaaacctaatgcgttcggcaccttaattggcgcgataattttgggtgtcttgcaaaatgggttggtgatgttgtcagtgccttattatgcgatggatattattaaaggcttggtattagctatggccctggcactgacttatattcagaaacggtga

SEQ ID NO: 40440 - protein, 331 aa, Yersinia pestis KIM
MSKELPLPDVQPWRHQLFDFLYKWGMLLTVVALIALFGLASDNFLDPNNIINILRSIAIVTVIAIGVSISLSIGGFDLSVGSTASLANAVVVSLFVWYGFGTTGAIILTLLICTLVGLFNAFLIVVLKIPDMLATLASLFVIQGVAMTYSRGGSITQSMLLPSGDMAEGVIPEIFSALGQVPVIVLIMLAVTVVVQLYLSLTKHGRRMYAIGGNPQAARLAGIRTVRYRVLAYVLSAQLAALGGILLASRIGSSQVNAGSGYLMDAVAAAYIGFSLAGSGKPNAFGTLIGAIILGVLQNGLVMLSVPYYAMDIIKGLVLAMALALTYIQKR

SEQ ID NO: 40441 - DNA, 1026 bp, Yersinia pestis KIM
  CDS (1)..(1026): transl_table=11
ttgaaggttcttattatgaatgtgttaaataagaaagatatgctcacttactttaaagagagcgggatttatgtggtgttgtttgtgctattggcaattattattatcaaggatccgacttttttaagtttgatgaatttaagtaacattctgactcaatcttcggtgcgtattattatcgcgttaggggtcgcgggtttgattgttacccaaggcacggatttgtccgcaggtcgtcaggtagggttagccgcagtggtcgctgcgacaatgctacaatcgatggataacgtgaataaagttttcccggacttgcagactgtacctattccagtggtcattctcgttgtctgcctgattggggcggttattggtttgattaacggtataattattgcgtacctgaatgtgactccatttattaccacattaggcactatgattatcgtttatggcgttaactcgctgtattacgattttgtcggtgcttcaccgattgccggttttgatcctgctttttcgacttttgctcaaggtttcttgcggtttggtgattttaaactgtcctatattaccttttacgccttaatagcaattatgtttgtatgggtactgtggaataagacccgttttggcaagaatatttttgctattggcggcaacccggaggcggcgaaagtctctggtgtgaatgtgccactgaatttgatcatgatttatgcattgtcgggggtgttctatgcctttggcggtatgctggaagcagggcgtatcggcagtgcgacgaacaatctcggatttatgtatgagctagatgcgatagcagcctgcgtggtgggtggggtgtccttcagtggtggcgtcggtaccgtgatcggcgtggtgaccggggttatcatcttcactgtcattaactatgggctcacgtatattggtgtgaacccgtactggcaatacattatcaagggcgggattatcatctttgcggttgcgttggattcactgaagtatgcgaagaagaaatag

SEQ ID NO: 40442 - protein, 341 aa, Yersinia pestis KIM
MKVLIMNVLNKKDMLTYFKESGIYVVLFVLLAIIIIKDPTFLSLMNLSNILTQSSVRIIIALGVAGLIVTQGTDLSAGRQVGLAAVVAATMLQSMDNVNKVFPDLQTVPIPVVILVVCLIGAVIGLINGIIIAYLNVTPFITTLGTMIIVYGVNSLYYDFVGASPIAGFDPAFSTFAQGFLRFGDFKLSYITFYALIAIMFVWVLWNKTRFGKNIFAIGGNPEAAKVSGVNVPLNLIMIYALSGVFYAFGGMLEAGRIGSATNNLGFMYELDAIAACVVGGVSFSGGVGTVIGVVTGVIIFTVINYGLTYIGVNPYWQYIIKGGIIIFAVALDSLKYAKKK

SEQ ID NO: 40443 - DNA, 999 bp, Yersinia pestis KIM
  CDS (1)..(999): transl_table=11
atggataaggcaaccgagacccgccgcgagggagcacctaccgcgagcaaactcaacggccaggccatgctgggctgggttttacaccatattgtctggatctggctgattgcactggttgtcatctttggtgtcttcaatgaatttttcctgacgatatccaatctgcaaaacgtgatggtgcaggccacggttttgggaaccttagggctggcggtggcactgccgctgctggtggctgagattgacttgtcgattccggcaaatgcgggtttctcggcggcggtgggggcgatggcttatgccgaactggggctgccgtggcctattgcagcattaataggtttactggttggcacatttatcggtttcttcaatggggtgtgcatcacccgattgaaaatggtctcgctgatagagacgttggcgatgatgattattatccagggcgcgctgttggcgctgacacagggcaagaccctgacaaacctttctgaaggttatatttggattggccaggcgaccatcggggggtggcccctgatgccggtggtgtttcttctggtgctggcggtgatgggggcggtgctgaagtatacggtgttaggccgttcgatctatgccgtcggtggtaatcctgttgcgtcaaactccgccgggattcgggtcgcgcgggtcaaaattattgcttacacgatttcagggttccttgccgcacttgctggctttttgttggcatcgtggcagatggccatcacctcaaaccaaggctcgagctacttgctctacgccatcgccgcgcccattatcggcggcgtcagtgtttttggtgggcacggtaacgtcaagggggtgctgggcggtgtgctgctgctgacggtgatccaagttggcctcgccattgtcaatgtcccttcgttctatgtcggcatgattggcggggtgatcatttttatcgctgtcgccattgatgctttccggatccgttacttcggatag

SEQ ID NO: 40444 - protein, 332 aa, Yersinia pestis KIM
MDKATETRREGAPTASKLNGQAMLGWVLHHIVWIWLIALVVIFGVFNEFFLTISNLQNVMVQATVLGTLGLAVALPLLVAEIDLSIPANAGFSAAVGAMAYAELGLPWPIAALIGLLVGTFIGFFNGVCITRLKMVSLIETLAMMIIIQGALLALTQGKTLTNLSEGYIWIGQATIGGWPLMPVVFLLVLAVMGAVLKYTVLGRSIYAVGGNPVASNSAGIRVARVKIIAYTISGFLAALAGFLLASWQMAITSNQGSSYLLYAIAAPIIGGVSVFGGHGNVKGVLGGVLLLTVIQVGLAIVNVPSFYVGMIGGVIIFIAVAIDAFRIRYFG

SEQ ID NO: 40445 - DNA, 1011 bp, Yersinia pestis KIM
  CDS (1)..(1011): transl_table=11
ttggtaatgtctctgacacggaccagtaaattcaggaaggccattcatcaatacgggatcatacttgcctttgttggcttgtgtgcggtcattgctctggctggtgaatttgcagtaaacagcgggacatggagcgagaattattttttatcacgggataatacactcattattctgcgccaggtctcgatcaacggcatcctggccattgggatgacgttcgttattatcaccgcgggtgttgatctctccgttggcgcggttttaggcttggccggtattgtcgccgcgcgttttgcgacgaataacagtgccatcgccttaggggggaccgattggccactgttagtacccatcgtgattgccattggcatcggtttagtctgcggcgctatcaatggctttatcttaggcaaatatcgtctgcaaccctttattgtcacaatggggatgttatctgtcgcccgtggcctgacattactgactactggcggaaacccggtatcacaattaaccgatgaattccgttggttaggtaacggttatattttgggtattcccgtaccggtgttgatctttattattctgttcgccattgcctggtttgtcttgaataagatgacgtttggccgttacgtctacgcggtgggcgggaatgaaaaaagtgcccgcacatccgggatcaacgtattacgtattaaagtggcggtatataccctttgcggtattttggcggcgatcgcgggtttaattttaaccgcacgtactggctcggcacaaactggcgctggcgtatcctatgaattggatgctatcgcggcggtcgttattggcggcaccagtatggctggcggtattggaactctgcgcggaaccttatttggtgtgctgataataggtgtgatgaacaatgggcttgatttactcggcgtacaatcctattaccagcaaattatcaaaggtgttctgattgtctttgctgtcatgcttgacccatcccgtaagcaataa

SEQ ID NO: 40446 - protein, 336 aa, Yersinia pestis KIM
MVMSLTRTSKFRKAIHQYGIILAFVGLCAVIALAGEFAVNSGTWSENYFLSRDNTLIILRQVSINGILAIGMTFVIITAGVDLSVGAVLGLAGIVAARFATNNSAIALGGTDWPLLVPIVIAIGIGLVCGAINGFILGKYRLQPFIVTMGMLSVARGLTLLTTGGNPVSQLTDEFRWLGNGYILGIPVPVLIFIILFAIAWFVLNKMTFGRYVYAVGGNEKSARTSGINVLRIKVAVYTLCGILAAIAGLILTARTGSAQTGAGVSYELDAIAAVVIGGTSMAGGIGTLRGTLFGVLIIGVMNNGLDLLGVQSYYQQIIKGVLIVFAVMLDPSRKQ

SEQ ID NO: 40447 - DNA, 1194 bp, Yersinia pestis KIM
  CDS (1)..(1194): transl_table=11
gtgaaacccatgtcacaagctaatcaatctgaatttaactcaccagaaaatggggataaaaagccattttttcggcttaaatccttaaatttacaagtttttgtcatgctggccgcgatcgccattattatgttgttcttcaccttcacgacagaaggggcctatctcagcgccagaaatatctctaacttgctgcgccagacggcgatcaccggcatcttggcggtcggtatggtgtttgtcattatctccgccgaaattgacttgtctgttggctcaatgatggggttattgggtggcatagcggccatttttgatgtctggctcggctggccgttgccgctgaccattgtcgttacgctggcgctggggctggtattaggggcatggaacggttggtgggtcgcgtatcgcaaagtgccttcgtttattgttacgctcgcgggcatgttggcttttcgtggcattttaattggtatcaccaatggcacgacggtttcgccgaccagtaatgcgatgtcgcagattggccagagctatctgccaagtggcattggttttggcatcggtgctattggcctgatgttgtttgtggcctggcaatggcgtcggcgtaatcaccgcatccgcttggggttaccggttgccgccccgcaaggggatgtgactcgccaaactattaccgcagttatcgttctgggtgccatatatttattgaatgattatcgtggtgtacctacgccggtactaatccttactgcattaatgctggcgggggtatttatggctactcgcaccgcttttggtcgccggatctacgctattggcggcaatattgatgcggcgcgcctgtctggaattaatgtagagcgcactaaactggcagtattcgcgattaacggactgatggtggcgatggctggtttgatcctcagttcacgtttaggcgcaggttcgccttctgcgggcaatatcgctgaactggatgcgattgcggcgtgtgtcattggcggtaccagcctggccggaggcgttggcagtgtggcgggggccgtaatgggcgcatttattatggcttctctcgataatgggatgagcatgctagatgtgccgacgttctggcagtacattgtcaaaggcgcaattttgctgctggccgtgtggatggattccgccaccaaacggcgggtgtga

SEQ ID NO: 40448 - protein, 397 aa, Yersinia pestis KIM
MKPMSQANQSEFNSPENGDKKPFFRLKSLNLQVFVMLAAIAIIMLFFTFTTEGAYLSARNISNLLRQTAITGILAVGMVFVIISAEIDLSVGSMMGLLGGIAAIFDVWLGWPLPLTIVVTLALGLVLGAWNGWWVAYRKVPSFIVTLAGMLAFRGILIGITNGTTVSPTSNAMSQIGQSYLPSGIGFGIGAIGLMLFVAWQWRRRNHRIRLGLPVAAPQGDVTRQTITAVIVLGAIYLLNDYRGVPTPVLILTALMLAGVFMATRTAFGRRIYAIGGNIDAARLSGINVERTKLAVFAINGLMVAMAGLILSSRLGAGSPSAGNIAELDAIAACVIGGTSLAGGVGSVAGAVMGAFIMASLDNGMSMLDVPTFWQYIVKGAILLLAVWMDSATKRRV

SEQ ID NO: 40449 - DNA, 933 bp, Streptococcus agalactiae 2603V/R
  CDS (1)..(933): transl_table=11
atgatgaaatatatatcagagttaacaaccctgattgcgttagctggtttaatggttattatcacactcattaatcctaatttcctcacaaccaataatctactcaatttattattacaagtaactgcaaatggttttatcgctttcgggatgaccttcgttattttgactggcggtattgatttatcagtcgggtccatattagccctatctagtgcattaacagctggattaatcggccacggagtacccgttggtattgctatcgttttatctgttgccttaggtggcatcttgggaatgctaaacggactcttcatttcttacggaaaattagcaccatttatcgttacactggcaacaatgactatctttagaggagcaacgctagtttattcaaacggcaacccaattaccgctggcttatccgatagttttctattccaatttttgggacaaggctatattgttggtatcccattcccagtcattctcatgtttcttacttttattattttgtatattttgttacataaaacagccttcgggaaatctgtttacgctttaggaggtaatgaaaaagcagcgtatatctcgggtattaagttaaacaaagttaaaattatcatctacactatctcaggtatcatggcttccatttctgggttaattatcacatcacgccttagctcagcacaaccaacagctggagcaagttatgagatggatgctattgccgccgttgtcttaggtggaacgtctttatctggtgggaaaggacgtatcattggaacattgattggtgctcttattattggtgtcctgaacaatggattaaacatcattggtgtctctgcattttggcaacaagttgtgaaaggtatcgttattttaatggctgttttacttgatcgctttaaagtagcaaaatag

SEQ ID NO: 40450 - protein, 310 aa, Streptococcus agalactiae 2603V/R
MMKYISELTTLIALAGLMVIITLINPNFLTTNNLLNLLLQVTANGFIAFGMTFVILTGGIDLSVGSILALSSALTAGLIGHGVPVGIAIVLSVALGGILGMLNGLFISYGKLAPFIVTLATMTIFRGATLVYSNGNPITAGLSDSFLFQFLGQGYIVGIPFPVILMFLTFIILYILLHKTAFGKSVYALGGNEKAAYISGIKLNKVKIIIYTISGIMASISGLIITSRLSSAQPTAGASYEMDAIAAVVLGGTSLSGGKGRIIGTLIGALIIGVLNNGLNIIGVSAFWQQVVKGIVILMAVLLDRFKVAK

SEQ ID NO: 40451 - DNA, 939 bp, Oceanobacillus iheyensis HTE831
  CDS (1)..(939): transl_table=11
atgaataataataaaatggcttcgatgtggcaaaaagtaatcccgttaatagctttagtattgctaataatcactgttacgatcatgaacccggcatttttagatccagctaatattatgaatctactaagacaaatttccattaatggattaattgcttttggtatgacttttgtaattctaacaggtggaattgatttatcggtaggatctattcttgcattgtctagtgctttagctgcaataatgatgacatcgggcattgatccaattttagcagtaattataggtgtattattaggtgcagtatttggtgcattgaatggtattttggtttcaaaaggtaacttagcaccgtttatcgttacattagcaacaatgacgatatttagagggttaacattagtatttacagatggaaaaccgataactggattaggagactcctatgcttttcaattatttggtaaaggatactttttaggaataccagtaccagcagtaacgatgatcattgcatttgtaattctttggtttttacttcataaaatgtcatttgggcgtaaaacatatgcaatcggcggaaatgagaaggcggcaaaaatttcaggtataaaagtagatcgtgtcaaaatctttatttattctattagtggaatgatggcagctctagcaggaatgattcttacttcccgccttaattctgctcaaccaactgcaggtacttcttatgaaatggatgctattgcggcagtagttctaggtggtacaagccttgctggcgggaaaggtcgtatagcaggtacgtttatcggagtattaattatcggtattttaaataatggaatgaacttacttggaatttcctctttctatcaacaagtagtaaaaggtgttgttatcttaatcgcagtgctactagatcgtaaaaaatcctaa

SEQ ID NO: 40452 - protein, 312 aa, Oceanobacillus iheyensis HTE831
MNNNKMASMWQKVIPLIALVLLIITVTIMNPAFLDPANIMNLLRQISINGLIAFGMTFVILTGGIDLSVGSILALSSALAAIMMTSGIDPILAVIIGVLLGAVFGALNGILVSKGNLAPFIVTLATMTIFRGLTLVFTDGKPITGLGDSYAFQLFGKGYFLGIPVPAVTMIIAFVILWFLLHKMSFGRKTYAIGGNEKAAKISGIKVDRVKIFIYSISGMMAALAGMILTSRLNSAQPTAGTSYEMDAIAAVVLGGTSLAGGKGRIAGTFIGVLIIGILNNGMNLLGISSFYQQVVKGVVILIAVLLDRKKS

SEQ ID NO: 40453 - DNA, 1218 bp, Bifidobacterium longum NCC2705
  CDS (1)..(1218): transl_table=11
atgagcgccgcaactgcaacacctgcaaagaaagaagaaaagaccggcctgctggccacggtcgccaacaatgcccgtcaatacggtattgtcggcgcactgctgatcatcgtcgtggccttcgagatcctgaccggaggtgtgctgctgaagccgaactccttcgtgtccctgatccagcagaacgcctacgtgatcatcctggccattggtatggtgatggtcatcatcgccacccacatcgacctttcggttggttccttggtggccttcatcggtggtgtgtgtgcactgctgatggaacgcgccggagtcaactggatgctcgccatcgtcatcgctctggtcgtcggcctgatcgtcggcgtctggcagggcttctgggtcgccgtcatcggcatcccgggcttcattaccactctggccggcatgttgatcttccgtggtctcgccaccgtgatcgtcggcgaatccgtgccgattacctccctcgaattccgtggcattgcccgtaactacctgcccaacatccttggctggtggggtccgttcgacggtctgaccattgtgctcggcatcctgtgcattgtcggctttgcctggagccagctgcgcaagcgcgcccgtgtggccaaggtcggcctggtgcccgagccgatgagcctgaccgtcctcaagattgtgcttgtcgcggtcgtcatcgccttcgtcacctacctgctggcttcctccggtaacgctgatcagggtggtaccccgatcatgctggtgatcgtcggtgtgctggtcttcatctacaacttcatcctgaccaagaccgtgttcggtcgccacgtgtacgccgttggtggcaaccgcaaggccgccatcctctccggtatcaacacccgccgcgtggacttcctgctgttcgtccacatgggcttcctgtccgcagtggccgctgtctgcatgctttcccgtctggcttccgcaactgctcaggccggtatggagttcgagatggacgccatcgctgcctgcttcatcggtggcacggccgtcaccggtggtattggtaccatcccgggcgctgtgattggtgcattcgtgatgggtgttatcaaccagggtctgtcgattatgggtgttgacaccgccgtggtgaagaccatcaagggcctcgtgctcctgctggccgtcgccgtggacatcatatccaagcgcaagaagagctga

SEQ ID NO: 40454 - protein, 405 aa, Bifidobacterium longum NCC2705
MSAATATPAKKEEKTGLLATVANNARQYGIVGALLIIVVAFEILTGGVLLKPNSFVSLIQQNAYVIILAIGMVMVIIATHIDLSVGSLVAFIGGVCALLMERAGVNWMLAIVIALVVGLIVGVWQGFWVAVIGIPGFITTLAGMLIFRGLATVIVGESVPITSLEFRGIARNYLPNILGWWGPFDGLTIVLGILCIVGFAWSQLRKRARVAKVGLVPEPMSLTVLKIVLVAVVIAFVTYLLASSGNADQGGTPIMLVIVGVLVFIYNFILTKTVFGRHVYAVGGNRKAAILSGINTRRVDFLLFVHMGFLSAVAAVCMLSRLASATAQAGMEFEMDAIAACFIGGTAVTGGIGTIPGAVIGAFVMGVINQGLSIMGVDTAVVKTIKGLVLLLAVAVDIISKRKKS

SEQ ID NO: 40455 - DNA, 1128 bp, Brucella suis 1330
  CDS (1)..(1128): transl_table=11
atgagcgaacccaattccgaaacgaaggccgcagcggcggcacccgccgatgagcggctgaaatcggccagcaccttgcagcgcctgttgagcaggccggaactgggcgcggtgtccggtctggttctcatcacgatcttctttgtttcaaccgccaattcggccatgtttaccgcagccgggatcatgaatttcatggccccggcctcgcagctcggtattcttgctgtcgcagcggcgctgttgatgatcggcggcgagttcgatctttccattgggtctatggtggcctttgccggcctgatttttgccgcagcccttgtcgtctggcaggtgccgcttgccgttgccattatcgttaccttgctgtttgcggcgctggtgggggcggtgaatgcgcagatcgtcatcagaacgggtctgccgtcctttatcgtcacgctggcctttctcttcatattgcgcggcctttcgcttgtcgggctgaagtgggcaaccggcggtgcgacgcagctgcgcggtgtgaaggaagcggtcagcggcagctatctggccggcctcttttccggcgatgcatttccggggcttttcgcatggctggcggaaaaggatttgattgcgaaatttccaaatggcgagccggcagtgaaaggtgtgctggtcgaggtgctgtggtttgtcgtgattgcccttgtcgcgacctatattctggtgcgcacccgcttcggcaactggatttttgcggcgggcggcgatgcgcttgccgcgcgcaattccggtgttccggtgcgccgcgtcaaaaccacgctcttcatgtgcacggccatggcggcagcacttgtggctatcctgactgttctcgatgccgggtccaccgatgcacggcgcggtttccagaaagaattcgaggcaatcatcgcggccgtgatcggcgggtgcctgctgaccggcggttatggctcggccatcggcgctttcttcggcgcgatcattttcggcatggtgctgatcgggctgacctatacgcagatcgaccaggactggtatcttgtgtttctcgggggaatgcttctgatcgctgtgctcttcaataatttcatccgcaagcgcgccacgggcgagcgttga

SEQ ID NO: 40456 - protein, 375 aa, Brucella suis 1330
MSEPNSETKAAAAAPADERLKSASTLQRLLSRPELGAVSGLVLITIFFVSTANSAMFTAAGIMNFMAPASQLGILAVAAALLMIGGEFDLSIGSMVAFAGLIFAAALVVWQVPLAVAIIVTLLFAALVGAVNAQIVIRTGLPSFIVTLAFLFILRGLSLVGLKWATGGATQLRGVKEAVSGSYLAGLFSGDAFPGLFAWLAEKDLIAKFPNGEPAVKGVLVEVLWFVVIALVATYILVRTRFGNWIFAAGGDALAARNSGVPVRRVKTTLFMCTAMAAALVAILTVLDAGSTDARRGFQKEFEAIIAAVIGGCLLTGGYGSAIGAFFGAIIFGMVLIGLTYTQIDQDWYLVFLGGMLLIAVLFNNFIRKRATGER

SEQ ID NO: 40457 - DNA, 1239 bp, Brucella suis 1330
  CDS (1)..(1239): transl_table=11
atgaacgatatcaatacgctgcttgatcgtcaggatgtacgggtgcgccacgataaaggcgtttctggcgccatccgcacctttatcgaccgggtcaagtcgggcgatctcggttcattgccggtcattgttggccttctcatcatctggactgttttccagacgttgaacccggttttcctttccagcaacaacctcgtgaacctgctattcgattgctcgaccatcggcgtcatttcgctcggcatcgtctgcgtattgatgctgggtgagatcgacctttcggtcggttccattagtgggctttcttcggctatcatcggtgtattatgggtcaataatggctggccggtgggcgtcgccatcattgcagcactttgcgcaggcgcactggctggcttcctctacgcgctcctctataaccgcttcagcatgccaagcttcatttccacactggctgggctgctcgcagctcttgggcttcagctttacctcctcggcaatacaggctccatcaatctgccttacggttcgtggctggtcagcttcggccagcttctggtaatgccgcgtccgctttcttatgcgctggcgctggtcgcgggacttgcgatctttttcacgggttttcgcgccgcgcagcgccgccgcacggcagggctttccgctccctcggctgcgggcattgcgctcaaagctttggtcatcacgctcattatcggctgtggggtattttatctcaaccagtcgcgcggcgtgccatggatgtttgccctgttcgtggcgctggtgatcgcgatgaactatgcgcttacgcgcaccagatggggccgctgcgtgcaggcggttggcggcaatcgcgaggctgcgcgtcgtgccggcatcaatgtgaatttcatctatgtctcggccttcatggcctgctccacactcgcggctgccggtggtatcatggcggcggcgcgtctggcctcatccagccagcaggcaggcaccggtgacgtcaacctcaatgctatcgcggcagcggttatcggcggtaccagcctattcggcgggcgcggcagcgcgtggtcggccctgctcggtattatcgtcatccagtcgattgcgagcggtttgacgcttctcgatctgtcgtcttcgcttcgctacatgattacgggtgcagtgcttgccatcgccgtgattgtcgattcccttgcccgccgttcgcgccagtcgcacggccgcgcctag

SEQ ID NO: 40458 - protein, 412 aa, Brucella suis 1330
MNDINTLLDRQDVRVRHDKGVSGAIRTFIDRVKSGDLGSLPVIVGLLIIWTVFQTLNPVFLSSNNLVNLLFDCSTIGVISLGIVCVLMLGEIDLSVGSISGLSSAIIGVLWVNNGWPVGVAIIAALCAGALAGFLYALLYNRFSMPSFISTLAGLLAALGLQLYLLGNTGSINLPYGSWLVSFGQLLVMPRPLSYALALVAGLAIFFTGFRAAQRRRTAGLSAPSAAGIALKALVITLIIGCGVFYLNQSRGVPWMFALFVALVIAMNYALTRTRWGRCVQAVGGNREAARRAGINVNFIYVSAFMACSTLAAAGGIMAAARLASSSQQAGTGDVNLNAIAAAVIGGTSLFGGRGSAWSALLGIIVIQSIASGLTLLDLSSSLRYMITGAVLAIAVIVDSLARRSRQSHGRA

SEQ ID NO: 40459 - DNA, 1191 bp, Brucella suis 1330
  CDS (1)..(1191): transl_table=11
atgagcgagaatgtaatccagagcggccagcagagcagcgtggggcgctatctcaagaacaatctgcgtgaatccgggatgctgctttcgctcgttgcaatcatgatcttcttccagatcgtgaccggcggcgttctcatgaagccgctgaacctcaccaatctcgttttgcagaacagctatatcgtcatcatggcgcttggaatgctgctcatcatcgtcacgggccatatcgatctttcggtcggttcggtctgcggctttatcggggcgctcgctgccgtcatgatggtaaagctcggcattccctttcccattgcggccattctctgcctcattgtcggcgggttgatcggcgcgatccagggtttttgggtcgcctatttcaatatcccctccttcattgtgacattggccggtatgctcgtgttcaaggggctgatgcttgccgttctgggcggacagtcggtcggaccttttccggtcgtgttccagaagctctcgtcgggcttcattccagaggtgatcggcacgtttgacggcgtttatctcacctcgctcatcatcggcgttctgcttgcggttttcctcatctggcagagcatgcggtcgcgcgcgcgccatattgcccatgaggtggagaccgagcccttcggccttttcgtggtcaagtgcatcctctatttcgtcgcaattgcctatctttcgctgctcatttcctcacatcgcggtatgccgaacgtactcatcatcatggcggtgctgattgccgcctatgcgtttctcaccaatcgcaccgtgatcggccgccagatctatgcggtgggcggcaatcgtcacgccgccaagctttccggcgtgaaaaccgagcggctgacgtttctcaccttcgtcaatatgggtgtgctggcagcacttgcgggtctcgtcttcgccgcccgtctcaatacggcgacgccgaaagctggcatcggctttgaactggacgtcatcgcggcctgcttcatcggtggcgcttcggcctatggcggtgtggggcgggttacgggtgccgtgatcggcgcgctcatcatgggcgtgatgaacaacggcatgtcgatcctcggcatcggtatcgactatcagcaggtcatcaagggtatcgtgctgctgggggcggtttgtatcgacgtttataaccagaaacgctga

SEQ ID NO: 40460 - protein, 396 aa, Brucella suis 1330
MSENVIQSGQQSSVGRYLKNNLRESGMLLSLVAIMIFFQIVTGGVLMKPLNLTNLVLQNSYIVIMALGMLLIIVTGHIDLSVGSVCGFIGALAAVMMVKLGIPFPIAAILCLIVGGLIGAIQGFWVAYFNIPSFIVTLAGMLVFKGLMLAVLGGQSVGPFPVVFQKLSSGFIPEVIGTFDGVYLTSLIIGVLLAVFLIWQSMRSRARHIAHEVETEPFGLFVVKCILYFVAIAYLSLLISSHRGMPNVLIIMAVLIAAYAFLTNRTVIGRQIYAVGGNRHAAKLSGVKTERLTFLTFVNMGVLAALAGLVFAARLNTATPKAGIGFELDVIAACFIGGASAYGGVGRVTGAVIGALIMGVMNNGMSILGIGIDYQQVIKGIVLLGAVCIDVYNQKR

SEQ ID NO: 40461 - DNA, 1170 bp, Brucella suis 1330
  CDS (1)..(1170): transl_table=11
atgacgttgacaggcaaaagcctcagaaaatttctctcagaatacaaaatcgtggcactgctgattgttgtcgccctgatctgggcattcttcgccatcatgacttacgatcccgagatgggccggtcgcagtttctcaccgcgcgcaatttctccaatcttttgcgccagatggcaatcaccggcatgctggcttcagccatggtgtttgtcatcgtggcgggtgaaatcgatctgtcggtgggggctttgctcggcctgttaggcggtgtcgcggcggtgctcgatgtggtttacggctggccgttatgggccactatcgctacggttctggtgctgggtggagtgcttggcggtttcaacggctggctcaccgcctatctcggcattccgtccttcatcgttacgctgggcgggcaattggtgtttcgcggtattgtgctgggtatcatgggcggtgtcaccattgcgccgatttcgcccgagttcaaatatatcgggcaaggctatttgcccggctggcttggcaatgtctgtgccatggcgctgtttacagtgcttgtcctgattacgctcagaacccgttccagcaagcgcaaacacaatttgcaaacgctttcaccggcgatggaaaccgctcgccttctgggcacgggtatcctgatccttggttttatcctggtcctcaacagctatcagggcgtaccggttccggttctcgtgctgctggttattcttggcgtcttcaccgttatttcccgccagactgttttcggccggcatatttatgcggtcggttccaatcctgaagccacgcgcttttccggtgtcaacgtgaatttcgtcaaaatggccgtgtttgcgctgatgggacttatagcggcagtggcgggcctcaccacgactgcacgccttgcggccggtacgccatcggcaggtttgggcggcgaacttgatgccatcgcatcatgctttatcggcggcacatccatgcgcggcggcgtgggatccgtgattggtgcgctggtcggtgcgcttatcatgtcaagcctcgataatggtatgtcgatgctgggcgtcgatacattctggcagcaaatcatcaagggcagtattcttgtgctggccgtttatctcgatatcgtatcatcaggcacacgtcgcgcctga

SEQ ID NO: 40462 - protein, 389 aa, Brucella suis 1330
MTLTGKSLRKFLSEYKIVALLIVVALIWAFFAIMTYDPEMGRSQFLTARNFSNLLRQMAITGMLASAMVFVIVAGEIDLSVGALLGLLGGVAAVLDVVYGWPLWATIATVLVLGGVLGGFNGWLTAYLGIPSFIVTLGGQLVFRGIVLGIMGGVTIAPISPEFKYIGQGYLPGWLGNVCAMALFTVLVLITLRTRSSKRKHNLQTLSPAMETARLLGTGILILGFILVLNSYQGVPVPVLVLLVILGVFTVISRQTVFGRHIYAVGSNPEATRFSGVNVNFVKMAVFALMGLIAAVAGLTTTARLAAGTPSAGLGGELDAIASCFIGGTSMRGGVGSVIGALVGALIMSSLDNGMSMLGVDTFWQQIIKGSILVLAVYLDIVSSGTRRA

SEQ ID NO: 40463 - DNA, 1029 bp, Shigella flexneri 2a str. 301
  CDS (1)..(1029): transl_table=11
atgctgaagtttattcagaacaaccgtgaaatcacggcattgctggcggtggtgctgctgtttgtattacccggttttctcgaccgccagtatttaagtgtgcaaacgctgaccatggtttatagcagcgcgcaaatcctgatcctgctggcaatgggcgcgacgctggtaatgcttacgcgcaatattgatgtttcagtgggttcgattaccggaatgtgcgcggtgctgttggggatgttactgaacgcaggatattcactacctgttgcctgtgtcgcgactttactgcttggtttgctcgcgggatttttcaacggtgccctggtcgcgtggctaaagatccctgccattgttgccacccttggcacgttagggttgtacagaggcatcatgttgctgtggactggcggtaaatggattgaagggttacccgccgaactgaaacagctctccgccccgctgctgcttggcatttcagcaattggttggttgacgataattctggtggcatttatggcctggctgctggcgaagacggcgtttggacgcagtttttatgccacgggcgataatttacagggcgctcgtcaactgggcgttcgtacggaagccattcgcattgtggcattttcgttgaacggctgcatggcggcactggcgggaattgtgtttgcttcgcagattggttttatcctcaaccagaccggtaccgggctggagatgaaagcaattgcagcctgcgtgctgggcggcattagtttgctcggtggttccggtgcgatcatcggtgcggtactcggcgcatggttcctgacgcagatcgatagcgtactggtgctgttgcgcattccggcatggtggaatgattttatcgcgggtctggttctgctggcggtgctggtgtttgatggacgcctgcgttgtgcgctggaacgtaatctacggcggcaaaaatatgcccgctttatgacgccaccgccatccgttaaacccgcttcgtcaggtaaaaaacgggaggccgcataa

SEQ ID NO: 40464 - protein, 342 aa, Shigella flexneri 2a str. 301
MLKFIQNNREITALLAVVLLFVLPGFLDRQYLSVQTLTMVYSSAQILILLAMGATLVMLTRNIDVSVGSITGMCAVLLGMLLNAGYSLPVACVATLLLGLLAGFFNGALVAWLKIPAIVATLGTLGLYRGIMLLWTGGKWIEGLPAELKQLSAPLLLGISAIGWLTIILVAFMAWLLAKTAFGRSFYATGDNLQGARQLGVRTEAIRIVAFSLNGCMAALAGIVFASQIGFILNQTGTGLEMKAIAACVLGGISLLGGSGAIIGAVLGAWFLTQIDSVLVLLRIPAWWNDFIAGLVLLAVLVFDGRLRCALERNLRRQKYARFMTPPPSVKPASSGKKREAA

SEQ ID NO: 40465 - DNA, 1011 bp, Shigella flexneri 2a str. 301
  CDS (1)..(1011): transl_table=11
atgagtgcgttaaataagaaaagttttcttacttacctgaaagagggcggtatttacgtcgttcttttagttttgctggcgattattattttccaggacccaacatttttaagtctgttgaacttaagtaatattctcacccagtcatcggtgcgtattattatcgcgctcggtgtggcagggttaattgtcacccaggggaccgatctttctgctggtcgtcaggtagggctggcggcagtggtggctgcgacattattgcagtccatggataacgccaacaaagtgttcccggaaatggcgacgatgccgattgcgctggttattctgattgtctgtgccattggtgcggtgatcggtttgatcaacggtctgattatcgcttatctcaacgtgacgccgttcattaccacgctcggcacgatgatcatcgtctatggcatcaactcgctctattacgactttgtcggggcgtcgccaatttctggttttgacagtggcttctctacctttgctcagggctttgtcgcgctggggagtttccgtctctcttacatcaccttctacgcgttgattgcggtggcgttcgtctgggtgttgtggaacaaaacccgcttcggtaagaacatttttgccattggcggtaacccggaagcggcaaaaatatctggtgtcaacgtcggcctgaacctgctgatgatctacgcgttgtctggcgtgttctatgcctttggcgggatgttagaagccggacgtatcggctctgccaccaacaacctcggctttatgtatgagctggatgctatcgcggcgtgcgtggtaggcggtgtatcgttcagcggcggtgtggggacggtgattggcgtggtgaccggggtaattatttttaccgtcatcaactatggcctgacgtatatcggcgtaaacccatactggcagtacatcatcaaaggggcgattattatcttcgccgtagcgctggattcactgaaatacgcgcgtaagaagtga

SEQ ID NO: 40466 - protein, 336 aa, Shigella flexneri 2a str. 301
MSALNKKSFLTYLKEGGIYVVLLVLLAIIIFQDPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFVALGSFRLSYITFYALIAVAFVWVLWNKTRFGKNIFAIGGNPEAAKISGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 40467 - DNA, 999 bp, Shigella flexneri 2a str. 301
  CDS (1)..(999): transl_table=11
atgtatgcttcgtcattaccattgccgcagggcaagagcgtctcgctcaaacaatttgtcagtcgccatattaatgagatcggtttgctggtggtgattgccattctttatctggtcttctccctgaacgcgcctggctttatctcattgaataaccagatgaacgtgctgcgcgatgccgccaccattgggattgccgcctgggcgatgacgctgattattatctccggtgaaattgatgtcagcgttgggccgatggtggcttttgtctcggtgtgcctggcatttttgctgcaatttgaagttccgttggcgattgcttgtctgctggtgttgctgttaggcgcgctgatgggaacgctcgccggggtgctgcgcggcgtgtttaacgtaccaagtttcgttgccacactggggctgtggagcgctctgcgcggaatggggctgtttatgaccaacgcactgccagtgccgattgacgaaaacgaggtgctggactggctgggcggacaatttctcggtgtgccagtatccgcgctgatcatgatggtgttgtttgcgctgtttgtgttcattagccgaaaaaccgccttcgggcgctcggtttttgccgttggcggtaatgccacggcggcgcagttgtgcggtattaacgttcgtcgagtgcgcattcttatctttaccctttcgggattattagcggcggtgaccggcattttgttggcggcacgcctcggttccggtaacgcaggtgccgcaaacggtctggagtttgacgtcatcgccgcggtcgtggtcggcggtacggcactttccggcggtcgcggttccctgttcggtacattgcttggtgtgctggtgattacgctaatcggtaacggtctggtgctgctcggtattaactcctttttccagcaggtggtacgcggcgtcatcatcgtggtggcggtgctggcgaatatcttgctgacccagcgaagcagtaaagcgaaacgctaa

SEQ ID NO: 40468 - protein, 332 aa, Shigella flexneri 2a str. 301
MYASSLPLPQGKSVSLKQFVSRHINEIGLLVVIAILYLVFSLNAPGFISLNNQMNVLRDAATIGIAAWAMTLIIISGEIDVSVGPMVAFVSVCLAFLLQFEVPLAIACLLVLLLGALMGTLAGVLRGVFNVPSFVATLGLWSALRGMGLFMTNALPVPIDENEVLDWLGGQFLGVPVSALIMMVLFALFVFISRKTAFGRSVFAVGGNATAAQLCGINVRRVRILIFTLSGLLAAVTGILLAARLGSGNAGAANGLEFDVIAAVVVGGTALSGGRGSLFGTLLGVLVITLIGNGLVLLGINSFFQQVVRGVIIVVAVLANILLTQRSSKAKR

SEQ ID NO: 40469 - DNA, 966 bp, Shigella flexneri 2a str. 301
  CDS (1)..(966): transl_table=11
atgataacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattctccagcaaacttcggtgaacgccattatggcggtcgggatgacgctggtgatcctgacgtcgggcatagacttgtcggtaggttctctgttggcgctaaccggcgcagttgctgcatctatcgtcggcattgaagtcaatgcgctggtggctgtcgctgctgctctcacgttaggtgccgcaattggtgcggtaaccggggtgattgtagcgaaaggtcgcgtccaggcgtttatcgctacgctggttatgatgcttttactgcgcggcgtgaccatggtttataccaacggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaacgaagcggcaacgcgtctttctggtatcaacgtcaataaaatcaaaatcatcgtctattctctttgtggtctgctggcatcgctggccgggatcattgaagtggcgcgtctctcctctgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaa

SEQ ID NO: 40470 - protein, 321 aa, Shigella flexneri 2a str. 301
MITQTVSGRRYFTKAWLMEQKSLIALLVLIAIVSTLSPNFFTINNLFNILQQTSVNAIMAVGMTLVILTSGIDLSVGSLLALTGAVAASIVGIEVNALVAVAAALTLGAAIGAVTGVIVAKGRVQAFIATLVMMLLLRGVTMVYTNGSPVNTGFTENADLFGWFGIGRPLGVPTPVWIMGIVFLAAWYMLHHTRLGRYIYALGGNEAATRLSGINVNKIKIIVYSLCGLLASLAGIIEVARLSSAQPTAGTGYELDAIAAVVLGGTSLAGGKGRIVGTLIGALILGFLNNGLNLLGVSSYYQMIVKAVVILLAVLVDNKKQ

SEQ ID NO: 40471 - DNA, 942 bp, Streptococcus agalactiae NEM316
  CDS (1)..(942): transl_table=11
gtgaaaaatatgatgaaatatatatcagagttaacaaccctgattgcgttagctggtttaatggttattatcacactcattaatcctaatttcctcacaaccaataatctactcaatttattattacaagtaactgcaaatggttttatcgctttcgggatgaccttcgttattttgactggcggtattgatttatcagtcgggtccatattagccctatctagtgcattaacagctggattaatcggccacggagtacccgttggtattgctatcgttttatctgttgccttaggtggcatcttgggaatgctaaacggactcttcatttcttacggaaaattagcaccatttatcgttacactggcaacaatgactatctttagaggagcaacgctagtttattcaaacggcaacccaattaccgctggcttatccgatagttttctattccaatttttgggacaaggctatattgttggtatcccattcccagtcattctcatgtttcttacttttattattttgtatattttgttacataaaacagccttcgggaaatctgtttacgctttaggaggtaatgaaaaagcagcgtatatctcgggtattaagttaaacaaagttaaaattatcatctacactatctcaggtatcatggcttccatttctgggttaattatcacatcacgccttagctcagcacaaccaacagctggagcaagttatgagatggatgctattgccgccgttgtcttaggtggaacgtctttatctggtgggaaaggacgtatcattggaacattgattggtgctctcattattggtgtcctgaacaatggattaaacatcattggtgtctctgcattttggcaacaagttgtgaaaggtatcgttattttaatggctgttttacttgatcgctttaaagtagcaaaatag

SEQ ID NO: 40472 - protein, 313 aa, Streptococcus agalactiae NEM316
MKNMMKYISELTTLIALAGLMVIITLINPNFLTTNNLLNLLLQVTANGFIAFGMTFVILTGGIDLSVGSILALSSALTAGLIGHGVPVGIAIVLSVALGGILGMLNGLFISYGKLAPFIVTLATMTIFRGATLVYSNGNPITAGLSDSFLFQFLGQGYIVGIPFPVILMFLTFIILYILLHKTAFGKSVYALGGNEKAAYISGIKLNKVKIIIYTISGIMASISGLIITSRLSSAQPTAGASYEMDAIAAVVLGGTSLSGGKGRIIGTLIGALIIGVLNNGLNIIGVSAFWQQVVKGIVILMAVLLDRFKVAK

SEQ ID NO: 40473 - DNA, 990 bp, Escherichia coli CFT073
  CDS (1)..(990): transl_table=11
atgatgtcttctgtttctacatcgggttctggcgcacctaagtcgtcattcagcttcgggcgtatctgggatcagtacggcatgctggtggtgtttgcggtgctttttatcgcctgtgccatttttgtcccaaattttgccaccttcattaatatgaaagggttgggcctggcaatttccatgtcggggatggtggcttgtggcatgttgttctgccttgcttccggtgactttgacctttctgtcgcctccgtaattgcctgtgcgggtgtcaccacggcggtggttattaatctgactgaaagcctgtggattggcgtggcagcggggttgctgctgggcattctctgtggtctggtcaatggctttgttatcgccaaactcaaaataaatgccctgatcacgacactggcaacgatgcagattgttcgaggtctggcgtacatcatttcagacggtaaagcggtcggtatcgaagatgaaagcttctttgcccttggttacgccaactggttcggtctgcctgcgccaatctggctcaccgtcgcgtgtctgatcatctttggcttgctgctgaataaaaccacctttggtcgtaataccctggcgattggcgggaacgaagaggctgcgcgtctggcgggtgtaccggttgttcgcaccaaaattattatctttgttctctctggcctggtatcagcgatagccggaattattctggcttcacgtatgaccagtgggcagccaatgacgtcgattggctatgagctgattgtgatctccgcctgcgttttaggtggcgtttctctgaaaggcggcatcggaaaaatctcatatgtggtggcgggtatcttaattttaggcaccgtggaaaacgccatgaacctgcttaatatttctcctttcgcacagtacgtagttcgcggcttaatcctgctggcagcggtgattttcgaccgttacaagcaaaaagcgaaacgcactgtctga

SEQ ID NO: 40474 - protein, 329 aa, Escherichia coli CFT073
MMSSVSTSGSGAPKSSFSFGRIWDQYGMLVVFAVLFIACAIFVPNFATFINMKGLGLAISMSGMVACGMLFCLASGDFDLSVASVIACAGVTTAVVINLTESLWIGVAAGLLLGILCGLVNGFVIAKLKINALITTLATMQIVRGLAYIISDGKAVGIEDESFFALGYANWFGLPAPIWLTVACLIIFGLLLNKTTFGRNTLAIGGNEEAARLAGVPVVRTKIIIFVLSGLVSAIAGIILASRMTSGQPMTSIGYELIVISACVLGGVSLKGGIGKISYVVAGILILGTVENAMNLLNISPFAQYVVRGLILLAAVIFDRYKQKAKRTV

SEQ ID NO: 40475 - DNA, 1011 bp, Escherichia coli CFT073
  CDS (1)..(1011): transl_table=11
atgagtgcattaaataagaaaagttttcttacttacctgaaagagggcggtatttacgtcgttcttttagttttgctggcgattattattttccaggacccaacatttttaagtctgttgaacttaagtaatattctcacccagtcatcggtgcgtattattatcgcgcttggtgtggcagggttaattgtcacccaggggactgacctttccgcaggtcgccaggtggggctggcggcagtagtagcagcgacgttattgcagtccatggataacgccaacaaagtgttcccggaaatggcgacgatgccgattgcgctggttattctgattgtctgtgccattggtgcggtgatcggtttgatcaacggcttgattatcgcctatctcaacgtgacgccgttcattaccacgctcggtacgatgattatcgtctacggcattaactcgctctattacgactttgtcggggcatcgccaatttccggttttgacagtggtttctccacttttgcccaaggctttattgcgctggggagtttccgtctctcttacatcaccttctatgcgttgattgcggtggtgtttgtctgggtgttatggaacaaaacccgcttcggtaagaacatttttgccattggcggtaacccggaagcggcgaaagtatctggtgtcaacgtcggcctgaacctgctgatgatttacgcgttgtctggtgtgttctatgccttcggcgggatgttagaagccggacgtatcggctcagccaccaacaacctcggctttatgtatgagctggatgctatcgcggcgtgcgtggtaggcggcgtatcgttcagcggcggtgtggggacggtaattggtgtggtgaccggggtgattatttttaccgtcatcaactatggtctgacgtacatcggcgtaaacccgtactggcagtacatcatcaaaggggcgattattatcttcgccgtggcgctggattcactgaaatacgcgcgtaagaagtga

SEQ ID NO: 40476 - protein, 336 aa, Escherichia coli CFT073
MSALNKKSFLTYLKEGGIYVVLLVLLAIIIFQDPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFIALGSFRLSYITFYALIAVVFVWVLWNKTRFGKNIFAIGGNPEAAKVSGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 40477 - DNA, 999 bp, Escherichia coli CFT073
  CDS (1)..(999): transl_table=11
atgtctgcttcgtcattaccattgccgcagggcaagagcgtctcgctcaaacaatttgtcagtcgccatattaatgagatcggtttgctggtggtgattgccattctttatctggtcttctccctgaatgcgcctggctttatctcattgaataaccagatgaacgtgctgcgcgatgccgccaccattgggatcgccgcctgggcgatgacgctgattattatctccggtgaaattgatgtcagcgttgggccgatggtggcttttgtttcagtgtgcctggcgtttttgctgcaatttgacgttccgctggcgattgcttgtctgctggtgttgctgttaggtgcgctgatgggaacgctcgccggggtgctgcgcggcgtgtttagcgtgccaagttttgttgccacgctgggtttatggagcgccctgcgcggaatggggctgtttatgacgaacgccttgccagtgccaattaacgaaaacgaagtgctggattggctgggcggacaatttctcggtgtgccggtatccgcgctgatcatgatggtgttatttgcgctgtttgtgttcattagccgcaaaactgccttcgggcgctcggtttttgctgttggcggtaatgccactgcagcgcagttgtgcggtattaacgttcgtcgggtacgcattcttatttttaccctttcgggattattagcggcggtgaccggcattttgttggcggcccgcctcggttccggtaacgcaggtgccgcaaacggtctggagtttgacgtcatcgccgcggtcgtggtcggcggtacggcgctttccggcggtcgcggctcgttgttcggtacgctgcttggcgtactggtgattacgctaatcggtaacggtctggtgctgctcgggattaactcctttttccagcaggtggtgcgcggcgtcatcatcgtggtggcggtgctggcgaatatcttgctgacccagcgtagcagtaaagcgaaacgctaa

SEQ ID NO: 40478 - protein, 332 aa, Escherichia coli CFT073
MSASSLPLPQGKSVSLKQFVSRHINEIGLLVVIAILYLVFSLNAPGFISLNNQMNVLRDAATIGIAAWAMTLIIISGEIDVSVGPMVAFVSVCLAFLLQFDVPLAIACLLVLLLGALMGTLAGVLRGVFSVPSFVATLGLWSALRGMGLFMTNALPVPINENEVLDWLGGQFLGVPVSALIMMVLFALFVFISRKTAFGRSVFAVGGNATAAQLCGINVRRVRILIFTLSGLLAAVTGILLAARLGSGNAGAANGLEFDVIAAVVVGGTALSGGRGSLFGTLLGVLVITLIGNGLVLLGINSFFQQVVRGVIIVVAVLANILLTQRSSKAKR

SEQ ID NO: 40479 - DNA, 990 bp, Escherichia coli CFT073
  CDS (1)..(990): transl_table=11
atgacagagaaaactcttgccagtccgaaaccttcggaaattcccattgcaaataattttaaaaaagtcttcaggcaatatggtggtatcctcagtggaatggtggtgttaatcattctgttcagttttattaatgacagtttttttaccgccaataacattactaatattattcttcaggtttcgataattgcaattaccgcctatggaatgacttatgtgcttttgcttggcgatattgatttatcggtcggttcaaccattgcattgattggcacatttgctgcgcttggggcttcatggggaattccatttgttttattggtcccattatccattattgcagcactggctttggggatgataaatggtggcttgacggctatagcggggatcccttcgtttattgtcaccgttgctactatggggatcttccgtggtatcgcttatatagtgaccgatggtatgcccatcatgattaaagatgatgcttttctggcgctggggaatggagaatttctctatatacctattcctatatggatattaatcatcttattgctgataaaccacttcattcttactaaaacaacctttggacgaaaaatttatatcactggtggtaataaagaagcggcaatttattcagggataaatgtcacccgcttgaaaattaaagtctttatgattacagccgtgctggcaggtatcagcgggatgatccttgcctcacgcctctattccgggcaaccgaattccgcgttgagctacgaactggatgctattgccgcggctgtactgggaggcaccagcctgaatggcggctatggaaccgtggtggggacggtgatcggcgcattaaccatcggcgttattaataatggcatgaacttaatgaatgttccttatttttaccagatggtggttaaaggattagtcattcttgtagccgtttattttgacgtaagaaataaaagaaaacgcagctaa

SEQ ID NO: 40480 - protein, 329 aa, Escherichia coli CFT073
MTEKTLASPKPSEIPIANNFKKVFRQYGGILSGMVVLIILFSFINDSFFTANNITNIILQVSIIAITAYGMTYVLLLGDIDLSVGSTIALIGTFAALGASWGIPFVLLVPLSIIAALALGMINGGLTAIAGIPSFIVTVATMGIFRGIAYIVTDGMPIMIKDDAFLALGNGEFLYIPIPIWILIILLLINHFILTKTTFGRKIYITGGNKEAAIYSGINVTRLKIKVFMITAVLAGISGMILASRLYSGQPNSALSYELDAIAAAVLGGTSLNGGYGTVVGTVIGALTIGVINNGMNLMNVPYFYQMVVKGLVILVAVYFDVRNKRKRS

SEQ ID NO: 40481 - DNA, 987 bp, Vibrio vulnificus CMCP6
  CDS (1)..(987): transl_table=11
atgagtagtgaaatcatgagcaaaagaaaatcaaatgagacaaacaaaacttggatcagtaaagagtggctcattgagcagaaatcgctcatcgcgttacttttcctcatcgtggtggtctcttttctcaatccaaactttttcaccgtagacaacattctcaacattcttcgtcaaacctcggtgaacgcgatcatcgccgtggggatgaccttggttattctgactgcgggcatcgatttgagtgtggggtcggtgttggccctatgtggcgcgtttgctgctagccttgtcgcgatggaagtcccggtattcatcgcggtgccaaccgcgctgttagcgggggcaacgttgggggccattagcggcattattatcgccaaaggcaaagttcaagcctttatcgccacactggtgacgatgaccttgctgcgtggtgtcaccatggtgtataccgatggccgtcctatctctacgggttttaccgatactgccgatgcgtttgcttggtttggcactggctatgcgctaggcattccggtaccggtttggttgatggtggtggtgtttgcggccgcttggtatctgcttaatcacacccgctttggtcgctatgtgtatgcactgggtgggaacgagtctgccactcgtctatccggtatcaacgtcgacaaagtcaaaatcggtgtttacgcgatttgcggcctacttgctgctttggcaggcatcatcgtcacatcacgtctatcttcggctcaaccaacggcagggatgggctatgagcttgatgcgattgccgccgtggtgcttggtggtaccagtttaatgggtggtaaaggacggattatgggtacgttgattggtgcgttaatcatcggtttcctaaacaacgcgctgaacttactcgatgtttcttcttactaccaaatgatcgccaaagctgctgttattttgctggcggtaatggtggataacaaaaataaatga

SEQ ID NO: 40482 - protein, 328 aa, Vibrio vulnificus CMCP6
MSSEIMSKRKSNETNKTWISKEWLIEQKSLIALLFLIVVVSFLNPNFFTVDNILNILRQTSVNAIIAVGMTLVILTAGIDLSVGSVLALCGAFAASLVAMEVPVFIAVPTALLAGATLGAISGIIIAKGKVQAFIATLVTMTLLRGVTMVYTDGRPISTGFTDTADAFAWFGTGYALGIPVPVWLMVVVFAAAWYLLNHTRFGRYVYALGGNESATRLSGINVDKVKIGVYAICGLLAALAGIIVTSRLSSAQPTAGMGYELDAIAAVVLGGTSLMGGKGRIMGTLIGALIIGFLNNALNLLDVSSYYQMIAKAAVILLAVMVDNKNK

SEQ ID NO: 40483 - DNA, 1086 bp, Bradyrhizobium japonicum USDA 110
  CDS (1)..(1086): transl_table=11
gtgatggccatgcccctggaatccccgatcaccttctcgaatgtcggcaagatcaagtggtggcagcgcggcatcttcgcctcccagaccggctacgtgctgctcgcgctggccgtgctgctggtgatcatgcatttcgccagcccgtatttcttcacccagggcaacatgcagaacgtggcgaagaacttttccttcatcgccatcgccaccctcggcgtcaccttcgtgatcatcaccggcggcatcgatctctcggtcggctcgatgatgtgcttctcggccatgatcacctcgatggtcatgaccgagctgtcgacgccgggcgggctcggcgcctcgctcttcgtgcacatggcggccgacggcaagacggtgctggccaatgtccccggcctgatcctgctgatctccgtcgtcgcgggccttggcgtcgcgctgatcgccggtctcgtcaacggcttctgcatcgcggtgctgggcctgtcgccgttcgtgaccacgctcggcatgctctcgatcgtgcgcgggctcggctatgtcgtctccaacgggcgcggcagctttcctggcgggccggacgccgattacttctacgcgctcacctcgggcgacgtgctcggcgtgcccgtaccgttcatctatctcgtgatccttgcgctggcgatggcggtggtgctgcaccacacctcgttcggccgccacgtcttcgcgctcggcggcaacgagaaggcggccgaactgaccggcatcccggtcgtgcgcgtgaagatcgaggtctatgtgctctgcgcgctcgccgctggcctccagggcatcatcatctccggctggctcggatcggcacccgccaacatggcgacctcctacgagctcaacgtgatcgcggcggccgtcatcggcggtgccaaccttgccggcggcatcggcgggccgctgggggccattgtcggctgcgtgctgctggaggtgatccgcaacggtctcgtgctggcacaggtcagctcctactggcagcagacgctggtgggcgtgatcatcatcctggccgtgctggtcgatcgtgtgcgctcgcggatgatctga

SEQ ID NO: 40484 - protein, 361 aa, Bradyrhizobium japonicum USDA 110
MMAMPLESPITFSNVGKIKWWQRGIFASQTGYVLLALAVLLVIMHFASPYFFTQGNMQNVAKNFSFIAIATLGVTFVIITGGIDLSVGSMMCFSAMITSMVMTELSTPGGLGASLFVHMAADGKTVLANVPGLILLISVVAGLGVALIAGLVNGFCIAVLGLSPFVTTLGMLSIVRGLGYVVSNGRGSFPGGPDADYFYALTSGDVLGVPVPFIYLVILALAMAVVLHHTSFGRHVFALGGNEKAAELTGIPVVRVKIEVYVLCALAAGLQGIIISGWLGSAPANMATSYELNVIAAAVIGGANLAGGIGGPLGAIVGCVLLEVIRNGLVLAQVSSYWQQTLVGVIIILAVLVDRVRSRMI

SEQ ID NO: 40485 - DNA, 978 bp, Bradyrhizobium japonicum USDA 110
  CDS (1)..(978): transl_table=11
atgaccgacatcaccaaggaggcgatcgtgccgccccgctccttcctgtcgcaggacgcgatccaggtgttctatcgcctgctcgcagctttgctgatctgcgccgtgctggccgtgctcagcgattccttcctgagcctcggcaacatcctcaatgtgctgaggcaggcgagcctgaccttcttcatcgcctccggcctgacgctggtggtgctgaccgcgggcctcgatctctccgtcggcgccaatgtcgcgctgtcggcctgtatcgccggaaccgtgatccacaagaccggctcgccggcactcggcatcctcaccggccttgcctgcggcggcatcgtcggccttctcaacggtgtcatggtcaccgcgctgcgcatcccctccttcatcgcgacctatggcatgctctgggtgctgaacggcctgacctactggtacatggcgggcgagacccttcacggttttccggcaggcttccgccagatcggcagcggctatctgttcggcctgccgatcccggtctacctgctgctggtcttcctcggcatcggaacgctgtttgcccagcgcacgatctggggccaggagatctacgcgatcggcgccaatccggtcgcggcgcggctctccggcattccggtcgcgcggcgcctgctgctggtctatgccgtctccggcaccatggcggggctcgcctcgatcatcttcctgtcgcggctcaattcggccgaggccgacatcggcgagagcctgacgctaccggcaatcgcggccgtgctgatcggcggcacctcgctgttcggcggtgtcggcaccgtgttcggcaccttcatcggcgcgttgatcctgacgctggtgctgaacggcatgaacctgctctcggtcagcgccaactggcagccgctcgtcaccggcgtcatcgtcatcctcgcggtctggctcgacatgaagacccgccgccgcgcgcaatga

SEQ ID NO: 40486 - protein, 325 aa, Bradyrhizobium japonicum USDA 110
MTDITKEAIVPPRSFLSQDAIQVFYRLLAALLICAVLAVLSDSFLSLGNILNVLRQASLTFFIASGLTLVVLTAGLDLSVGANVALSACIAGTVIHKTGSPALGILTGLACGGIVGLLNGVMVTALRIPSFIATYGMLWVLNGLTYWYMAGETLHGFPAGFRQIGSGYLFGLPIPVYLLLVFLGIGTLFAQRTIWGQEIYAIGANPVAARLSGIPVARRLLLVYAVSGTMAGLASIIFLSRLNSAEADIGESLTLPAIAAVLIGGTSLFGGVGTVFGTFIGALILTLVLNGMNLLSVSANWQPLVTGVIVILAVWLDMKTRRRAQ

SEQ ID NO: 40487 - DNA, 1191 bp, Bradyrhizobium japonicum USDA 110
  CDS (1)..(1191): transl_table=11
atgaccgacaagacggtttcgctgcccgaggagcgccggcacggcagcttcatcaagaataatttgcgcaattacggcatgctgatgtcgctgatcgcgatcatgctgttcttccaggtcatgaccggcggcacgctgctccagccgctcaatttgaccaacctggtgctccagaacagctacatcgtcatcatggcgctcggcatgctgctggtgatcgtcaccggccatatcgacctctcggtcggttcggtcgcgggcttcgtcggcgcggtggccgccgtgctgatggtgacctacaaggtcgactacacgctggccttcatcgcctgcctgctgctgggcgccgcgatcggcgcggcgcagggctattgggtggcctatttcaagatcccgtccttcatcgtgacgctggccggcatgctcgtgttcaagggtcttgcgcttgcggtgttgcagggccagtcgctcgggccgttcccggcgaccttccagaaactgtcctcgggcttcattccggagatcctgcccgaggccggcacgctgcatccgacctccatgctgatcggcgccgtgctcgcgctcggcctcgtttatgtcagcgccaagggccggtcgcgcgagcagtcgcacggcatcgaggtcgagccttatgccttcttcctcggcaagagcattttgctggcctgcgccgtgctctacttcacctatctgatcgcctcgcatcgcggcctgcccaacgtgctggtgatcatgggcgcgctgatcgcgctctacggcttcgtcacccgtcgcaccgtgatcgggcggcagatctacgcggtcggtggcaatgccaaggcggcaagcctgtcgggcatcaagaccgagcggctgaccttcctcaccttcgtcaacatgggcgtgctggccgcgctcgccggcctcgtcttcgccgcgcgtctcaacaccgcgacgccgaaggcgggcctgggcttcgagctcgacgtcatcgccgcctgcttcatcggcggcgcctcggcctatggcggcgtgggccgcgtcggcggcgccgtggtcggcgccatgatcatgggcgtgatgaacaacggcatgtccatcctcggcatcggcatcgactatcagcaggtcatcaagggcctggtgctgctgggagcggtgtgcatcgacgtgtataatcagcggcggtga

SEQ ID NO: 40488 - protein, 396 aa, Bradyrhizobium japonicum USDA 110
MTDKTVSLPEERRHGSFIKNNLRNYGMLMSLIAIMLFFQVMTGGTLLQPLNLTNLVLQNSYIVIMALGMLLVIVTGHIDLSVGSVAGFVGAVAAVLMVTYKVDYTLAFIACLLLGAAIGAAQGYWVAYFKIPSFIVTLAGMLVFKGLALAVLQGQSLGPFPATFQKLSSGFIPEILPEAGTLHPTSMLIGAVLALGLVYVSAKGRSREQSHGIEVEPYAFFLGKSILLACAVLYFTYLIASHRGLPNVLVIMGALIALYGFVTRRTVIGRQIYAVGGNAKAASLSGIKTERLTFLTFVNMGVLAALAGLVFAARLNTATPKAGLGFELDVIAACFIGGASAYGGVGRVGGAVVGAMIMGVMNNGMSILGIGIDYQQVIKGLVLLGAVCIDVYNQRR

SEQ ID NO: 40489 - DNA, 1029 bp, Bradyrhizobium japonicum USDA 110
  CDS (1)..(1029): transl_table=11
atggcgagcagtgagacggcctttgctgaagctcatcgggcgcgcggtctggcgcccttcctgcgctcgcagatgcgcaacatcgcgccgttcctgacgctgatcttcctgtccgccttcttcgccgtcgccagcccctccttcgccacgctcgacaatctcggcaacatcctgacgcaggtgtcggtaacaggcatcatcgccgtcggcctcaccttcgtgatcctctgcgccgagatcgacctgtcgatcgccagcatcgccaatgtcaccggcatcgcggttgcctatttcacgctgcaggagtcctacgtcaacatcgccaacatccccctgcccggcgcggttgcgatcatcctgtcgatcctgctctgcgccctgctcggcctcgtcaatgcgctgggcctgaccgtgatcggcatcccctccttcatcatgaccttggcgatgatgcagatcgcggccggcatctcggcgctgctggtgcgcggccagatcgcctacaaggtgcccggcctgatcacgacgctcggctccggatcgatcggcggcatcccctggatcgtcatcgtcgcggccatcatgctgctcggcggccatctggtgctgacctacacgcgcttcggccgctacgtctacatggtcggcggcaaccgcgaggccgccgaatattccggcctcaacgtcaagttcatcctcggcgcggtgatggtgatctcggcggtgtgctccggcatcggcggcatgctgggcgtcgcccatttcggcagcgcgcagcagaacgagttcgacacctatttgctcgactccatcgccgccgtcgtggtcggcggcaccagcctgttcggcggccgcggcggcatcggcaacaccatcgtcgggctcttcgtcctgggggtcctgaataacggcctcgaccacgtcaacatcgacagctttttgaagatcctgatccgtggcctgatcctgctggcggccttgatcatcaacgtctacgcccagcggttgagggagaaggcggcggagtag

SEQ ID NO: 40490 - protein, 342 aa, Bradyrhizobium japonicum USDA 110
MASSETAFAEAHRARGLAPFLRSQMRNIAPFLTLIFLSAFFAVASPSFATLDNLGNILTQVSVTGIIAVGLTFVILCAEIDLSIASIANVTGIAVAYFTLQESYVNIANIPLPGAVAIILSILLCALLGLVNALGLTVIGIPSFIMTLAMMQIAAGISALLVRGQIAYKVPGLITTLGSGSIGGIPWIVIVAAIMLLGGHLVLTYTRFGRYVYMVGGNREAAEYSGLNVKFILGAVMVISAVCSGIGGMLGVAHFGSAQQNEFDTYLLDSIAAVVVGGTSLFGGRGGIGNTIVGLFVLGVLNNGLDHVNIDSFLKILIRGLILLAALIINVYAQRLREKAAE

SEQ ID NO: 40491 - DNA, 1041 bp, Bradyrhizobium japonicum USDA 110
  CDS (1)..(1041): transl_table=11
atgcctgataacggatcgacgcaggcgaaggccgccacggcaaacggcctggccgccgcccaggagaccaggcgtcagcgcatcaggcttctgatccgcgcggccggcatgctgccggtgctgctgctgctatgcgccggctttcactacctgtcggatggccgtttcttcaccggacagaatctcggcatcgtcttgcagcaggccgccgtcaacaccgtgcttgccgcgggcatgaccttcgtcatcctgaccggcggcatcgatctctcggtcggctcgatcctggcggcgtccgcgatggccggcctgacgatctcgaaactgccggagctcggggcgctgtggctgccggccgccgttctcaccggcctcggcttcggtgtcgtcaatggcgcgctgatcgcgctgttgcgcctgccgccgttcatcgtgacgctgggctcgctcaccgccgtgcgcggtctggcgcggctgctcggcgccgacaccacggtgttcaatccttccattccctacgccttcatcggcaacggctcgctgacgctcgttccgggcgttgcttcgatcccgtggctctcggtgatcgctttgctcgtcatcctcgtctcgtggctggtgctgcgccggaccgtgctcggcgtgcacatctacgcggtgggcggcaacgagagcgcggcgcggcttgccggcatcaaggtctgggccgtgctgatcttcgtctacggcgcatcggggctgctggccggacttggcggcgccatgcaggcggcgcggctctatgcggccaacggccttcaactcggccagtcctatgaactcgacgccatcaccgccgtgatcctcggcggcacctctttcgtcggcggtatcggctcgatctggggcacgctggtcggcgcgctgatcatcgcggtcctgtcgaacggcctgatcctcaccggcgtctcggacatctggcaatatgtgatcaagggcctggtgatcatcggcgccgtggcgctggaccgctaccggttgcaaggctcggccagaacctga

SEQ ID NO: 40492 - protein, 346 aa, Bradyrhizobium japonicum USDA 110
MPDNGSTQAKAATANGLAAAQETRRQRIRLLIRAAGMLPVLLLLCAGFHYLSDGRFFTGQNLGIVLQQAAVNTVLAAGMTFVILTGGIDLSVGSILAASAMAGLTISKLPELGALWLPAAVLTGLGFGVVNGALIALLRLPPFIVTLGSLTAVRGLARLLGADTTVFNPSIPYAFIGNGSLTLVPGVASIPWLSVIALLVILVSWLVLRRTVLGVHIYAVGGNESAARLAGIKVWAVLIFVYGASGLLAGLGGAMQAARLYAANGLQLGQSYELDAITAVILGGTSFVGGIGSIWGTLVGALIIAVLSNGLILTGVSDIWQYVIKGLVIIGAVALDRYRLQGSART

SEQ ID NO: 40493 - DNA, 1011 bp, Clostridium tetani E88
  CDS (1)..(1011): transl_table=11
atgtcggaatttgtaaacaaggagaaaaaaataaatacaaaaaatataaaagaatttgcaggtaagtatgcaatatatttggttcttttagctttgttattatccataggatttctagatagtaatttcctttcaaaacgaaatattataaatgtattaattatagcatctgtacgtgtaataatagcactaggtgttggtggagcattgattaccagaggaacagatttatcagcaggacgtgtagttggatttactgcatgtatatcggctagtttattacaaagaccagattatgcatataaactatttaaaaatgcacctcaactacctttaataatacctatattattagtaatatttatagggcttcttataggtgtaataaatggattagttgtagcttacttaaaagtacctccttttatagctactttaggaatgatggttatagtatatggagcagcatgtatatatactaatgctcaacctataggaggtctaagaaaagatttttcagaactgggaacagggtcaacgctaggtatacctaatttaataataattgctggactagtaatacttgtaatgtggtttatattaaataaaactaagtttggaaaacatatatatgccatagggggaaatccaaatgctgcagaagtttcaggggtaaatgtagatcttacacttgtaaaagtttatgcattagcgggagctttatatggattagcaggagcattactagctgcaagaacaggtggagctacaaataattatggtctaatgtatgaattagatgccatagctgcggctactataggaggagtttcaacttcaggtggaattggaacggttcaaggtataataacaggtgttttaatatttgaggttttaaataatggattagttatcttaggtgtatctgcatattggcaacaagttataaagggaattataatcataggagctgtagcctttgatattagaaaatatattgctaaaaaataa

SEQ ID NO: 40494 - protein, 336 aa, Clostridium tetani E88
MSEFVNKEKKINTKNIKEFAGKYAIYLVLLALLLSIGFLDSNFLSKRNIINVLIIASVRVIIALGVGGALITRGTDLSAGRVVGFTACISASLLQRPDYAYKLFKNAPQLPLIIPILLVIFIGLLIGVINGLVVAYLKVPPFIATLGMMVIVYGAACIYTNAQPIGGLRKDFSELGTGSTLGIPNLIIIAGLVILVMWFILNKTKFGKHIYAIGGNPNAAEVSGVNVDLTLVKVYALAGALYGLAGALLAARTGGATNNYGLMYELDAIAAATIGGVSTSGGIGTVQGIITGVLIFEVLNNGLVILGVSAYWQQVIKGIIIIGAVAFDIRKYIAKK

SEQ ID NO: 40495 - DNA, 987 bp, Clostridium tetani E88
  CDS (1)..(987): transl_table=11
gtgataggaggaaaaaatatgactgaattaagcagagaaaataataaagttagtaaaaaggatattatacaaaagtttagtacagttttgattttagtaatgctgatgattgctctaacagttatgaaacctgtttttatgactagaaataatattatgacaatcttacttcaaacagctgttattgcggttatagctataggtgaaactttagtaataataacatctggtatagatctttctgtaggatctttagttgcaatctcaggtgttgctagtgctatttttatgagagatggtatgaatatgatcctagcttgcatgcttggtatacttataagtacagcttgtggattaattaatggatttatagtagctaaaggaaatattccagagtttatagtaacacttggtatgatgagtatagttagaggtgcttcattagttgttacacaaggcttacctgtttcaggattaccagatggctttcaagtattaggtactggaaaattatttggggttattccagttccagcagtgataatgattattttagccatgatttttaccctgatattaagaaaaacacttataggaagatatacttatgctataggaagtaatgaagaagctacaaagctttcaggaataaatacagatagagttaaaattacggtttatggattaagtggattattagcaggaatagctggtatattacttacagcaagacttatatctgcacaaccaacagctgggacaggctatgaattagatgctatagctgcggctgttattggaggagctagtcttgcaggtggagaaggaactataacaggaactataataggggctttaataatgggtgtattaagaaatggacttaaccttttaaatgtttcagcattttggcaacaaatagttataggagctataattatagctgctgtatatggagataagttgaaaaataaaaaattaaattag

SEQ ID NO: 40496 - protein, 328 aa, Clostridium tetani E88
MIGGKNMTELSRENNKVSKKDIIQKFSTVLILVMLMIALTVMKPVFMTRNNIMTILLQTAVIAVIAIGETLVIITSGIDLSVGSLVAISGVASAIFMRDGMNMILACMLGILISTACGLINGFIVAKGNIPEFIVTLGMMSIVRGASLVVTQGLPVSGLPDGFQVLGTGKLFGVIPVPAVIMIILAMIFTLILRKTLIGRYTYAIGSNEEATKLSGINTDRVKITVYGLSGLLAGIAGILLTARLISAQPTAGTGYELDAIAAAVIGGASLAGGEGTITGTIIGALIMGVLRNGLNLLNVSAFWQQIVIGAIIIAAVYGDKLKNKKLN

SEQ ID NO: 40497 - DNA, 951 bp, Clostridium tetani E88
  CDS (1)..(951): transl_table=11
atgaaaggaaataaaatgaacaacaatataaaagaattccttttgaagtttaaatcgttatttggattgatattactatgtataataatttctatattaacaccaagatttttaaatgtatctaacataatgaatgtatttactcaagtatctgttaatgcaatattagctataggaatgtcttttgtaattttaactggaggaattgatttatctgtgggatcaacacttgctataacaggtgccctttctgctagtataataagacttactaatagtatctttttatccttggttgtagctttaataattggagcagcaattggactgatgaatggagtaacagtagctaaaggaaagatacaagcttttatagtaactttagcaactatgactgtatttagaggggttactatggtatatacaaatggtacgccaatatcaggactatctgagaagtttatggtaataggtaataaaaagatattaggatatataccagttccagctataataactataataatacttattatggcatggtatgttttaagtcaaactagatatggaagatatgtttacgctcttggaggtaatgaagattcagctaggctttcaggaataaatacagataaagttaaaatgcttgtgtatgtaatatgtggcatgacagctgctttaagtggtgtaattacaactagcagggtgggaacagcttctccaaatgctggacttggttttgaactggatgctatagcagcagtagtacttggtggaactagtttagctggtggggaaggaacagttgttggaactataataggagctatgataataggtgttttgaataatggattaaacttagcaggagtatcggcatattatcaatctattgtaaaggggttagtaatacttctagctgttttaatagataaaaagagtaaaaaataa

SEQ ID NO: 40498 - protein, 316 aa, Clostridium tetani E88
MKGNKMNNNIKEFLLKFKSLFGLILLCIIISILTPRFLNVSNIMNVFTQVSVNAILAIGMSFVILTGGIDLSVGSTLAITGALSASIIRLTNSIFLSLVVALIIGAAIGLMNGVTVAKGKIQAFIVTLATMTVFRGVTMVYTNGTPISGLSEKFMVIGNKKILGYIPVPAIITIIILIMAWYVLSQTRYGRYVYALGGNEDSARLSGINTDKVKMLVYVICGMTAALSGVITTSRVGTASPNAGLGFELDAIAAVVLGGTSLAGGEGTVVGTIIGAMIIGVLNNGLNLAGVSAYYQSIVKGLVILLAVLIDKKSKK

SEQ ID NO: 40499 - DNA, 1233 bp, Tropheryma whipplei str. Twist
  CDS (1)..(1233): transl_table=11
atggaaataatgaaaattaaacttttttctagtagaaattttgggattcttgttgcagccgttgcggtcgctctgttttttcaggtagcttcaggcggtaggatgctgacaagcgacaatgtgctcaatattgtcaatggaaacagccatatctttattgtgtcgattggcatggtgcttgtaattgtttcgggcaatattgatctttcagttggttctgttgctgcctttgttggaatagttgttgccgttgctaccgatagctttcatttaagcgcatggcaagccattatcctggggctgctaattgggcttgtagtcgggtgttggcaggctttttgggttgcctttgtgggtatcccggcttttattgccactttggctggcatgcttactttcagaggtctcaatcagcttgtgggcaattctcggtcagtacccgtgccagatgattttacttactttggtgccggttatctccccgatatattcactaacactgcgttcaatgtcccgacagttattttgggctttgttgtcttcctgctgttagtgataatgcagatacttcgcaggcgcaacaggaaactacttggcattcagcaagagaatattcccgtatttttactgagaatcgcaatatatgggcttgccgtggcgtatctcacatatctctttgccacaggtcatcccgggacaagcttcccaattcctggtctaatatttgttgttattgcttttatctatgtattcatctccgagagaaccatccttggaaggcatatatatgctgttggcggtaatagaaatgcagccattctctctggtgtcagtgtgaaaagagttaatttctttgtcatggcaaacatgtcaattcttgccagtattgcgggcatgatgtttgttggtcgctctggagggtctggtccatctgatggtgttggatgggaacttgacgcaatagctgctgtatttgtcggcggcgcggccgtcagcggtggtgttgggacagttattggcgcatgccttggtggtgtggttgttgcccttctaagtaacggcttgcttatcatgggtattagtgctgatatagctgcgattatcaagggtttagttttgttggcagctgtttcttttgatgtcgttagtaaaaaccgggaaaaaccgtctataatcagattgtttgtacgacgaagtggactttcgcgggataaggccggtggtcgaggatga

SEQ ID NO: 40500 - protein, 410 aa, Tropheryma whipplei str. Twist
MEIMKIKLFSSRNFGILVAAVAVALFFQVASGGRMLTSDNVLNIVNGNSHIFIVSIGMVLVIVSGNIDLSVGSVAAFVGIVVAVATDSFHLSAWQAIILGLLIGLVVGCWQAFWVAFVGIPAFIATLAGMLTFRGLNQLVGNSRSVPVPDDFTYFGAGYLPDIFTNTAFNVPTVILGFVVFLLLVIMQILRRRNRKLLGIQQENIPVFLLRIAIYGLAVAYLTYLFATGHPGTSFPIPGLIFVVIAFIYVFISERTILGRHIYAVGGNRNAAILSGVSVKRVNFFVMANMSILASIAGMMFVGRSGGSGPSDGVGWELDAIAAVFVGGAAVSGGVGTVIGACLGGVVVALLSNGLLIMGISADIAAIIKGLVLLAAVSFDVVSKNREKPSIIRLFVRRSGLSRDKAGGRG

SEQ ID NO: 40501 - DNA, 1224 bp, Tropheryma whipplei TW08/27
  CDS (1)..(1224): transl_table=11
atgaaaattaaacttttttctagtagaaattttgggattcttgttgcagccgttgcggtcgctctgttttttcaggtagcttcaggcggtaggatgctgacaagcgacaatgtgctcaatattgtcaatggaaacagccatatctttattttgtcgattggcatggtgcttgtaattgtttcgggcaatattgatctttcagttggttctgttgctgcctttgttggaatagttgttgccgttgctaccgatagctttcatttaagcgcatggcaagccattatcctggggctgctaattgggcttgtagtcgggtgttggcaggctttttgggttgcctttgtgggtatcccggcttttattgccactttggctggcatgcttactttcagaggtctcaatcagcttgtgggcaattctcggtcagtacccgtgccagatgattttacttactttggtgccggttatctccccgatatattcactaacactgcgttcaatgtcccgacagttattttgggctttgttgtcttcctgctgttagtgataatgcagatacttcgcaggcgcaacaggaagctacttggcattcagcaagagaatattcccgtatttttactgagaatcgcaatatatgggcttgccgtggcgtatctcacatatctctttgccacaggtcatcccgggacaagcttcccaattcctggtctaatatttgttgttattgcttttatctatgtattcatctccgagagaaccatccttggaaggcatatatatgctgttggcggtaatagaaatgcagccattctctctggtgtcagtgtgaaaagagttaatttctttgtcatggcaaacatgtcaattcttgccagtattgcgggcatgatgtttgttggtcgctctggagggtctggtccatctgatggtgttggatgggaacttgacgcaatagctgctgtatttgtcggcggcgcggccgtcagcggtggtgttgggacagttattggcgcatgccttggtggtgtggttgttgcccttctaagtaacggcttgcttatcatgggtattagtgctgatatagctgcgattatcaagggtttagttttgttggcagctgtttcttttgatgtcgttagtaaaaaccgggaaaaaccgtctataatcagattgtttgtacgacgaagtggactttcgcgggataaggccggtggtcgaggatga

SEQ ID NO: 40502 - protein, 407 aa, Tropheryma whipplei TW08/27
MKIKLFSSRNFGILVAAVAVALFFQVASGGRMLTSDNVLNIVNGNSHIFILSIGMVLVIVSGNIDLSVGSVAAFVGIVVAVATDSFHLSAWQAIILGLLIGLVVGCWQAFWVAFVGIPAFIATLAGMLTFRGLNQLVGNSRSVPVPDDFTYFGAGYLPDIFTNTAFNVPTVILGFVVFLLLVIMQILRRRNRKLLGIQQENIPVFLLRIAIYGLAVAYLTYLFATGHPGTSFPIPGLIFVVIAFIYVFISERTILGRHIYAVGGNRNAAILSGVSVKRVNFFVMANMSILASIAGMMFVGRSGGSGPSDGVGWELDAIAAVFVGGAAVSGGVGTVIGACLGGVVVALLSNGLLIMGISADIAAIIKGLVLLAAVSFDVVSKNREKPSIIRLFVRRSGLSRDKAGGRG

SEQ ID NO: 40503 - DNA, 1005 bp, Pseudomonas syringae pv. tomato str. DC3000
  CDS (1)..(1005): transl_table=11
atggacgccaaagcccctgttcatcaggccgccgcaaaaccgtcaggccgtgtgtggttgctcaagctgctgcccaacaatatcggcgggccattgattggtctggccctgctgttagtcgtcttttctttcagctccgaattcttcttcaccctgcgcaacggcctgaacattcttgatcaggtaacagtgctgggcattctcgccatcggcatgacagcggtgatcgtcatcggcggcattgacctatctgtcggttcggtactggcgttttcgatgatgatgctcggctggctgtatcaggatcaaggcctggcgcttggcctggcgatcccggtagcaatagcaactggcatgctcgcaggcctggtgtccggcttgttgattacctacgcccgactgcccgctttcatcgccacgctgaccatgatgtcggtcgcccgcggcctggcaaacattctcaccgagggccggcagatcgtcggttatccggagtggttcaccagcctggccacggttcgtcatttcggcttcttatcggctacggtcgggctgtttctggtcatgctggtggtggcctgggtattcctgcgctttcgggccggtggtcgcaacctgtatgccattggcggcagccccgaagtggcgcggctttcggggattaaggtgcgcgccatcaccttgtgggtgtacgccatcagcggtgcgctggccggtatagccgccgtgaccatggctgcccgcctcgactcctcgcaacccagcgccgggctgacgctggaactggacgccatcgccgcggtggtgatcggcggtgccagcctcagcggcggtgtcggcagcgtcggcggcacgctggtcggtgtgctgatcatcggcgtgctgcgtaacggcctcaacctgctcggtgtgtcgcccttcattcaacaggtggtcatcggcgtagtgattgcccttgctgtgaccatcgataccttgcgtcgccgttccaacagtgctcattaa

SEQ ID NO: 40504 - protein, 334 aa, Pseudomonas syringae pv. tomato str. DC3000
MDAKAPVHQAAAKPSGRVWLLKLLPNNIGGPLIGLALLLVVFSFSSEFFFTLRNGLNILDQVTVLGILAIGMTAVIVIGGIDLSVGSVLAFSMMMLGWLYQDQGLALGLAIPVAIATGMLAGLVSGLLITYARLPAFIATLTMMSVARGLANILTEGRQIVGYPEWFTSLATVRHFGFLSATVGLFLVMLVVAWVFLRFRAGGRNLYAIGGSPEVARLSGIKVRAITLWVYAISGALAGIAAVTMAARLDSSQPSAGLTLELDAIAAVVIGGASLSGGVGSVGGTLVGVLIIGVLRNGLNLLGVSPFIQQVVIGVVIALAVTIDTLRRRSNSAH

SEQ ID NO: 40505 - DNA, 990 bp, Pseudomonas syringae pv. tomato str. DC3000
  CDS (1)..(990): transl_table=11
atgaacaataaaaaagaggtgcgtatgtctaccgaatccagccttcaggctccccgtcagggcatgaacctgcgtcgttttgtcgatgactgggtgatgctcctggctgccgtgggaattttcctgctgtgtgccgtgttcatcgacaacttcatgtcaccgctgaacatgcgcggtcttggcctggcgatttctaccgtgggcattgccgcctgcaccatgttgttctgcctggcgtccgggcacttcgacctgtcggtgggctcggtgctggcctgctccggggtcatcgccggtatcgtcattcgcgacaccgacagcgtgtttctcggtgtgtcggcagcgctggcgctggggctggtggttggccttatcaacggcatcgtcatcgccaagctgcgtatcaatgcgctgattgcgacattggcgaccatgcagatcgtgcgcgggctggcctatatcttctccaacggcaaggccgtcggtgtttccaacgaagacttcttcatcttcggcaatggccagatctacggcgtgccggtgcctattctgatcaccatcgcctgcttcatgttcttcggctggttgctcaactacaccacctacgggcgcaacacgatggccatcggcggtaaccaggaagccgcgctgctggcgggcgtgcatgtcgatcgcaccaagatcatcatcttcgcagtacacggcctgatcggtgcgttggcgggtgtggtactggcttcccgcatgacctcgggccaaccgatgatcggccagggctttgagctgaccatcatctcggcttgtgtgctgggcggggtctcgctaagtggcggtatcggcatgattcgtcatgtgatcgctggcgtgctgattctggcaatcatcgagaacgcgatgaacctgaagaacatcgacaccttctaccagtacgtgattcgcggcacgattctgctgttggcggtgatcattgaccggatgaagcgtcgctga

SEQ ID NO: 40506 - protein, 329 aa, Pseudomonas syringae pv. tomato str. DC3000
MNNKKEVRMSTESSLQAPRQGMNLRRFVDDWVMLLAAVGIFLLCAVFIDNFMSPLNMRGLGLAISTVGIAACTMLFCLASGHFDLSVGSVLACSGVIAGIVIRDTDSVFLGVSAALALGLVVGLINGIVIAKLRINALIATLATMQIVRGLAYIFSNGKAVGVSNEDFFIFGNGQIYGVPVPILITIACFMFFGWLLNYTTYGRNTMAIGGNQEAALLAGVHVDRTKIIIFAVHGLIGALAGVVLASRMTSGQPMIGQGFELTIISACVLGGVSLSGGIGMIRHVIAGVLILAIIENAMNLKNIDTFYQYVIRGTILLLAVIIDRMKRR

SEQ ID NO: 40507 - DNA, 1137 bp, Pseudomonas syringae pv. tomato str. DC3000
  CDS (1)..(1137): transl_table=11
atgaatcaggtcaaacagttcttcacccgctacaaaatgctcgcgctggtgattgccattgccgttatctggctgtttttcagctggcagacggagggcggatttctgaccccgcgcaacctctccaacctgctgcgacagatgtccatcaccggcattctggcgtgtggcatggtgctggtcatcatcagtggcgagatcgacctgtcggtgggctcgatgctcggcctgctcggcggcctggcggcaattctcgatgtcgtttaccacgtaccgctgctggcaaacctgagcctggttgcgctgtgcgggctgatgatcggcctggccaatggttacatgactgcctacctgcgcattccgtccttcattgtcgggctgggcggcatgctggcctttcgcggcattctgctggggattaccggtggcacgaccatcgctccggtgtcgccttcgctggtctacgtcggccaagggtatttgccgcattctgtcggtacagggcttggcgtactgctgctggcgctgacgctgtttctgacctggaaacaacggcgcaacagagccctccacgggctaacggcccattcgatggttcgcgatgtgttacgcgtggtattgatcggcgcggtgctgggcgggtttgtctacatcctcaacagctacgacgggattccggttccggtgttgctgctgctggttttgctcggtgtgttcagttacgtcaccagccagacagtattcggacggcgcgtctatgccgtgggcagcaacatggaagccacgcggttatccggcatcaacgtacaggcggtgaagctttggatcttcggcatcatgggcgtgatgtgcgccttcgccgggctggtcaacaccgcgcgcctggccgcaggctcgccctcggccggcaacatgggcgaactggacgccattgccgcctgtttcatcggcggcacgtccatgcgcggcggctccggcaccgtgtatggcgccctgcttggcgcactggtgattaccagcctggacaacggcatgtcgatgctcgacgtcgacagttactggcagatgatcgtcaagggcggcatcctcgtgctggcggtgtgggtggacgtcagtacacgggccgggcgccggtga

SEQ ID NO: 40508 - protein, 378 aa, Pseudomonas syringae pv. tomato str. DC3000
MNQVKQFFTRYKMLALVIAIAVIWLFFSWQTEGGFLTPRNLSNLLRQMSITGILACGMVLVIISGEIDLSVGSMLGLLGGLAAILDVVYHVPLLANLSLVALCGLMIGLANGYMTAYLRIPSFIVGLGGMLAFRGILLGITGGTTIAPVSPSLVYVGQGYLPHSVGTGLGVLLLALTLFLTWKQRRNRALHGLTAHSMVRDVLRVVLIGAVLGGFVYILNSYDGIPVPVLLLLVLLGVFSYVTSQTVFGRRVYAVGSNMEATRLSGINVQAVKLWIFGIMGVMCAFAGLVNTARLAAGSPSAGNMGELDAIAACFIGGTSMRGGSGTVYGALLGALVITSLDNGMSMLDVDSYWQMIVKGGILVLAVWVDVSTRAGRR

SEQ ID NO: 40509 - DNA, 1026 bp, Pseudomonas syringae pv. tomato str. DC3000
  CDS (1)..(1026): transl_table=11
atgagcaacgcgattctgcaaaacaagccggccctggcgccgaccggaaaaaaaagaaggctgccgaccgagctgagtatttttctggtgctgatcggtataggcctgatctttgaactgttcggctggatcgttcgcgatcaaagctttctgctcaactcccagcgtttggtactgatgattcttcaggtgtcgatcatcggcctgctcgctatcggcgtcacgcaggtgatcatcaccacgggcatcgacctgtcgtccggctcggtattggcgttgtcggcgatgattgccgcgagtctggcgcagacctcggatttttcccgcgcggtgtttccttcgctgactgacctgcccgtatggattccgatcgtggtcgggctcggggtggggttgctggccggcgccatcaacggcagcatcatcgcgatcaccggcatcccgcccttcatcgccacattgggcatgatggtctctgcacgcggcctggcacgcttctacaccgaaggccagccggtgagcatgctctctgattcctacacggccattggccagggcgcgatgccggtcatcatctttctggtggtggcggtcattttccacattgcgctgcgctacaccaagtacggcaaatatacctacgccattggtggcaacatgcaggcggcgcgcacctcggggatcaacgtcaagcgtcacctgatcattgtctacagcatcgccgggctgctggccggattggcaggcgtggttgcctcggcgcgagccgcaaccggccaggcgggcatgggcatgtcctatgagctggatgcgatcgcggcggcagtcatcggcggcaccagcctggcgggcggcgtcgggcgaattaccggcacggtcatcggtgcgctgattctcggggtaatggccagcggcttcacgtttgttggcgtggacgcctacgttcaggacatcatcaagggtctgatcattgtggcggcggtggtaatcgatcaatatcgcaacaagcgcaagaccaagcgctga

SEQ ID NO: 40510 - protein, 341 aa, Pseudomonas syringae pv. tomato str. DC3000
MSNAILQNKPALAPTGKKRRLPTELSIFLVLIGIGLIFELFGWIVRDQSFLLNSQRLVLMILQVSIIGLLAIGVTQVIITTGIDLSSGSVLALSAMIAASLAQTSDFSRAVFPSLTDLPVWIPIVVGLGVGLLAGAINGSIIAITGIPPFIATLGMMVSARGLARFYTEGQPVSMLSDSYTAIGQGAMPVIIFLVVAVIFHIALRYTKYGKYTYAIGGNMQAARTSGINVKRHLIIVYSIAGLLAGLAGVVASARAATGQAGMGMSYELDAIAAAVIGGTSLAGGVGRITGTVIGALILGVMASGFTFVGVDAYVQDIIKGLIIVAAVVIDQYRNKRKTKR

SEQ ID NO: 40511 - DNA, 984 bp, Vibrio parahaemolyticus RIMD 2210633
  CDS (1)..(984): transl_table=11
atgagtaccaataccatgagcaaaccgaccgaaacaagcagcaaaaagctgtttactaaagagtggttgattgaacaaaaatcactgattgcactgctatttttgattgttgtagtgtcttttttaaacccgaatttttttacggtagacaacattcttaacatccttcgtcaaacctcagttaacgcgatcatcgccgtaggtatgactctggttatcttaactgctggtatcgacttgagtgtcggctctgtccttgcgctttgtggtgcatttgccgcgagcctaatcgcgatggaagtgccagttttaattgcggttccaacggctctattagctggtgcagcactgggcgcaatcagtggcatcatcatcgctaaaggcaaagtgcaagccttcatcgcgacgctggtcaccatgacattactgcgcggagtgaccatggtttacaccgacggtcgaccaatttctactggcttcacagacacggcagacgcattcgcatggtttggtacaggctacgcgttaggtattccagtgccagtttggttgatggttgttgtattcgcagcggcttggtacctacttaatcacactcgctttggtcgctatgtttacgcactaggcggcaatgagtctgcgactcgcctgtctggcattaacgtagaccgagtaaagattggtgtgtacgccatctgcggtatgttagctgcacttgcgggcatcatcgtgacttctcgtctgtcttctgctcagccaacggcgggtatgggatacgaactggatgcgattgcagctgtggtacttggcggtacgagcttgatgggcggtaaaggccgtatcatggggacattgattggtgcgctgatcatcggcttcttgaacaatgcgcttaacctactggacgtttcttcttactaccaaatgattgcaaaagcagtggttatcttgctggcggtattggtagacaacaaaaacaaataa

SEQ ID NO: 40512 - protein, 327 aa, Vibrio parahaemolyticus RIMD 2210633
MSTNTMSKPTETSSKKLFTKEWLIEQKSLIALLFLIVVVSFLNPNFFTVDNILNILRQTSVNAIIAVGMTLVILTAGIDLSVGSVLALCGAFAASLIAMEVPVLIAVPTALLAGAALGAISGIIIAKGKVQAFIATLVTMTLLRGVTMVYTDGRPISTGFTDTADAFAWFGTGYALGIPVPVWLMVVVFAAAWYLLNHTRFGRYVYALGGNESATRLSGINVDRVKIGVYAICGMLAALAGIIVTSRLSSAQPTAGMGYELDAIAAVVLGGTSLMGGKGRIMGTLIGALIIGFLNNALNLLDVSSYYQMIAKAVVILLAVLVDNKNK

SEQ ID NO: 40513 - DNA, 990 bp, Vibrio parahaemolyticus RIMD 2210633
  CDS (1)..(990): transl_table=11
atgtctgtaacaagctctacgaaaatactagaacaacaggacgcgaagcgttcatggaattttgctgggatttgggaccgattcggcatgctgatggtgttcgctggtctgtttttattgtgtgctttctttgtgccttacttcgcgacgttcatcaatatgaaaggtctgggtttggcgatctctatgagtggcatggtggcgtgtgccatgctgttttgcttggcgtgtggtgatctggatttgtcggtcgcgtccatcattgcttgctcaggtgtggttaccgccgtcgcgatcaacgcaactagcagcgtggtacttggtgtgggcgcaggtctgctttctggcgttgcctttggcctgttaaacggttttgtcattgctaagttgcaaatcaacgcactgatcaccactttggcgaccatgcagatagcacgaggcttgggctacatcatctcagatggtaaagcggtgggcatcacagaagagagcttctttgcactgggtaactcatcatttattggtatcccaacgcctatttggttgacgatcattacctttggagtttttgctttcttgctgaatcgcactgtttatggtcgtaacacgctcgcgattgggggcaacgaagaagcggctcgcttagcgggtgtgaatgtagtgaaaactaagatgattatcttcaccgtgtctggttttatctcggcattggcgggggttattttggcggcgcgtatgaccagtggtcagcctatgacgtcagtgggctttgaattggtggttatctctgcctgtgtccttggtggtgtgtcgctaaaaggtggcatcggtaaagtctcttacgtgattgctggcgtgctgattttgggtacagtcgaaaatgcaatgaaccttcttaacatgtcaccattcgcgcaatacgtcgtgcgcggtgcaatattacttgctgctgttatttttgaccgctacaaacaaaccagccgcgcataa

SEQ ID NO: 40514 - protein, 329 aa, Vibrio parahaemolyticus RIMD 2210633
MSVTSSTKILEQQDAKRSWNFAGIWDRFGMLMVFAGLFLLCAFFVPYFATFINMKGLGLAISMSGMVACAMLFCLACGDLDLSVASIIACSGVVTAVAINATSSVVLGVGAGLLSGVAFGLLNGFVIAKLQINALITTLATMQIARGLGYIISDGKAVGITEESFFALGNSSFIGIPTPIWLTIITFGVFAFLLNRTVYGRNTLAIGGNEEAARLAGVNVVKTKMIIFTVSGFISALAGVILAARMTSGQPMTSVGFELVVISACVLGGVSLKGGIGKVSYVIAGVLILGTVENAMNLLNMSPFAQYVVRGAILLAAVIFDRYKQTSRA

SEQ ID NO: 40515 - DNA, 1011 bp, Salmonella enterica subsp. enterica serovar Typhi Ty2
  CDS (1)..(1011): transl_table=11
atgagtgcgttaaacaagaaaagctttttgacctggctgaaagagggcggaatttacgtcgttcttttagtgctgctggcgattattattttccaggacccgacttttttaagtttgctgaatttaagtaatattctgacgcaatcttcggtacgtattattatcgcgctgggcgtggcgggactcatcgtcacccaggggacagacctgtcggcggggcgtcaggtagggctggcggcggttgtggcggcaacattactgcaatcaatggaaaacgccaacaaagtgtttccggaaatggcgaccatgccgattgcgctggtcatcctgattgtctgcgcgattggcgcggtgattggcctggtgaacggcatcatcattgcttacctgaacgtgacgccgtttattaccacgcttggcacgatgattatcgtttatggaatcaactccctttactatgactttgtcggcgcttcgcccatttccggctttgacagcggcttttccacctttgcgcagggctttgtggcgatgggcagtttccggctctcctacatcaccttttacgctctgattgcggtagtgtttgtctgggtgctgtggaataagacccgctttggtaaaaacatttttgctattggcggcaacccggaagcggcgaaagtttctggcgtaaacgtggcgctgaacctgctgatgatttatgcgctctccggcgtgttttatgccttcggcggcttactggaagcagggcgtattggttctgccaccaacaacctcggctttatgtatgaactggatgcgattgccgcgtgcgtggtcgggggcgtatcgtttagcggcggagtggggacggtcttcggcgtggtgaccggcgtcattatctttaccgtcatcaactatggcctgacctatatcggggtaaacccgtactggcagtacattatcaaaggcggcattatcattttcgccgtggcgctggactcgctgaaatacgcgcgtaagaagtag

SEQ ID NO: 40516 - protein, 336 aa, Salmonella enterica subsp. enterica serovar Typhi Ty2
MSALNKKSFLTWLKEGGIYVVLLVLLAIIIFQDPTFLSLLNLSNILTQSSVRIIIALGVAGLIVTQGTDLSAGRQVGLAAVVAATLLQSMENANKVFPEMATMPIALVILIVCAIGAVIGLVNGIIIAYLNVTPFITTLGTMIIVYGINSLYYDFVGASPISGFDSGFSTFAQGFVAMGSFRLSYITFYALIAVVFVWVLWNKTRFGKNIFAIGGNPEAAKVSGVNVALNLLMIYALSGVFYAFGGLLEAGRIGSATNNLGFMYELDAIAACVVGGVSFSGGVGTVFGVVTGVIIFTVINYGLTYIGVNPYWQYIIKGGIIIFAVALDSLKYARKK

SEQ ID NO: 40517 - DNA, 1044 bp, Salmonella enterica subsp. enterica serovar Typhi Ty2
  CDS (1)..(1044): transl_table=11
atgttgaaattcatccaaaataaccgggaagcgacggcactgctggcaatagtctgtttattcgtgtttcttggcgcgctggatagccagtatttgagcgtgcaaacgctgacaatggttttcagtagcgcgcaaattttgatgctgttggcgattggcgcgacgatggtaatgctcacccgcaatattgatgtatcggtgggctcgacgacaggaatgtgcgcggtattgctgggagtaatgttaaacgccggctatagcctgccggtcgcctgcctggccacactaatattaggaattgtcgccggattttttaatggcgtactggttgcctggttgaagatacccgccattgtcgccacgctgggaacgctgggcttgtatcgtgggatcatgctgctatggacagggggaaaatggattgaaggattacccgcaggcttaaagcaactctctgctccggtgtttctgggaatttccgcaatcggctggtttaccctggtgttagcgctgcttatggcctggctcctggcgaaaaccgcctttggccgcaatttttacgccaccggcgataacctgcagggcgcccggcaattgggtgtccgtaccgagatggtacgcatcatggcattttcacttaatggcggtatggcggcattggctggaatcgtgtttgcctcgcagattggcttcattcccaatcaaaccggcacggggctggaaatgaaagccatcgcggcctgcgtattggggggaattagcctgttaggcgggtcaggcacggtcatcggcgctattctcggcgcttattttcttacgcaaatcgatagtgtgttagtgctgctgcgcatccccgcctggtggaacgattttattgctggcctggtattgttgggcgtactggtattcgatgggcggctgcgttgcgcattacaacgcaatctgcgccgccagaaatatgcccgttttatatcaccacccactccactacaggcggaagcaaaaacgcacgcacaacagaataaaaacaaagaggtggcatga

SEQ ID NO: 40518 - protein, 347 aa, Salmonella enterica subsp. enterica serovar Typhi Ty2
MLKFIQNNREATALLAIVCLFVFLGALDSQYLSVQTLTMVFSSAQILMLLAIGATMVMLTRNIDVSVGSTTGMCAVLLGVMLNAGYSLPVACLATLILGIVAGFFNGVLVAWLKIPAIVATLGTLGLYRGIMLLWTGGKWIEGLPAGLKQLSAPVFLGISAIGWFTLVLALLMAWLLAKTAFGRNFYATGDNLQGARQLGVRTEMVRIMAFSLNGGMAALAGIVFASQIGFIPNQTGTGLEMKAIAACVLGGISLLGGSGTVIGAILGAYFLTQIDSVLVLLRIPAWWNDFIAGLVLLGVLVFDGRLRCALQRNLRRQKYARFISPPTPLQAEAKTHAQQNKNKEVA

SEQ ID NO: 40519 - DNA, 999 bp, Streptomyces avermitilis MA-4680
  CDS (1)..(999): transl_table=11
atgtccgcatccggtgtcgaggccggcagggggagcggcgtcgtccgcggcgagcggctcagcgccctggcccagcagcacggtgcgctggtggccctcctggtactggcacttgtcgcctcgttctccttcgactccttcgccaccggcgacaacatcgagaacctggccatgacgtcgtcgttcctggccgtggtcgcactcggcatgaccttcgtcatcgtcaccggaggcatcgacctgtccgtcgggtcggtcttcgccctcggtggcgtactcgccgcctggggctcgcggtacggcgccctggtcgccctgctgctgccgctcgcggtctgcggtctgatcggatgcgtcaacggtctgctcatcgccaggacccggctcgcccccttcatcgtcacgctcgccgcgatgctcgccgcacggggtctcatgctcaacatcaccgacgaaggcgccaccacgtatctggtcgacaaggaaacggtcttcgtccacctcggccagggcagactgctgggcgtcggcgcgccggtgtggatcaccggcgcgctgttcctggcgggtgccgtcgccctgcgccgcactcgcttcggccagaacgtctacgccgtcgggggcaacgaggacgccgccgctctcatgggagctccggtcgcccgcaccaagatcacggtgtacacgctttccgcgctgctcgccggattggcaggtgccctgaacgcggcctggctcgcctccggcgtcacgatcctcggttacggcatggagctggacgccatcgccgccgtcgtcatcggcggcacgctgctctccggtggcctcggcttcgtcagcggatccctggtgggtgtgctgctgctgaagacgatccagaacatcatcaaccagatcggctcactcgactccgcctaccagcaggtggtcagcggtggcttcctcgtggtggtcatcatcgcccagacctggctggccaggcggcgccgggtcgcctga

SEQ ID NO: 40520 - protein, 332 aa, Streptomyces avermitilis MA-4680
MSASGVEAGRGSGVVRGERLSALAQQHGALVALLVLALVASFSFDSFATGDNIENLAMTSSFLAVVALGMTFVIVTGGIDLSVGSVFALGGVLAAWGSRYGALVALLLPLAVCGLIGCVNGLLIARTRLAPFIVTLAAMLAARGLMLNITDEGATTYLVDKETVFVHLGQGRLLGVGAPVWITGALFLAGAVALRRTRFGQNVYAVGGNEDAAALMGAPVARTKITVYTLSALLAGLAGALNAAWLASGVTILGYGMELDAIAAVVIGGTLLSGGLGFVSGSLVGVLLLKTIQNIINQIGSLDSAYQQVVSGGFLVVVIIAQTWLARRRRVA

SEQ ID NO: 40521 - DNA, 1020 bp, Streptomyces avermitilis MA-4680
  CDS (1)..(1020): transl_table=11
atgacgcagcccgtatctccgcccaggggcggcaccggccaggcgtcaccggtgagtgaactccccgcatggcgctccctcgccgcccgcgccgacgtccgcacgctctcgctgctcggtgtgctcgccgccctggtcgtcatcggcggcatcaccaaacccgacgagttcctcgacacccgcaatctccaactcgtcctcacccaggcctcggtgatcggcgtcgtcaccgtcggcatgaccttcgtcatcacctccggcggcatcgacctgtccgtcggcgcgatcgtcgccctcgcctccgtatgggccaccaccgtcgccacccaggagtacggcttcgccggcatcctcttcaccgcgatgatcgtcggcgtgggctgcggcctcgtgaacggactgctgatcgcgtacggcgggctggtgccgttcatcgccacgctcgccatgctggcctcggcccgcggcctcgcgctccagatcacggacggcaggacacagatcgtcaccgtcgacacggtcctgaagctgggggagcgcgattcctatctgctcggcatcccgccgctcgtcctggtcttcgcggtcgtgacggtcatcggctggctgatcctgaaccgcaccaccttcgggcggcgcacggtcgccgtcggcggcaacgcggaggcggcccggctcgcgggcatcgacgtacgacgccagcggctgtacctctacctgctctccgggctgtgctgcggcatcgccgccttcctgctgatcatcctgtccggctcgggccagaacaccaacggcaacctgtacgagctcgacgccatcgcggccgcgatcatcggcggcaccctgctcagcggaggccggggcaccatcaccggctcggtcctcggcgtactgatcttcaccacgatcaccgacatcttcgccctgaacaacctgcagagcgacgtccagcagatcgccaagggcgcgatcatcgtcgccgccgtgctggtccagcgccgtaccgcgagcacgacctga

SEQ ID NO: 40522 - protein, 339 aa, Streptomyces avermitilis MA-4680
MTQPVSPPRGGTGQASPVSELPAWRSLAARADVRTLSLLGVLAALVVIGGITKPDEFLDTRNLQLVLTQASVIGVVTVGMTFVITSGGIDLSVGAIVALASVWATTVATQEYGFAGILFTAMIVGVGCGLVNGLLIAYGGLVPFIATLAMLASARGLALQITDGRTQIVTVDTVLKLGERDSYLLGIPPLVLVFAVVTVIGWLILNRTTFGRRTVAVGGNAEAARLAGIDVRRQRLYLYLLSGLCCGIAAFLLIILSGSGQNTNGNLYELDAIAAAIIGGTLLSGGRGTITGSVLGVLIFTTITDIFALNNLQSDVQQIAKGAIIVAAVLVQRRTASTT

SEQ ID NO: 40523 - DNA, 1293 bp, Streptomyces avermitilis MA-4680
  CDS (1)..(1293): transl_table=11
gtgagcatcgaaaagacctccgcgaccgcggaccaggccgccgtcgagaacccggaggcggccgcgggatcggacgtcgccgtcgacccccggctgctcgtgcgcgaacgaggcttcgccggctacatctccgagttcaagcggaagatccgcgccggtgacctgggctccctcccggtcgtcgtcggcttgatcatcatctgggcgatcttcgcgagcctgaactcgaacttcctcaccgcgggcaacctctccgacatctccgtggcgatggtcggtaccggcatgatcgccgtcggcatcgtcttcgtgctgctgctcggcgagatcgacctctccgtcggttccgtcagcggtgtcgcgggcgccgccttcgcggtcctcaacgtcacccacggcatgcccgagtggctggcgctgattctcgccatcctcacgggtacggtcgcgggcgccatccacggcttcgtcttcgcgcgcatcggtgtgccggccttcgccgtcaccctggcgggtctgctgttctggaacggcttcatgctccagatcctcggcagcaacggcacgatcaacctggacagctccggcctggtggccaagctgagcggttactacttcagcgacgtggcggcggcctacggtctcgccgtgttcgccgtggcggtcttcttcctcaccacgttcttcgacaaccgccgccgtgaggccgcgggggtgccgtcccgtccgctgagcgagatcatcgtccgtacggtgctcctcgccgtggtggccttcgccgccgccgccgtcttcaaccagtacaagggcctgccgctggccgtcgtcctgttcctggcggtcctggtgatcacggacttcgtgctgcgccgcaccgcgtacggccgcaagatcttcgcgctcggcggcagcatcgaggcgtcccgccgtgccggtatcaacgtcgccgcggtccgtatctcggtctacgcgatctccggcaccttcgccgccatcggcggtctgttcatcgcctccaagatcgcctcggcgaaccagggtgccggtgccggtgacctcctgatgaacgccatcgcggcggccgtcatcggcggtaccagcctgttcggcggccgcggccgcacctggaacgcgctgctcggtgtgctggtcatcgtctcgatccagtacggcctggcccttcagggcatcgcctcgccggtccagtacatgatcaccggtggtgtactcctcgcgaccgtcgtcatcgacgcggtcacccgcaagacccagaagtcggcgggccgcgcgtaa

SEQ ID NO: 40524 - protein, 430 aa, Streptomyces avermitilis MA-4680
MSIEKTSATADQAAVENPEAAAGSDVAVDPRLLVRERGFAGYISEFKRKIRAGDLGSLPVVVGLIIIWAIFASLNSNFLTAGNLSDISVAMVGTGMIAVGIVFVLLLGEIDLSVGSVSGVAGAAFAVLNVTHGMPEWLALILAILTGTVAGAIHGFVFARIGVPAFAVTLAGLLFWNGFMLQILGSNGTINLDSSGLVAKLSGYYFSDVAAAYGLAVFAVAVFFLTTFFDNRRREAAGVPSRPLSEIIVRTVLLAVVAFAAAAVFNQYKGLPLAVVLFLAVLVITDFVLRRTAYGRKIFALGGSIEASRRAGINVAAVRISVYAISGTFAAIGGLFIASKIASANQGAGAGDLLMNAIAAAVIGGTSLFGGRGRTWNALLGVLVIVSIQYGLALQGIASPVQYMITGGVLLATVVIDAVTRKTQKSAGRA

SEQ ID NO: 40525 - DNA, 1947 bp, Streptomyces avermitilis MA-4680
  CDS (1)..(1947): transl_table=11
gtggccactgacacgctcaagagcacaacgggcgcgagtggcgcctcggcggtccgccggctcctgctcgacaacggggcgctcaccgcgctcatcgtcctcgtcgtcgcgatgtcggcgctgtccggcgacttcctgacgacggacaacctgctcaacatcggcgtccaggcggccgtgaccgccatcctcgccttcggtgtgaccttcgtgatcgtctcggcgggcatcgacctgtcggtcggttcggtcgcggcgctctcggccaccgtccttgcctggacggcgacttcgcacggcctgccggtcgtggtcgccgtggccctcgcggtcgccaccggcgtagcgtgcggtctcgtcaacggcttcctgatctcgtacgggaaactaccgccgttcatcgcgacgctcgccatgctgtcggtgggccgcggtctgtcgctggtgatctcgcagggcagcccgatccccttccccgactcggtctcgcacctcggtgacacgctcggcggctggctgccggtgcccgtcctggtgatgatcgtgatgggtctgatcaccgccctgatcctcggccgtacgtacatcgggcgctccatgtacgcgatcggcggcaacgaggaggccgcgcgcctgtcgggcctgcgggtgaagaagcagaagctcgcgatctacgcgctgtcgggtctgttcgcggccgccgcgggcatcgtgctcgcctcccggctctcctccgcgcagccgcaggccgcacaggggtacgagctggacgcgatcgccgcggtcgtcatcggcggcgcctcgctcgcgggcggtacgggcaaggcgtccgggacgctgatcggcgcgctgatcctggcggtgctgcgcaacgggctgaatctgctgtccgtgtccgcgttctggcagcaggtcgtcatcggtgtcgtgatcgcgctggcggtgctcctcgacacgctgcgccgcaaggccggggcgactccggtggccggtgcctcgagtggcggcaagggcaagcaggcgatgacgtatgtgatcgcggccgtggtcgcggcggccgtcgtgggggcgatgtccttcctgcacaacggctcgtcggcttcgccgacgcagaagatgggcctgtccctctcgaccctcaacaaccccttcttcgtacagatcaagacgggtgcgcaggaggaggcgaagaagcagggcgccgacctgacggtcacggacgcgcagaacgacgcctcgcagcaggccaaccaggtgcagaacttcaccagctcgggcgtcggttcgatcatcgtcaacccggtggactcggacgcggcgggcccggcggtgcgctccgccaacaaggccgacattcccgtcgtgggcgtcgaccggggcgtcaacaaggcggacacggccgcgctggtcgcctccgacaacgtcgcgggcggcaggctgggcgccaaggcgctggccgagaagctgggcggcaagggcaggatcgtgatcctccagggtctggccggcacctccgccagccgtgagcgcggggcgggcttcgccgagggcctgaaggcctaccccggcatcaaggtcgtcgcccggcagcccgcggacttcgaccgcaccaaggggctcgacgtcatgacgaacctgctccaggcgcacccggacgtccagggcgtcttcgccgagaacgacgagatggcgctcggcgcgatcaaggcgctgggtgccaaggccggaaagtcggtctcggtcgtgggcttcgacggcacgccggatgggctgacggcggtcaagtcgggcacgctgtacgcgtccgtggcgcagcagccgaaggagctgggccggatcgcggtgcagaacgcgctgcgggcggccgagggcaagaaggtcgacaagacggtgaaggtgccggtgaaggtggtcacggcgaagaacgtggcggccttcggcggctga

SEQ ID NO: 40526 - protein, 648 aa, Streptomyces avermitilis MA-4680
MATDTLKSTTGASGASAVRRLLLDNGALTALIVLVVAMSALSGDFLTTDNLLNIGVQAAVTAILAFGVTFVIVSAGIDLSVGSVAALSATVLAWTATSHGLPVVVAVALAVATGVACGLVNGFLISYGKLPPFIATLAMLSVGRGLSLVISQGSPIPFPDSVSHLGDTLGGWLPVPVLVMIVMGLITALILGRTYIGRSMYAIGGNEEAARLSGLRVKKQKLAIYALSGLFAAAAGIVLASRLSSAQPQAAQGYELDAIAAVVIGGASLAGGTGKASGTLIGALILAVLRNGLNLLSVSAFWQQVVIGVVIALAVLLDTLRRKAGATPVAGASSGGKGKQAMTYVIAAVVAAAVVGAMSFLHNGSSASPTQKMGLSLSTLNNPFFVQIKTGAQEEAKKQGADLTVTDAQNDASQQANQVQNFTSSGVGSIIVNPVDSDAAGPAVRSANKADIPVVGVDRGVNKADTAALVASDNVAGGRLGAKALAEKLGGKGRIVILQGLAGTSASRERGAGFAEGLKAYPGIKVVARQPADFDRTKGLDVMTNLLQAHPDVQGVFAENDEMALGAIKALGAKAGKSVSVVGFDGTPDGLTAVKSGTLYASVAQQPKELGRIAVQNALRAAEGKKVDKTVKVPVKVVTAKNVAAFGG

SEQ ID NO: 40527 - DNA, 1245 bp, Streptomyces avermitilis MA-4680
  CDS (1)..(1245): transl_table=11
atgagtgccaatgtcacggccaagacaccggccgaagcgtcacccgggggaagtccctccggatccggtcccggcctgctccggctgctggtcgacggcatgcgcagcaacatgcgccagtacggcatgctgatcgccctcggggtgatcgtggccctgttcgcggtgtggacgggtggcgacctgctcctgccgcgcaacgtgtccaacctcgtgctgcagaacagctacatcctgatcctcgcgatcggcatgatgatcgtcatcatcgcgggccacatcgacctgtcggtcggctcgatcaccgccttcgtgggcggtgtggccgcggtgctgatggtcaaccacgacgtgccctggccgctcgcggtgctgctgtgcctggccgtgggagcggccgcgggggccgcgcaggggttcatgatcgcctatctgggcatgccgtcgttcatcgtgacgctcgccggcatgctgatcttccgcggtctgaccgaggtcttcctcaagggccagacgctcggcccgttcccggagggccttcagaaggtcgccaacggcttcctgcccgaggtcggcccgaagaccaactaccacaacctcacgctgctgctcggtctcgcactggtcggcttcgtgatctggcgtgagatgaaggaccgcaagcggcaggcggagtactccctcgaggtgctgcccgccaacctgttcgcggtgaagctcgccctgctgaccgcggcgatcatcgccctcaccatggagctcggcagctacaagggcgcgccggtcgtcctgctggtcctggcggtgctcctggtcggcttcggctacgtcatgcgcaacgtggtggtcggtcgccacgtgtacgcgatcggcggcaacctgccggcggccaggctgtcgggcgtcagggacaagaaggtcaccttcctcgtcttcctcaacatggggatgatggccgcgctcgcgggcctggtcttcgcggcgcggttcaacggagcctcgccgaaggccggcgtcaacttcgaactcgaggccatcgccgcgtcgttcatcggcggtgcctcgatgagcggcggcgtgggcaccatcctcggcgccatcatcggcggcctggtcctcggtgtgctcaacaacggcatgaacctcgtcggcgtcggcaccgactggcagggggtcatcaagggcctcgtgctgctcgcggcggtcggcttcgacgtgtggaacaagcgcaaggtcggttcgtaa

SEQ ID NO: 40528 - protein, 414 aa, Streptomyces avermitilis MA-4680
MSANVTAKTPAEASPGGSPSGSGPGLLRLLVDGMRSNMRQYGMLIALGVIVALFAVWTGGDLLLPRNVSNLVLQNSYILILAIGMMIVIIAGHIDLSVGSITAFVGGVAAVLMVNHDVPWPLAVLLCLAVGAAAGAAQGFMIAYLGMPSFIVTLAGMLIFRGLTEVFLKGQTLGPFPEGLQKVANGFLPEVGPKTNYHNLTLLLGLALVGFVIWREMKDRKRQAEYSLEVLPANLFAVKLALLTAAIIALTMELGSYKGAPVVLLVLAVLLVGFGYVMRNVVVGRHVYAIGGNLPAARLSGVRDKKVTFLVFLNMGMMAALAGLVFAARFNGASPKAGVNFELEAIAASFIGGASMSGGVGTILGAIIGGLVLGVLNNGMNLVGVGTDWQGVIKGLVLLAAVGFDVWNKRKVGS

SEQ ID NO: 40529 - DNA, 960 bp, Streptomyces avermitilis MA-4680
  CDS (1)..(960): transl_table=11
gtgctgctccgccgcgcccgcgaactcgccctggtgccagccctgttgctgctcctggtgctcggtgcggtcgtcaacgactcgttcctcaccgagcgcaatctgatctcgatcctcggcgcctcggccgccctcgccatggtcgtgctcgccgagtcgctcgtcctgatcaccggcaagttcgacctctccctggagtcggtcgtcggtatcgcgcccgccgtgggcgcgctgctcgtgctgccggccgcccagtccggctggggcaccgagttccccgccgcgctcgccctcctcgcgatcctcgtcgtgggcgcggtcatcggcgccttcaacggcatcctcgtcgtgaagctcaagctgaacgccttcatcgtcaccctcgcgatgctgatcatcctgcgcggactgctggtcggcgcgaccaagggcaagacgctgttcgggatgcccgacgcgttcttcaccctggccaccaccacgttcctgcgggtccccatgtccgtgtggctggccgcgatcgccttcggtgtgaccggcctggtcctgcgctaccaccgcgtcggccgcgccctgtacgcgatcggcggcaacgcggacgcggcccgcgcggccggtatccgcgtcgagcgcgtcatgctcggcgtcttcgtcgtcgccggtgtcctcgcctccgtcggcgggatcatgcagaccggctatgtcggcgcgatcagcgccaaccagggcaacaacatgatcttcacggtgttcgcggcggcggtcatcggcggcatcagcctcgacggcggcaagggcaccatgttcggcgccctgaccggcgtactcctgctcggcgtcgtacagaacctgctgaccctcgcccaggtgccgtccttctggatccaggccatctacggcggaatcatcctggtcgccctgatgatcgcgcgggtgacgacgggccgcgcccaggactga

SEQ ID NO: 40530 - protein, 319 aa, Streptomyces avermitilis MA-4680
MLLRRARELALVPALLLLLVLGAVVNDSFLTERNLISILGASAALAMVVLAESLVLITGKFDLSLESVVGIAPAVGALLVLPAAQSGWGTEFPAALALLAILVVGAVIGAFNGILVVKLKLNAFIVTLAMLIILRGLLVGATKGKTLFGMPDAFFTLATTTFLRVPMSVWLAAIAFGVTGLVLRYHRVGRALYAIGGNADAARAAGIRVERVMLGVFVVAGVLASVGGIMQTGYVGAISANQGNNMIFTVFAAAVIGGISLDGGKGTMFGALTGVLLLGVVQNLLTLAQVPSFWIQAIYGGIILVALMIARVTTGRAQD

SEQ ID NO: 40531 - DNA, 936 bp, Bacillus cereus ATCC 14579
  CDS (1)..(936): transl_table=11
atggctaagaaggggaatgtattacaacaactcggttctttaatcggtttagtattaattatcgtcgtaattacagctttaaatccagcgttcattgaaattccaaatttatttaatatactgcgtcaagtatcgattaatgcgcttattgcatttggaatgaccttcgtaattttaacagggggtattgacttatcggtaggttctattttagcattatcaagtgcacttgttgctggaatgatggcaagtggcatggatccgttccttgcaatggcagttggactattagcaggtcttgtaatgggaattgtaaacggtatcatcattgcgaaaggaaaagtagctccatttattgcaactttagcaacaatgactatttttcgtgggttgacgcttgtttatatggacggacgtccgatcactggtcttggtgatcatttaatgttccaaatgtttggccgcggttattttcttggtattccggtaccagctgttacaatgatgatcgctttcgcagtactgtacttcattttgaagaaaacgacatttggtcgccgtacatttgcaattggtggaaatgaagaagcagcagcactatcaggtattaatgttacgagaattaaagtaatgatttacggtctttccggaattttggcagcgcttgcaggtattgtcttaacgtcacgattagattctgcacagccgactgcaggtacttcttatgaattagatgcaattgcagcagttgtattaggtggaacaagtctttctgggggaagaggatggattgttggtacattcatcggtgtacttattatcggtgtactaaataacggtttaaatttattaggtgtatcttctttcttccaacaagttgtaaaaggacttgtaatcttattagctgtattaattgatcgtagaaaagaagcgtaa

SEQ ID NO: 40532 - protein, 311 aa, Bacillus cereus ATCC 14579
MAKKGNVLQQLGSLIGLVLIIVVITALNPAFIEIPNLFNILRQVSINALIAFGMTFVILTGGIDLSVGSILALSSALVAGMMASGMDPFLAMAVGLLAGLVMGIVNGIIIAKGKVAPFIATLATMTIFRGLTLVYMDGRPITGLGDHLMFQMFGRGYFLGIPVPAVTMMIAFAVLYFILKKTTFGRRTFAIGGNEEAAALSGINVTRIKVMIYGLSGILAALAGIVLTSRLDSAQPTAGTSYELDAIAAVVLGGTSLSGGRGWIVGTFIGVLIIGVLNNGLNLLGVSSFFQQVVKGLVILLAVLIDRRKEA

SEQ ID NO: 40533 - DNA, 996 bp, Bacillus cereus ATCC 14579
  CDS (1)..(996): transl_table=11
ttgaatctcgttcataaaacgaaaactaagaaactatatttacctactcatcttttttatcaatttagtacaattgctattattataggtgttacaatttttttctctatcgtcaatgattcttttttaacatataacaatattagtgatattttacgctctatctccatcgtaacgttacttgcaatcggcgttacctttacattgattgtagatgggtttgatttatcagtcggctctaccgctagtttagcaacaattgcagctgcttcttgtctcgttttatatcgacaagaactattagttacactccttgttcctattctttgcggattattagttggattattaaatgcactactcgttatccgaattaaactacctgatttactagctacattaagtatcatgtatatcgtcaatggactacacttaacattttcaaaaggatcttcaatttatgaaggaatgtccggtgcaacaggacattttattccatcttttttatttatcggtcaaggttccgtcttaggaattccagtccctgtcattatcatgcttactgtcgttttaattgcacatctatttttagaaaaaacaacgtacggtcgtttcttttatatgactggtgggaatcgagaagctgctagattagccggtattcctactgatcgttaccgtgtatatgcttatatgattagtggtttactagcttctattggcggcattattctatgcagccgcgttggaacaggacaagtttcagctggtgctccattattaatggatgcagtcgcagctgcctatatcggttacgcaatgttcggtgccaagaaaccaaatatagtcggaacattcctcggctcggtattaattggaattatattaaatggactcacaatgatgaacgtcccttattatgcacaagatattattaaaggcagcattttaattacagctttagccttttcatttattaaaaagaagcgtaaataa

SEQ ID NO: 40534 - protein, 331 aa, Bacillus cereus ATCC 14579
MNLVHKTKTKKLYLPTHLFYQFSTIAIIIGVTIFFSIVNDSFLTYNNISDILRSISIVTLLAIGVTFTLIVDGFDLSVGSTASLATIAAASCLVLYRQELLVTLLVPILCGLLVGLLNALLVIRIKLPDLLATLSIMYIVNGLHLTFSKGSSIYEGMSGATGHFIPSFLFIGQGSVLGIPVPVIIMLTVVLIAHLFLEKTTYGRFFYMTGGNREAARLAGIPTDRYRVYAYMISGLLASIGGIILCSRVGTGQVSAGAPLLMDAVAAAYIGYAMFGAKKPNIVGTFLGSVLIGIILNGLTMMNVPYYAQDIIKGSILITALAFSFIKKKRK

SEQ ID NO: 40535 - DNA, 954 bp, Bacillus cereus ATCC 14579
  CDS (1)..(954): transl_table=11
atgaaacatatgttaaaaatgcatgaaacgtctatcatactgttactactaatttatatagctattgtaggaatgataaaccctagttttattcaatttaactcgttatctttactgatgaaatcaagcgttattttagtcgtgctagcaatcggtcaatcgttcgtcttatttacgaaaaatatagatgtatcagttggttcaagcatggggttaagtgcagcagtttgcggaatgatgttaacgaatgggtatagtgcattcttgtcgatatttgtagctattatacttggggccattattggtttcgtaaatggtattggagttgcgaagtttcgggtaccagccattattatgacattaggcatgttaggaattattagaggtacaatgttaattttcacaggcgggaagtggattgaagatattccaaacgattttaagcagctgtcatctatcatcattcttggtttacctataactgtatggttcgttcttattattttactactactatacttctttttaagaaaagtgccattgggaagatacttttatgcggtaggtgataatgaagatggcgcgaggcttattggtatacctgtaaataaagtgaagatatatgcgtttatgatttcaggcataagcgctgcgctcgctggttgcatatttgttatgaatatcggtttcgtgccaaatcaaacaggtacaggattagaattacaagtaatcgcagccgctgtactaggaggaattcatttaaaaggaggaacaggatctttatttggagctgcattaggagcgttatttttagaaacaataagtagctcactcgtctttttaaaaataccagcattttggaataatgctatttcaggttttttattattacttatcatcatattagatagtgttatgaaaaagtggaaggcagaaaggaggatgaatctatga

SEQ ID NO: 40536 - protein, 317 aa, Bacillus cereus ATCC 14579
MKHMLKMHETSIILLLLIYIAIVGMINPSFIQFNSLSLLMKSSVILVVLAIGQSFVLFTKNIDVSVGSSMGLSAAVCGMMLTNGYSAFLSIFVAIILGAIIGFVNGIGVAKFRVPAIIMTLGMLGIIRGTMLIFTGGKWIEDIPNDFKQLSSIIILGLPITVWFVLIILLLLYFFLRKVPLGRYFYAVGDNEDGARLIGIPVNKVKIYAFMISGISAALAGCIFVMNIGFVPNQTGTGLELQVIAAAVLGGIHLKGGTGSLFGAALGALFLETISSSLVFLKIPAFWNNAISGFLLLLIIILDSVMKKWKAERRMNL

SEQ ID NO: 40537 - DNA, 1011 bp, Shigella flexneri 2a str. 2457T
  CDS (1)..(1011): transl_table=11
atgagtgcgttaaataagaaaagttttcttacttacctgaaagagggcggtatttacgtcgttcttttagttttgctggcgattattattttccaggacccaacatttttaagtctgttgaacttaagtaatattctcacccagtcatcggtgcgtattattatcgcgctcggtgtggcagggttaattgtcacccaggggaccgatctttctgctggtcgtcaggtagggctggcggcagtggtggctgcgacattattgcagtccatggataacgccaacaaagtgttcccggaaatggcgacgatgccgattgcgctggttattctgattgtctgtgccattggtgcggtgatcggtttgatcaacggtctgattatcgcttatctcaacgtgacgccgttcattaccacgctcggcacgatgatcatcgtctatggcatcaactcgctctattacgactttgtcggggcgtcgccaatttctggttttgacagtggcttctctacctttgctcagggctttctcgcgctggggagtttccgtctctcttacatcaccttctacgcgttgattgcggtggcgttcgtctgggtgttgtggaacaaaacccgcttcggtaagaacatttttgccattggcggtaacccggaagcggcaaaaatatctggtgtcaacgtcggcctgaacctgctgatgatctacgcgttgtctggcgtgttctatgcctttggcgggatgttagaagccggacgtatcggctctgccaccaacaacctcggctttatgtatgagctggatgctatcgcggcgtgcgtggtaggcggtgtatcgttcagcggcggtgtggggacggtgattggcgtggtgaccggggtaattatttttaccgtcatcaactatggcctgacgtatatcggcgtaaacccatactggcagtacatcatcaaaggggcgattattatcttcgccgtagcgctggattcactgaaatacgcgcgtaagaagtga

SEQ ID NO: 40538 - protein, 336 aa, Shigella flexneri 2a str. 2457T
MSALNKKSFLTYLKEGGIYVVLLVLLAIIIFQDPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFLALGSFRLSYITFYALIAVAFVWVLWNKTRFGKNIFAIGGNPEAAKISGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 40539 - DNA, 1062 bp, Rhodopirellula baltica SH 1
  CDS (1)..(1062): transl_table=11
gtgttcggcaaaagccagcctcttccacgctcggtcgtcattcagaaggaagtcactgcgttgttgaagcgagggttgaataccgccggaccgatgttggcgttggtcatcgtgatcctgttctttgccattgccgaatgggcaaccggtagcgacggaaacttcacgtccatggcgtcggtgcgattggttggcattcagagcgtcaagatcggcatcgcttcgctgggaatgacgttgatcattattagcggcggaatcgatttgtccgcgggcacggcggcggctctgtgtggatgtgtcgcggcactgacgctcgaaagtgaatggtcgatcgttcccgctctggccatggcggtcggtgctggcgcattgtgcgggttgttcaatggcattttgatcgcgggattgcgactgactccgttcatcatctcgttgggatcgatgacgatcttcatggggttgggcaagagcctgtccgagcaaggtggcacgatcacaccgccggcggaaagtatccctgaatggctttgggcatcggtcacgccgtttcccaacccggaatggattgcctacccgttactgcctaattttggatggggcgtgtggctgaccattgtgctggccatcgcgaccgcgttgctgctgcaccaaactctgtttggacgtcatgtgttcgcgatcggatccagcgaagcgaccgcgagattgtgcggcgtgaaagtccggcaaaccaagatcctggtttatgtcatcgccggtgccctgttcggtttggccggttgtgtcgacatcgctcggctcggcaaaggcgacgcatccgcgggcatgggattggaactggagatcatcgcggcggtcgtgatcggcggcggttcattgctgggcggccgcggcagcgtggtcggaacactgtgcggcgtgttgatcatgagcgtgattgcacacggatgcacttcgctgggattggaaaatcacattgaaaatattctgttgggtgtgatcattgtcgcggcggtctacgtcgatcgactgcgagcactcaagaaagaatccgtatga

SEQ ID NO: 40540 - protein, 353 aa, Rhodopirellula baltica SH 1
MFGKSQPLPRSVVIQKEVTALLKRGLNTAGPMLALVIVILFFAIAEWATGSDGNFTSMASVRLVGIQSVKIGIASLGMTLIIISGGIDLSAGTAAALCGCVAALTLESEWSIVPALAMAVGAGALCGLFNGILIAGLRLTPFIISLGSMTIFMGLGKSLSEQGGTITPPAESIPEWLWASVTPFPNPEWIAYPLLPNFGWGVWLTIVLAIATALLLHQTLFGRHVFAIGSSEATARLCGVKVRQTKILVYVIAGALFGLAGCVDIARLGKGDASAGMGLELEIIAAVVIGGGSLLGGRGSVVGTLCGVLIMSVIAHGCTSLGLENHIENILLGVIIVAAVYVDRLRALKKESV

SEQ ID NO: 40541 - DNA, 972 bp, Rhodopirellula baltica SH 1
  CDS (1)..(972): transl_table=11
atgttagaaaacaaacgcgaacacctcgcgaaatttcaatcgctgatcgcgttggcagtgatgctgatcgcgatgagctttctgtcagacagtttcttcacgcccgagaatgggttgaacattctgagacaaatttcagtcaatctcagcctttcgattgggatgacattgatcatcttgaccggcggaatcgacttgtcggtcggtgccattctcgctttgtccggcgccgtggcggcagggttgctgaagaacggcatcatgctcgaaccgcttggtgtgaagctggagttcaccgttttcggagcgattgtttctggattgttggtcggttccgccgcagggttgttcaatggagtcgcggtgactcgtttcaagcttccgccgtttgtcgccacgctgggaatgttcagcatcgctcgtggtttgacgatgttgtggacgggcgggttcccggtcacgggtctcggttcatcgttcggttccatcggcacgggcgtgttcctgcaaattccggttccggtttggatcaccggtgcattggttggcgtgtttgtgctgttgacccggacaactcgttttggccggcatgtgtacgcggttggcggcaacgaacgcgcttcgttgttgacaggattgccagtcgatcggatcaaaatcgcggtttacacgctcggtggtttgctcgctggagtggcgggactcatcgtgaccgctcgactggattcggctcaacccaacgcagggttgggctacgaactcgattcgattgccgccgtcgtgattggtggcacatccctgtcgggcggacgaggcagcgtcatggggacggtgctgggttgcctgatcattggtgtgttgaacaacagtttgtttctgttaaacgtttcccctttttggcaacaagtggtcaagggattcgtgatcctggccgccgtcgccgtggaccgcatgagtcaaagggaccgataa

SEQ ID NO: 40542 - protein, 323 aa, Rhodopirellula baltica SH 1
MLENKREHLAKFQSLIALAVMLIAMSFLSDSFFTPENGLNILRQISVNLSLSIGMTLIILTGGIDLSVGAILALSGAVAAGLLKNGIMLEPLGVKLEFTVFGAIVSGLLVGSAAGLFNGVAVTRFKLPPFVATLGMFSIARGLTMLWTGGFPVTGLGSSFGSIGTGVFLQIPVPVWITGALVGVFVLLTRTTRFGRHVYAVGGNERASLLTGLPVDRIKIAVYTLGGLLAGVAGLIVTARLDSAQPNAGLGYELDSIAAVVIGGTSLSGGRGSVMGTVLGCLIIGVLNNSLFLLNVSPFWQQVVKGFVILAAVAVDRMSQRDR

SEQ ID NO: 40543 - DNA, 939 bp, Chromobacterium violaceum ATCC 12472
  CDS (1)..(939): transl_table=11
atgaccccgcaacagaaagccaatttgcaacgcctcggccccttcatcgccctggtgctggtggccgtcggcctgtccgtgatgagtccggacttcctcaccgtcaacaacctgctgaacgtgatgcgccaggtgtcgatcaacgcgctgatcgccttcggcatgacgctggtgatcctgctgggcggcattgacctgtcggtcggctccatcctggcgctgtcctcggtgctgaccgccaccctgttgcgcgcaggcgtggatccgatgctggcgacgctgctgggcatcctggccggcgcggcgatgggcctgttcaacggcctggtggtcagcaagggcaaggtggcgccgttcatcgccacgctggcgtcgatgaccatcctgcgcggcctggcgctggtgttttccaacggcagcccgatcaccggcttcgacagcgagctgttctccatgctgggcggcggctatgtcgccggcctggtcccggtgccggtggtgtggatgctgatcctgttcgccggcttctggttcctgctgaagaagacggtgttcggccgccacctgtacgccaccggcggcaacgaggaggcggcgcggctgtccggcgtcaaggtggacagcgtcaagctgtgggtgtacaccacctccggcgcgatggcggcgatggccggcgtggtgctgacctcgcgcctcaattcggcgcagccgactgccggcaccggctacgagctggacgcgatcgccgcggtggtgctgggcggcaccagcctcagcggcggccgcggctggattttcggcactctgatcggcgcgctgctgatcggcgtgctcaacaacggcttgaacctgctgggcgtgtcctcgttctaccagcaggtgatcaagggcgcggtgatcctgctggcggtactgctggatcgcagcaacaagaagtga

SEQ ID NO: 40544 - protein, 312 aa, Chromobacterium violaceum ATCC 12472
MTPQQKANLQRLGPFIALVLVAVGLSVMSPDFLTVNNLLNVMRQVSINALIAFGMTLVILLGGIDLSVGSILALSSVLTATLLRAGVDPMLATLLGILAGAAMGLFNGLVVSKGKVAPFIATLASMTILRGLALVFSNGSPITGFDSELFSMLGGGYVAGLVPVPVVWMLILFAGFWFLLKKTVFGRHLYATGGNEEAARLSGVKVDSVKLWVYTTSGAMAAMAGVVLTSRLNSAQPTAGTGYELDAIAAVVLGGTSLSGGRGWIFGTLIGALLIGVLNNGLNLLGVSSFYQQVIKGAVILLAVLLDRSNKK

SEQ ID NO: 40545 - DNA, 981 bp, Gloeobacter violaceus PCC 7421
  CDS (1)..(981): transl_table=11
atgggcgagagcacgtcaaaaaacccaaaactcctcaccctaccggattggttgcgtgaatggctcgcccgccagactgcctacggcccggccatcgccgtactgatcgagatcgtcgtcttcagcgccatcgccccgggcttttttaccctcgagaacttcatcaacatctcgctgcagacggcgattttcggcatcctggcggtcggaatgacactggtgatcctgacgggcggcatcgatctgtcggtgggatcggtggtggcccttgccggggtgagcggggccatggtcgcccaagcgggcgggctcggcatgcccgtggccatcgtggtaggcggtggggtcgggcttttgagcggtctgttggtggcgtactttcgggtggctccgtttgtggtcaccctggccgggctcaccattgcccgcggcctcgcctttttgctcaccggcggccggtcgatcggcggtttgccgcccgacttcaccttctggggccaaaaacagctcggcttactgccgctgccagtgctcgtcttgatggtagtggtgaccggaggatactttttgctcacccgcacagtcttcggccgccagatctacgccatcggcggcaacgccgaggcgagttggctcgcgggagtgccggtgcaaggggtgctggtggcggtctatctcatcaacggcttgctcgcggggctcgcgggcgggatgctcgccgcccggctcggagccggaattcccaatagcggccaactctacgaattggaggtgatcgcagcggtagtggtggggggcaccagtttgagcggcggccgaggaggagtactcggcagtctgctcggggcgctgtttatcggcaccctcggcaacggtctcaatctgctgggcgtcgatccgtacctgcaaaaaatcgtactgggagtggtgatcctggcggctgtgctcgtcgatagcgccggacggcggggacaaagatga

SEQ ID NO: 40546 - protein, 326 aa, Gloeobacter violaceus PCC 7421
MGESTSKNPKLLTLPDWLREWLARQTAYGPAIAVLIEIVVFSAIAPGFFTLENFINISLQTAIFGILAVGMTLVILTGGIDLSVGSVVALAGVSGAMVAQAGGLGMPVAIVVGGGVGLLSGLLVAYFRVAPFVVTLAGLTIARGLAFLLTGGRSIGGLPPDFTFWGQKQLGLLPLPVLVLMVVVTGGYFLLTRTVFGRQIYAIGGNAEASWLAGVPVQGVLVAVYLINGLLAGLAGGMLAARLGAGIPNSGQLYELEVIAAVVVGGTSLSGGRGGVLGSLLGALFIGTLGNGLNLLGVDPYLQKIVLGVVILAAVLVDSAGRRGQR

SEQ ID NO: 40547 - DNA, 972 bp, Photorhabdus luminescens subsp. laumondii TTO1
  CDS (1)..(972): transl_table=11
atgaattctaatatatcaccgacatttaaacgttggtttactaaagagtggttactgaaacaaaagtcactgattgcgttgctagtgctgatagcagtagtttcttctcttagccaaaactttttcactttaaataacttgtttaatattctgcaacaaacatcagtcaatgccattatggccgttgggatgacattggttatcctgacatcaggtattgacctgtctgttggttcattgcttgcgttaacaggtgcaatagtagcttcattggttggtacggaagttaatgctctggtggctatcgtgagtgctttggctttaggtgctgcaattggtgcttgtacaggaataataattgctaaaggtaaagtacaggcttttattgccactctagtcatgatgttattacttcgtggaataacccgtgtctatactgatggtagtccaataaatacaggattcagtgataatgccgatctgtttggctggtttggtattggtcgcccactgggaattcctactccagtatggctgatgttgatagtttttgttatcacatggtatatcctgcatcacacccgtttaggtcgttatatttatgccttgggggggaatgaatcggctacccgtttatctggtatcaatatcgataaaattaaaattatcgtttactccttatgcggtttcctgacggcattggcaagtattattgaagttgctcgtctttcttctgctcaacctatggcggggggaggttatgaattagatgctattgctgccgtagttctgggaggaactcgcctggctggtggtaaggggttaattattggtactttgattggtgcactaatcctcggttttttaaataatggcttaaacttattaggtatttcttctaactatcagatgattgttaaagcaattgtaatattgttggcagttctggttgataacaaaagtggtaaataa

SEQ ID NO: 40548 - protein, 323 aa, Photorhabdus luminescens subsp. laumondii TTO1
MNSNISPTFKRWFTKEWLLKQKSLIALLVLIAVVSSLSQNFFTLNNLFNILQQTSVNAIMAVGMTLVILTSGIDLSVGSLLALTGAIVASLVGTEVNALVAIVSALALGAAIGACTGIIIAKGKVQAFIATLVMMLLLRGITRVYTDGSPINTGFSDNADLFGWFGIGRPLGIPTPVWLMLIVFVITWYILHHTRLGRYIYALGGNESATRLSGINIDKIKIIVYSLCGFLTALASIIEVARLSSAQPMAGGGYELDAIAAVVLGGTRLAGGKGLIIGTLIGALILGFLNNGLNLLGISSNYQMIVKAIVILLAVLVDNKSGK

SEQ ID NO: 40549 - DNA, 1008 bp, Vibrio vulnificus YJ016
  CDS (1)..(1008): transl_table=11
atggacgctgttaaatctttcgcattaaagcatttaaaagagagcgcaatatacgcggttctccttattctactggctgttattgttattcaagagccatcgtttcttagcttgagaaacttaagtaatatcctgactcaatcttccgtgcgtgtcatcatcgctctcggtgtcgccggcctgattgtcacccaaggcaccgacctgtcagccggccgccaagtgggtttggcggcggtgatttcggccaccttgttgcaatcgatcgataacgtcaacaaagtgttcccaggcattggcgaagtgcccatcgtcgcggtgatcatttgcgtgtgcttgattggcgccatcatcggtttggtcaacggcgttatcgttgcttacctaaaagtaacgccctttatcgccacattgggcaccatgatcatcgtttacggcatcaactcgctttactacgatgccgtgggcgcctctccgattgcgggctttgacgagcgtttcaccacctttacgcaaggctttatcaacctcggtggtttccgtttctcctacatcaccttctacgccatcatcgccattgtctttatgtgggtgctgtggaacaaaaccgtgtttggcaaaaacattttcgccgtgggtggcaacccagaagcggccaaagtgtctggtgtgaacgtccccctcaccttgttgaaagtgtatgccctttctggcgtgctttacgcctttggcggtatgttggaagctggccgtatcggcagtgccaccaacaacttaggcttcctatacgagcttgatgccatcgccgcgtgtgtggtcggcggcgtttcatttgccggtggtgtcggtagcattgctggtgttgtcacgggtgtgttgatcttcaccgttatcaactacggtatgacctacatcggcgtcagcccatactggcaatacattattaaaggctccatcatcgtcttcgcggtcgcactcgattcgatgaaatacgccaacaaaaaataa

SEQ ID NO: 40550 - protein, 335 aa, Vibrio vulnificus YJ016
MDAVKSFALKHLKESAIYAVLLILLAVIVIQEPSFLSLRNLSNILTQSSVRVIIALGVAGLIVTQGTDLSAGRQVGLAAVISATLLQSIDNVNKVFPGIGEVPIVAVIICVCLIGAIIGLVNGVIVAYLKVTPFIATLGTMIIVYGINSLYYDAVGASPIAGFDERFTTFTQGFINLGGFRFSYITFYAIIAIVFMWVLWNKTVFGKNIFAVGGNPEAAKVSGVNVPLTLLKVYALSGVLYAFGGMLEAGRIGSATNNLGFLYELDAIAACVVGGVSFAGGVGSIAGVVTGVLIFTVINYGMTYIGVSPYWQYIIKGSIIVFAVALDSMKYANKK

SEQ ID NO: 40551 - DNA, 987 bp, Vibrio vulnificus YJ016
  CDS (1)..(987): transl_table=11
atgagtagtgaaatcatgagcaaaagaaaatcaaatgagacaaacaaaacttggatcagtaaagagtggctcattgagcagaaatcgctcatcgcgttacttttcctcatcgtggtggtctcttttctcaatccaaactttttcaccgtagacaacattctcaacattcttcgtcaaacttcggtgaacgcgatcatcgctgtggggatgaccttggttattctgaccgcgggcatcgatttgagtgttgggtcggtgttggccttatgtggtgcgtttgctgccagccttgtcgcgatggaagtcccggtattaatcgcagtgccaaccgcgctgttagcgggagcttcgttgggcgctattagcggcgttattattgccaaaggcaaagttcaagcctttatcgccacgctggtgacgatgactctgctgcgtggcgttaccatggtttacaccgatggccgtcctatctctaccggattcactgatacggcagatgcattcgcttggttcggtacaggttatgcgctaggcattccggtaccggtttggttgatggtggtggtgtttgcagccgcttggtatctgcttaatcacacccgctttggtcgctatgtgtatgcactgggtgggaacgagtctgccactcgtctatccggtattaacgtcgacaaagtcaaaatcggtgtttacgcgatttgcggcctacttgctgctttggcaggcatcatcgtcacatcccgtctatcttcggctcaaccaacggcagggatgggctatgagctggatgcgattgccgccgtggtgcttggtggtaccagcttaatgggtggtaaagggcggattatgggcacgttgatcggtgcgttaatcatcggtttcctaaacaacgcgctgaacttactcgatgtttcttcttactaccagatgattgccaaagctgcggtgattttgctggcggtgatggtcgacaacaagaacaagtaa

SEQ ID NO: 40552 - protein, 328 aa, Vibrio vulnificus YJ016
MSSEIMSKRKSNETNKTWISKEWLIEQKSLIALLFLIVVVSFLNPNFFTVDNILNILRQTSVNAIIAVGMTLVILTAGIDLSVGSVLALCGAFAASLVAMEVPVLIAVPTALLAGASLGAISGVIIAKGKVQAFIATLVTMTLLRGVTMVYTDGRPISTGFTDTADAFAWFGTGYALGIPVPVWLMVVVFAAAWYLLNHTRFGRYVYALGGNESATRLSGINVDKVKIGVYAICGLLAALAGIIVTSRLSSAQPTAGMGYELDAIAAVVLGGTSLMGGKGRIMGTLIGALIIGFLNNALNLLDVSSYYQMIAKAAVILLAVMVDNKNK

SEQ ID NO: 40553 - DNA, 954 bp, Bacillus cereus ATCC 10987
  CDS (1)..(954): transl_table=11
atgaaacgcatgttaaaaatgcatgaaacgtctatcatactgttactactaatgtatatagctattataggaataataaaccctagttttattcaatttaactcgttatctttactgataaagtcaagcgttattttagtcgtgctagcaattggccaatcgttcgtcttatttacgaaaaatatagatgtatcagttggttcaagcatggggttaagtgcagcagtttgcggaatgttgttaacggatggatatcatgcatctttgtctatacttgctgctattttacttggcgctattctcggttttataaatggaattggtgttgcgaagtttcgggtaccggccattattatgacattaggtatgttaggggtcattagaggtgcgatgttaatctttacaggtggaaagtggattgaagatataccaaacgattttaagcaactgtcatcgatcatcacacttggtttgccgatcattgtatggattgttcttattattttactactactatacttctttttaaggaaagtgccatacggaaggtacttctatgcggttggtgataatgaagatggcgcgagacttattggtatacctgttaataaagtgaagatatatgcgtttataatttcaggcataagcgctgcgctcgctggttgcatatttgttatgaatatcggattcgttccaaatcaaacaggaactgggatagaactacaggttatcgcagctgctgtactaggaggagttcatttaaaaggaggaacgggttctatagttggagctgcattaggagcgatatttttagaggcgataagcagctcactcgtctttttaaaaataccagcattttggaataatgctatttcaggtttcttattattgctaatcgtcatattagatagcgttatgaaaaagtggaaggcagaaaggaggatgaatctatga

SEQ ID NO: 40554 - protein, 317 aa, Bacillus cereus ATCC 10987
MKRMLKMHETSIILLLLMYIAIIGIINPSFIQFNSLSLLIKSSVILVVLAIGQSFVLFTKNIDVSVGSSMGLSAAVCGMLLTDGYHASLSILAAILLGAILGFINGIGVAKFRVPAIIMTLGMLGVIRGAMLIFTGGKWIEDIPNDFKQLSSIITLGLPIIVWIVLIILLLLYFFLRKVPYGRYFYAVGDNEDGARLIGIPVNKVKIYAFIISGISAALAGCIFVMNIGFVPNQTGTGIELQVIAAAVLGGVHLKGGTGSIVGAALGAIFLEAISSSLVFLKIPAFWNNAISGFLLLLIVILDSVMKKWKAERRMNL

SEQ ID NO: 40555 - DNA, 1323 bp, Mycoplasma mobile 163K
  CDS (1)..(1323): transl_table=4
ttggaaaggaaaaaaatgaaacaaaatatgtttaataaatttaaacaaaatatttctgattctctaaatatttttacaaacaacattaaaaaaataaaaaaccatattttgaaaatatccttttttatttttattaacaaatatttaaaaataggattaaaacattttaacaagtattcaatgttttatatattagggctgatggtcttagtattttcgacagtttcaataggaaatggcttgactttttttagtccgaatcagtttgttaatttattaagaaataattcgtatatttttataattggtttaccaatgttgctagttattgtaagtggaaatatagatttaagtgttgggaggcttttaggattttctagtgcaattgctttaacactttttaataatgtaactggcggaaacatatttctaacaattattcttactttgttattaggagcaggggttggtattatccaaggtgttatgattggatactatagaattccagcattcattattactctgggggggatgctaatttttcaaggtcttgaattagttttaacaaatggtcaacctttaattgtcgattttgatacaagctttgtacaattttctcaagctccttttcctgattttaatttaggaactactcaaaatcctttttgaattatttcatttttaattttattagtaatcggatctttactagtagcttattcatttcaaagaagatttaaagcaaaaaaatataatttagaagttgaaaatctttttgtatttttgattaaacaattatttgttattggtttattctttgttctggctattttaacagcaatgtcaagaattggattacaattatttatgctttatattttaattttaattattttgtttgtaattttaactaaatatacaaaatttggtagatctatttatgctattggtgggaatagaaaagctgctgaattaagtggtattaatgctaaatttacaacatttgctatttttgtgatcatgggaattataacttcttttgctggtattatttttgcaggtaattttcaagcagctcaaccaaatggaactgcaggatttgaactaaatgtaatttcttcaatattcattggtggagctagtgttgctgggggaattggaacagttattggatccattatgggggcattaataatcgctacaattaatcttggtttagttgtaaatcaagttgaagctgcatttattaatattattacaggtattgttttagctgctgctgtaacttatgatattttctccaaacggaaaattggttaa

SEQ ID NO: 40556 - protein, 440 aa, Mycoplasma mobile 163K
MERKKMKQNMFNKFKQNISDSLNIFTNNIKKIKNHILKISFFIFINKYLKIGLKHFNKYSMFYILGLMVLVFSTVSIGNGLTFFSPNQFVNLLRNNSYIFIIGLPMLLVIVSGNIDLSVGRLLGFSSAIALTLFNNVTGGNIFLTIILTLLLGAGVGIIQGVMIGYYRIPAFIITLGGMLIFQGLELVLTNGQPLIVDFDTSFVQFSQAPFPDFNLGTTQNPFWIISFLILLVIGSLLVAYSFQRRFKAKKYNLEVENLFVFLIKQLFVIGLFFVLAILTAMSRIGLQLFMLYILILIILFVILTKYTKFGRSIYAIGGNRKAAELSGINAKFTTFAIFVIMGIITSFAGIIFAGNFQAAQPNGTAGFELNVISSIFIGGASVAGGIGTVIGSIMGALIIATINLGLVVNQVEAAFINIITGIVLAAAVTYDIFSKRKIG

SEQ ID NO: 40557 - DNA, 936 bp, Bacillus anthracis str. Sterne
  CDS (1)..(936): transl_table=11
atggctaagaaggggaatgtattacaacaacttgggtctttaattggactagcgctaattattgtagtaattacggctttaaatccagcgtttattgaaattccaaatttatttaatatactgcgtcaagtatcgattaatgcgcttattgcattcggaatgacctttgtaattttaacagggggtattgacttatcggtaggttctattttagcattatcaagtgcacttgttgctggaatgatggcaagtggcatggacccgttccttgcgatggcagttggattattagctggtcttgtaatgggaattgtaaacggtatcatcatagcgaagggaaaagtagctccgtttattgcgactttagcaacaatgactatttttcgcgggttgacgcttgtttatatggacggacgtccgatcactggtcttggtgatcatttaatgttccaaatgtttggccgcggttattttctcggtattccagtaccagctgttacaatgatgatcgctttcgcagtactgtacttcattttgaagaaaacgacatttggtcgccgtacatttgcaattggtggaaatgaagaagcagcagcattatcaggtattaatgttacgaaaattaaagtaatgatttacggtctttccggaattttggcagcgtttgcaggtattgtcttaacatcacgactagattctgcacagccgactgcaggtacttcttacgaattagatgcaattgcagcagttgtattaggtggaacaagtctttctgggggaagaggatggattgttggtacattcatcggtgtacttattatcggtgtactaaataacggtttaaatttattaggtgtatcttctttcttccaacaagttgtaaaaggacttgtaatcttactagctgtattaattgatcgtcgaaaagaagcgtaa

SEQ ID NO: 40558 - protein, 311 aa, Bacillus anthracis str. Sterne
MAKKGNVLQQLGSLIGLALIIVVITALNPAFIEIPNLFNILRQVSINALIAFGMTFVILTGGIDLSVGSILALSSALVAGMMASGMDPFLAMAVGLLAGLVMGIVNGIIIAKGKVAPFIATLATMTIFRGLTLVYMDGRPITGLGDHLMFQMFGRGYFLGIPVPAVTMMIAFAVLYFILKKTTFGRRTFAIGGNEEAAALSGINVTKIKVMIYGLSGILAAFAGIVLTSRLDSAQPTAGTSYELDAIAAVVLGGTSLSGGRGWIVGTFIGVLIIGVLNNGLNLLGVSSFFQQVVKGLVILLAVLIDRRKEA

SEQ ID NO: 40559 - DNA, 954 bp, Bacillus anthracis str. Sterne
  CDS (1)..(954): transl_table=11
atgaagcgcatgctaaaaatacacgaaatgtctatcataacgttactactaatttatatagctattgtcggaatgataaaccctagttttattcaatttaactcgttatctttaatggtgaaatcaagcgttattttagtcgtgctagcaatcggccaatcgttcgtcttatttacgaaaaatatagatgtatcagttggttcaagcatggggttaagtgcagcagtttgcggaatgttgctaacgaatgaatatagtgcatccttgtcgatatttgctgctattacacttggcgctattatcggtttcgtaaacgggatgggcgttgcgaagtttcgagtaccagccattattatgacattaggcatgttaggaattattagaggtgcgatgttgattttcacaggcgggaagtggattgaagatattccaaacgattttaagcagctgtcatctatcgtcattcttggtttacctataactgtatggttcgttcttattattttactactactatacttctttttaaggaaagtgccatttggaagatacttttatgcggtaggtgataatgaagatggcgcgagacttattggtatacctgttaataaagtgaagatatgtgcgtttataatttcaggcataagtgctgcactcgctggttgcatatttgttatgaatatcgggttcattccaaatcaaactggtacaggattagaattacaagtaatcgcagccgctgtactaggaggcattcatttaaaaggaggaacaggatctttatttggagctgcattaggagcattatttttagaaacaataagcagttcactcgtctttttaaaaataccagcattttggaataatgctatttcaggttttttattattacttatcatcatactggatagtgttatgaaaaagtggaaggcagaaaggaggatgaatctatga

SEQ ID NO: 40560 - protein, 317 aa, Bacillus anthracis str. Sterne
MKRMLKIHEMSIITLLLIYIAIVGMINPSFIQFNSLSLMVKSSVILVVLAIGQSFVLFTKNIDVSVGSSMGLSAAVCGMLLTNEYSASLSIFAAITLGAIIGFVNGMGVAKFRVPAIIMTLGMLGIIRGAMLIFTGGKWIEDIPNDFKQLSSIVILGLPITVWFVLIILLLLYFFLRKVPFGRYFYAVGDNEDGARLIGIPVNKVKICAFIISGISAALAGCIFVMNIGFIPNQTGTGLELQVIAAAVLGGIHLKGGTGSLFGAALGALFLETISSSLVFLKIPAFWNNAISGFLLLLIIILDSVMKKWKAERRMNL

SEQ ID NO: 40561 - DNA, 936 bp, Bacillus thuringiensis serovar konkukian str. 97-27
  CDS (1)..(936): transl_table=11
atggctaagaaggggaatgtattacaacaacttgggtctttaattggactagcgctaattattgtagtaattacggctttaaatccagcgtttattgaaattccaaatttatttaatatactgcgtcaagtatcgattaatgcgcttattgcattcggaatgacctttgtaattttaacagggggtattgacttatcggtaggttctattttagcattatcaagtgcacttgttgctggaatgatggcaagtggcatggacccgttccttgcgatggcagttggattattagctggtcttgtaatgggaattgtaaacggtatcatcatagcgaagggaaaagtagctccgtttattgcgactttagcaacaatgactatttttcgcgggttgacgcttgtttatatggacggacgtccgatcactggtcttggtgatcatttaatgttccaaatgtttggccgcggttattttctcggtattccagtaccagctgttacaatgatgatcgctttcgcagtactgtacttcattttgaagaaaacgacatttggtcgccgtacatttgcaattggtggaaatgaagaagcagcagcattatcaggtattaatgttacgagaattaaagtaatgatttacggtctttccggaattttggcagcgcttgcaggtgttgtcttaacatcacgactagattctgcacagccgactgcaggtacttcttacgaattagatgcaattgcagcagttgtattaggtggaacaagtctttctgggggaagaggatggattgttggtacattcatcggtgtacttattatcggtgtactaaataacggtttaaatttattaggtgtatcttctttcttccaacaagttgtaaaaggacttgtaatcttactagctgtattaattgatcgtcgaaaagaagcgtaa

SEQ ID NO: 40562 - protein, 311 aa, Bacillus thuringiensis serovar konkukian str. 97-27
MAKKGNVLQQLGSLIGLALIIVVITALNPAFIEIPNLFNILRQVSINALIAFGMTFVILTGGIDLSVGSILALSSALVAGMMASGMDPFLAMAVGLLAGLVMGIVNGIIIAKGKVAPFIATLATMTIFRGLTLVYMDGRPITGLGDHLMFQMFGRGYFLGIPVPAVTMMIAFAVLYFILKKTTFGRRTFAIGGNEEAAALSGINVTRIKVMIYGLSGILAALAGVVLTSRLDSAQPTAGTSYELDAIAAVVLGGTSLSGGRGWIVGTFIGVLIIGVLNNGLNLLGVSSFFQQVVKGLVILLAVLIDRRKEA

SEQ ID NO: 40563 - DNA, 990 bp, Bacillus thuringiensis serovar konkukian str. 97-27
  CDS (1)..(990): transl_table=11
ttgaatctcatttataaaactaagaaactatatttgcctactcatcttttttatcaatttagtacaattgctatcattataggtgttacaatttttttctctatcgtcaatgactcttttttaacatacaacaacattagtgatattttacgttctatttccatcgtaacgttactcgcaattggtgttacctttacattaattgtagatggatttgatttatcagttggctctaccgctagtttagcaacgattgccgctgcttcctgtctcattttatatcgacaagaactattagtcacactccttgttcctattctgtgtggactattagttggattattaaatgcactactcgttatccgaattaaactacctgatttactagctacattaagtatcatgtatatcgttaatggactacacttaacattttcaaaaggatcttctatttatgagggtatgtctgaggctaaaggacattttattccatcctttttatttatcggtcaaggttccgtgttaggaattccagtccctgtcattatcatgcttatcgtcgttttaattgcccatctatttttagaaaaaacaacgtacggtcgtttcttttatatgacaggtggaaatcgagaagctgctaggctagccggtatccctactgatcgttaccgtgtgtatgcttatatgattagcggtttactagcttctattggcggtattattctatgtagccgcgttggaacaggacaagtttcagctggtgcccccttattaatggatgcagtcgcagctgcctatatcggttatgcaatgttcggcgccaagaaaccaaatatagtcggaacatttctcggctcagtattaattggaattatattaaatggactcacaatgatgaacgtcccttattatgcacaagatatcattaaaggcagcattttaattacagctttagctttttcatttattaaaaagaaacgtaaataa

SEQ ID NO: 40564 - protein, 329 aa, Bacillus thuringiensis serovar konkukian str. 97-27
MNLIYKTKKLYLPTHLFYQFSTIAIIIGVTIFFSIVNDSFLTYNNISDILRSISIVTLLAIGVTFTLIVDGFDLSVGSTASLATIAAASCLILYRQELLVTLLVPILCGLLVGLLNALLVIRIKLPDLLATLSIMYIVNGLHLTFSKGSSIYEGMSEAKGHFIPSFLFIGQGSVLGIPVPVIIMLIVVLIAHLFLEKTTYGRFFYMTGGNREAARLAGIPTDRYRVYAYMISGLLASIGGIILCSRVGTGQVSAGAPLLMDAVAAAYIGYAMFGAKKPNIVGTFLGSVLIGIILNGLTMMNVPYYAQDIIKGSILITALAFSFIKKKRK

SEQ ID NO: 40565 - DNA, 954 bp, Bacillus thuringiensis serovar konkukian str. 97-27
  CDS (1)..(954): transl_table=11
atgaagcgcatgctaaaaatgcacgaaacgtctatcataacgttactactaatttatatagctattgtcggaatgataaaccctagttttattcaatttaactcgttatctttaatggtgaaatcaagcgttattttagttgtgctagcaatcggccaatcgttcgtcttatttacgaaaaatatagatgtatcagttggttcaagcatggggttaagtgcagcagtttgcggaatgttgctaacgaatgaatatagtgcatccttgtcgatatttgctgctattacacttggcgctattatcggttttgtaaacgggattggcgttgcgaaatttcgggtaccagccattattatgacattaggcatgttaggaattattagaggtgccatgttaattttcacaggcgggaagtggattgaagatattccaaacgattttaagcagctgtcatctatcgtcattcttggtttacctataactgtatggttcgttcttattattttactactactatacttctttttaaggaaagtgccatttggaagatacttttatgcagtaggtgataatgaagatggcgcgagacttattggtatacctgttaataaagtgaagatatgtgcgtttataatttcaggcataagtgctgcgctcgctggttgcatatttgttatgaatatcgggttcattccaaatcaaactggtacaggattagaattacaagtaatcgcagccgctgtactagggggcattcatttaaaaggaggaacaggatctttatttggagctgcattaggagcattatttttagaaacaataagcagttcactcgtctttctaaaaataccagcattttggaataatgctatttcaggttttttattattacttatcatcatactggatagtgttatgaaaaagtggaaggccgaaaggaggatgaatctatga

SEQ ID NO: 40566 - protein, 317 aa, Bacillus thuringiensis serovar konkukian str. 97-27
MKRMLKMHETSIITLLLIYIAIVGMINPSFIQFNSLSLMVKSSVILVVLAIGQSFVLFTKNIDVSVGSSMGLSAAVCGMLLTNEYSASLSIFAAITLGAIIGFVNGIGVAKFRVPAIIMTLGMLGIIRGAMLIFTGGKWIEDIPNDFKQLSSIVILGLPITVWFVLIILLLLYFFLRKVPFGRYFYAVGDNEDGARLIGIPVNKVKICAFIISGISAALAGCIFVMNIGFIPNQTGTGLELQVIAAAVLGGIHLKGGTGSLFGAALGALFLETISSSLVFLKIPAFWNNAISGFLLLLIIILDSVMKKWKAERRMNL

SEQ ID NO: 40567 - DNA, 969 bp, Erwinia carotovora subsp. atroseptica SCRI1043
  CDS (1)..(969): transl_table=11
atgagttctcaatctatcgcggcaaaacgctggtttagcaaagagtggttactggagcagaaatcgctgatcgcgctcctgatcctgattgcagttgtttccgccctgagccctaactttttcaccctgaataacctgttcaatattcttcagcagacgtcggtgaatgccattatggccgtcggcatgacgctggtgatactgacctcgggaattgatttgtcggtgggttcactgctggcgctgacgggggctgtagcggcatccatcgttgggcttgaagtgaatgcgctggtggctgtgtttggcgcactggcggtgggtgcgctgattggcgcgggcaccggtgtcatcgtttctaaaggtaaagtacaggcgtttatcgccacgctggtcatgatgctgctactgcgcggcgtgacgatggtctataccaacggtagcccggtgaatactggcttctccgacgttgcagatgcttttggttggttcggcattggtcgtccgctgggtattccgacgccaatctggattatggctatcgtattcgctgcggcctggtacatgctgcaccatacgcgcctgggtcgctatatctatgcgttgggcggtaacgaatccgcaacccgtttatccggcatcagcgttgataaaatcaagattattgtttattccctgtgtgggctgctgtctgccctggcgggaattattgaagtcgcacgtttgtcctctgcacagcctacggcgggtacagggtatgagctggatgctatcgcggctgtggtattgggcggcaccagtctggctgggggtaaagggcgtatcgttggcacgttgatcggcgcacttatccttggtttcctcaacaacggactgaatttattaggtgtttcttcttactaccaaatgatcgtcaaagcagtcgtcattttgctggcggttctggtagataacaaaagcagtaaataa

SEQ ID NO: 40568 - protein, 322 aa, Erwinia carotovora subsp. atroseptica SCRI1043
MSSQSIAAKRWFSKEWLLEQKSLIALLILIAVVSALSPNFFTLNNLFNILQQTSVNAIMAVGMTLVILTSGIDLSVGSLLALTGAVAASIVGLEVNALVAVFGALAVGALIGAGTGVIVSKGKVQAFIATLVMMLLLRGVTMVYTNGSPVNTGFSDVADAFGWFGIGRPLGIPTPIWIMAIVFAAAWYMLHHTRLGRYIYALGGNESATRLSGISVDKIKIIVYSLCGLLSALAGIIEVARLSSAQPTAGTGYELDAIAAVVLGGTSLAGGKGRIVGTLIGALILGFLNNGLNLLGVSSYYQMIVKAVVILLAVLVDNKSSK

SEQ ID NO: 40569 - DNA, 1182 bp, Erwinia carotovora subsp. atroseptica SCRI1043
  CDS (1)..(1182): transl_table=11
gtgctgaaaacatcgcagtctgaacaacaacatgtcgccggatctgtctcgatgctgcaacgactgaaaagcatcaatcttcaggtctatgtgatgattgccgccatcatcgcgatcatgctcttcttcacctatatgaccgacggggcgtacctcagcgcgcgtaatctttccaacctgctgaggcaaacggcaattactggcattctggccgtcggtatggtgtttgtcattatctccgccgagatcgatctgtcggtcggatcgatgatggggttattgggcggtgcggcggctatttttgatgtctggtttggctggcctttgccgctgaccattgttgtgacgctcgcgctgggattattgcttggcgcgtggaacggctggtgggttgcctaccggaaagtcccttcttttatcgtgacgctggcggggatgctggcttttcgcggcattttgatcggtattaccaatgggacaacggtttccccgaccagtgaggcgatgtcgcagattgggcaaagctatctgccttctggcatcggttttatgttcggtgctatcgggctgatggtgtttattggctggcagtggcgtcggcgtagtagccgtgctcggttagggttaccgataaatccacccgcaggggatgtcggccgccagacagtgacagcactagtcgtattgggcgcgatctatctgctgaatgactatcgtggcgtgccaacgccggttctggtgctgacgctgttgatgctgggcggtatttttctggcgacgcgaaccgcgtttggtcgtcgtatctatgccgtgggcgggaatatcgatgccgctcgcttatcgggagtgaatgtcgaacgcaccaaaatggcggtgttcgcgattaatggcctgatggtcgcggtcgctgggctgattctcagttcacgattgggggcagggtcgccatctgccgggaatattgccgagctggatgcgattgcggcctgcgtgattggcggaaccagtctggcgggcggtattggcagcgtggcgggcgcggttatgggggcatttatcatggcgtcgctggataacggaatgagcatgttggatgtgccgacgttctggcaatacgtcgtgaaaggcggaatcctgctcttggcggtgtggatggacaccgctaccaagcggcgcgtatga

SEQ ID NO: 40570 - protein, 393 aa, Erwinia carotovora subsp. atroseptica SCRI1043
MLKTSQSEQQHVAGSVSMLQRLKSINLQVYVMIAAIIAIMLFFTYMTDGAYLSARNLSNLLRQTAITGILAVGMVFVIISAEIDLSVGSMMGLLGGAAAIFDVWFGWPLPLTIVVTLALGLLLGAWNGWWVAYRKVPSFIVTLAGMLAFRGILIGITNGTTVSPTSEAMSQIGQSYLPSGIGFMFGAIGLMVFIGWQWRRRSSRARLGLPINPPAGDVGRQTVTALVVLGAIYLLNDYRGVPTPVLVLTLLMLGGIFLATRTAFGRRIYAVGGNIDAARLSGVNVERTKMAVFAINGLMVAVAGLILSSRLGAGSPSAGNIAELDAIAACVIGGTSLAGGIGSVAGAVMGAFIMASLDNGMSMLDVPTFWQYVVKGGILLLAVWMDTATKRRV

SEQ ID NO: 40571 - DNA, 1032 bp, Erwinia carotovora subsp. atroseptica SCRI1043
  CDS (1)..(1032): transl_table=11
atgtcccagcagccgctttctaagacgattacgccgcccaacacgcgtggacgttttgaccccattggcttttttgaacgctttggcgtgtttattttcatgattttgctgctgattttctttcagtcgcagaacagcaactttctgtccgaacgcaacatcaccaacatccttaccgaagtgtccatctacggcatcatggccgtagggatgacgttcgtcattttgaccgctgggatcgacctgtccgtcggctcgattctggcggtatgtgcaatcactgccgcgtcggtgattaaaggcgacaacttcaccaccgtcgatcccgatgcctggtacggcttgagctggctggtcgcgttgggcgtctgtctggcaatgggcacctttattggtttcttgcatggtttaggggtgaccaaactgcgtctgccaccgttcatcgtcacgctgggcgggatgaccatctggcgcggattaacgctggtgatgaacgatggtgcgccgattgcgggctttgaccccggctatcgctggtggggacggggagagatcctcggtatttcggtgccgatctggatcttcgcgctggtcgccttactgggctatctggcgctgcataaaacccgctggggacgctttgtgtacgccatcggtggcaacaccgaagcggcgcgattggctggtgtgaatgtgcagcgtgtactcgtcagcgtctacgtggtgattggctgcctggctggactggcgggctttattctcagcgctcgtctcggcagcgcagaagcggtcgcggggatcaccttcgaactgcgcgtcatcgcctcggtggtgatcggtggcacctcgctgatgggcggctatggccggatcagcggcacgattatcggctcgatcatcatgggaattctgattaacggactggtattgatgaacgtatcggcctattaccagcagattatcaccgggttaattatcgtgctggccgtggcgttcgacacctatgccaagagccgtcgcggcgctatctga

SEQ ID NO: 40572 - protein, 343 aa, Erwinia carotovora subsp. atroseptica SCRI1043
MSQQPLSKTITPPNTRGRFDPIGFFERFGVFIFMILLLIFFQSQNSNFLSERNITNILTEVSIYGIMAVGMTFVILTAGIDLSVGSILAVCAITAASVIKGDNFTTVDPDAWYGLSWLVALGVCLAMGTFIGFLHGLGVTKLRLPPFIVTLGGMTIWRGLTLVMNDGAPIAGFDPGYRWWGRGEILGISVPIWIFALVALLGYLALHKTRWGRFVYAIGGNTEAARLAGVNVQRVLVSVYVVIGCLAGLAGFILSARLGSAEAVAGITFELRVIASVVIGGTSLMGGYGRISGTIIGSIIMGILINGLVLMNVSAYYQQIITGLIIVLAVAFDTYAKSRRGAI

SEQ ID NO: 40573 - DNA, 1098 bp, Erwinia carotovora subsp. atroseptica SCRI1043
  CDS (1)..(1098): transl_table=11
atgaaaacgactcaccttccggcagcgtcgggcgcgctatcaccgggtaagtttgtacgctcacgagagagcatcctgctgttgatcctcaggctgcgcacgttcatcgcgctgttcctgattctggggttctttgctttcacggtgcccgggtttttggcgacaggtagcctgatcatcatggtgaagcacattgctatcaacgcgtttctggcattagggatcacgtttgtcatcattaccgccgggattgacctgtcaatcggagccacgctggggctgtgtggcatggtggcgggttacatgattacgcagggcattgtgctgcccatgttcggcatcgcgattttccccagcgtgtgggtcattgtgcctgtcgtattggtgattggtgcgctcattggtgccatcaacggctggattatcacgcggtataacgttgcgccctttatctgcacgctgggcacgatgtatatcgtgcgtggggcatcaatgctgatttccggtggggaaacgttcccaggcttaggtggtaacccgcagttgggtaataccggctttgagctgattggttccggcacgattttaggattgccgctcgctatctggctgatgttggtactggctctggtgattgcctatgtggcacgtcgcctgccgtttggccgccatgtctatgcgattggcgacaacgagcgtgccgctgagctttccggcgtcaaggttcgtcaggtcaaagtctgggtctacacaatttccggcttctgcgcggctatcgcgggcatcgtggtgtcctctcagttggtcgccagccatccggcgacgggcaccgcttttgaaatgaacgcgattgctgctgtggttctcggcggaacgtcattagcgggcggacgcgggactattctgggtacgctgattggcgcgtttgtcatcgggattcttgccgacgggctggtcatgatgggcgtgagtgaattctggcagatggtgattaaaggcatcgtcattattgtggctgtgattatcgaccagatgcaaaaccgtatgcagcacagggccgcaattgtgtcacagaaggccgcggcggaaggcgcttag

SEQ ID NO: 40574 - protein, 365 aa, Erwinia carotovora subsp. atroseptica SCRI1043
MKTTHLPAASGALSPGKFVRSRESILLLILRLRTFIALFLILGFFAFTVPGFLATGSLIIMVKHIAINAFLALGITFVIITAGIDLSIGATLGLCGMVAGYMITQGIVLPMFGIAIFPSVWVIVPVVLVIGALIGAINGWIITRYNVAPFICTLGTMYIVRGASMLISGGETFPGLGGNPQLGNTGFELIGSGTILGLPLAIWLMLVLALVIAYVARRLPFGRHVYAIGDNERAAELSGVKVRQVKVWVYTISGFCAAIAGIVVSSQLVASHPATGTAFEMNAIAAVVLGGTSLAGGRGTILGTLIGAFVIGILADGLVMMGVSEFWQMVIKGIVIIVAVIIDQMQNRMQHRAAIVSQKAAAEGA

SEQ ID NO: 40575 - DNA, 987 bp, Erwinia carotovora subsp. atroseptica SCRI1043
  CDS (1)..(987): transl_table=11
atgtcaacggttacgtctgcaacctcagaaaagaagaaaaacggtatgggattgtcccgcatttgggataactacggcatgctggtggtttttgccgtgctgtttcttggctgtgcgattttcgtcccaaatttcgcctcatttatcaatatgaaagggttgggactggcgatctccatgtccggtatggtggcctgcgggatgctgttctgtctggcttctggtgattttgatctatctgtggcttcgattatcgcctgttccggggtggcgacggcggtggtgattaatatcagtgaaagtctgtggatcggcgtcggtgctgggctgctgctgggcgtggcattcggtttacttaacggcttcgtgattgcccgtttgaagatcaacgcactgatcacgacgctggcgaccatgcagattgcacgcggtctggcgtacattatttctgatggtaaagcggtagggattgaagatgagcgtttcttcgcattgggttatgccaactggctgggcttgcctgcgccaatttggatcaccatcggctgtatgatcctgtttggcctgttgctgaacaagaccacgtttggccgcaatacgctggcgattgggggaaatgaggaagcggcgcgtttggccggggtgccggttgtacgtaccaagatcatcatttttgccttgtccggtctggtatccgccgcggcgggaatcattttggcttcgcgtatgaccagcggccagccgatgacgtccatcgggtatgagctgatcgtcatttctgcctgtgtgctgggtggcgtatcgctgaaaggcgggatcggcaaaatttcctacgtggtggctggcgtactgattttaggtacggtggaaaacgcgatgaacctgctaaatatttctcctttctctcagtatgtggtgcgcggtcttattttgctggcggcggttatcttcgaccgttacaaacagctggcgaagaaaacggtataa

SEQ ID NO: 40576 - protein, 328 aa, Erwinia carotovora subsp. atroseptica SCRI1043
MSTVTSATSEKKKNGMGLSRIWDNYGMLVVFAVLFLGCAIFVPNFASFINMKGLGLAISMSGMVACGMLFCLASGDFDLSVASIIACSGVATAVVINISESLWIGVGAGLLLGVAFGLLNGFVIARLKINALITTLATMQIARGLAYIISDGKAVGIEDERFFALGYANWLGLPAPIWITIGCMILFGLLLNKTTFGRNTLAIGGNEEAARLAGVPVVRTKIIIFALSGLVSAAAGIILASRMTSGQPMTSIGYELIVISACVLGGVSLKGGIGKISYVVAGVLILGTVENAMNLLNISPFSQYVVRGLILLAAVIFDRYKQLAKKTV

SEQ ID NO: 40577 - DNA, 996 bp, Erwinia carotovora subsp. atroseptica SCRI1043
  CDS (1)..(996): transl_table=11
gtgagtcacccactttcatctaacggggcgatccccttccgtcaccacgttttcgagtttctctataagtggggcatgctgatcacggtcgtcgcactgattgcactttttggactcgcgtcggaaaattttctcgacccgtataacatcatcaatattttgcgttctatcgccatcgtcacggtgattgcgattggcgtctccatttcactgtccgttggcgggtttgacctttccgtgggatcaacggcatcgttggccaacgctctggttatctccctctttgtctggcatgggttcggcaccactggcgcgattgttttgacgctcctgctgtgtacgctggtcgggctattcaacgcttttctcatcgttgtgctgaagattcccgatatgctggcgacgctcgccagtctgttcgtcattcagggcgtggcgatgacgtacagctatggcggttccatcacgcagaacatggtgttgcccagtggtgaaatggcagaaggtgtcattcctgagttctttgccacgctaggtcaggtgccggtgattgttgtcattatgctggcggtgacggtactggtgcagttgtatctgtcccttaccaagcacggtcgccggatgtatgccatcggcggcaacccagaagccgctcgactggcgggcattcgcacagcgcgttatcgggtacaggcgtatgtattctcttccttactcgcagcgctgggcggcatcctactcgcatcacgcatcggttcttcacaggtcaatgctgggggcggctatttaatggatgctgttgctgcggcatatatcggtttctcactggcgggatccggtaagccgaatgcgctgggtacactgctcggtgccgtcattcttggcgtcttgcagaatggtcttgtgatgctctccgtgccttattacgccatggatatcatcaaaggtctggttctcgcgctcgcgttggcaatgacgtatatccagaaacgctga

SEQ ID NO: 40578 - protein, 331 aa, Erwinia carotovora subsp. atroseptica SCRI1043
MSHPLSSNGAIPFRHHVFEFLYKWGMLITVVALIALFGLASENFLDPYNIINILRSIAIVTVIAIGVSISLSVGGFDLSVGSTASLANALVISLFVWHGFGTTGAIVLTLLLCTLVGLFNAFLIVVLKIPDMLATLASLFVIQGVAMTYSYGGSITQNMVLPSGEMAEGVIPEFFATLGQVPVIVVIMLAVTVLVQLYLSLTKHGRRMYAIGGNPEAARLAGIRTARYRVQAYVFSSLLAALGGILLASRIGSSQVNAGGGYLMDAVAAAYIGFSLAGSGKPNALGTLLGAVILGVLQNGLVMLSVPYYAMDIIKGLVLALALAMTYIQKR

SEQ ID NO: 40579 - DNA, 963 bp, Erwinia carotovora subsp. atroseptica SCRI1043
  CDS (1)..(963): transl_table=11
atgttgaaacgccacttccccctgttgatgacgattctggtatttattgctggttatctgttttgcctcagccaatttcccggttttgcttcgacgcgagttttctttgatttactgacggataacgcctttctggggatcgtggcggttgggatgacgtttgtcattctgtctggcgggatcgatctctccgttgggtcagttattgcatttactggtgtgctattggccaaattgatcggtacgtatggaattgatcctttctttgcgttcgcaattgcactggtaatgggagccatgtttggcgggttgatgggatggattatcgatacgctgaaattgcctgcatttattatcacgcttgccggtatgttctttgtccgagggatgagctttatcgtttcacaggagtcgattcccatcgatcatccggtctatagccaattggcgggtttagcatggcgcatgcctgatgggggacgatttacctttctggcgttagttatgttggttgtggtgctactggggattgtaatggcgcatcgtacccgcttcggtaaccgtgtttatgctataggcggtaacagctattctgcggagctgatgggagtgcctgttaggcgaacgacgattcatatatacatgctttccagtatgttagcggtgctgtcaggcattgttttttcgctctatacctcagcgggttatgctctggcagcaagcggtgtggagttggacgccatcgctgctgtcgtgatcggcggtacgctactgaccggtggtgtcggaacggtattgggaaccctgtttggcgtactgattcagggcctgattcaaacgtatatcacatttgacggcaccttgagctcatggtggacaaaaatcgtcatcggtttcctgctgtttgctttcattgggttacagaaagcgttaagcacattctggttagccagacgtgcttaa

SEQ ID NO: 40580 - protein, 320 aa, Erwinia carotovora subsp. atroseptica SCRI1043
MLKRHFPLLMTILVFIAGYLFCLSQFPGFASTRVFFDLLTDNAFLGIVAVGMTFVILSGGIDLSVGSVIAFTGVLLAKLIGTYGIDPFFAFAIALVMGAMFGGLMGWIIDTLKLPAFIITLAGMFFVRGMSFIVSQESIPIDHPVYSQLAGLAWRMPDGGRFTFLALVMLVVVLLGIVMAHRTRFGNRVYAIGGNSYSAELMGVPVRRTTIHIYMLSSMLAVLSGIVFSLYTSAGYALAASGVELDAIAAVVIGGTLLTGGVGTVLGTLFGVLIQGLIQTYITFDGTLSSWWTKIVIGFLLFAFIGLQKALSTFWLARRA

SEQ ID NO: 40581 - DNA, 978 bp, Propionibacterium acnes KPA171202
  CDS (1)..(978): transl_table=11
gtgactactacatcaaccgctactacgcaaagaccgtcagttggcaggaaagttggttcctggtcccttaatcacggtgctctcgtaggccttattattctctgtattgctctgtttattgcgactccagtattcctcactgtgccgaatatcattaatatcggaatccaagccgcggtggtggcgattatggccttcggtatgaccttcgtcatcgttacctccggcattgatttgtctgtgggttcggtcgcagctctttcagccatggtctcagcatggatgttctctaacgctggtctgccaagctggctcacccttatcatcggcctgctaatcggactgcttgctggagctgtttccggtctggccatcgcctatggcaagttgcctgcctttatcgccacgctggccatgatgagcgtcgcacgcggactaactcttgttatctctggcggcacccccgtcgccacctctgacgcagtgaaccagctgggtgctgatgttgggccaattccggtgcctgtcatcatgctcgccctagccggtgtggtgtgctggttcatgctgtcgcgtacggtgctggggcgttctctctatgccattggtggtaacgaagaggctgctcgtctctccggtattccggtgcgtcgcatcctcgtcactgtctacgctctggccggtgtttttgctggcctagctggtctggtgttggctggtcggctctcctcagcccagcctcaggcggggttcgggtatgagcttgatgccattgcagctgtcgttattggtggagcctcattgtcaggaggttctggaaaggcaagcggcacttttattggtgctgttttactagccgttattcgtaacggtcttaatattcttaacgtttcctcgttctggcagcaggttgttatcggctgcgttatcgcgctggctgtcggattcgatgtcttcaggtctaagaaagaatcctga

SEQ ID NO: 40582 - protein, 325 aa, Propionibacterium acnes KPA171202
MTTTSTATTQRPSVGRKVGSWSLNHGALVGLIILCIALFIATPVFLTVPNIINIGIQAAVVAIMAFGMTFVIVTSGIDLSVGSVAALSAMVSAWMFSNAGLPSWLTLIIGLLIGLLAGAVSGLAIAYGKLPAFIATLAMMSVARGLTLVISGGTPVATSDAVNQLGADVGPIPVPVIMLALAGVVCWFMLSRTVLGRSLYAIGGNEEAARLSGIPVRRILVTVYALAGVFAGLAGLVLAGRLSSAQPQAGFGYELDAIAAVVIGGASLSGGSGKASGTFIGAVLLAVIRNGLNILNVSSFWQQVVIGCVIALAVGFDVFRSKKES

SEQ ID NO: 40583 - DNA, 1350 bp, Leifsonia xyli subsp. xyli str. CTCB07
  CDS (1)..(1350): transl_table=11
atgagcacacagatccccgcgaagaagaagtcgggcggtatccgcgacctgggcaagatgttcggcggcgggcagtcgactggacggcagttcggcatcctgggcgcgctcgtcgtcatcgtcgtcctgttccagatcctgacggacgggaagacgctcgacccggtcaacctcatcaacctggtcaaccagaacgcgtacgtgctgatcctggcgatcggcatggtcatggtgatcatcgccgggcacatcgacctgtcggtgggctcggtcgcggcggcggtcggcatcgtcgtggccaaggcgatgaccgagtggcacgtaccgtggcctctcgccgtcctgctcggtctcgtcatcggcgtggccatcggcgcgtggcagggctggtgggtggcttacatcggcgtgcccgcgttcatcgtgacgctggccggcatgctgatcttccgcggcctgaaccagctgatcggcagcgcgaacaccatcccggtgccggacggcttcaccttcatcggcggcggtttcctccccgagtggggaccggacaccggctacaacaactccacactgctgctcggcctgatcatcgccatcgtcatcgtgctgcttgagatgcgcacccgccgtacgcagaccaaaatgggctccgacaaggctccgctctgggtgagcacgttcaaggtcatagtgctggacgccctggtcgtctacttcaccttcctcttcgcgggaggtcgcgtcggcacctcgttcccggtctccggcatcatcctgggcgtcctgatcatcgtctactcgttcgtcacgcgcagcacgatcttcggccggcacatctacgcggtcggtggcaactcgcacgctgcggaactgtcgggtgtgaagatcaagcgcgtcaacttcttcgtgatgatgaacatgtcggtgctcgccgcgctcgccggaatgatcgccgtcgcccgctcggtctcctccggcccgcaggacggcctcggctgggagctcgacgcgatcgccgctgtgttcatcggtggtgccgcggtctccggcggcatcggcaccgtcgccggttctatcgtcggtggtctcgtgatcgccgtcctgaacaacggccttcagctgcttggcgtcacgagcgactgggtgcaggtcatcaagggcctcgtgctgctgatcgcggtcggtgtcgacgtctactcgaaccgccgtggcggtccatcgctcatcggccggctcttcggcggcggtcgccgccctgagtctgcgacggacgctgtcggcatcgaccagcccgccgtcctcccgacctccagcgccgccgaagagtcgtcgcgctcgctcacgaactga

SEQ ID NO: 40584 - protein, 449 aa, Leifsonia xyli subsp. xyli str. CTCB07
MSTQIPAKKKSGGIRDLGKMFGGGQSTGRQFGILGALVVIVVLFQILTDGKTLDPVNLINLVNQNAYVLILAIGMVMVIIAGHIDLSVGSVAAAVGIVVAKAMTEWHVPWPLAVLLGLVIGVAIGAWQGWWVAYIGVPAFIVTLAGMLIFRGLNQLIGSANTIPVPDGFTFIGGGFLPEWGPDTGYNNSTLLLGLIIAIVIVLLEMRTRRTQTKMGSDKAPLWVSTFKVIVLDALVVYFTFLFAGGRVGTSFPVSGIILGVLIIVYSFVTRSTIFGRHIYAVGGNSHAAELSGVKIKRVNFFVMMNMSVLAALAGMIAVARSVSSGPQDGLGWELDAIAAVFIGGAAVSGGIGTVAGSIVGGLVIAVLNNGLQLLGVTSDWVQVIKGLVLLIAVGVDVYSNRRGGPSLIGRLFGGGRRPESATDAVGIDQPAVLPTSSAAEESSRSLTN

SEQ ID NO: 40585 - DNA, 1128 bp, Yersinia pseudotuberculosis IP 32953
  CDS (1)..(1128): transl_table=11
atgatgaaagcaacaactggcacggcgttggcgagtcacctgcccggtggagcgtcatggtcacgggaaaatatgctgctgcttctgttaaagatgcgcacctttattgccctgtttctgatcctgggtttcttttcaatcatggtccctgggttcttagccacggggagtttgatcatcatggtgaagcatattgcgattaatgccttcctcgcattaggcatcacctttgtcattatcaccgcaggtatcgatctctccatcggcgcgacgctggggctgtgcggcatgattgccggttggatgatcacccaaggcattgtcttgccgatgtttggcatcgctatcttccccagtgtttgggttgtggttccggtggtgttagttatcggggcactcattggtgcggttaatggctggatcattactcgctacaacgtcgccccgtttatttgcacccttggcaccatgtatgtggtgcgaggggcctcgatgttgatctctggtggcgaaaccttccccggcttacaaggcaatccgcaactggggaataccggttttgacctgctgggatcgggaacgctactggggttgccgatcgccatctggattatgttcattctggcgctggtgattgcttacgttgcccgccgccttccgtttggccgccatgtttatgccatcggggataacgaacgcgctgctgaactttctggtgtcaaagtgcgtcaggtgaaagtctgggtttacaccctatccggcttctgtgccgcgatagcggggattatcgtgtctgcccaattggttgccagccacccggccaatggcagtggcttcgaaatgaatgctatcgccgctgttgttctgggcgggacatcgctggcaggcgggcgggggaccattcttggtacgctgattggcgcttttgttatcggcatcttggctgatgggctggtgatgatgggcatcagtgaattctggcaaatggtgatcaaaggcatcgtgattatcgtggccgtgattatcgatcagatgcaaaaccggatgcagcacaaggcggcgattgtgtcgcaaaaagtgaccgccatcccctctgacatcacctctcaggcggtaaaaagtgagtag

SEQ ID NO: 40586 - protein, 375 aa, Yersinia pseudotuberculosis IP 32953
MMKATTGTALASHLPGGASWSRENMLLLLLKMRTFIALFLILGFFSIMVPGFLATGSLIIMVKHIAINAFLALGITFVIITAGIDLSIGATLGLCGMIAGWMITQGIVLPMFGIAIFPSVWVVVPVVLVIGALIGAVNGWIITRYNVAPFICTLGTMYVVRGASMLISGGETFPGLQGNPQLGNTGFDLLGSGTLLGLPIAIWIMFILALVIAYVARRLPFGRHVYAIGDNERAAELSGVKVRQVKVWVYTLSGFCAAIAGIIVSAQLVASHPANGSGFEMNAIAAVVLGGTSLAGGRGTILGTLIGAFVIGILADGLVMMGISEFWQMVIKGIVIIVAVIIDQMQNRMQHKAAIVSQKVTAIPSDITSQAVKSE

SEQ ID NO: 40587 - DNA, 1029 bp, Yersinia pseudotuberculosis IP 32953
  CDS (1)..(1029): transl_table=11
atgctacagccgctttccaagccccaggcatcggtaaaaagcgcgatgcgttttgacccgatcactttttttgaacgcttcggcgtcctgatttttatgttcctgctgctgattttcttccaattgcagaacagtaattttctctcagaacgcaatattttcaacatcctaactgaggtatccatctacggcatcatggccgtgggcatgaccttcgttatcctgaccgcgggtattgatctttccgtcggctcaattcttgcggtgtccgccatgacagccgcttatgtgattaaaggcgataactttaccaccattgaccccaacgcttggggcggcatgagttggctaattggcctcagtatttgtctggcaatgggcacccttattggttttttgcagggcttgggggtcacgcgtctgcgtctgccgccctttattgtcaccctgggtgggatgaccatctggcgtggcctgacgttggtgattaacgacggtgcccctatcgccgggtttgatgcaggctaccgctggtgggggcgcggggacttactcggtatttcaatacccatttggatttttgccattgtcgcgatagccggttatctggcgctgcacaaaacccgctgggggcgtttcgtctatgcgattggcggtaatcctgaagcggcacgtttggcgggagttaatgtgaaacgcgtgctggtcagcgtctacgtggtgatcggctgccttgccgggttggcgggtttcatcctaagcgcccggctgggcagtgctgaagcggtagccgggatctcgtttgaattgcgggtgattgcctcggtggtgattggcggcacttcactgatgggcggctacgggcgtatcggcggcaccattattggctccatcatcatggggatcttgattaacggtttggtgctgatgaatgtttcggcttactaccagcaaattatcaccggcctgatcatcgtattggcggtggcctttgatacctacgccaagaaccgtcgcggcgcgctgtaa

SEQ ID NO: 40588 - protein, 342 aa, Yersinia pseudotuberculosis IP 32953
MLQPLSKPQASVKSAMRFDPITFFERFGVLIFMFLLLIFFQLQNSNFLSERNIFNILTEVSIYGIMAVGMTFVILTAGIDLSVGSILAVSAMTAAYVIKGDNFTTIDPNAWGGMSWLIGLSICLAMGTLIGFLQGLGVTRLRLPPFIVTLGGMTIWRGLTLVINDGAPIAGFDAGYRWWGRGDLLGISIPIWIFAIVAIAGYLALHKTRWGRFVYAIGGNPEAARLAGVNVKRVLVSVYVVIGCLAGLAGFILSARLGSAEAVAGISFELRVIASVVIGGTSLMGGYGRIGGTIIGSIIMGILINGLVLMNVSAYYQQIITGLIIVLAVAFDTYAKNRRGAL

SEQ ID NO: 40589 - DNA, 999 bp, Yersinia pseudotuberculosis IP 32953
  CDS (1)..(999): transl_table=11
atggataaggcaaccgagacccgccgcgggggagcacctaccgcgagcaaactcaacggccaggccatgctgggctgggttttacaccatattgtctggatctggctgattgcactggttgtcatctttggtgtcttcaatgaatttttcctgacgatatccaatctgcaaaacgtgatggtgcaggccacggttttgggaaccttagggctggcggtggcactgccgctgctggtggctgagattgacttgtcgattccggcaaatgcgggtttctcggcggcggtgggggcgatggcttatgccgaactggggctgccgtggcctattgcagcattaataggtttactggttggcacatttatcggtttcttcaatggggtgtgcatcacccgattgaaaatggtctcgctgatagagacgttggcgatgatgattattatccagggcgcgctgttggcgctgacacagggcaagaccctgacaaacctttctgaaggttatatttggattggccaggcgaccatcggggggtggcccctgatgccggtggtgtttcttctggtgctggcggtgatgggggcggtgctgaagtatacggtgttaggccgttcgatctatgccgtcggtggtaatcctgttgcgtcaaactccgccgggattcgggtcgcgcgggtcaaaattattgcttacacgatttcagggttccttgccgcacttgctggctttttgttggcatcgtggcagatggccatcacctcaaaccaaggctcgagctacttgctctacgccattgccgcgcccattatcggcggcgtcagtgtttttggtgggcacggtaacgtcaagggggtgctgggcggtgtgctgctgctgacggtgatccaagttggcctcgccattgtcaatgtcccttcgttctatgtcggcatgattggcggggtgatcatttttatcgctgtcgccattgatgctttccggatccgttacttcggatag

SEQ ID NO: 40590 - protein, 332 aa, Yersinia pseudotuberculosis IP 32953
MDKATETRRGGAPTASKLNGQAMLGWVLHHIVWIWLIALVVIFGVFNEFFLTISNLQNVMVQATVLGTLGLAVALPLLVAEIDLSIPANAGFSAAVGAMAYAELGLPWPIAALIGLLVGTFIGFFNGVCITRLKMVSLIETLAMMIIIQGALLALTQGKTLTNLSEGYIWIGQATIGGWPLMPVVFLLVLAVMGAVLKYTVLGRSIYAVGGNPVASNSAGIRVARVKIIAYTISGFLAALAGFLLASWQMAITSNQGSSYLLYAIAAPIIGGVSVFGGHGNVKGVLGGVLLLTVIQVGLAIVNVPSFYVGMIGGVIIFIAVAIDAFRIRYFG
